United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 2

SEQ ID NO: 2855 - DNA, 1536 bp, Triticum aestivum
  unsure (1)..(1536): unsure at all n locations
  Clone ID: PAT_TA_2855
cgcggccgctctaaccctagccgccggcgcgcggccccacgcaacccccccccccccaccgaggcgcgagccggcggaggcgggaagagaaggtggggtggcggcggccgcgcgggcggcggcgggggccgccgccaagggggaagaagaaggggttcggtccccttcgtgctcgactgcaccaagccccatgaaggacaggacgacgaggatcacgtcgctggagaagtgcctcaagggcggctccaaggtcgccggcggcaaggccggccccctccggggcccccgccaccgtcacgcgcgacaagagcaacggccacggcgccccccgcggcgcggtctccaagaggtacgtaaagcacgtaactaacaagaactagaagaagcacaaggtgcggggctgtcttcgggtgatcgcatccaacaagggacgcaacgtgttcaagctgcagcacgtccaagtagcttgacaagtacggaggacggaggatggatgacgtagatcagtagttaatattggtagtgtgttgcttgtagtgttttgtactttgatgctggattttcccttttgattttttgatcctatactttattgttgttgtccatttgtacttttgttgtggccttcatttcgcaatgaattctttaaattaaagaagtatcatattgttatctacctgtactaaagattaatagatgtgtataaccgagactatgtatacgggagtttaccgaatctgcggctgcgaagaaaaggagctttctactcctaaaaactaataataaataatgcgaatgctaggaaaaaaggaaaagacttcccccagcctggtgtgcacgagtggaagcttcgatatcacagttctcttcagggacgacgcttccacaggttgaccgggaagacaacgccttgcgcggttacccccgttttgcattccccccttgcacgcggcgccccccatggtcccccccccccgcccccttgcacaaggggcagtcatgtcccccaattttaatctctctgtaatgaaacctgcgcgcgcacttctcctcgctcgccgcgcagtcggggacccaggggcgcgccatatcccgccccgttttccttgattatttcggggtacgtggggcgctcggcgataggctattccagttggtggcgaaagagagcagcgtggaagatggagtcaccttcgagggtttgatcgtctccaaagcaacatatgaaaggggaactaaagatgaagccgatgagttcatttttcaactgtgcgatgtgatgggagatagtatcttaacaaggtctgatctggcagctgtattggcgtccattcatgaaaccatatttgcagataataaggaagccagggaaggttcaaacaagagtacatttgaagcatttctcaactctgcggtattttcgaaagatgctgnaggggtctctgagaaatctatgtcattatcagactctagaaactggtgtattgtcatgccatcactgaagaaatncttggaagtttgttgatgccccctgac

SEQ ID NO: 2856 - DNA, 1265 bp, Triticum aestivum
  unsure (1)..(1265): unsure at all n locations
  Clone ID: PAT_TA_2856
agccggcttcaggtacctctacttcattatccagaaaacatgtcctccgagttgctactcttaaataaagagtatgcttggcatataggaggtggcttctctcaacatgatgtgcaagagtggaagcttctataccacagttctcttcatggacaaagcttcaacactttcttaggcaatgtaacgaatggagatgcacagactgttttggttattaaagatacagaaggttccatttatggtgcatatgcatcacaaccatgggaaaggcacagtgatttttatggtgacatgaagacattccttttcaagttatatcccgaagcgtccatatttcgccctactggagcaaacaaaagtttgcaatggtgtgctgtgaacttcacctctgagaacattccaaatggtatcggctttggagggaagccacatcactttggccttttcctctctgcgggcttcgatcaagggcactcatttacctccagcacattcaccaatcctcccctttccaacacgagcaggttcagaccagaagttattgaatgttgggggatacaagtgaagggatcgaatgacgagaagccggagcttgtaaaggggacggtccttgagagattcaaggaggatcggaacatgctgaagctgattggtatggcgagtgcgagtgactgagcactgaaaaaaaatcacaatagcagatatttggaggttgtgtacagcactctttttatgggaaataataaccttatttatatctggtcgctactcttgagttttagctcttggagcttttctgtttcacatccagagtgatacaaggttagctgcatggagttgttggtttatactgtatggatccaggacgtcattttctgcccagtccgagagcagggagtaactgtctgttcatttgtcaagatggatcttcgaaagctgggctgctgattaaaggatgtatgaaatgtgttcctaaaactaaatccagtgtagcatgtattggggtggataaagtatgagtggatacagtcaantnctcctaaaaaanggccantaaaccaanaaggggnggcccgtaccaattcgcctaatatgagcgtattacgcgcntcaatggcgtcngtttanaactcctgacgggaaaacctggcgttcccaattatcncctgcaacaatccccttcccaactgggtaaaacaaaaggcccacgatgccctccaaaattccaccnaaggnaatggaccncctgtacgggcatanccggg

SEQ ID NO: 2857 - DNA, 1424 bp, Triticum aestivum
  Clone ID: PAT_TA_2857
ctgcacactgccgccacgccactacactgccgccgggacagcttgcttccccgctgcctcgcgccgccgggatccgcctagggctcgccttccccgctcgccaggaaccccacctcccgccggccgccgcaccgttctccgccgtcagaggaaagcaagcgcaccagcgcgggtcgaggaaggggtaggtgagggggggagaggggggagatggccggcgctgggaggaaagtggccgtcgccgccgtgcagttcgcctgcaccgacacggtggccgacaacgtcgccgccgccgagaggttgattagagaagctcataagaaaggtgcgaacattgtcctcattcaggagctatttgaggggcactatttctgtcaagctcaaaggatggatttctttgggcgtgccaagccttataaagagaacccgactataatgagaatgcaaaaacttgcaaaggagttggatgttgtaatacctgtaagtttctttgaagaagcgggcaatgctcattacaattccgtggccattattgatgctgatggcaccgatcttggcctataccgcaaatcacacattccagatggaccaggttatcaagagaaattttatttcaacccgggtgacactggattcaaggctttcaaaaccaagtatgcaacaattggtgttggaatttgttgggaccagtggtttccagagaccgcaagggctatggtgctacagggggcggagatattgttctatcccactgctattggttctgaaccccaggatatgaacctggattcccgcgaacactggaagcgtgtcatgcaaggccatgccggtgctaacttggttcctcttgttgcttctaaccggataggaaaggaaactgtcgagactgagcatgggaacagcaccataaaattctacgggaactcattcatcgcagggccaactggagaaatcgtgaagcttgcaaatgacaaagacgaggaggtgctcgtggcagagtttgacttggacgagatcaaatctacgagacacggctgggggatattcagggacaggcgtcctgatctatacaaagtgctactgacgttggatggcaagacatcatcatcatcctaggttccacttttatgaagacgacatgaactccagaatactatgctgagaaaacacaggatccgtaagtctatcttcaccctgccaaagaattggtttgcctctttgcaacgtatccccgtgtttgcgactcggtgattttccaccaatagagcattaataaaatactgtcatgtaagagaatatttgctcctacatttatgaagatgagggatcaaagcaatataataatgatgcatcgcatttattaaaaaaaaaaaaagccaggcctccagcccccccccgcgtaccccctttgcactcgcgaattc

SEQ ID NO: 2858 - DNA, 772 bp, Triticum aestivum
  Clone ID: PAT_TA_2858
acactcaagatagctaatcttgcaaccggtgaattcctgcatcttgagaaacctgtaaagaatttgaggggtgatcacttcttgttctacaactttgggtttcacccattgacaaaagaatacaagattacacacttacttggtgattccatcgagggtcgccctcgcccccataataataacagattcagcgtcgttcaagtttacacgcttggtgatgagaaatggagggatatcaaaactccagaagccctaagcttaaactgtgtaaaaaactctggagcggtcactattgacggaacactgtattggctaattgaagacgtggtagctagctggcagcatgcagttatgaccttcgatctctgtggagaaagttttgcacagatacaactgcctgcaactaaacctgaagattttgccgctggtggttctcgtcggtattggatcagagagatggatggcaaggtatgtgtagcgactgctcaaacctgtccttctctgcccagatggcttgttggtaagctgcagatctgggaacttgagaacaaaacagagcaaaggtggatccagaagtacaatattcagtgctcgccagattacattccgggtccaaatttggttcatggggataagatcatactgcaacgttgcgatggcaacctatattcctatgagttgctcggggagaacttcaatactgaactgtgtaagatggcaaagctgttagatttcagtccccacaagcctgacaacatgcaatcctatatct

SEQ ID NO: 2859 - DNA, 916 bp, Triticum aestivum
  Clone ID: PAT_TA_2859
cggacgcgtggtagacagcggccagagaagaggaactgaaaagaaaaaacggggaagaaaaaggaggcaagcagtgcacaggtctagtggaaaatggcggaggcggcgtgctcgacctcgggcacgtagctcacgcgcagctcatcgttccccgtcgcgctctccagagaccccgcgccgccgccggtgaccaccagcttccccgtgcggcggctccgcgtctccacccgtctcgttctccagctagggtttcccccgatccccaatcactagtttgcgaatggcttcatcacagcatgttgaagtggaggctgcgaagctacttcaaaaactcattctggaatcaaaggatgagcccgctaaattagcaacaaaactttacgtgatatgtcaacatatgaagttaagtggaaaagagcagtctcttccctatcaggtcatatctagggccatggagactgttgtaagtcaacatggaattgatatggatgcattgcgatcatcacgagttccatttgccggcggtccacaagcagtagattctagtggccttatgtctaaagacaaggaggtcattggtggtcagtcttccatggttggaagtgatgcatcccagagcagcggtcaagctgcattatggcatttgccaccaggttcggcagatatggcaaggcctggggtgtatattccaggcagggcttcagcaggacaaaataggggtgatgtcacaggatctgatattcatcaaggctccatgtcgcaaaagagtggcaggtcctctggagtctaaagccctgcaggtctgcaaatgggggacactagatctatgaattcacatgattctttgaagtccgatgaaaaaacaagcatgaaagcttcctcttccaagagaaaaaggatggatttcaaagcagca

SEQ ID NO: 2860 - DNA, 478 bp, Triticum aestivum
  unsure (1)..(478): unsure at all n locations
  Clone ID: PAT_TA_2860
aaatantattatcgaggagggggtatatcgaccccccctcgtgttgaagttacccccctcgtgttgaagttattgggagggggtaatatcgacaacgacaacatacatacacgggaaaataatgttatcggggagggggtatatcgaccccccccccacgtgttgaagttatcaggagggggttatatcgacaacgacgacatatatacacgggaaaataatgttatcggggagggggtatatcgaccccccccctcgtgttgaagttatcccccctcgtgttgaagttatcgggaggggtatatatcgacgacgacagacccgataaaacataagaaaacgaagaagaaataaaaagaggagagaagaagaaaggaatagaggagaggattgaagaaaaaagaagaaaaaaaagaagaagaaaaaagaggagaagaagaaaggaatagaggagaagaagaaaaaatagaatattttc

SEQ ID NO: 2861 - DNA, 1158 bp, Triticum aestivum
  Clone ID: PAT_TA_2861
cttcttcggacccctgcaatcccatcttttccatccgcattcatctcctttgagcagctcctctcctctccattgtttctctgctcgaagatgaagctctccatgcagtcgctggcccggaagctctccatcccgtcgcccaagcggggcaagaagcagcagcagcagcaggacggcggcaagcgcggcatctcccggagcgaggcgccgtcgttcgcgtcggcgtcctcctcctccaccacctcgtcctcctccgaggacgcgctgccgcgggcgtcgacgccgcggtcggtgctgcccgcggagatctcgcggcgggagctggaggccgtgctccggcggctgggccacgaggagccctccgacgacgagctcgacgccgtggcggccatcgccgccgccggggaggccggccccgaggacgagctgatggaggcgttcaacgtgttcgacgccgacggcgacggccgcatcaccgccgaggagctccgcggcgtgctgctcgccatcctcggcggcgaggcggacgggtgcagcctcgacgactgccgccgcatgatcggcggcgtcgacgccgacggcgacggcttcgtcggcttccaggacttcgcgcgcatgatgatggtgtccaccacggcggcggcggccaccacctcggccggcccgagattcctctgaactagcccgtcgatggatccgctacgccaggctcctcctcctcctgttcccgctctgttctgctcgcccccgccgattagattagattagattagatgcgcgagcgatattatcctaggaaaggaaacccggcacccaacagctgtcaacagagctccagatactataacggtggctgatttattctcgcttatttttagacaggttcccgtttatgtttggattccaccgtcatcactggctattgccgggggaagcacgatcgcgatcgcccccagttaatggagttgcacaaatggggagggcggtgcacgcgatggtacgctgccagggccttcacttgccaatgcgtcactctcatggaaattccgacaattcttgtccagtgtaattgcagatgaattatgtaagccaagaacccaaaaaaaaaaaaaaaactgtcgagttcgagttatggtaatgaactaatgatattgattc

SEQ ID NO: 2862 - DNA, 1957 bp, Triticum aestivum
  unsure (1)..(1957): unsure at all n locations
  Clone ID: PAT_TA_2862
ggaggagtcagagcgtgatgcatttgaggggtgtagcggtggagtggagatgaactggggtattggggatgagaaggggggcgaggggacgacccattggttacagcaatgtggacttccaggggtggagtttgagaatttgaataaagggaatgttgggatgagggatggtgtgagctttgatgatggattcaaaatgggctccttgcatgggatggagtcaaacctcctccaggctatgaactcagatcctgcggcatataatggcacggagaatgcacatgacctgtcctctggaaatttcttggctatgggggctgatgcacataagaatggagtggacctgggggctggcaattcatttttctttggcaataataatgggaagaggcacgttgaggatattgatgatgggtacaatgaccagatgcaaacacaacagcagtttctgcagggcaatcaacataagcggatgcggaactccagcagtagtgtaccacctggatcagcattcttcaatgcaaattattcagaacccatacagaacttattggtcaatgccagcatgttatacgaacagaaagagagagagattcaagaggcgctgtcacagaagcaatttatggctaacttgctgcaggagaaggaagcaattatccactcactaaactcagccaggtttgagcaagagaataagttgcaatcaaagcttaggtgctttgagcatgatctgaatgtgatgggtcagttggtcagtgggtataagagggctttgaaacagagtcatgcttctttcaatgagtacaggaagaagttcccttctaacgagttccgttatcgtgatgttcctaatggcggcggtcttgtccttagcgtcagggagttggagagggagttggagaggaaacggtgtgaggaagagcagcagaaaattgctgcagcaaatgagatgattggaaatttcaagcttgaatggttgtcaaagcctgatgattgggaagatcgcatcaaccttttgtggcgcaaaactgaagggctggctcgggagcttgatcttctcaaggaaaaaagaaaagcaaagcttgcagcccttgctagggaagaatgagttctctgatagttagaggttctaatgtgaagatggagagctctcttggatgtttgacgtcaacagcgagacatgggattggcggcaactgtggctagctcgtcgtgcattgtagactgtagcgaagaaggcataattccagctgtaaatcgaatgttttgtcatccaagggcgttctagtgaccagtactagtgcttgctttatttagatggccttttggttgacttcctgcatggagtaaaatactgggtggtgccaggttaatcttatatgtgtagaacagttcacaaagtgtcttatatttgcaaccaactttggatgcaaactggtagggctataccttattttgcatattctcaaggaaaagagaaaatgcaacagcttcgcagcccttggctagggaagaatgatttctctgatagttaagagggtctaatgtgaagaatgggagaggtctccttggatgtgtgcattggatgtttgnacgtcaacagcgagacatggcattggcaactgtggctagctcgtcgtgcattgtagactgtagcgaagaaggcataattccagctgtaaatcaaatgttttgtcatccaagggtgttctagtgaccattactagtgcttgctttatttagatgccctttggttgagttcctgcatggagtaaaatactgggtggtgccaggttaatcttatatgtgtagaacagttcacatagtctcttacttttgcatccaactttgcgtgcttggtagttgatttataccttattttgcttgaatattggaagctaacggagtgtaattaggcattctcttggttctaaaaaaaaaaaaaaaaaaaaaaaaa

SEQ ID NO: 2863 - DNA, 466 bp, Triticum aestivum
  Clone ID: PAT_TA_2863
gctctaacctgttctccgacctcttcccgcacctagcaaatggtaagccaagaaagccaactgacggcattgcacatgagctgacaaagaaatgctgctgctgctattcaacgagatcgattctacctaaagcgccaatcaatgcagctgcacatgtccaccacgttgatccccatggccccaatgcaaccccgcacatggctgtcgtggccgctgatcgcgactgtcatcaccatcagtctgcctctgtggcttaagttgcgacctgacagggccttaagtgccgccagcgagggatgaatctgtctacgtgtccttcgtgacacggtgaactgaagaatgcaaccgtgaagggaggcccttacaggcatcacagccatgcagcgtgcacatacccagagggtaccgcctataaatttcaccctaatgcatccgtatgtcgtcttgcggcatcgtctactgcgct

SEQ ID NO: 2864 - DNA, 609 bp, Triticum aestivum
  unsure (1)..(609): unsure at all n locations
  Clone ID: PAT_TA_2864
cagtctgctccctcaggcgacggatcgtgctcctgacagtgaccgcacttgcagtgttcatggtataggcaccaccggccttaaccttcccgcagtccttgcatccccagattccgactgctttcctcttcacggcaaacttgccgcagaactcacagaagtacttctcagagtgcattacatctgaggatctggatgacatgaatattgagatcatgaggaacacactctacaaagcgtatcttgaggatttttacaaattttgcgtgaaactaggtggtgcgacggctgagattatgtgtaatctcctttcatttgaagctgacagaagagctgtaaacattacaataaacagtattggtacctgcccgtcgagcggccgcccgggcaggtcagacggcanntaagggaggaggaggagagcggcggcgaagntggtgtcgctgaagctgcagaagcgcctggcctcgagcgtcctcaagtgtggcaagggcaaggtctggctcgaccccaatgaggtcaacgagatctccatggccaactcccggcagaacatccggaagctggtaaaggatggtttcatcatcnnnnngcctcnnnnnntncact

SEQ ID NO: 2865 - DNA, 903 bp, Triticum aestivum
  Clone ID: PAT_TA_2865
gtttatgacacaacaaaatagaactgcaaacgcagctgtgtctcgatcagttacagtacagttactagaaaatcagagtttcaaatgctgtgatctctttcactcatcatcaacttcagactcttccttgtcagtcccctttctctctgtctccatggcgtcgtcgacctcggaatcttcctcatcagtccccttgtcctcggtttccatagcatcatcatcttcagaatcttcctcatcagaatccacgtcctcgtagataagcggagggcctccctcttcttcatcggattcatcatcgcagatctcgctgaaatgataatccaggcaggtagacagtttgagcgacgatgcgaaggtcgatgttcttgcgtcaatcagctgataaagcgagttgagcagcagcagagaagaatcctgagatactatgctgctcatgtgtcggctaagcagagcttgaagccatgggagcaagcaaaccagtactgaacccctagattgcataagcgataccaatgatttgaggagcttcacagcgtctgctggcgtcaggagtgataccgacttcacgataaccttgccgtctctgttgtacaggcagcccagcagcgcggcgcggtcgtcggcctgcagggcctgcctgagcaggacgtggacggagtccgcgctggggggcaccacgggcagcgactccccggcggcgccacctgccgcctcggcgagcgggctcatggccgcgagcttctccgccaaggtcggctcgtcgaggctgtactccgccgcgtccggagcgccatcggagggggcgacctcggcgcgtctccggcggcggcgctgcggcgtctggtccatcgagcagtttggagaggcggcggcggagcgaggagaggaggcggcggcggg

SEQ ID NO: 2866 - DNA, 604 bp, Triticum aestivum
  Clone ID: PAT_TA_2866
gctagagcacaagcatcaaatccaagtaggtagtagttaacgcaaatccaccatgaagaccttactcatcctgacaatccttgcgatggcaataaccatcgccaccgccaatatgcaggccgaccctagcggccaagtacaatggccgcaacaacaaccattcctgcagcctcaccaaccattctcccagcaaccacaacaaatatttccccaaccccaacaaacattcccccatcaaccacaacaaccttttccccagccccaacaaccgcaacaatcattcccccaacaacaaccatcgttgattcaacaatctctacaacaacagttgaacccatgcaagaatttcctcttgcagcaatgcaaacctgtgtccttggtgtcatccctctgttcaatcatcttgccaccaagcgattgccaggtgatgcggcaacaatgttgtcaacaactagcacaaattcctcagcaactccagtgtgcagccatccatagcgtcgtgcattccatcatcatgcagcaagaacaacaagaacaactacagggtgtgcaaatcctggtgccactgtctcaacagcaacaggtgggtcaaggtattctcgtc

SEQ ID NO: 2867 - DNA, 729 bp, Triticum aestivum
  Clone ID: PAT_TA_2867
tcggcacgaggcttataagtagagtgcatcattaaagccaagcaagcagtggtcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcaactgcaaccatttccgcagccgcaaccatttccgccacaactaccatatccgcagccgcaatcatttccaccacaacaaccatatccacaacagcaaccacagtatctacaaccacaacaaccaatttcgcagcaacaagcacaacaacaacaacaacaacaacaacaataacaacaacaacaacaaatccttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgaggtgccaagccatccataatgttgctcatgctatttttatgcatcaacaacaacaacaacaacaagaacaacaacaacagt

SEQ ID NO: 2868 - DNA, 914 bp, Triticum aestivum
  Clone ID: PAT_TA_2868
aagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaatcatttccaccacaacaaccatatccacaacagcaaccacagtatctacaaccacaacaaccaatttcgcagcaacaagcacaacaacaacaacaacaacaacaacaacaacaacaacaacaacaaatccttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgaggtgccaagccatccatagcgtcgtgcattccatcatcgtgcagcagcaacaacaacaacaacaacaacaacaacaacaacaacaaggcatgcatatcctgctgccactatctcaacaacaacagttgggtcaaggtactctcgtccaaggccagggcatcatccaacctcaacaactagctcaattggaggcgatcaggtcattggtgttgcaaactcttccaaccatgtgcaacgtgtatgtcccacctgagtgctccatcatcagggcaccatttgccagcatagtcgcggggattggtggccaatgaaaaaagcaagatctatactaatagatagatggatcatcgttgcttagcagatgcaccaatcgatgtaacgatgacaaataaagtggcgtgcaccatcatgtgtgaccccgaccagtgctagttcaagcttgggaataaaagacaaacagagttcttgtttgccaaaaaaa

SEQ ID NO: 2869 - DNA, 607 bp, Triticum aestivum
  unsure (1)..(607): unsure at all n locations
  Clone ID: PAT_TA_2869
caacaaccttttcacaaccccaacaaccatttccctggcaaccacaacaaccatttccccagacccaacaatcgttccctctccaaccacaacagccattcccccagcaaccccaacaatcatttccccagccccaaccccagcaaccccaacaaccattccctcaacaaccacaacaaccattccccctacgaccgcaacaaccatttccccagcaaccccaacaatcacaacaatcatttccccagccccaaccccagcanccccaacaaccatccatccttcaaccacaacaaccattaccccaacaaccacaacaaccatttcaacagccccaacaacaattatcccagcaaccagaacaaacaatttcccagcaaccccaacaaccattcccccacaccaacctcaacaaccatatccacaacaacaaccatatgggagtagtcttacaagcatcggtggccaatgaaatgaacacctgtaatacaagacggatggatcatcgttgtttagtcaatgagcgttcaatgtaacgatgataaataaagtgatgtgcaccataatgtgtaaccccgacctatactagttcaaacatgggaataaa

SEQ ID NO: 2870 - DNA, 1060 bp, Triticum aestivum
  unsure (1)..(1060): unsure at all n locations
  Clone ID: PAT_TA_2870
ttcgaaattaaccctactaaagggaacaaaagctggagctccaccgcggtggcggccgctctagaactagtggatcccccgggctgcaggaattcggcacgagcacaacngccatatccccagcaaccacaacaaccattcccccagactcaacaaccccaacaactatttccccagtcccagcaaccacaacaacaattttctcagccccaacaacaattcccgcagccccaacaaccgcaacaatcattcccccaacaacaaccaccgttcattcagccatctctacaacaacaggtgaacccatgcaagaatttcctcttgcagcaatgcaaacctgtgtcactgggtgtcatccctctgggtcaatgatctggccacaaagcgatttccaaagtggatgcggcaacaatgctgccaacaactagcacagttcctcaagcagtcccagtgtgcaagcatccataccatcatacattccatcatcatgcagcaagaacaacaagaacaacaacaaggcatgcatatcctgctgccactatatcagcagcaacaggtgggtcaaggtactctcgtccagggccagggcatcatccaaccccaacaaccagctcaattggaggcgatcaggtcattggtgttgcaaactctttcaaccatgtgcaacgtgtatgtccacctgagtgcttcatcatcaangnaccatttttcaagcgtagtcgcccgcantggtgggcaatgaaaaatgcaggagccatactnataggtagaaggatcatcggtgcttaattgaattanccatcgtgtaacgatgattggaatnaactgggggtgcaccattatggggngaccccgancagngcaantttnaactttgggaataaaaggaccaaggaaaggttcaaagntttgggaaaaaaaaaaaannnnnnnnnnnnaaaaaaaaaaactttcnggggggggcccgggncccaatttgnccctttanggggggcgntttacnaattaanngggccggggntttnnaaacntnngnaactgggnaaaaaccctggggttc

SEQ ID NO: 2871 - DNA, 498 bp, Triticum aestivum
  Clone ID: PAT_TA_2871
attttcccagtcacgacaaccatttccccagcaaccccaacaaccattcccactgcaaccgcaacaaccatttccccagcaatcaagcacaaataattcctcagcaaccccaacaaccattccctctacaaccacaacaatcattccttcggcaatcacaacaaccgttcctccaacaaccacaacaaccatctccccaaccccaacaagtagtacaaataattccccagcaaccccaacaaccattccctctgctggcaaaccaacctcagcaaccttatccacaacagcaaccatcaggagtaatggtataggcatcgggggccaaggaaatgaagagctatagtactagcccggcggatcatcgttgtttagtcaattgagtgttcaatgtaacgatgataaataaagtgatgtgtaccatcatgtgtaaccccgacctatactaagttcaaacatgagaataaaagacaaagaaagttcttgtcacaagggcca

SEQ ID NO: 2872 - DNA, 542 bp, Triticum aestivum
  Clone ID: PAT_TA_2872
gccggccgggtctggaacacaccatcatatccatatccagcccaacaaatggcgcctctcaaggtgactgctgccgtctgtgtcgtgctggtcctgatgatccagctacaggtgccaacggtcgcgcaggacataccatgcgacgagtgcgagccgggatgcggccaggcttgcaatgcgcagcgcccctacttctgcaacagcttttgcaacatctttcccaccctgtgcaactactgcttcctcatccaatccgacttgtgcgtgcccgggtgcacaaacctctgcaggatcaactgcgtgtgatcgaccatgcaggaacacatcgacatgagtggactccagagtgtcgatgagcatgcctgcgatgccattgttatatttgctgctctatgtgcaataagtcaatgccggtcaggctgcatgcatgtattgcatgcgagtgccttgacttagcatttgatactgtgtttaatttgctactattcccttcactacagcatattacatattactaaaaaaaaaaaaaaaaaaggccccta

SEQ ID NO: 2873 - DNA, 865 bp, Triticum aestivum
  unsure (1)..(865): unsure at all n locations
  Clone ID: PAT_TA_2873
gccggccggtttgggtccctgctacccccgctttcctccccctcgcgccgccgccgccgccgccacctcctccgcagtcagcccaccgcgaagcgaggtcgaatcagccatggcggacgccaagaccaccacggcggtcaccctccgcacccgcaagttcatgaccaaccgcctgctcgcccgcaagcagttcgtgctcgaggtcatccaccccggccgcgccaacgtctccaaggcggagctcaaggagaggctcgccaaggtgtacgaggtcaaggaccccaactgcatcttcgtgttcaagttccgcacccacttcggaggcggcaagtcctccgggtttggtctcatctacgacaacctcgagtccgccaagaagttcgagcccaagtaccgcctcatcaagaacggtcttgctacaaaggtggagaagtcacgaaagcagatcaaggaaaggaaaaacaggaccaagaagatccgtggtgtgaagaagaccaaggccggagatgcgaagaagaagtaagggcctgtccttggtttaggacggtatccctgttgcaatgttgctgagtgcttaattataactagaaaagactttatcatttatgtcatctcctggtatgttaagaggcattttgtagtatcttatgctatgattttgaggaacttgttatacacctggttgtcgttgttcttggtttcggctgttgatcagtcaaaattcattgtgggttattttccccttgaatgtttccatgttgcgcaatggaatgatttcttacgagcgatttcaagttctgtttaggtgtcattggagcaactctagcggatctcttttttagnatttcaagttctgtttaggggg

SEQ ID NO: 2874 - DNA, 611 bp, Triticum aestivum
  Clone ID: PAT_TA_2874
aggaattcggcacgagggccgccgccgccgccgccacctcctccgcagtcagcccaccgcgaagcgaggtcgaatcagccatggcggacgccaagaccaccacggcgggtcaccctccgcacccgcaagttcatgaccaaccgcctgctcgcccgcaagcagttcgtgctcgaggtcatccaccccggccgcgccaacgtctccaaggcggagctcaaggagaggctcgccaaggtgtacgaggtcaaggagaagtcacgaaagcagatcaaggaaaggaaaaacaggaccaagaagatccgtggtgtgaagaagaccaaggccggagatgcgaagaagaagtaagggcctgtccttggtttaggacggtatccctgttgcaatgttgctgagtgcttaattataactagaaaagactttatcatttatgtcatctcctggtatgttaagaggcattttgtagtatcttatgctatgattttgaggaacttgttatacacctggttgtcgttgttcttggtttcggctgttgatcagtcaaaattcattgtgggttattttccccttgaatgtttccatgttgcgcaatggaatgatttcttacgagcgat

SEQ ID NO: 2875 - DNA, 658 bp, Triticum aestivum
  Clone ID: PAT_TA_2875
agatgaagaccttcctatctttgtcctccttgccatggcgatgaagatcgccactgccgctagggagttaaaccctagcaacaaagagttacaatcacctcaacaatcattttcccatcaacaacaaccatttccacagcagccatatccacaacaaccatatccatcacagcaaccatatccatcgcaacaaccatttcccacaccccaacaacaatttccccaacaatcacaacaatcatttccccagccccaaccccagcaaccccaacaaccatccatccttcaaccacaacaaccattaccccaacaaccacaacaaccatttcaacagccccaacaacaattatcccagcaaccagaacaaacaatttcccagcaaccccaacaaccattcccccagcaaccacaccaacctcaacaaccatatccacaacaacaaccatatgggagtagtcttacaagcatcggtggccaatgaaatgaacacctgtaatacaagacggatggatcatcgttgtttagtcaatgagcgttcaatgtaacgatgataaataaagtgatgtgcaccataatgtgtaaccccgacctatactagttcaaacatgggaataaaagacaaagaaagttcttgtcaaaaaaaaaaaaaaaaaaaaaa

SEQ ID NO: 2876 - DNA, 565 bp, Triticum aestivum
  Clone ID: PAT_TA_2876
gcacagatcttcaattgagaatagcgagagtgactctgacaggaagaggcacatgaagagtaggaaagataggaagaggcggagatacgcaccgccggaaggatgactcatcagaggatgatgaatctggaggggaagagaggaggcatcaccgccaccataagaggcgtcatcaccggagggatgcatctggtagtgacagtgatgggagcgaatccccacatgaaaggaagcgatccagtaaacagaagagccacaagaggtcagaaagccatggattgggtgaggatgagcgacattgtccgcagggggcaagtcgctctggagagaagagcagggagcataagaggggctaaagaggagcgctgaagcggtaaattgtactcatcggtgtttgcaacagtgcttgtcctttgttatttgtccttgtcaaatggttgttgcattttaagcatgattcttaatatgtgtaacatatttgcgtattactgtttgtcagtggctgaactatccatatatgcataaatggtgttgccttgaaatcagtaatttgtgcatatttaat

SEQ ID NO: 2877 - DNA, 911 bp, Triticum aestivum
  Clone ID: PAT_TA_2877
cgaccccacctcccagatctcatctgcgacgacctcctccctcccgatcccgctccgtctccccccaccgccaccgctgccgctgccgcctcccccaccgaggtcttgtcttcggcgatccagccggagcccgcggcggcgacgatgtacgggtgggagatgctgtcgttcaacatacacgatgggttcctggaggccatcgtgcggggcaaccgctcgggcctcctcaccgccgccgactacaacaacctctgccagtgcgagaccctcgacgacatcaagatgcacctcaccgccaccgagtacgggccctacctccagaacgaaccttcaaccttgcacacaacgacaattgtggagaagtgcactcttaaactagtcgatgagtacaagcacatgctgtgccaggccactgaaccactatctacgttcttgcagtatataacttatggccacatgattgacaatgttgtccttattgtaactgggacactgcatgagagagatgttaatgaactattggagaaatgccatccattgggaatgtttgacagcattgcatctcttgcagttgctcaaaatatgcgcgagctttacagattggttttggttgacacaccgttagccccatacttctcagaatgcattacatctgaggatttggatgacatgaatatcgagattatgaggaacactctttacaaagcataccttgaggacttttacaaattctgtgaaaaacttggtggtgcaactgctgagattatgtgcgatcttctgtcatttgaagcagacagaagagctgtgaacattactataaatagtattggtactgagttgacaagagatgaccgcaggaagctgtactccaactttggtttattgtatccatatggtcatgaagaactggc

SEQ ID NO: 2878 - DNA, 620 bp, Triticum aestivum
  Clone ID: PAT_TA_2878
gcaaattcctcaccaattcgcctgctgtgtctcgacggaactccccacagatccacacccggcgcatcccgtcccggtggtgcctccctccccgttattccgcgccaaccccccttctcggtgcgcggactaagcggagacaagttgcaggatgactgcaaagaccctcagaaacaagggggcaactgactgcacaggaggcccgactagggagcagagtgccatacatagaaagaccaaggttacaagtgggagtaatggccgaaaaccaaaaggctttggtaggtttaacgaaggcataaaaaggatgttgaaacttgaggcagctgagaaggcgctgtctgatgccgtggagaaagaatgtcttgctgaggagaaatattattgcggacttcatgatcgacctaaatcatacactacttttgatgagaaacaatttggcaatctagacgatcctgtcgctcgagattttccttgcagtgtcgtctcacttgctttatttgatggagatacaatgttatttgcatgctccggcatacctctaccacccgggagagctaaacttccccttacaagatatgtgacatcagaacgtttggttagagtatatcagggatata

SEQ ID NO: 2879 - DNA, 882 bp, Triticum aestivum
  Clone ID: PAT_TA_2879
cagcaaccacaacaaccatttccccagcaacaaccacaacaaccatttccccagcaaccacaacaaccattcccccagactgaacaaccacaacaaccatttccccagttccagcaaccacaacaaccttttccccagccccaacaacaattcccgcagccccaacaaccgcaacgatcattcccccagcaacaaagaccgtcctttcagccatctctacaacaacggttgaacccatgcaagaatatcctcttgcaacaatgcaaacctgcatcattggtgtcatccctttggtcgataatctggccacaaaatgattgccaagtgatgcagcaacaatgctgccaagaactagcacaaattccttagcagctccagtgtgcagccatccatagcgtcgtgcattccatcatcatgcagcaacaagaacaagaacaagaacaagaacaagaacaagaacaacaacaacaacaaggcatgcgtatattttttccactatcttgacaacaacaagtgggtcaaggtactctcttccaaggccagggcatcatccgacctcaacaaccagctcaattggaggcgatcaggtcattggtgttgcaaactcttccaaccatctgcaacgtgtatgtcccacctgagtgctccaacatcagggcaccatttgccagcatagtcgcggaattggtggccaatgaaaaaagcaagacctatactaatagatagatggatcaccgttgcttagcagatgcaccaatcgatgtaacgatgacaaataaagtggcatgtaccatcatgtgtgaccccgaccagtgctagttcaagcttgggaataaaagacaaacaaagttcttgtttgccagcattgattgtcattgttcc

SEQ ID NO: 2880 - DNA, 905 bp, Triticum aestivum
  Clone ID: PAT_TA_2880
ttagtgttgatctcggctggtgatttcactagtccgcgcaggtgcgaagcccggattcagcccgctgctcccctctcctctcccgtcgtcggagccccggcgacccctcttccaagtcgccatcgtcctcacctccagcgccacttcctcttctccaccactcgacccagcctagcagcgagtcggcggacgggaggatgatgggaagcaacaaccccggcggcgcagggggagggggagggggagggatggccccgggcacggggggcggcggcagcgacgggcggcacgacgacgaggccgtgctcaccgacttcctctcctccctcatggactacaatcccacgatcccggacgagctcgtggagcactacctcggccgaagcggcttccactgccccgacctacgcctaacaaggctggttgctgtagctgctcaaaagttcatttcagacattgcaagcgactctcttcagcactgcaaagccagggttgcagcacctatcaaagataacaagagcaaacaaccaaaggatagacgtcttgtgttgacaatggatgatctttcaaaagccttgcgtgagcatggtgttaatctgagacatccagagtattttgcggacagcccatcagcagggatggccccctcaacaagagaggagtagaatgggtcaattcttcaacaagagagggctagaattcgttgtttcttataagcgtaacaagtgaacggtcgtgtccttcccaactttatgttacaaaaccttataagcactagtaaacgcgcacgtgcaacgcacgtatcctaataaaccaaaataaaagtatgaacttttgtattgttttactggaacatttaatgcgtgtcacactcaatgatttcaatgtaataatttattttagat

SEQ ID NO: 2881 - DNA, 1057 bp, Triticum aestivum
  unsure (1)..(1057): unsure at all n locations
  Clone ID: PAT_TA_2881
ttgatggtatcgaacaattagggctgcgagtcggtgtcacagacccaagtggtgttcctgttcttgacggatcttgacttggtattggggtcatttctgtgcccacatctctcacagacaccgcctgaactgtagaaatagcttcagtatcattgcaggtcttaattgcaattgaattggtttcagcttgacccttctgatagtctgagttggcgctagaaccttgatctgcacagacatcagcatgcctgaccaacttcggctgatgtgaagcgaaagacagcctctctaatatgctccgagaggccgacgaagccggattgaatctcttcatgttctgaatggggcgagcaaatgcgccgtggtgtttgggcacaacgccaccgcccctgggcgcagcggaactcacctggtgtgcactctggttctgcgatgcacccttggtggtattctgctgaacagtctgcttgttcacaatccatttctcggcgtcgttccacttggaggaagcctgtcttgagaagtacccagccgttgggttctgcgccgccgtcttctcgcctccatggaactcaaagctgctggtactggcattgtcaagaccactgtcgcattcattgctgtcctcctcgacagttcgcactggatgtatcatgcttgagttgctcggcgccggttggtgaactgaacccttggacatgttctgaaccttgtagctatctactgctggatccttgtctacaacttcggtgttgctgactgctgaagggcatttagcggcaccggagctgtcttcgtcaagaacatcgcatactaataatctgttctgcgctagcgatggctcggcgttctttgaaggcgatgttcgcgacgagctgctgctgatgaccctcacacgattgtgggctcccaggagcttcatcctcagctttgtgggagaaagggcgcctgcctggggcttgtgaatcctctcatactccattgctcgctccgtgctggtctgctggccggacgcgcgcttnctgtgtgtgccccgccctntnctgcttgggcggcc

SEQ ID NO: 2882 - DNA, 765 bp, Triticum aestivum
  unsure (1)..(765): unsure at all n locations
  Clone ID: PAT_TA_2882
gattcggcccgctgctcccctctcgtctcccgtcgtcggacccccggcgacccctcttccaagccgccatcgtcctcacctccagcgcgacttcgtcttctccaccactcgacccagctcagcagcaaggcggcggacgggaggatgatgggaagcaacaaccccggcggcgcagggggaggggngagggatggccccgggcacgggggccggcggcagcgacgggcggcacgacgacgaggccgtgctcaccgagttcctctcctccctcatggactacaatcccacgatcccggacgagctcgtggagcactacctcggccgaagcgggcttccactgccccgacatacgcctaacaaggcttggttgctgtagctgctcaaaagttcatttcagacattgcaagcgactctcttcagcactgcaaagccagggttgcagcacctatcaaagataacaagagcaaacaaccgaaggatagacgccttgtattgaccatggatgatctttcaaaagcattgcgtgagcatggtgttaatctgaaacatccagagtattttgcggacagcccatcagcagggatgcccccctcaacaagagaggagtagaatcgatcgctccttcaacaagagagggctagaatccattgtttcttatatgcgtacccagtgaatgggcgtgtccttccaactttatgtaacaaagccttataagcatgtatgcaatggcagttgatgtattatggaccaaaaaaaaaaaaaaaa

SEQ ID NO: 2883 - DNA, 712 bp, Triticum aestivum
  Clone ID: PAT_TA_2883
ctcgtgccgaattcggcacgagccacggccaccggatccagccggccttctcctcgctcctcccctcctccctcgcaccgaaacgcgatcgaacatcatctacccgatggctcctctcctgtcgccaccgctgctcgccgacctggtggccaagtcccattcctcctccacggccgtccgctgttccggcagtgtccggcgatgggcagtcgcagggctggccggcgccgggaggagagaccgccaccggagacggaggacgtgggggaggaggggcttcagggtgtccgcggtggcgacggagccccgcagcccggaggggagcgccgccgaagattactacgccgttcttggcgttatgccggacgcaacaccgcaacagatcaagaaagcctactacaattgcatgaaggcgtgccatccagatctcagtgggaacgaccccgatgtgaccaacttctgcatgttcatcaacgaggtttacacggtacttaccgaccccatccagcgagccgtgtatgacgagatcaatggctttactgcaacagcaaccaaccccttcttggatgatgcacccagggatcatgtgtttgtcgatgagtttagctgcataggttgtaaaaactgtgctaatgtctgttccaaggttttcgagattgaggaggattatgggcgtgcaagagtttacaatcaatcaggcaatgaagagcta

SEQ ID NO: 2884 - DNA, 822 bp, Triticum aestivum
  Clone ID: PAT_TA_2884
ggcacgagcccggattgggcccgctgctcccctctcgtctcccgtcgtcggaccaccggcgacccctcttccaagccgccatcgtcctcacctccggcacttcctcttctccaccactcgacccagctcagcagcagggcggcggacgggaggatgatggggagcaacaaccccggcggcgctgggggagggggagggatggccccgggcacgggggccggcggcagcgacgggcggcacgacgacgaggccgtgctcaccgagttcctctcctccctcatggactacaatcccacgatcccggacgagctcgtggagcactacctcggccgaagcggcttccactgccccgacctacgcctaacaaggctggttgctgtagctgctcaaaagttcatttcagacattgcaagtgactctcttcagcactgcaaagccagggttgcagcacctgtcaaagataacaagagcaaacaaccaaaggatagacgtcttgtattgacaatggatgatctttcaaaagccttgcgtgagcatggtgttaatctgaaacatccagagtattttgcggacagcccatcagcagggatggccccctcaacaagagaggagtagaatcgattgcttcttcaacaagagagggctagaatcaattgtttcttataagcgtacccagtgaacggtcgtgtccttcccaactttatgtaacaaaaccttataagcatgtatcgaatgtcagttcttgatgtattatggacccgtagttgccttcatttgatgcttatgtatagtaatgctgggtaagttctccaattaccctaa

SEQ ID NO: 2885 - DNA, 583 bp, Triticum aestivum
  Clone ID: PAT_TA_2885
gtgagcaatagtaaacacaaatcaaacatgaagaccttcatcatatttgtcctccttgccatggcgatgaacatcgccagtgccagtaggctgctaagccctagaggcaaggaattgcatactccacaagaacaattcccccaacaacaacaattcccccaaccacaacaacaacaacaacaacaacaacaacaaggcatgcatatcctgctgccactatctcaacaacaacagttgggtcaaggtactctcgtccaaggccagggcatcatccaacctcagcaactagctcaattggaggcgatcaggtcattggtgttgcaaactcttccaaccatgtgcaacgtgtatgtcccacctgagtgctccatcatcagggcaccatttgccagcatcagggcatcatcagggcaccatttgccagcatagtcgcggggattggtggccaatgaaaaaagcaagatctatactaatagatagatggatcatcgttacttagcagatgcaccaatcgatgtaacgatgacaaataaagtggcgtgcaccatcatgtgtgaccccgaccagtgctagttcaagcttg

SEQ ID NO: 2886 - DNA, 1159 bp, Triticum aestivum
  unsure (1)..(1159): unsure at all n locations
  Clone ID: PAT_TA_2886
agcaaatccaagtacgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaaccatttccccagcaaccacaacaacaatttccccagccccaacaaccacaacaaccatttccccagcaaccacaacaacaatttccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacctacaacaacaacaacaacaacaacaacaacaacaaggcatgcatatcctgctgccactatctcaacaacaacagttgggtcaaggtactctcgtccaaggccagggcatcatccaacctcagcaactagctcaattggaggcgatcaggtcattggtgttgcaaactcttccaaccatgtgcaacgtgtatgtcccacctgagtgctccatcatcagggcaccatttgccagcatcagggcatcatcagggcaccatttgccagcatagtcgcggggattggtggccaatgaaaaaagcaagatctatactaatagatagatggatcatcgttacttagcagatgcaccaatcgatgtaacgatgacaaataaagtggcgtgcaccatcatgtggaccccgaccagtgcagttcaagctnggaataaagacaaacagag

SEQ ID NO: 2887 - DNA, 1146 bp, Triticum aestivum
  unsure (1)..(1146): unsure at all n locations
  Clone ID: PAT_TA_2887
caactagagcacaagcatcaaatccaagtaggtagtagttaacgcaaatccaccatgaagaccttactcatccaaacaatcctcgtgatggcaataaccatcgccaccgccaatatgcaggtcgaccctagcggccaagtacaatggccacaacaacaaccattcccgcagcctcaccaaccattctcccagcaaccgcaacaaacatttccccaaccccaacaaacattcccccatcaaccacagcaacaattttcccaagcctcagcaaccacaacaacaatttatccaagccccaacaaccattcccccaacaaccacaacaaacatatccccagcgaccacaacaaccattcccccagactcaacaaccccaacaaaccatttccccagtcccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcagcagcaacaacaacaacaacaacaacaaccaacancaacaacaccaaggcatgcatatcctgctgccactatctcaacaacaacagttgggtcaaggtacctctcgtccaaggccagggcatcatccaacctcagcaactagctcaattggaggcgatcaggtcattggtgttgcaaactcttccaaccatgtgcaacgtgtatgtcccacctgagtgctccatcatcagggcaccatttgccagcatagtcgcggggattggtggccaatgaaaaaagcaagatctatactaatagatagatggatcatcgttacttagcagatgcaccaatcgatgtaacgatgacaaataaagtggcgtgcaccatcatgtgtgaccccgaccagtgctagttcaagcttgggaataaaagacaaacagagttcttgtttgccagc

SEQ ID NO: 2888 - DNA, 888 bp, Triticum aestivum
  Clone ID: PAT_TA_2888
tcggcacgaggctagagcacaagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacgaactattccccaaccccatcaaacattccaccatcaaccacaacaaacatttccccaaccccaacaaacatacccccatcaaccacaacaacaatttccccagacccaacaaccacaacaacaaatcccccagcaaccacaacaattcccccagcaacaattcccccaacaacagcaatttccccaacaacaagaattcccccaacagcaattcccgcaacaacaattccaccaacaacaatttccccaacaacaattcccccaacagcaattcccccaacaacaacagttcccccaacaacaacaattaacgcaacaacaattcccccggccacaacaatcccctgaacaacaacaattcccccagcaaccaccacaacaattcccccaacaacaatttccaataccatacccaccccagcaatcacaagaaccttccccataccaacaatatccacaacaacaaccatctgggagcgacgttataagtatcagtggcctatgaaatgaagagatgtaatactagacgggtgaatcatcgttgttagtcaatggagcataatgtaacgatgataaataaagtgatgtgcaccatcatgtgtaaccccgacctgtactagtccaaacatgggaataaaagacaaataagttcttttctgaaaaaaaaaaaaaaaaaa

SEQ ID NO: 2889 - DNA, 492 bp, Triticum aestivum
  Clone ID: PAT_TA_2889
gcacacacacacacacacacagagccgaaacccactcttcgctcaaccgtctcggagcagaggctctcccttcaccttcgtcttcctccctctcggcagttcgacctttgcatggcagcagtggctagctccaaggggcgggtgatcgctgggagcctcgtggcgcgcgtcctcgccggcaaggccaacgcctccccgaggtatgctcacatgcctcctgtgagccgcccgtgaaaaacagactagtacatgttccaagtaaatcagttccaagtactaagtactaagtgctactgctactctagctgcaagatcttgttcttgttcccatgggagattcataagtgctaattctaattcttgtacttgttattgtgccctcccctgccgtttggcactgggttcccctcaacacaagcgcgttgttggataagtagcgtcatgctacgctaaaactttggaaaggattttccaaaccccaaaaaaaaaaaa

SEQ ID NO: 2890 - DNA, 1063 bp, Triticum aestivum
  Clone ID: PAT_TA_2890
ggcgatttttaccgccactgccgcttgggagttaaacccgggcaacaaagagttacaatcacctcaacaatcattttcctatcaacaacaaccatttccacagcagccatatccacaacaaccatattcatcacagcaaccatatccatcgcaacaaccatttcccacaccccaacaacaatttcccgagcaatcacaacaaccatttacccagccccaacaaccgacccccatacaaccacaacaaccattcccccagcaaccccaacaaccacaacaaccttttccacaaccccaacaaccatttccctggcaaccacaacaaccatttccccagacccaacaatcgttccctctccaaccacaacagccattcccccagcaaccccaacaaccatttccccagccccaactaccattcccccagcaatcagaacaaataattgcccagcaactccaacaaccattccccctgcaaccgcaacaaccattcccccagcaaccccaacaaccatttccccagccccaacaaccaatccccgtgcaaccacaacaatcattcccccaacaatcccaacaatcacaacaaccttttgcccagccccaacaattatttcctgaactccaacaaccaattccccagcaaccacaacaaccattccccctgcaaccgcaacaaccattcccccagcaaccgcaacaaccattcccccagcaaccgcaacaatcatttccccagcaaccacaacaaccattcccccagcaacctcaacaaccatatccacaacaacaaccatatgagactagtcttacaagcatcggtggccaatgaaatgaagacctgcaatacaagatggatggatcatcgttgtttagtcaatgagcgttcaatgtaacgatgataaataaagtgatgtgcaccataatgtgtaaccccgacctatactagttcaaacatgggaataaaagacaaagaaagttcttgtcacaaaaaaaaaaaaaaaaaaaaaaaaaaaaaaaaaaaaaaaaaaaaaaaaaaaaaaaaaaaaaaaaaaaaaaaaaa

SEQ ID NO: 2891 - DNA, 464 bp, Triticum aestivum
  Clone ID: PAT_TA_2891
gccggccgggtccggagacacagctcaaattaagcctcgagatggctaagtagtcacaactgaccacaagatggcgtcgctggccagggctgcccgtctcctggtggtcgcgttgctggtcgtcttctccgctgctatcacgggctgccacggagttcacagggagatcagcggtcgacccgggtcaatcccaagcacaccgcgtggtatcattccccgtccccacattccgattccatgtggccgcggactatttcgatgcccaccgccgccacgcggtgtcggtgcacctccccctcacccggacaatggagggcagccttgatgcatgcaagctagctaattcttccacgtacggccaaagtcaactatatatattcgcaataatatgcgctcgatcgggtacttgataataaaacttgagtatggccctgctctaaaaaaaaaaaaaaaaaaggccccta

SEQ ID NO: 2892 - DNA, 981 bp, Triticum aestivum
  unsure (1)..(981): unsure at all n locations
  Clone ID: PAT_TA_2892
caaagccccacggccaccggatccagccggccttctcctcgctcctcccctccctccctcgcaccgaagcgcgatcgagcatcctctacccgatggctcctctcctgtctccgccgctgctcgccgacctggtggccaaggcccattcctcctccacggccgtccgctgttccggcagtgtccggcgatgggaagtcgcggggctggccggcgccgggaggagggaccgccaccggagacggaggacgtgggggaggaggggcttcagggtgtccgcggaggcgacggatccccgcagcccggaggggagcgccgtcgaagattactacgccgctcttggcgtcatgccggacgcaacaccgcaccagatcaagaaagcgtactacaattgcatgaaggcgtgccatccagatctcagtggaaacgaccctgacgtgaccaacttctgcatgttcatcaacgaggtttacacggtaaaatcctgagaaatgaaaatcggatgcaaatgagcaatttgcgttgcaatctaatctgtgaagttaacacgagcaagggatgaacaggtactaaccgaccccatccagcgagccggtatgacgagatcaatggctttactgcaacagcaaccaaccccttcttggatgatgcacccagggatcatgtgtttgtcgatgagtttagctgcataagatgtaaaaactgtgctaatgtgtgttccaaggttttcgagattgaggaggattatgggcgtgtgttagctgatgtaatgttacaccgtagaatcatcgttcgtgacgataataatgatccgaccagaactcctctagtatcattgttctgttgtcattgtgtagtttactctgtatctgaactttgttttactcagcgaaaccgtactgctatgatgaatgtgtcgatgtaaatcgtggctgtcgtgcctgtctgactgatacattgttcatgtagtcgatgannnaaaaa

SEQ ID NO: 2893 - DNA, 618 bp, Triticum aestivum
  Clone ID: PAT_TA_2893
aggaagatggcgctggctatcctggcgaggcggagggcggcggaggccgtggcgcggcgggcgcacgcccccggggcggcggcgctgtccgcgtggagggcgtacgcggcggcggcggaggagagcgacgtcgtggtggtcggcggcgggccgggagggtacgtggcggccatcaaggcggcgcagctggggctcaagaccacctgcatcgagaagcggggcaccctcggcggcacctgcctcaacgtcggatgcatcccctccaaggctctgttgcactcttctcatatgtaccatgaagcaaagacttcttttgcacaccatggagtgaaaatctctaatctggaagtggatctcccagccatgatggcgcagaaagacaaggccgtggccgggttaacaaaaggaatcgaaggcctctttaagaagaacaaagtgacatatgtcaaaggctttgggaaacttacttccccttcagaagtttcggttgatttggtcgatggtggtaacactgttgtcaaaggaaaaaacataatcattgccactggatctgatgtaaaatcacttcctgggattacaattgacgagaagaagattgtctcatccactggcgccctg

SEQ ID NO: 2894 - DNA, 621 bp, Triticum aestivum
  Clone ID: PAT_TA_2894
cacacctagagcacaaatcagcaaatccaagtacgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaagcattcccccaacaaccacaacaaccattccctcagactcaacaaccccaacaaccattcccccagcaaccacaccaacctcaacaaccatatccacaacaacaaccatatgggagtagtcttacaagcatcggtggccaatgaaatgaacacctgtaatacaagacggatggatcatcgttgtttagtcaatgagcgttcaatgtaacgatgataaataaagtgatgtgcaccataatgtgtaaccccgacctatactagttcaaacatgggaataaaagacaaagaaagttcttgtcaaaaaaaaaaaaaaaaaaa

SEQ ID NO: 2895 - DNA, 434 bp, Triticum aestivum
  Clone ID: PAT_TA_2895
tatcctcagcaggcaaagaaaatcgttgtacagcttcctctcctataccataatttgccctttgcatgcacacgttcaacaattttgaaggagcggcacgtaaaacaactaatgcctccttccaactccattgtcgcccagacagaggtgggaggcgttgtagaacagatagacgccaatccatgtcttcaatggaatggctggcatgtttgagtctccactctaacgcttgcctgccagcaggtgacagaccagtacttggcaactgatccatatcagggcctttaaataggacattatgtcgaagtatgtcaagcagaagtccaacaaaagatatcaccatgttcttcccttcagattcagtattactatctcagcaatcatgaatgacagaacactctgggggggcggcttgccggacgcgtgggcggacg

SEQ ID NO: 2896 - DNA, 841 bp, Triticum aestivum
  Clone ID: PAT_TA_2896
gcggccgcccgggcaggtacagttactagtaaccagggttcaaatgttgtgatctctttcactcatcatcaacttcagactcttccttgtcggtcccctttctctctctctccatggcatcgtcgacctcggaatcttccccatcactccccttgtcctcggtttccatagcatgtagacagtttgagcgacgatgcgaaggtcgatgttcttgcgtcaatcagctgataaagcgagttgagcagcagcagagaggaatcctgagacactatgctgctcatgtgccggctaagcagagcttgaagccatgggagcaagcaaaccagcactgaacccctagactgcatgagcgatatcagggatttgaggaacttcacagcgtctgctggcgtcaggagtgataccgacttcacgataaccttggcgtctctgttgtacgaggtgaaggaccccaactgcatcttcgtcttcaagttccgcacccacttcggaggcggcaagtcctccggattcggtctcatctacgacaacctcgagtccgccaagaagttcgagcccaagtaccgcctcatcaggaatggccttgctaccaaggtagagaagtcacgcaagcagatcaaggaaaggaagaacaggacaaagaagatccgtggtgtgaaggaccccaactgcatcttcgtcttcaagttccgcacccacttcggaggcggcaagtcctccggattcggtctcatctacgacaacctcgagtccgccaagaagttcgagcccaagtaccgcctctcaggaatggccttgctaccaaggtagagaagtcacgcaagcaggtcgacgcggccgc

SEQ ID NO: 2897 - DNA, 727 bp, Triticum aestivum
  unsure (1)..(727): unsure at all n locations
  Clone ID: PAT_TA_2897
cacacacacacccacacccagagccgaaacccactcttcgctcaaccgtctcggagcagaggctctcccttcaccttcgtcttcctccctctcggcagttcgacctttgcatggcagcagtggctagctccaaggggcgggtgatcgctgggagcctcgtggcgcgcgtcctcgccggcaaggccaacgcctccccgaggagggcggtgcacgcgtcggcctacgacaagaacgtggacgagcaggtgcgcccggccttcgtgccggacgatgtgatcggcgggcgcccgggagcccagacaagtactggggccctcacccaaccaccggcgtcttcggccccgccgcggtcgacccccaagctgggccgccagcctcgcgccggccagcgcccgcccaagggcggccctccgtgctggaccagaagtgtggttccgccccgctccaagactccgagaagcccccgtcgccttgatttgcccggcgacgacaattcgaccatagccaactcgacatctctataatccgcttaactggggtcgacgactactaattatatctacanggttgctcctgctataataatncagacaatggaagcacggaacggtataataatcgtgtgctgcccggataagagcaacanaaattgtgatggtatatgaagtatgttgttgtgctgtattacccctcttaacagtctatgcagtgtttgaaaaaaaaaaaa

SEQ ID NO: 2898 - DNA, 1109 bp, Triticum aestivum
  Clone ID: PAT_TA_2898
accaaagccaagtgagcaatagtaaacacaaatcaaccatgaagaccttcatcatatttgtcctccttgctatggtgatgagcatcgccagtgccactaggcaactaagccttagaggcaaggagttgcaaacaccacaagaacaattcccccaacagcaattccctcaaccacaacaaatcctccaacaacaattcccccaacaacaacaaatcccccaagcagccgcaacaattcccccaacagcaattcccgcaacaacaatttccccaacaacaacaattcccgcaacaacaacagttcccccaacaacaacaattcccccatccacaacaattcccccaacaacaacagttcccccaacaacaacaattcccccaacaacaattcccccagcaaacacaacaacaattcccccaacaacaatttcccataccatacccaccccaacaacaatcacaagaagcttccccataccaacaataccacaacaacaacaacaaccatctgggagcgacgttataagtatcagtggccgatgaaatgaagagatgtaatactagacaggtgaatcatcgttgttagtcaatggagcataatgtaatgggtataaataaaatgatgtgcaccatcatgtgtaaccccgacctgtactagttcaaacatgggaataaaagacaaataagttcttttctgaagcaaaaaaaaaaaaaaaaaacggtccgcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcgggtcgttcggctgcggcgagcggtatcagctcactcaaaggcggtaatacgggt

SEQ ID NO: 2899 - DNA, 1127 bp, Triticum aestivum
  Clone ID: PAT_TA_2899
aagggcattgaaggcctgttcaagaagaacaaggttgagtatgttaaagggtttgggaagcttgtctctccgtcagaggtatctgtggatttagttgatggtggtagcactatcgtcaaagggaagaatataattgtcgccactggctcagatgtgagatggctcggcgttctttgaaggcgatgttcgcgacgagctgctgctgatgaccctcacgcggttgtgggctcccaggagcttcatcctcagctttgtgggagaaagggcgcctgcctagggcttgtgaatcctctcatactccattgctcgcaccgtgctggtctgctggccggatgcgtgcctctgtgtgtgccccgccctctcagcttgggcggcggctgctgagagtgtgggagggagagtgaggggggaagaaggggggtgggcgtgacgggagaagagaagagaacacacttttttttaagcacacccacacgcatactcatcaaccgagcagtcaaatttctgtgtacattcgggcctacatatgctactgctgttgtacagagataattcatgtgcagatggatggcctacgttaactacagaagtcaatttgtcaactacagatgtcagtcagtgacaacccccctactacccctccctcttgtttcatcatccaccagatgtagctacttgttctctgttacaagactaaactaatgactgcagagatgacaacgtacagagctgatttcacaaaatctgccctcggataacttaatcagtggatgaattcacccatgccgccacgtcatctgagtggcatcagctcaaggggtcaaaccttctggctggaagctcaaatcacactgcaagggctcggtgcgcaccattttataacctccgctcgtccgtgcccccattggctgtgtgatgagatggtaacactggccagccccgcttgctgcaatctgcttttcgaacgccgggcaagaaaccatgttccctggccatggaggaaggagccacttcgataggctgctgctatccaccaacaggcccttgtactacaacatcctgactccgttgcttctttttggaggagccacggcgagtataaacaagtctctttggagggtgttgtt

SEQ ID NO: 2900 - DNA, 680 bp, Triticum aestivum
  Clone ID: PAT_TA_2900
gactatgacactgtacctggcgtggtgtacacacacccagaggtggcctccgttggcaagacggaggaacaggtcaaggcatctggtgtagcctaccaggttgggaagttccccctgctggcaaacagtcgggcgaaggcaattgatgatgccgaagggatggtgaaggtgatatctgagaaggaaactgacagaatcctcggcgtacacataatgtcccctggcgctggcgagatcatccacgaggctgtgcttgcacttcagtatggagcatccagtgaggacattgcccgtacgtgccatgcgcatccgacagtgagcgaggccctgaaggaggcatgcatgaacacctacgacaaggcgatccacatgtgatttctgatgtgagttcagctgccagcttgaaacaattggcaagtttttgaaataattttcaatcgatgcgttctagaaacatcaatttcttttttgttgtgagcttgtttcatatgcggaactgtgaattgcgaccttcgctgcagattgtagttacatgatgctaaattccctttccttgctgtggccgcatgtttgcatactcctaaataatatgtgaaattggtgtccatgttattagagcttctctttcggttgatacatttgaggaaattttatgtcgccatttcaatgcatttttctgc

SEQ ID NO: 2901 - DNA, 1009 bp, Triticum aestivum
  Clone ID: PAT_TA_2901
cgggcgccgtggcacatcgagccaggcgctcgcttcccgtcccgacctcccaatttcgccgtctccccgctcatccctcgccgctcgccggacgcccagagccgcagcctctccgtctcgcccgatcggcgtttgggactcgtcagcagccgcgccaccgcaactgtgcgggccgtgcccctgcctctggcagctaggcgcccctgcaagccggcgcacgccgcccactccgcgcaccggcgctcggccggcaggcagcagcaagccagcaaccatccttgttgatttgagacccagcatagcagcaaggaagcggacgggaggatgatgggaagcaacaaccccggtggcgcaggcggagggatggctccgggcatgggggtgggcagcagcgacgggcggcacgatgacgaggccgtactcaccgagttcctctcctccctcatggactacaaccccacgattccggacgagctcgtggagcactacctcggtcgcagcggcttccactgccccgacctacgccttacaaggttggttgctatagctactcaaaagttcatttcagacgtcgcaagtgactcccttcagcattgcaaagccagggttgcagcacctatcaaagacaacaagagcaaacaaccgaaggatagacgtcttgtattgacgatggatgatctttcaaaagccctgcgtgagcatggtgttaacttgaaacatccagagtattttgcggacagcccatcagcagggatgggcccttcaacaagagaggagtagaatcaatcacttcttcccgtaccaagacatgcccttacaactttatgtaccgttgcagcaacataacattataagcatctacgcgatggctgttctttatgtattatgcaccagcagtgtgtggttgccaccattttgatgcttatcaagttctccaagtcaccccctatcttggattgattgcatcttgaaactgtcgatcacatgaaattggctttgtgtagcaggt

SEQ ID NO: 2902 - DNA, 469 bp, Triticum aestivum
  Clone ID: PAT_TA_2902
cggacgcgtgggctctcactccagagcacttctgtagcaaatggacaacctcaggctgttgcggatccgggctcgatttgcaagcttcaggctgatcttcccatcgccaggagacactcccttcagcgcttcctggagaagcgccgtgacagggtggtgagcaaagctccttacggcgccgggaagccattcgaaggcatgggagcatcttctgggatggaagcggtcgcggagggcaaggcccagtaaccctgaaagaagaaagacggccctgcccctgatgtttggaaggaaaggggcgtgtgttagctgatgtgatgttacaccgtagaatcatcatcgttcgtgacgataataatgatccgacgagaacctctattgtcattgttctgttgtcattgtgtagtttactctgtatctgaacttgttttggtctgcggaaccgtacctgcccgggcggccgctcgaa

SEQ ID NO: 2903 - DNA, 926 bp, Triticum aestivum
  Clone ID: PAT_TA_2903
atccaagcagaggtccgaaccgactgatgttgaaggaatcagcggtatgagttgtggttaggggtgaaatgccactcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggccagtgagacgatgggggataagcttcatcgtcgagagggaaacagcccggatcaccagctaaggcccctaaatgaccgctcagtgataaaggaggtgggggtgcaaagacagccaggaggtttgcctagaagcagccaccctttaaagagtgcgtaatagctcactgatcgagcgcccttgcgctgaagatgaacggggctaagcgatctgccgaagctgtgggatgtcaaaatgcatcggtaggggagcgttccgctgctatcacgggctgccacggagttcacagggagatcagcggtcgacccgggtcaatcccaagcacaccgcgtggtatcattccccgtccccacattccgattccatgtggccgcggactatttcgatgcccaccgccgccacgcggtgtcggtgcacctccccctcacccggacaatggagggcagccttgatgcatgcaagctagctaattcttccacgtacggccaaagtcaactatatatattcgcaataatatgcgctcgatcgggtacttgataataaaacttgagtatggccctgctctcatgtgggtgtgcacttaaatttttgtttggaactttgggtgtgaacttaattagttacaacgtgtaatcaataaaactgcttccgttcagaatcataataaaaaatactctttttatagt

SEQ ID NO: 2904 - DNA, 1535 bp, Triticum aestivum
  Clone ID: PAT_TA_2904
gggttcaccccaaccccacttgtatcccacaccttgcggactttgataataaaagcttggttctactcaaaaataaaaaataaaaaaatcgagccagccgctcgtttcccgtcccgacctcccaatttcgccgtctccccgctcatcgctcgccgctggccggacgcccagagccgcagcctctccgtcccgcccgctcggcgtttggggctcggcagcagccgcgccaccgcaactgtgcgggccgtgcccctgcctctggccgccaggcgcccctgcaagccggcgcacgcggcccactccgcacaccggcgctcggccggcaggcagcagcaagccagcaaccatccttgttgatttgaggagaatcgccctgttttcaaatcctagatccgccactgtcgtcactcttctccaccactcagacccagcatagcagcaaggaagtggacgggaggatgatgggaagcaacaaccccagcggcgcaggcggagggatggctccgggcatgggggcgggcagcagcgacgggcggcacgatgacgaggccgtactcaccgagttcctctcctccctcatggactacaaccccatgattccggatgagcttgtggagcactacctcggccgcagcggcttccactgccccgacctacgccttacaaggttggttgctgtagctactcaaaagttcatttcagacatcgcaagtgactcccttcagcattgcaaagccagggttgcagcacctatcaaagacaacaagagcaaacaactgaaggatagacgtcttgtattgacgatggatgatctttcaaaagccctgcgtgagcatggtgttaacctcaaacatccagagtattttgcggacagcccatcagcagggatgggcccttcaacaagagaggagtagaacaatcacttcttcccgtaccaagaaatgcccttacaagtttatgtaccgttgcagcaacataacattatgagcatctacgcgatggctgttctttatgtattatggaccagcagtgtgtggttgccaccattttgatgcttatcaagttctccaagtcaccccctatcttggattgattgcatcttgaaactgtcgatcacatgaaattggctttgtgtagcgggtgagtttgattcctgatggttggctagtatggcacccatggaaactggagatcagatagaccttagcttatcttcagcatctagttgcaggaacataagtcaaaattgcgtactacgttctataagagaagtcatattcaggatgcaatctgaatttcgagacacaacgctccacgaaaagcatcggtaaaatatggcaacacactgaaaggaacaaggcatattctgctgttgacttgttatccagaagcaactattgcatcaacaactatcacctcctccatattgccatgacaaagactgtctgattgtaaaacaaattgcgtgtgtttaaatgaaaattatcgttgcaaggatacaaaaaaaaaaaaaaaaaaaaaaaaaataaaaaaaa

SEQ ID NO: 2905 - DNA, 1010 bp, Triticum aestivum
  Clone ID: PAT_TA_2905
cgtccggtccctttcaacgagagggagggagagaggagcagttagttgagaacttgagacccgaggcggagatggatctgctggagaggaggagcgccactattaaggccgaggcgggggaggcccagcggaaggaagcggagaggaaggagcaggagcttgagaaggagaaggagacccagcagcaaggccaaggaggactcacccgacccccgctcgccaacggcaggtctggaatgttgccaatgtcgagccctccagcaaatccgggacagcttaccattttttatggtgggtcagtatgtgtgtatgactcagtgccaccagagaaggctcaagcaatcatgctcattgcagcagcagcagctgcggcctcaaaaagcaatggcaccgctgctgttaagcctccagcgatgtctgcgaccaatgctatccaagccatgcttacgcggtcgctctcactacagagcacttctgtagcaaatggacaacctcaggctgttgcggatcctggctcgatttgcaagcttcaggctgatcttcccatcgccaggagacactcccttcagcgcttcctggagaagcgccgtgacagggtggtgagcaaagctccttacggcgccgggaagccatccgaaggcctgggagcatcttctgggatggaagcggtcgcggagggcaaggcccagtaacactgaaagaagaaagacggccctgcccctgatgtttggaaggaaaggggcgtgtgttagctgatgtgatgttacaccgtagagttacaccgtagaatcatcgttcgtgacgataataatgatccgaccagaacctctattgtcattgttctgttgtcattgtgtagtttaccctgtatctgaacttgttttactcagcggaaccgtactgctattgatgaatatgtcgatgtaaatcgtggctgtcgtgcctgtctgactgatacattgttcttgtagtcgatgaatgatatcacccgtgtcgtctcaatttaaaaa

SEQ ID NO: 2906 - DNA, 689 bp, Triticum aestivum
  Clone ID: PAT_TA_2906
gccggccgggtccgggaataagcgtccccttctcctccatcagccagctagccagcatcccccatcttcttcctctctacagatcgagttcgatcaaacacatccatcataaccatatccagcccaagaaatggcgcctctcaaggtgacagctgccttatgtgtcgtgctggtcctgatgatccagctgcaggcgccggcggccgcacaggacataacatgcgacgagtgcggaccgggatgtggccaggcgtgcaatgcgcagcgcccctacttctgcaacagcttctgcaacatctttcccaccctgtgcaactactgcttcctcatccaatccgacttgtgtgtgcccgagtgcacaaacctctgcaggatcaactgtgtgtgatcgaccatgcaggaacgcatcgacatgcgtggattcaagagtgtcgatgagcgtgcctgcgttgccattgttatatttgctgctctatgtgcaataagttgatgccggtcaggcggcatgcatgtattgcgtgcgagtgcctcgacttagcatttgatattgtgtttaatttgctactattcccttcactatagaatattacatattactatgttgtgcatccaatgcatttatgttgtacacccaccatttggttatgaaaaagacttgtttggaaaaaaaaaaaaaaaaaaggccccta

SEQ ID NO: 2907 - DNA, 631 bp, Triticum aestivum
  unsure (1)..(631): unsure at all n locations
  Clone ID: PAT_TA_2907
catccacacacacacacacacacacacaagcgaaacccactccacccaaccgtctcggagcagagcagagcctctctttgtccttcaccttcgtcttcctccctctcggcagctcgacctttgcatggcagcagtggctagctccaaggggcgggtgatcgctgggagcctcgtcgcgcgcgtcctcgccggcaaggccaacgcctccccgaaggagggcggtgcacgcgtcggcctacgacaagaacgtggacgaagcaggtggcgcccggccttccgtgccgggacgatgtgatcggcgggcgccggggagcccagacaagtactgggggccctcaccccaccaccgggcgtcttcggccccgcccgcggtcgaccccaagctgggccgccaacctcgcgccgggcaacgccgccgcgaatggtggcgcctccgtgctggaccaaaaagtgttggttccgcccgctcgaagactcgagaagcccccgtcgcctgatcgccggcgaacaacaagacgaagatagnccaactcgacatctctatcaatccgcctaacttggggtcgaacaaccaacctaattataatccaaaataanngttgcntgtgcnanagtanaanacaattggaag

SEQ ID NO: 2908 - DNA, 1725 bp, Triticum aestivum
  Clone ID: PAT_TA_2908
cgtgcgcaccttcactgagtggtgctattcgtattaacccatggaatgttgaatcaacggcggagtcactaaatgaggccatatgaatgtgagagcgtgacaaggagctgaggcacgaaaaacattaccgctatgtaagcacacatgatgttgcatattggtcaaggagctttatccaggacctggagagggcttgcaaggatcatttcaggaagccatgttggggcattggattgggatttggattcagggtggtggcactagacccaaatttctcaaagcttagttttgattcaattataatgtcttatgggagatcaaagagtagagctatatttcttgactatgatggtacattggtgccacaggcttctctctaccagaaaccaagtgaagaattagtaagcatcattaataccctatgctcggataagaacaacatcgtctttattgtcagtggaagaagcaagaatagcttgggatcaatgttctcctcatgtccaattctaggcatcgcggcagagcatggttatttcttaaggtggactagagatgaagaatggcaaaccagtacccagtccccagatattggatggatgcaaatggccgagccagtgatgaatctttatacagaagcaactgatggatcctacattgaaaccaaagaaactgctttggtgtggcaccatagggatgctgaccaaggctttgcgtcttctcaggcaaaggagatgcttgatcacctgggaaagtgtactagcaaatgaagcagtctcagtcaagagcggccagttcaattgttgaagtcaaacctcagggtgttagcaaaggtcttatagctgagaagatacttgcatcaatgaaggagaaaggtcaacaggcagattttgttttatgcattggtgatgatagatccgatgaggatatgtttgaaaatattgcggatgccatgaaaaagggcattgttgctccaaaaacaccactgtttgcatgtactgtggggcagaaaccgagcaaagccaagttctatctggacgatacatatgaagtagtcagtatgctgagtgcactagcagaagtttcagaaccagacccaacggcaggcttgacagatgacctggctacatcagtctcctcattagacatcggtgatgaacaaatacagttcagtaatacaaggatagaaggatgttagcctggaactgaatctgcatactatgatgctctgactcactaaaactattttctttgatccgaaggggtggagcagtgggcaaatgacccacagcagggcaaaaactatcttacaggtcacaatcattaatttcttggactcatgattcattgtagagaagaaaatgtgtttctcctggtggacaagggagttatatagtctgaagctgcaaggagaggggttacattctggtagctacaatagcctcgttcctcggttggttactgcatttcaatgggttggctgcaagaagactcatatgtgcatagctgatctttcgtgctcccatgtttctcttgtgttctccgtgatatggagaatattggcgttaaacctggggaaaggacaactgttgcagcttgtctgtcggcttgattaacaaaaatattgtagtcaagaaacctagttttcttttcttgtaatgttgcgcaggtgtctgaatatcaaggatgagattcaaatgataatttgacagagttatgtgcaccctt

SEQ ID NO: 2909 - DNA, 1899 bp, Triticum aestivum
  unsure (1)..(1899): unsure at all n locations
  Clone ID: PAT_TA_2909
ttttttttttttcctcagacaactatcaggcattacaaatatccagccagaaacaaagtactagtactgtactaaatccaatggaaaggtctgggcccacattagtgcaaacattaggatctcaagcgcggagaattcttttctttagaacttggataacaagtacaaaaatgcatattctgacaacatattctgatctctcattcgagcaaacgaaaaccaagcacagacggcatggagttggaagctacacaaacgacacatggaaatcacaggacttgggcggcggtgttcagcttctcggcgaccgcgatctgagtccgtgtgatgcttgacaggtataccagcgcaagattgtcctgaatcttgtcattgaagagcctgtcaaaagatgctggagacagctttggcatggaggagacggtgtcagcaatgaacctgcctatcttgttgtccggtgccacacgagcttcgacaacatcatcaacatatttgtagatctcgtcaataagagcatatagcttttgcattgaagactccatccttcacacaactagcgcacaagcatcaaatccaagtaggtagtagttaacgcaaatctaccatgaagaccttactcatcctgacaatccttgcgatggcaataaccatcgccaccgccaatatgcaggtcgaccctagcggccaagtacaatggccgcaacaacaaccattcctgcagcctcaccaaccattctcccagcaaccacaacaaatatttccccaaccccaacaaacattcccccatcaaccacaacaacaatttccccaagcctcagcaaccacaacaacaatttctccaagccccgacaaccattcccccaacaaccacaacaaccatatcccccagactcaacaaccacaacaaccatttccccagcaaccacaacaaccatttccccagactcaacaaccccaacaaccatttccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcagcagcagcaacaacaacaacaacaaggcatgcatatctttctgccactatctcagcagcaacaggtgggtcaaggttctctagtccaaggccagggcatcatccaaccacaacaaccagctcaattggaggcgatcagatcattggtgttgcaaactcttccatccatgtgcaacgtgtatgtcccacctgagtgctccatcatgagggcaccatttgccagcatagtcgcgggcattggtggccaatgaaaaactgaagagctatactaataggtagatggatcatcgttgcttagctgatgccctggccttggactagagaaccttgacccacctgttgctgctgagatagtggcagaaagatatgcatgccttgttgttgttgttgttgctgctgctgctgcatgatgatggaatgcacgaacgctatgggatggctgcgcactggagctgtttganggatcctgtgccaagttgttggaacaattgttgccgcaatcactttggcaaacccctttgtgggcanaataattgaccaaaagggatnacaccaatgacccaaggtttcaatngttgcaanaggntatccttgcangggtcaactggtggtgtaaaaatggttaatnaanggccttntttttggggnananttgtttcggtnnttgggc

SEQ ID NO: 2910 - DNA, 1203 bp, Triticum aestivum
  Clone ID: PAT_TA_2910
cccttcttgaagttaagtccgagaactttgtgtaagtgtaatgcagaatagcagcctcctccaacttaatttcattcggggatttcatgtaattatgccatctatgagcaccattcggacgcatatgctcctggacccttgccgctgatttcccattaccataagtgaggaaatagtttggattaccccgcgtggcctctttgtataggccaaagtatgtatccttcggaagatgatcgtagttcttcttaaacatggaaacctcagtaaaaggatctttaatgtcatcccgctcaacgctgctctcatagttggggaagataaccatgtcaacattatcaggaacatccaaaagcaaccgcctcagagagtactccctggcacccgctggatgaattaactcgtcggtatcaagatgtatgatccaatccattccagcctcccttgccataacaatagccatttccatgttaagtgactgcttaacaaaaagctcataattgcatggcttgtaaaagaaacctgaaagccaagtttcattccaaatgcggcttctgtcctgttgttcttttagttctttagttctgtaaataatttttacaccccggatagattcaagaacagaagtaacagctggtttagcagcctctccttcaacaaatagaataaagtgcgaaacaccaatgaccttgtgataatacaaccatggaagaatttggtgtaagctagcagatgtgcttcccgtgatacagatcttgggggttatagccgttgtcggagtcgaagctccagcctcggtagagagagattccgtgggaggaggcgctccggccgaggatctcggcgcagtcggcggccgcggaggaggccgacgcggaggagacggcgaagtaggagcctcggcctcccgtggaggatgaggaggagcccagtgggctgttctccatgccggggaaccgctgcgtgtcggcggcgccacacggtgccggtggggtcgcgcatgccgccgcgccactggagcgcgaaggcgaaggcggcgagcgcgagcggtagcagcgtgaggaggaggagcacgcgcatcgcgaacaccgccgcccctccggcgccggccgcggaggaggaggaggcgctgcggtagcccgccattggggggagtcggtggcaggttggtggagacctccctcgtgccgaattcggcacgag

SEQ ID NO: 2911 - DNA, 560 bp, Triticum aestivum
  Clone ID: PAT_TA_2911
gccggccgggctccgggatctaacacaaccatcatatccatatccagcccaacaaatggcgcctctcaaggtgactgttgccatgtgtgtcgtgctggtcctgatgatccagctgcaggcgccggcggctgcgcaggagataccatgcgaccagtgcgggccgggatgcgcccaggcgtgcaatgcgcagggcccctacttctgcaacagcttctgcaacatctttcccaccctgtgcaactactgcttcctcatccaatccggcttgtgcattcccgagtgcgcaaacctctgcagggtcaactgcgagtgatcgaccatgcaggaacgcatcgacatgcatggattcgagggtgtcgatgagcgtgcctgcgttgccattgttatattagctgctctatgtacaataagtcgatgccggtcaggctgcatgcatgtattgcgtgcgagtgcctcgacttagcatttgataccgtgtttaatttgctactattcccttcactcaacatattacatattaccatgttgtgcatcaaaaaaaaaaaaaaaaaaggccccta

SEQ ID NO: 2912 - DNA, 1186 bp, Triticum aestivum
  Clone ID: PAT_TA_2912
ttttttttttggcaaacaagaactttgtttgtcttttattcccaagcttgaactagcactggccggtgtcacacatgatggtgcactccactttatttgtcatcgttacatcgattggtgcatcagctaagcaacgatgatccatctacctattagtatagctcttcagtttttcattggccaccaatgcccgcgactatgctggcaaatggtgcccccatgatggagcactctggtgggacatacacgttgcacatggatggaagagtttgcaataccaatgatctgatcgcctccaattgagctggttgttgtggttggatgatgccctggccttggactagagaaccttgacccacctgttgctgctgagatagtggcagaaagatatgcatgccttgttgttgttgttgttgttgctgctgctgcatgatgatggaatgcacgacgctatggatggctgcgcactggagctgttgaggaatctgtgctagttgttggcagcattgttgccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaaccatttccccagctccagcaaccacaacaaccttttccccagccccaacaacaattaccgcagccccaacaacaacaacaaggcatgcatatctttctgccactatctcagcagcaacaggtgggtcaaggttctctagtccaaggccggggcatcatccaaccacaacaaccagctcaattggaggcgatcagatcattggtgttgcaaactcttccatccatgtgcaacgtgtatgtcccacctgagtgctccatcatgagggcaccatttgccagcatagtcgcgggcattggtggccaatgaaaaactgaagagctatactaataggtagatggatcatcgttgcttagctgatgcaccaatcgatgtaacgatgacaaataaagtggagtgcaccatcatgtgtgacaccggccagtgctagttcaagcttgggaataaaagacaaacaaagttcttgtttgccagcattacttgtc

SEQ ID NO: 2913 - DNA, 738 bp, Triticum aestivum
  Clone ID: PAT_TA_2913
gatctaacacaaccatcatatccatatccagcccaacaaatggcgcctctcaaggtgactgctgccgtctgtgtcgtgctggtcctgatgatccagctacaggtgccaacggtcgcgcaggacataccatgcgacgagtgcgagccgggatgcggccaggcttgcaatgcgcagcgcccctacttctgcaacagcttttgcaacatctttcccaccctgtgcaactactgcttcctcatccaatccgacttgtgcgtgcccgggtgcacaaacctctgcaggatcaactgcgtgtgatcgaccatgcaggaacacatcgacatgagtggactccagagtgtcgatgagcatgcctgcgttgccattgttatatttgctgctctatgtgcaataagtcaatgccggtcaggctgcatgcatgtattgcatgcgagtgccttgacttagcatttgatactgtgtttaatttgctactattcccttcactacagcatattacatattactacgttgtgcatccaatgcatttatattgtacgcccaccatttggttatgaataagactcgtttggaatatcaaaaaaaaaaaaaaaaatccagtactgagttttatgtaatgtgaggattatatgtgtttgtgactgaaaaaaaaaaaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 2914 - DNA, 714 bp, Triticum aestivum
  Clone ID: PAT_TA_2914
aggtcgccgccgcagccgccacctcctccgcaggcagcccaccgcgaagcgaggtcgaatcagccatggcggacgccaagaccaccacggcggtcaccctccgcacccgcaagttcatgaccaaccgcctgctcgcccgcaagcagttcgtgctcgaggtcatccaccccggccgaggtaccatacttgccgacgattccagccttcttggtgcgcttcgtcatctcggcggcgggtagcaggaggcggctgctgcggcgtaggcggggagatggcggtgcgcgtggcgcagccactattaaggcggaggcgggggaggcccagcgcaaggaagccgagaggaaggagcaggagcttgagaaggagcaggagacccagcagccaggactcaccggcagacccccgctcgccaacggcaggtctggaatgttgccaatgtcgagccctccagcaaatccgggacagcttaccattttttatggtgggtcagtatgtgtgtatgactcagtgccaccagagaaggctcaagcaatcatgctcattgcagcagcagcagctgcggcctcaaaaagcaatggcaccgctgctgttaagcctccagcgatgtctgcgaccaatgctatccaagccatgcttacgcggtcgctctcactccagagcacttctgtagcaaatggacaacctcaggctgtcgcggatcctggctcgatttgc

SEQ ID NO: 2915 - DNA, 563 bp, Triticum aestivum
  Clone ID: PAT_TA_2915
atgtcataaaaataaaaataggttggcataacgcataacaggcaactgtagggacatactttcatgtttgaaagatcctaaaatcagaaccaaaattactaacagatcgctcaatagccaaaatacagagattggtaagtcttcactccactacagaacccctgaattcctcaagacaacagtagtgcaatcatgcttcggtctgctccctcaagcgacggatcgtgctcctgacggtgactgcactagcagtgttcatggtataggcgccgccagccttgaccttgccacagtccttgcatccccaaattccaacagctttcctcttcacagcaaacttcccacagaattcacagaagtacttggagtgctgagacaactccatcttcttgatctgcttacgtaaactggcaccgtacctggtaccatacttgccgacgattccagccttcttggtgcgcttcgtcatctcggcggcgggtagcaggaggcggctgctgcggcgtaggcggggagatggcggtgcgcgtgcgcctacgcgtccgcggacgcgtgggcggacg

SEQ ID NO: 2916 - DNA, 1012 bp, Triticum aestivum
  Clone ID: PAT_TA_2916
tcattcccaggtccctttcgcccgccccaacgagagagggagaggagcagttagttgagacccgaggtggagatggatctgctggagaggagcgcagccactattaaggcggaggcgggggaggcccagcgcaaggaagccgagaggaaggagcaggagcttgagaaggagcaggagacccagcagccaggactcaccggcagacccccgctcgccaacggcaggtctggaatgttgccaatgtcgagccctccagcaaatccgggacagcttaccattttttatggtgggtcagtatgtgtgtatgactcagtgccaccagagaaggctcaagcaatcatgctcattgcagcagcagcagctgcggcctcaaaaagcaatggcaccgctgctgttaagcctccagcgatgtctgcgaccaatgctatccaagccatgcttacgcggtcgctctcactccagagcacttctgtagcaaatggacaacctcaggctgtcgcggatcctggctcgatttgcaagcttcaggctgatcttcccatcgccaggagacactcccttcagcgcttcctggagaagcgccgtgacagggtggtgagcaaagctccttacggcgccgggaagccatccgaaggcatgggagcatcttctgggatggaagcggttgcggagggcaaggcccagtaaccctgaaagaagaaagacggccctgcccctgatgtttggaaggaaaggggcgtgtgttagctgatgtgatgttaccccgtagaatcatcgttcgtgacgataataatgatccgaccagaacctctattgtcattgttctgttgtcattgtgtagtttactctgtatctgaactcggtttagtctgcggaaccgtactgctatgatgaatgtgtcgatgatgtaaatcgtggctgtcgtgcctgtctgactgatacattgttatcgtagtcgataaatgatatcatctgtgccgtttttgttttaaatgttcccagttggtttggg

SEQ ID NO: 2917 - DNA, 929 bp, Triticum aestivum
  unsure (1)..(929): unsure at all n locations
  Clone ID: PAT_TA_2917
ctagagttgaaacaccaaagccaagtgagcaatagtaaacacaaatcaaacatgaagaccttcatcatatttgtcctccttgccatggcgatgaacatcgccagtgccagtaggctgctaagccctagaggcaaggaattgcatactccacaagaacaattcccccaacaacaacaattcccccaaccacaacaattcccccaacaacaaattccccaacaaccaacaacatcaaatcccccagcaaccacaacaattcccccaacaacaacaattcctccaacaacaacaaatcccgcaacaacaaatcccccaacaacatcaaatcccccagcaaccacaacaattcccccaacaacaattcccccaacaacaccaatccccccaacaacaattcccccaacagcaattcccccaacaacaacagttcccccaacaacaacaattaacgcaacaacaattcccccggccacaacaatcccctgaacaacaacaattcccccaacaacaattcccccagcaaccaccacaacaattcccccaacaacaatttccaataccatacccaccccagcaatcacaagaaccttccccataccaacaatatccacaacaacaaccatctgggagcgacgttataagtatcagtggcctatgaaatgaagagatgtaatactagacgggtgaatcatcgttgttagtcaatggagcataatgtaacgatgataaataaagtgatgtgcaccatcatgtgtaaccccgacctgtactagtccaaacatgggaataaaagacaaataagttcttttcaaaaaaaaaaaaaaaaaactcgagggggggcccggtacccaattcgccctatagtgaggtcggattacaattcactggccgtcgttttacaacgtcntggactggggaaaaccctggcg

SEQ ID NO: 2918 - DNA, 1560 bp, Triticum aestivum
  Clone ID: PAT_TA_2918
gacgacctttggcttgtgaaggcgaattcttttctggctgatagataaaaatccccaccacatccgcaagcgcgaactccctccccggatctgcaactagccggcttccctcccgatccgtctcgccgcggccgagatccttccttcctccggcgagagccaagatgtactcgtgggagatgctgtcgttcaacatccacgacgggttcctggaggcgatcgtgcgggggaaccgctcgggcctcctcacccaagccgattacaacaacctctgccagtgcgagaccctcgacgacatcaagatgcacctctccgccaccgagtacggtccatacctccagaacgaaccttctcccttgcacacgacaacaattgtggagaagtgcactctcaagctggttgatgaatacaaacacatgttgtgccaggcgaatgaacctctatctacattcctacagtacataacgtatggacacatgatcgataatgttgtacttattgttactgggacattgcatgaaagagatgttaacgaactgttggagaaatgccatccattgggcatgtttgacagcattgcatcacttgcggttgctcaaaatatgcgtgagctttacaggctggttctagttgatacacccttagcaccgtacttctcagagtgcattacatctgaggatctggatgacatgaatattgagatcatgaggaacacactctacaaagcgtatcttgaggatttttacaaattttgcgcgaaactaggtggtgcgacggctgagattatgtgtaatctcctttcatttgaagccgacagaagagctgtaaacattacaataaacagtattggtactgagctgactagagatgaccgccggaagctgtactccaactttggtctattgtttccgtatggtcatgaagacttggctgtctgtgaagatgttgaccaggtgcgtggtgtaatggaaaagtaccccccataccagtctatttttgccaagatatcatatggcgaaagccagatgttggacaaggccttttatgaggaggaagtaaagaggctgtgcctgtcatttgaacagcagttccactatgccgttttcttcgcatacatgaggctacgagagcaggagataaggaacttgatgtggatctctgaatgcgttgctcagaaccagaagaacagggtccacgacagcgtcgtgccgatcttttaatcgccccctattactgtgcatatggttgtacaaaaggcctgctttgatgatggcacaatcgattgcacactttacaagctcatggtttgttattacccctgttcctctttctacgcggctgaaaagctagacctggagtagtgtatcattatttgtttttgtagtaaaaataaaaggcgcagttgtacggtaaactaaataaatgatgtttattttcgtagtgggtggcactatttgtgcagtttgttggcaatgtaaaatgtacacccaagatatcaaatggtttgttggcaaaacagactcttttactgcattatcaaatggaacttgtgcagcttag

SEQ ID NO: 2919 - DNA, 923 bp, Triticum aestivum
  unsure (1)..(923): unsure at all n locations
  Clone ID: PAT_TA_2919
cacgagttttttttttgcaaatattagagcacggatagcagaaggcaaatcagaatccacagtaaatctcaggcaaaaaaagggtgagagaataacataacagaacatcatcgcaccaagtacaaagataatccttgactaaacagccaacagaactgaatccaaagtatcgtctaaactgcaaaatcccagatgattcactaggacaaaacactagtagcaacttatgcttcagtctgctccctcaagcgacggatagtgctcctgacagtgaccgcactggcagtgttcatggtgtaagcaccgccagccttcaccttcccacagtccttgcatccccaaattccaactgctttcctcttcacagcaaacttcccacagaactcacagaagtacttggagtgctgagacacctccatcttcttgatctgcttacgcaaactggcaccataacgggtaccatatttgccgacaattccagccttcttggtgcgcttcgtcatctcgtcgacgggtaggaggcgtgggcggcgagctgctgcggctgcggcggcggcgaaatccgggagacggaagctgcctcgtgccgaattcctgcagcccgggggatccactagttctagagcggccgccaccgcggtggagctccagcttttgttccctttagtgagggttatttccaagcttggcgaaatcatggccatagctggttctgngtgaaattggtatccggtaaaatttccccacaacatacgagccgaagcataagggggaaagcctggggggcctaatgaagggactaacctcaatttaattgcgtgcgctaactgccccgttttccagcgggaaacctggtgggcccacttgattaatgaattggcccaaccccggggaaaaagcggtttgggttttggccctctttt

SEQ ID NO: 2920 - DNA, 792 bp, Triticum aestivum
  Clone ID: PAT_TA_2920
cccaacaacctttttcccagccccaacaactgatccccatgcaggcacaacaaccattcccccagcaatcccaacaatcacaacaaccttttcccgggccccaacaattatttcctgaactccaacaaccaattccccagcaaccacaacaaccattccccctgcaaccgcaacaaccattcccccagcaatcgcaacaaccattcccccagcaaccccaacaaccatgccccctgcaaccgcaacaaccattcccccaacaaccacaacaaccattcccccaacaaccacaacaacctttccccctacaaccacaacaaccattccccctacgaccgcaacaaccattttcccagcaaccccaacaatcacaacaatcatttccccagccccaaccccagcaaccccaacaaccatccatcctgcaaccacaacaaccatttctgcagccccaacaacaattatcccagcaactagaacaaacaatttcccagcaaccccaacaaccattcccccagcaaccacaccaacctcaacaaccatatccacaacaacaaccatatgggagtagtcttacaagcatcgatggccaatgaaatgaagacctgtaatacaagacggatggatcatcgttgtttagtcaatgagtgttcaatgtaatgatgataaataaagtgatgtgcaccataatgtgtaacccccgacctatactagttcaaacatgggaataaaagacaaaggaagttcttgtcacaaagacatcaaaaaaaaaaaaaaaactcgtgccgaatc

SEQ ID NO: 2921 - DNA, 690 bp, Triticum aestivum
  Clone ID: PAT_TA_2921
agtaaattttctgttcgaaacatgttcaatttatatgaacaacagctaaagtcaatgcaaatagaagcacaaatgcacaggcggccccgctagttcttctaagaacagatgacaatagctttaagattcaagaaccaacgacacacacaacgaatacccttagacaatcaactaagcacgataaacgagatacacattgtaacgtagctggatacattcagaaccccaacaagccgataaataacattgtatgttgtcaatttaggctatattgcgtcgaatgagtctcgtctgaactacaaaatccagaggctcctttgtcagattgaccgcgatcaagcttcagtctgctccctcaggcgacggatcgtgctcctgacagtgaccgcactggcggtgttcatggtataggcaccaccggccttaaccttcccgcagtccttgcatccccagattccgactgctttcctcttcacggcaaacttgccacagaactcacagaagtacttggagtgctgggagacctccatcttcttgatctgcttacgcagactggcaccgtaccttgtaccatatttgccaacgattccagccttcttggtgcgcttcgtcatctcgtcggcgaggaggaggcgtccgcaacaacgggcggcggcggcggcggcaaagagggcagggaggcggcggcgc

SEQ ID NO: 2922 - DNA, 1628 bp, Triticum aestivum
  unsure (1)..(1628): unsure at all n locations
  Clone ID: PAT_TA_2922
acgcgtccggaagcaagttgagcccggcacgaccgcgccctttggcttgtgagaaggcgaattcttttctggctgatagataaaaatctccaccacatccgcaagcgcgaactccctcccggatctgcaactagccggctcccctcccgatccatctcgccgcggcggagatccttcattcctccggcgagagccaagatgtactcgtgggagatgctgtcgttcaacatccacgacgggttcctggaggcgatcgtgcgggggaaccgctcgggcctcctcacccaagccgattacaacaacctctgccagtgcgagaccctcgacgacatcaagatgcacctctccgccacagagtacggcccatacctccagaacgaaccttctcccttgcacacaacaacaattgtggagaagtgcactcttaagctggttgatgaatacaaacacatgttgtgccaggcgaatgaacctctatctacattcctacagtacataacgtatggacacatgatcgataatgttgtccttattgttactgggacattgcatgaaagagatgttaacgaactgttggagaaatgccatccattgggcatgtttgacagcattgcatcacttgcggttgctcaaaatatgcgtgagctttacaggctggttctagttgatacacccttagcaccgtacttctcagagtgcattacatctgaggatctggatgacatgaatattgagatcatgaggaacacactctacaaagcgtatcttgaggatttttacaaattttgcgtgaaactaggtggtgcgacggctgagattatgtgtaatctcctttcatttgaagctgacagaagagctgtaaacattacaataaacagtattggtactgagctgactagagatgaccgccgcaagctgtactccaactttggtctattgtttccgtatggtcatgaagagttggctgtctgtgaagatgttgaccaggtgcgtggtgtaatggaaaagtaccccccataccagtctatttttgccaagatatcatatggcgaaagccagatgttggacaaggccttttatgaggaggaagtaaagaggctgtgcctctcatttgaacagcagttccactacgccgttttcttcgcatacatgaggctacgagagcaggagataaggaacttgatgtggatctcggaatgcgttgcccagaaccagaagaacagggtccacgacagtgtcgtgccgatcttttaatcgccctcttactgtgcatatggttgtacaaaaggcctgctctgatgatggcacaatcgattgcacactttacaagctcatgatttgttattacccctgttcctctttctacgcggctgaaaagctagacctggagtagtgtatcattatttgtttttgtagtaaaataaaaggcgcagttgtacggtaaattaaataaatgatgatgtttattttcgtagtgggtggcactatttgtgcagtttgttggcaatgtaaaatgtacacccaagatatcaaatggtttgttggcaaaactctcttactgcattatcaaatggaacttgtgcagncttagtaaggacatggnaaattgttgggcaccgtcgttaact

SEQ ID NO: 2923 - DNA, 1132 bp, Triticum aestivum
  Clone ID: PAT_TA_2923
gcacgaggcacaactagagcacaagcatcaaatccaagtacgtagtagttaacgcaaatccactatgaagaccttactcatcctaacaatccttgcgatggcaataaccatcggcaccgccaatatgcaggtcgaccctagcagccaagtacaatggccacaacaacaaccagtcccacagcctcaccaaccattctcccagcaaccacaacaaacatttccccaaccccaacaaacattcccccatcaaccacaacaacaatttccccagcctcagcaaccacaacaacaatttctccagccccaacaaccattcccccaacaaccacaacaaccatatccccagcaaccacaacaaccattcccccagactcaacaaccccaacaactatttccccagtcccagcaaccacaacaacaattttctcagccccaacaacaattcccgcagccccaacaaccgcaacaatcattcccccaacaacaaccaccgttcattcagccatctctacaacaacaggtgaacccatgcaagaatttcctcttgcagcaatgcaaacctgtgtcactggtgtcatccctctggtcaatgatctggccacaaagcgattgccaagtgatgcggcaacaatgctgccaacaactagcacagattcctcagcagctccagtgtgcagccatccataccatcatacattccatcatcatgcagcaagaacaacaagaacaacaacaaggcatgcatatcctgctgccactatatcagcagcaacaggtgggtcaaggtactctcgtccagggccagggcatcatccaaccccaacaaccagctcaattggaggcgatcaggtcattggtgttgcaaactcttccaaccatgtgcaacgtgtatgtcccacctgagtgctccatcatcaaggcaccattttccagcgtagtcgccggcattggtggccaatgaaaaatgcaagagccatactaataggtagatggatcatcgttgcttagttgatttacccatcgatgtaacgatgatagaataaactggcgtgcaccatcatgtgtgaccccgaccagtgcaatttcaagcttgggaataaaagacaaagaaagttcaagtttgcgaacaaaa

SEQ ID NO: 2924 - DNA, 702 bp, Triticum aestivum
  Clone ID: PAT_TA_2924
ttttttttttttttgtcagtcaagtcaagtaaattttctgttcaaaacatttcccagtctatatgaacaacagctaaagtatatgcaaatagacgcacagatgcacaggctgccctgctagttcttctaataacagatgacaatagcatcaagattcaagaaccaacgacacacacaaagagtaccttcagacgatcaactaagcacgataaacgagatacacattttagcgtagccggatactttcagaacccaacaagccgataaataacattgtatgttgtcaatttaggctacatagcgttgcacgagtctcgtctgaactacaaaatccaaaggctccttggtcagatcgaccgcgatcaagcttcagtctgctccctcaggcgacggatcgtgctcctgacagtgaccgcactggcagtgttcatggtataggcaccaccggccttaaccttcccgcagtccttgcatccccagattccgactgctttcctcttcacggcaaacttgccacagaactcacagaagtacttggagtgctgggagacctccatcttcttgatctgcttacgaagactggcaccgtacctggtaccatatttgccaacgattccagccttcttggtgcgcttcgtcatctcgccggcgaggaggaggcgtccgcggcaacgggcggcggcggcaaagcggacgcgtggg

SEQ ID NO: 2925 - DNA, 1584 bp, Triticum aestivum
  Clone ID: PAT_TA_2925
gaggaattcggcacgaggctgagccgggcacgacctttggcttgtgaaggcgaattcttttgtggctgatagataaaaatctccaccacattcgcaagcgcgaactccctcccggatctactactagccggctcccctcccgatccctctcgccgcggccgagatccttccttcctccggcgagagccaggatgtactcgtgggagatgctgtcgttcaacatccacgacgggttcctggaggcgatcgtacgggggaaccgctcgggcctcctcacccaagccgattacaacaacctctgccagtgcgagaccctcgacgacatcaagatgcacctctccgccaccgagtacggtccatacctccagaacgaaccttcccccttgcacacaacaacaattgtggagaagtgcactcttaagctggttgatgaatacaaacacatgttgtgccaggcgaatgaacctctatctacattcctacagtacataacatatggacacatgatcgataatgttgtccttattgttactgggacattgcatgaaagagatgttaacgaactgttggagaaatgccatccattgggcatgtttgacagcattgcatcacttgcggttgctcaaaatatgcgtgagctttacaggctggttctagttgatacacccttagcaccgtacttctcagagtgcattacatctgaggatctggatgacatgaatattgagatcatgaggaacacactctacaaagcgtatcttgaggatttttacaaattttgtgcgaaactaggtggtgcgacggctgagattatgtgtaatctcctttcatttgaagctgacagaagagctgtaaacattaccataaacagtattggtactgagctgactagagatgaccgccggaagctgtactccaactttggtctattgtttccgtatggtcatgaagagttggctgtctgtgaagatgttgaccaggtgcgtggtgtaatggaaaagtaccccccataccagtctatttttgccaagatatcatatggcgaaagccagatgttggacaaggccttttatgaggaggaagtaaagaggctgtgccagtcatttgaacagcagttccactacgctgttttcttcgcatacatgaggctacgagagcaggagataaggaacttgatgtggatctcggaatgcgttgcccagaaccagaagaacagggtccacgacagcgttgtgccgatcttttaatcgccccctattactgtgcatatggttgtgcaaaaggtctgctttgatgatggcacaatcgattgcacactttacaagctcatgatttgttattacccctgttcctctttctatgcggctgaaaagctagacctggactagtgtatcattatttgtttttgtagtaaaataaaaggcgcagttgtacggtaaactaaataaatgatgtttattttcgtagtgggtggcactatttgtgcagtttgttggcaatgtaaaatgtacacccaagatatcaaatggtttgttggcaaaacaaactcttttttactgcattatcaaaaaaaaaaaaaaaaaa

SEQ ID NO: 2926 - DNA, 769 bp, Triticum aestivum
  Clone ID: PAT_TA_2926
cacacacacacacacacacacacacacacagagcctaagcccactcttctcagagcagagcctctcccttcaccttcgtcttccttcctctcggcagttcgacctttgcatggcagcagtggctagctccaaggggcgggtgatcgctgggagcctcgtcgcgcgcgtcctcgccggcaaggccaacgcctccccgaggagggcggtgcacgcgtcggcctacgacaagaacgtggacgagcaggtgcgcccggccttcgtgccggacgatgtgatcggcggcgccgggagcccagacaagtactggggccctcacccgaccaccggcgtcttcggccccgccgcggtcgaccccaagctggccgccagcctcgcgccggcgagcgccgctgcgaatggtggcgcctccgtgctggaccagaaggtgtggttccgcccgctcgaggacgtcgagaagccccccgtcgcctgatcatcgccgacggcgacgatagcccagctcgacatctctatcactccgcttagctgggctcgacttcctacttataattacatataatctgtagtggtgtgctcgtgctatagtacagacatggcaggcaccagaaccagtagtagtaacgcggtgttgctgcccggaataagagcgagcagaagatgtgtgatgatgatgacagtgatgttggtggctgtgatgtactcccgtcttaaaccagtgctattgcaagtgtttggttaggggggggggggggggggggggggggggggg

SEQ ID NO: 2927 - DNA, 682 bp, Triticum aestivum
  Clone ID: PAT_TA_2927
agaagcatgaagttcctgattcaaaagaaaaccaaccaaatggaggaccacattttcgcttgtgcaattcttagacacgattccagttcctaatggtcaagatagctcggatggcagaaggcacaaaagaatccacagtaaatcaggcaacagcaacagaaggatggggggaataccataacaaaaacatccatggcaccaagtacaaagatacccttgactaaacagccaacagaactgaatccaaagtatcgtctaaactgcaaaaaacagataattccttaggacaaaacactgctggtagcaacttatgcttcagtctgctccctcaagcgacggatggtgctcctgacagtgactgcactggcagtgttcatggtgtaagcaccgccagccttcaccttcccacagtccttgcatccccaaattccaactgctttcctcttcacagcaaacttcccgcagaactcacagaagtacttggagtgctgagacacctccatcttcttgatctgcttacgcaaactggcaccataacgtgtaccatatttgccaacaattccagccttcttggtgcgcttcgtcatctcgtcgacgggtaggaggcgtgggcggcgagcagcggcggcggcggcgaaatccgggagacgggggcgagctgcggcgacccgacccggccggc

SEQ ID NO: 2928 - DNA, 927 bp, Triticum aestivum
  Clone ID: PAT_TA_2928
aacaaacatttccccaaccccaacaaacattcccccatcaaccacaacaacaatttccccagcctcagcaaccacaacaacaatttctccagccccaacaaccattcccccaacaaccacaacaaccatatccccagcaaccacaacaaccattcccccagactcaacaaccccaacaactatttccccagtcccagcaaccacaacaacaattttctcagccccaacaacaattcccgcagccccaacaaccgcaacaatcattcccccaacaacaaccaccgttcattcagccatctctacaacaacaggtgaacccatgcaagaatttcctcttgcagcaatgcaaacctgtgtcactggtgtcatccctctggtcaatgatctggccacaaagcgattgccaagtgatgcggcaacaatgctgccaacaactagcacagattcctcagcagctccagtgtgcagccatccataccgtcatacattccatcatcatgcagcaagaacaacaacaaggcatgcatatcctgctgccactatatcagcagcaacaggtgggtcaaggtactctcgtccagggccagggcatcatccaaccccaacaaccagctcaattggaggcgatcaggtcattggtgttgcaaactcttccaaccatgtgcaacgtgtatgtcccacctgagtgctccatcatcaaggcaccattttccagcgtagtcgccggcattggtggccaatgaaaaatgcaagagccatactaataggtagatggatcatcgttgcttagttgatttacccatcgatgtaacgatgatagaataaactggcgtgcaccatcatgtgtgaccccgaccagtgcaatttcaagcttgggaataaaagacaaagaaagttcaagtttgcgaaaaaaaaaaaaaaaaaaaa

SEQ ID NO: 2929 - DNA, 775 bp, Triticum aestivum
  Clone ID: PAT_TA_2929
cccacgcgtccacacacacacacacacacagagccgaaacccactcttcgctcaaccgtctcggagcagaggctctcccttcaccttcgtcttcctccctctcggcagttcgacctttgcatggcagcagtggctagctccaaggggcgggtgatcgctgggagcctcgtggcgcgcgtcctcgccggcaaggccaacgcctccccgaggagggcggtgcacgcgtcggcctacgacaagaacgtggacgagcaggtgcgcccggccttcgtgccggacgatgtgatcggcggcgccgggagcccagacaagtactggggccctcacccaaccaccggcgtcttcggccccgccgcggtcgaccccaagctggccgccagcctcgcgccggccagcgccgccaagggcggcccctccgtgctggaccagaaggtgtggttccgcccgctcgaggacgtcgagaagccccccgtcgcctgatcgccggcgacgaccagtcgaccatagcccagctcgacatctctatcactccgcttagctgggctcgacgacctacctaattatagtctacagtggtctgctcgtgctatagtaagtacagacaatggcaggcaccggaaccggtagtagtaatgcggtgttgctgcccggaataagagcgagcagaagatgtgtgatggtgatgatgacagtaatgttgttggctgtgatgtacccccgtcttgaaccagtactattgcaagtgtttggtacccgctgcgtctcttgatgttgt

SEQ ID NO: 2930 - DNA, 1931 bp, Triticum aestivum
  Clone ID: PAT_TA_2930
ccacgcgtccgctccgtcccccatcttctttctttcttgcgcaaaaggaaaggagaggagaatttggaatctccataccattttttcttcctaaaagaaaatcgaggcgaggaggagtccgcgtccgcgagatggcgatggcgagcttggcgaggaggcgcgcggcggaggcggtgctgctgcggcggccccacgcggcggcgtgggcgtccgcgtgccgggggtacgccgcgtcgggggaggagagcgacgtcgtcgtgatcggcggcgggcccggcgggtacgtggcggccatcaaggcagcgcagctcggccttaagaccacctgcatcgagaagaggggcgcgctcggggggacctgcctcaacgtcggctgcatcccgtccaaggctcttctgcattcgtcgcatatgtaccatgaggcaaagtcttcttttgcacaccatggcgtcaagttctccaatctggaggtagatctgcctgcaatgatggctcagaaagacaaggctgtttctgggcttacaaagggcatcgaaggcctgttcaagaagaacaaggttgagtatgttaaagggtttgggaagcttgtctctccgtcagaggtatctgtggatttagttgatggtggtagcactatcgtcaaagggaagaacataattgttgccactggctcagatgtgaaatcgctccctggagttacaattgatgagaagaagattgtgtcatctactgggggctcttgcacttacagaaataccaaagaagttggtggtcattggagctggatacataggtctagagatgggttctgtctggaacaggctagggtctgaagtgactgtggttgaatttgcccctgatattgtcccatcaatggatggagagataaggaagcagtttcagcgtatgctagagaagcaaaagtttaagttcatgctcaagacaaaggtagttggggtcgatacctctggaagtggtgtcaagttaactgtggagcctgcagctggtggagagcagactgtcattgaggctgatgttgtccttgtatctgctggcagagtcccatacactgctggtattgggctggacgccattggtgttgagacagacaagggcggaagggtccttgttgacaatcgctttatgacaaatgttaagggcgtatacgcgattggagatgcgatacctggaccgatgcttgcacacaaggctgaggaggatggtgttgcatgtgttgaatttatcgcggggaaggagggccatgttgactatgacactgtacctggcgtggtgtacacacacccagaggtggcctccgttggcaagacggaggaacaggtcaaggcatctggtgtagcctaccaggttgggaagttccccctgctggcaaacagtcgggcgaaggcaattgatgatgccgaagggatggtgaaggtgatatctgagaaggaaactgacagaatcctcggcgtacacataatgtcccctggcgcgggcgagatcatccacgaggctgtgcttgcacttcagtatggagcatccagcgaggacattgcccgtacgtgccacgcgcatccgacagtgagtgaggccctgaaggaggcgtgcatgaacacctacgacaaggcgatccacatgtgatttctgatatgagttcagctgccagcttgaaacaattggcaagtttttgaaataattttgaatcgatgcgttctagaaacatcaatttttcttttttgttgtgagcttgtttcgtatgcggaactgtgaattgcgaccttcgctgcagattgtagttacatgatgttaaattccctttcctttgctgtggccgcatgtttccatactcctaaataatgtgcgaaactggtgtcgatgttattagagctcctctttcagcggaaacatgagagaggaaattttatgttgcc

SEQ ID NO: 2931 - DNA, 1026 bp, Triticum aestivum
  Clone ID: PAT_TA_2931
cccacgcgtccgcccacgcgtccgacgagagagagggagagagagaggagcagttagttgagacccgaggcggagatggatctgctggagaggagcgcagccactattaaggcggagcagggggaggcccagcgcaaggaagccgagaggaaggagcaggagcaggagcaggagcacaaggagcaggagacccagcagccagggctcaccggccgacccccgctcgccaacggcaggtctggaatgttgcgaatgtcgagccctccagcaaatccgggacagcttaccattttttatggtgggtcagtatgtgtgtatgactcagtgccaccagagaaggctcaagcaatcatgctcattgcagcagcagcagctgcggcctcaaaaagcaatggcaccactgctgttaagcctccagcgatgtctgcgaccaatgctatccaagccatgcttacgcggtcgctctcactccagagcacttctgtagcaaatggacaacctcaggctgtcgcggatcctggctcgatttgcaagcttcaggctgatcttcccatcgccaggagacactcccttcagcgcttcctggagaagcgccgtgacagggtggtgagcaaagctcccttacggcgccgggaagccatccgaaggcatgggagcatcttctgggatggaagtggtcgcggagggcaaggcccagtaaccatgaaagaagaaagacggccctgcccctgatgtttggaaggaaaggggcgtgtgttagctgatgtgatgttacaccgtagaaccatcatcgttcgtgacgataataatgatccgaccagaacctctattgtcattgttctgttgtcattgtgtagtttactctgtatctgaacttgttttggtctgcggaaccgtactgctatgatgaatgtgtcgatgatgtaaatcgtggctgtcgtgcctgtctgactgatacattgttatcgtagtcgataaatgatatcatctgtgccgtctccgtttcaaatgttcccaaaaaaaaaa

SEQ ID NO: 2932 - DNA, 1449 bp, Triticum aestivum
  unsure (1)..(1449): unsure at all n locations
  Clone ID: PAT_TA_2932
tgccgcttggttaagggaacggaacccaccggagccgtagcgaaagcgagtcttaatagggcgattgtcactgcttatggacccgaacctgggtgatctatccatgaccaggatgaagcttggatgaaactaagcagaggtccgaaccgactgatgttgaagaatcagcggatgagttgtggttaggggtgaaatgccactcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggccagtgagacgatgggggataagcttcatcgtcgagagggaaacagcccggatcaccagctaaggcccctaaatgaccgctcagtgataaaggaggtgggggtgcaaagacagccaggaggtttgcctagaagcagccaccctttaaagagtgcgtaatagctcactgatcgagcgcccttgcgctgaagatgaacggggctaagccgatctgcccgaagctgttgggatgtcaaaatgcatccggtaggggagccgttccgccttaagagggaagcaacccgcgaaagcgggggtccgacgaaagcggaagccgagaatgtcggctttgagtaacgaaaacattggattgggatttggattcagggtggtggcactagacccaaatttctcaaagcttagttttgattcaattataatgtcttatgggagatcaaagagtagagctatatttcttgactatgatggtacattggtgccacaggcttctctctaccagaaaccaagtgaagaattagtaagcatcattaataccctatgctcggataagaacaacatcgtctttattgtcagtggaagaagcaagaatagcttgggatcaatgttctcctcatgtccaattctaggcatcgcggcagagcatggttatttcttaaggtggactagagatgaagaatgggcattgttgctccaaaaacaccactgtttgcatgtactgtggggcagaaaccgagcaaagccaagttctatctggacgatacatatgaagtagtcagtatgctgagtgcactagcagaagtttcagaaccagacccaacggcaggcttgacagatgacctggctacatcagtctcctcattagacatcaagtgatgaacaaatacaggnttcagtaatacaaggataggaaaggatcttagcctgggaactgaatctgcatactnnatgatgctctgactcactanaactattttcctttgatcgnaaggggtggnagaaccaagggggccaaattgacccacagcaagggcaaaaactatctttacaggtcacaatcattaaatttcttggactcatgattcat

SEQ ID NO: 2933 - DNA, 613 bp, Triticum aestivum
  Clone ID: PAT_TA_2933
agtacgggccttggggagagcagcagcaggaggcgggtatccagcacacagctcaaattaagcctcgagatggctaagtagtcacaactgaccacaagatggcgtcgctggccagggctgcccgtctcctggtggtcgcgttgctggtcgtcttctccgctgctatcacgggctgccacggagttcacagggagatcagcggtcgacccgggtcaatcccaagcacaccgcgtggtatcattccccgtccccacattccgattccatgtggccgcggactatttcgatgcccaccgccgccacgcggtgtcggtgcacctccccctcacccggacaatggagggcagccttgatgcatgcaagctagctaattcttccacgtacggccaaagtcaactatatatattcgcaataatatgcgctcgatcgggtacttgataataaaacttgagtatggccctgctctcatgtgggtgtgcacttaaatttttgtttggaactttgggtgtgaacttaattagttacaacgtgtaatcaataaaactgcttccgttcagaatcataataaaaaatactctttttatagcaaaaaaaaaaaaaaaaaaggccccta

SEQ ID NO: 2934 - DNA, 655 bp, Triticum aestivum
  Clone ID: PAT_TA_2934
ctatggacgccctaaggtgggtcacatctcgcttgtgcaaatatttgagctgacttcaatagctaatcgtcaagatagcacggatagcagaaggcaaatcagaatccacagtaaatcagagtggaatcaggcaacaaaagggtgggagaataacataacagaacatcatcgcaccaagtacaaagataatccttgactaaacagccaatggaactgaatccaaagtatcgtctaaactgcgaaatcccagatgattcactaggacaaaacactagtagcaacttatgcttcagtctgctccctcaaacgacggatagtgctcctgacagtgaccgcactggcagtgttcatagtgtaagcaccgccagccttcaccttcccacagtccttgcatccccaaattccaactgctttcctcttcacagcaaacttcccacagaactcacagaagtacttggagtgctgagacacctccatcttcttgatctgcttacgcaaactggcaccataacgggtaccatatttgccgacaataccagccttcttggtgcgcttcgtcatctcgtcgacgggtaggaggcgtgggcggtgagcggctgcggcggcgaaatccgggagacgaaagctgcggcggcggagacagggaattgtggag

SEQ ID NO: 2935 - DNA, 872 bp, Triticum aestivum
  Clone ID: PAT_TA_2935
ttttcagagcaaccaaaaagtggatataatactcgaacagccggaaaggtccagcatctctgagaaataagttctggtgggctaatgctcaaatatctgaaactgttttagcatataaggaccactcgcaatcacaaggataacatcaaccttaacaaatccttactccatgttggtaacaaaaacatcaaggaggcaacaaacactgccaacaaaggtacttgagaagaactacaactaagattcttggacgaatgcagccactccgttagcttagatagctttccttggtgcgacgacgttgtcagcctccttcttcactggctcttccttctctgacaagatcagctcaatgtggcaggggttggacatgtaaggattgatgcgtccatgagcacggtatgtacggcgcctctgcttttgggcttggttcacctggatgtgtgaaatgtagaggttgtcgacgtccaagcctttaacctcagcgttactctcagcattcttcagcaaatccaacacgaactgggctgactttgcaggccagcgaccctgcccatttggctggcggttctttacttgcgcagtacgacccacacctctgcagtatctccggaagggaatcgcttgcttgtgggcgagaacatcctcaaggtacctcttagccttgcccaaaggcatcctgcgaagagcaaacgctgtctcgcgtgtgttcttgaagtggaccctgagatccttgccacaggccttggccgacttggtcgggttggacggatccctcgagtacttcaccatggcggcggcggtggggttgcggccggagaggagggatgggagggtgagtgctggcccggacgcgtgggcggacgcgtggg

SEQ ID NO: 2936 - DNA, 1258 bp, Triticum aestivum
  unsure (1)..(1258): unsure at all n locations
  Clone ID: PAT_TA_2936
ctcttagctcgaanttaaccctactaaagggaacaaaagctggagctccaccgcggtggcggccgctctagaactagtggatcccccgggctgcaggaattcggcaccagcacaactagagcacaagcatcaaatccaagtaggtagtagttaacgcaaatccaccatgaagaccttactcatccaaacaatcctcgtgatggcaataaccatcgccaccgccaatatgcaggtcgaccctagcggccaagtaccatggccacaacaacaaccattcccgcagcctcaccaaccattctcccagcaaccgcaacaaacatttccccaaccccaacaaacattcccccatcaaccacaacaacaattttcccagcctcagcaaccacaacaacaatttatccagccccaacaaccattcccccaacaaccacaacaaacatatccccagcgaccacaacaaccattcccccagactcaacaaccccaacaaccatttccccaagtctcaagcaaccacaacaaccttttccccagccccaacaacaattcccgcagccccaacaaccacaacaatcattcccccaacaacaaccatcgttgattcaacaatctctacaacaacagttgaacccatgcaagaatttcctcttgcaacaatgcaaacctgtgtccttggtgtcatccctctggtcaatgatcttgccacgaagcgattgccaggtgatgcggcaacaatgttgccaacaactagcacaaattcctcaagcaactcccagtgtgcagccatccatagcatcgtggcattccatcatcatgcagcaagaacaacaaagaacaacgacagggtgtgcaaatcctggtgccactgtctcaacagcaacaggtaggtcaaggtactctccgtccaaggtcagggcatcatccaacctcaacaaccaagctcaattggaggtgattaggtcattggtgttgcaaactcttgcaaccatgtgcaacgtgtatgtcccaccttactgctccaccatcagggcaccatttgccagcatagtcgccggcattggtggccaatgaaaaaaaagcaagagctatactaaaaggtagataggtcaacgttgcttagcttatgcaccaatcgatgtaacgatgacaaataaagtggcgtgcaccatcatgtgtgaccccgaccaagtgctagttcaagattgggaataaaagacaaacaaagttcttgtttgctaaaaaaaaaaaaaaaaaaaaa

SEQ ID NO: 2937 - DNA, 918 bp, Triticum aestivum
  Clone ID: PAT_TA_2937
agattcagagcaactaaaaagtggatataatactcaaagtgaagagcccgaaggaccagcatctctgagaaataagttctggtgtgctaatgctcaaatatctgaaactgttttagcatataaagaccactcgcaatcacaaggatagcatcaaccttaacaaatccttactcaatgttggtaacaaaaacatcaaggaggcaacaaacactgccaacaaaggtacttgagaagaactacaactaagactgttggacgaatgcatccattccggtagcttagatagctttccttggtgcgacgacgttatcagcctccttcttcacaggctcttccttctctgacaagatcagctcaatgtggcaggggttggacatgtaaggattgatgcgtccgtgagcacggtatgtacggcgcctctgcttttgggcttggttcacctggatgtgtgaaatgtagaggttgtcgacgtccaagcctttaacctcagcgttactctcagcattcttcagcaaatccaacacgaactgggccgactttgcaggccagcgaccctgcccatttggctggcggttctttacttgcgcagtacgacccacacctctgcagtatctccggaagggaatcgcttgcttgtgggcgagaacatcctcaaggtacctcttagccttgcccaaaggcatcctgcgaagagcaaacgctgtctcgcgtgtgttcttgaagtggaccctgagatccttgccacaggccttggccgacttggtcgggttggacggatccctcgagtacttcaccatggcggcggcggtggggttgcggccggagaggagggatgggagggtgagtgctggccttggcacgaactcttccaacaggggaaaaactgaggcggcggcggaggtccccgaaccggccggc

SEQ ID NO: 2938 - DNA, 1165 bp, Triticum aestivum
  Clone ID: PAT_TA_2938
cgtccgcggacgcgtggggccgccgctcctcccccttcgcctcgctgccctcaccgagctccatggcggcgccggagacctccgcctgcggcgcgggccccgcgctcctcttcccgtcgtcgtcctcctcctcctcgtccgcgcgggtggaggccgtcgtcgtattcaccatctgcgacagcttcgtgcgccggcccgaccaggcggagcgcgtcatcggcaccctcctcggctccgtcctccccgacggcaccgtccacgtccgcaacgcctacgtcgtcccccacagcgagtccgccgaccaggttgctctcgacattgagtaccaccacaacatgtatgcgtcgcaccagaaggtgaaccccaaggaagtgcttgtgggatggttctccactggctttggtgtttcagggggtagtacgcttatccacgaattttattcaagagaagtacagagccctattcatcttactgttgacactggcttcaccatgggggaggcttccatcaaagcctatgtctcatccaacctgtctcttggagataggcaccttgctgcacaatttcaggaaattcctctggagttgaagatgcttgatgcagaaaaagttggatttgaaatgctgaaatctacgatggtggagaagctccccaatgatttggaaggaatggagtcttcaatgcaaaagctatatgctcttattgacgagatctacaaatatgttgatgatgttgtcgaagctcgtgtggcaccggacaacaagataggcaggttcattgctgacaccgtctcctccatgccaaagctgtctccagcatcttttgacaggctcttcaatgacaagattcaggacaatcttgcgctggtatacctgtcaagcatcacacggactcagatcgcggtcgccgagaagctgaacaccgccgcccaagtcctgtgatttccatgtgtcgtttgtgtagcttccaactccatgccgtctgtgcttggttttcgtttgctcgaatgagagatcagaatatgttgtcagaatatgcatttttgtacttgttatccaagttctaaagaaaagaattctccgcgcttgagatcctaatgtttgcactaatgtgggcccagacctttccattggatttagtacagtactagtactttgtttctggc

SEQ ID NO: 2939 - DNA, 1418 bp, Triticum aestivum
  unsure (1)..(1418): unsure at all n locations
  Clone ID: PAT_TA_2939
cacacctagagcacaaatcagcaaatccaagtacgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaagcattcccccaacaaccacaacaaccattccctcagactcaacaaccacaacaaccatttccccagcaaccacaacaaccatttccccagcaaccacaacaaccattcccccagactcaacaaccacaacaaccatttccccagcaaccacaacaaccattcccccagactcaacaaccacaacaaccatttccccagttccagcaaccacaccaaccttttcaccagccccaacaacaattcccgcagccccaacaaccgcaacaatcattcccccagcaacaacgaccgttcattcagccatatccacaacaacgtttgaacccatgcaagaatatcctcttgcaacaatgcaaacctgcgtcattggtgtcatccctctggtcgataatctggccacaaagcgattgccaagtgatgcagcaacaatgctgccaagaactagcacagattcctcagcagctccagtgcgcagccatccatagcgtcgtgcattccatcatcgtgcagcagcaagcaacaacaacaacaacaacaacaacaacaacaacaacaaggcatgcatatcctgctgccactatctcaacaacaacagttgggtcaaggtactctcgtccaaggccagggcatcatcccaacctcaacaactagctcaattggaggcgatcaggtcattgggtgttgcaaactcttccaaccatgtgcaacgtgtatgtcccacctgagtgctccatcatcagggcaccatttgccagcatagtcgcggggattggtggccaatgaaaaaagcaagatctatactaatagatagatggatcatcgttacttagcagatgcaccaatcgatgtaacgatgacaaataaagtggcgtgcaccatcatgtgtgaccccgaccagtgctagttcaagcttgggaataaaagacaaacagagttcttgtttgccagcaaaaaaaaaaaaaaaaaactcgagactagttctctcctcgtgccgaattcctgcagcccgggggatccactagttctagagcggccgccaccgcggtggagctccagcttttgttccctttagtgagggttgtttcgagcanggggtatcaaaactgctnctnggg

SEQ ID NO: 2940 - DNA, 1417 bp, Triticum aestivum
  unsure (1)..(1417): unsure at all n locations
  Clone ID: PAT_TA_2940
agcaaatccaagtacgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttgcccaaccccaacaaacatttccccatcaaccacaacaacaagttccccagcctcagcaaccacaacaaccattcccccagactcaacagccacaacaaccatttccccagcaaccacaacaaccattcccccagactcaacagccacaacaaccatttccccagcaaccacaacaaccatttccccagcaatcacaacaaccattcccccagactcaacaaccacaacaaccatttccccagcaaccacaacaaccattcccccagactcaacaaccacaacaaccatttccccagttccagcaaccacaccaaccttttccccagccccaacaacaattcccgcagccccaacaaccgcaacaatcattcccccagcaacaacgaccgttcattcagccatctctacaacaacgtttgaacccatgcaagaatatcctcttgcaacaatgcaaacctgcgtcattggtgtcatccctctggtcgataatctggccacaaagcgattgccaagtgatgcagcaacaatgctgccaagaactagcacagattcctcagcagctccagtgcgcagccatccatagcgtcgtgcattccatcatcgtgcagcagcagcaacaacaacaacaacaacaacaacaacaacaaggcatgcatatcctgctgccactatctcaacaacaacagttgggtcaaggtactctcgtccaaggccagggcatcatccaacctcagcaactagctcaattggaggcgatcaggtcattggtgttgcaaactcttccaaccatgtgcaacgtgtatgtcccacctgagtgctccatcatcagggcaccatttgccagcatcagggcatcatcagggcaccatttgccagcatagtcgcggggattggtggccaatgaaaaaagcaagatctatactaatagatagatggatcatcgttacttagcagatgcaccaatcgatgtaacgatgacaaataaagtggcgtgcaccatcatgtgtgaccccgaccagtgctagttcaagcttgggaataaaagacaaacagagttcttgtttgccagcattgcttgtcattgttccattcaccatgtatttagatgttcatccctaaccgcagttctaggcttacacatcaacagctagttgcttgtgccggcaggttcctatgtaatctaccgattaaggtnacctattaatccagtttataggccgat

SEQ ID NO: 2941 - DNA, 680 bp, Triticum aestivum
  Clone ID: PAT_TA_2941
gtcctgtcaggtggggagttgatctaacacaaccatcatatccatatccagcccaacaaatggcgcctctcaaggtgactgttgccatgtgtgtcgtgctggtcctgatgatccagctgcaggcgccggcggctgcgcaggagataccatgcgaccagtgcgggccgggatgcgcccaggcgtgcaatgcgcagggcccctacttctgcaacagcttctgcaacatctttcccaccctgtgcaactactgcttcctcatccaatccggcttgtgcattcccgagtgcgcaaacctctgcagggtcaactgcgagtgatcgaccatgcaggaacgcatcgacatgcatggattcgagggtgtcgatgagcgtgcctgcgttgccattgttatattagctgctctatgtacaataagtcgatgccggtcaggctgcatgcatgtattgcgtgcgagtgcctcgacttagcatttgataccgtgtttaatttgctactattcccttcactcaacatattacatattaccatgttgtgcatccaatgcatttatgttgtacgcccaccatttggttatgaaaaagactcgtttggaaaatcacatatctaccaaggcaaagttcaggttgcacctacttgtgtatagttcatctggaaaggtcaaatgttctcttgtttggaag

SEQ ID NO: 2942 - DNA, 654 bp, Triticum aestivum
  Clone ID: PAT_TA_2942
gggaaccttatcatataagattgacttggggtgcagaggggtagagagtgagagacgtgtcacaaaaatacaaataggttggcataacgcataacaggcagctgtagggacatactttcaagtttcaaagatcctaaaatcagaaccaaaattactaacagatatccatcgctcgatagccaaaatacagagattgttaagtcttcactccactacagaacccctggattcctcaagacaacagtagggcaatcatgcttcggtctgctccctcaagcgacggatcgtgctcctgacggtgactgcactagcagtgttcatggtataggcgccgccagccttgaccttgccacagtccttgcatccccaaattccaacagctttcctcttcacagcaaacttcccacagaattcacagaagtacttggagtgctgagacacctccatcttcttgatctgcttacgcaaactggcaccatacctggtaccatacttcccgacgattccggccttcttggtgcgcttcgtcatctcggcggcgggtagcaggaggcggctgcggcggcgtaggcggggagatggcggcgcgcgtgccgattcggcacgaggggacgaccagcggcagcaacgccgacgcggctccggctccgagtc

SEQ ID NO: 2943 - DNA, 1045 bp, Triticum aestivum
  Clone ID: PAT_TA_2943
cgagagagagggagagaggagcagttagttgagaacctgagacccgaggcggagatggatctgctggagaggagcgccactattaaggccgaggcgggggaggcccagcggaaggaagcggagaggaaggagcagcagcaggagcaggagacccagcagcaaggccaaggactcaccgccagacccccgctcgccaacggcaggtctggaatgttgccaatgtcgagccctccagcaaatccaggacagcttaccattttttatggtgggtcagtatgtgtgtatgactcagtgccaccagagaaggctcaagcaatcatgctcattgcagcagcagcagctgcggcctcaaaaagcaatggcaccgctgctgttaagcctccagcgatgtctgcgaccaatgctatccaagccatgcttacgcggtcgctctcacttcagagcacttctgtagcaaatggacaacctcaggctgtcgcggatcctggctcgatttgcaagcttcaggctgatcttcccatcgccaggagacactcccttcagcgcttcctggagaagcgccgtgacagggtggtgagcaaagctccttacggcgccgggaaaccgtccgaaggcatgggagcatcttctgggatggaagcggttgcggagggcaaggcccagtaaccctgaaagaagaaagacggccctgcccctgatgtttggaaggaaaggggcgtgtgttagctgatgtaatgttacaccgtagaatcatcgttcgtgacgataataatgatccgaccagaactcctctagtatcattgttctgttgtcattgtgtagtttactctgtatctgaactttgttttactcagcgaaaccgtactgctatgatgaatgtgtcgatgtaaatcgtggctgtcgtgcctgtctgactgatacattgttcatgtagtcgatgaatgatagcacctgtgtcgtctcagtttcaaaaaaaataagaaactaaaacaataaagaaaagaaaaaaaaaaaaaaaaaactcaaaaacaattacataacactt

SEQ ID NO: 2944 - DNA, 744 bp, Triticum aestivum
  Clone ID: PAT_TA_2944
atcctgacggtcaagtcaagtaaattttctcttcaaaacatttccagtttatatgaacaacagctagtctatgcaaatagacgcgcaaatgcacaggctgccctgctagttcatcgaataacagatgacaatagcattaagattcaagaatcaacgacacgcacaaagagtacagtcagacgatcatctaagcaacataaacgagatacacattgtaacgtagccagatactctcagaacccaacaagccgataaataacattgtatgctgtcaatttaggctacattgcgtcgaatgagtctcgtctgaactacaaaatccaaaggctcctttgtcagattgaccgcgatcaagcttcagtctgctccctcaggcgacggatcgtgctcctgacagtgaccgcacttgcagtgttcatggtataggcaccaccggccttaaccttcccgcagtccttgcatccccagattccgactgctttcctcttcacggcaaacttgccgcagaactcacagaagtacttggagtgctgggagacctccatcttcttgatctgcttacgcagactggcaccgtacctggtaccatatttgccaacgattccagccttcttggtgcgcttcgtcatctcttcggcgaggaggaggcgtccgcgacaacgggcggcggcggcggcggcggcggcaaagagggcagggaggcggcggcggcgccggacgcgtgggcggacgcgtgggcggacg

SEQ ID NO: 2945 - DNA, 942 bp, Triticum aestivum
  Clone ID: PAT_TA_2945
gaattcactagtgattagcgtggtcgcggccgaggtctagtctcgagtttttttttttttttaagagcaactaaaaagtggatataatactcaaagtgaacatcccgaaagggaccagcatctctgagaaataagttctgatgggctaatgctcaaatatctgaaactgttttagcatataaagaccactcgcgatcacaaggatagcatcaaccttaacaaatccttactccatgttggtaacaaaaacatcaaggaggcaacaaacactgccaacaaagatacttgagaagaactacaactaagattcttggacgaatgcagccactccgttagcttagatagctttccttggtgcgacgacgttgtcagcctccttcttcacaggctcttccttctctgacaagatcagctcaatgtggcaggggttggacatgtaaggattgatgcgtccatgagcacggtatgtacggcgcctctgcttttgggcttggttcacctggatgtgtgaaatgtagaggttgtcgacgtccaagcctttaacctcagcgttactctcagcattcttcagcaaatccaacacgaactgggccgactttgcaggccagcgaccctgcccatttggctggtggttctttacttgcgcggtacgacccacacctctgcagtatctccggaagggaatcgcttgcttgtgagcgagaacatcctcaaggtacctcttagccttgcccaaaggcatcctgcgaagagcaaacgctgtctcgcgtgtgttcttgaagtggaccctgagatccttgccacaggccttggccgacttggtcgggttggacggatccctcgagtacttcaccatggcggcggcggcgggggttgcggccggagaggagggatgggagggtgagtgctggccttggcacgaactcttccaacatttggaat

SEQ ID NO: 2946 - DNA, 828 bp, Triticum aestivum
  Clone ID: PAT_TA_2946
attcggcacgaggccattcccccagcaaccccaacaaccatttccccagccccaacaaccaatccccgtgcaaccacaacaatcattcccccaacaatcccaacaatcacaacaaccttttgcccagccccaacaattatttcctgaactccaacaaccaattccccagcaaccacaacaaccattccccctgcaaccgcaacaaccattcccccagcaaccgcaacaaccattcccccagcaaccgcaacaatcatttccccagcaaccacaacaaccattcccccagcaaccgcaacaaccattcccccaacaaccacaacaaccattccctcaacaaccacaacaaccattccccctacgaccgcaacaaccatttccccagcaaccccaacaatcacaacaatcatttccccagccccaaccccagcaaccccaacaaccatccatccttcaaccacaacaaccattaccccaacaaccacaacaaccatttcaacagccccaacaacaattatcccagcaaccagaacaaacaatttcccagcaaccccaacaaccattccccccagcaaccacaccaacctcaacaaccatatccacaacaacaaccatatgggagtagtcttacaagcatcggtggccaatgaaatgaacacctgtaatacaagacggatggatcatcgttgtttagtcaatgagcgttcaatgtaacgatgataaataaagtgatgtgcaccataatgtgtaaccccgacctatactagttcaaacatgggaataaaagacaaagaaagttcttgtcacaaaaaaaaaaaaaaaaaaaaa

SEQ ID NO: 2947 - DNA, 764 bp, Triticum aestivum
  Clone ID: PAT_TA_2947
ttcggcacgagggcgctttcctccctctcgcgccgccgccgccgctgccgccacctccgcaggcagcccaccgcgaagcgaggtcgaatcagccatggcagacgccaaggccacgacggcggtcaccctccgcacccgcaagttcatgaccaaccgcctgctcgcccgtaagcagttcgtgctcgaggtcatccacccgggccgcgccaacgtctccaaggcggagctgaaggagaggctcgccaaggtgtacgaggtgaaggaccccaactgcatcttcgtcttcaagttccgcacccacttcggaggcggcaagtcctccggattcggtctcatctacgacaacctcgagtccgccaagaagttcgagcccaagtaccgcctcatcaggaatggccttgctaccaaggtagagaagtcacgcaagcagatcaaggaaaggaagaacaggacaaagaagatccgtggtgtgaagaagaccaaggccggagatgccaagaagaaataagaacatttctgtcttcatcttttcactatcagcctttgcttggtttaggacggtatccctgtggcaatgttgctgagtgcttaattatgactagaaaagactatgccatttgtgtcatctcccgctatgttaagaggcattttgtagtatcttatgctaagattttgaagaacttggtcagactatctcatatacacctgttgtcgttgttcttggtttcggccattaatcagtcaaaatgcattgtgtgctttac

SEQ ID NO: 2948 - DNA, 1587 bp, Triticum aestivum
  Clone ID: PAT_TA_2948
accattttcacagcaacaacaaataccagttattcatccatctgttttgcagcagctaaacccatgcaaggtattcctccagcagcagtgcatccctgtggcaatgcagcgatgtcttgctaggtcacaaatgttgcagcagagcatttgccatgtgatgcagcaacaatgttgccagcagttgcggcaaatccccgagcaatcccgccatgagtgaatccgtgcatcatccatccttcacacacctagagcacaaatcagcaaatccaagtacgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaagcattcccccaacaaccacaacaaccattccctcagactcaacaaccacaacaaccatttccccagcaaccacaacaaccattcccccagactcaacagccacaacaaccatttccccagcaaccacaacaaccatttccccagcaatcacaacaaccattcccccagactcaacaaccacaacaaccatttccccagcaaccacaacaaccattcccccagactcaacaaccacaacaaccatttccccagttccagcaaccacaccaaccttttccccagccccaacaacaattcccgcagccccaacaaccgcaacaatcattcccccagcaacaacgaccgttcattcagccatctctacaacaacgtttgaacccatgcaagaatatcctcttgcaacaatgcaaacctgcgtcattggtgtcatccctctggtcgataatctggccacaaagcgattgccaagtgatgcagcaacaatgctgccaagaactagcacagattcctcagcagctccagtgcgcagccatccatagcgtcgtgcattccatcatcgtgcagcagcagcagcaacaacaacaacaacaacaacaacaaggcatgcatatcctgctgccactatctcaacaacaacagttgggtcaaggtactctcgtccaaggccagggcatcatccaacctcagcaactagctcaattggaggcgatcaggtcattggtgttgcaaactcttccaaccatgtgcaacgtgtatgtcccacctgagtgctccatcatcagggcaccatttgccagcatagtcgcggggattggtggccaatgaaaaaagcaagatctatactaatagatagatggatcatcgttacttagcagatgcaccaatcgatgtaacgatgacaaataaagtggcgtgcaccatcatgtgtgaccccgaccagtgctagttcaagcttgggaataaaagacaaacagagttcttgtttgccagcattgcttgtcattgttccattccccatgtatttagatgttcatccctccccgc

SEQ ID NO: 2949 - DNA, 1587 bp, Triticum aestivum
  Clone ID: PAT_TA_2949
aacttgagaaaagtttcatcagtttttcatttggatcaacgaccaataaaatatggtcaaatatcacattcctctcactgggacaaggtttacctcaatctaaggttcaaaattgacagcaggatacatcataagacatcggcggttaacaagacaacgcaacgcccaacaaccccagccctatctgtacatatacgtggtgacaatctatagtcctgcacccaagacgagatgtatgtgctcaaaggtacagtcaacactgcatggttaggaacctcttggcagccacaagaatcaagcaagcctccagcatttcccataatttcatgacaatgcgctttccatgagctcaaggaaaccagggggtgacattggcggcaccgcttcttcctggacatcaatcatttccagaatctttcttgcagttgcttgagaattgtcattaccgccttctttcaaggttgtggactgagcggctgttacattggtgtggatagactcattgttttcaagaccaatgtttgctttagggtgtgcttttgcagaagttactgcatcgatgaagatgccagattccttgagaccacgaataatagccattggtgcatatatgcgtgttaaaacgcccttcctcaaaagcttcaaatttgtatctttgtcagtccatacaacatgttcccggtaccagttcctcatctcttgctcggtagctgttgatgcaattatgaaggccaatctgtcaaactccaagataaaacatcgtttcacatcctcctttgttggcttacagccacacctatcccttcttgaagttaagtccgagaactttgtgtaagtgtaatgcagaatagcagcctcctccaacttaatttcattcggggatttcatgtaattatgccatctatgagcaccattcggacgcatatgctcctggacccttgtgttcaaagagttcaaaatcttatcatataaattgacttggtgtgtggaggggtagagagtgagagacgtgtcacaaaaatagaaataggttggcataacacataacaggcaactgtagggacatacttccaagtttcaaagatcctaaaatcagaaccaaaattactaacagatatccatcgctcgatagccaaaatacagagattgttaagtcttcactccactacagaacccctggattactcaagataacagtagtgcaatcatgcttcggtctgctccctcaagcgacggatcgtgctcctgacggtgactgcactagcagtgttcatggtataggcgccgcctgccttgaccttgccacagtccttgcatccccaaattccaacagctttcctcttcacagcaaacttcccacagaattcacagaagtacttggagtgctgagacacctccatcttcttgatctgcttacgcaaactggcaccgtacctggtaccatacttcccgacgattccggccttcttggtgcgctttgtcatctcggcggcgggtacgcaggaggcggctgctgcagcgtaggcggagagatggcggcgcccacgcgtccgcccacgcgtccgcccacgcgtccgcggacgcgcc

SEQ ID NO: 2950 - DNA, 792 bp, Triticum aestivum
  unsure (1)..(792): unsure at all n locations
  Clone ID: PAT_TA_2950
tcctctcgcgccgccgcagccgccacctcctccgcaggcagcccaccgcgaagcgaggtcgaataagccatggcagacgccaaggccacgacggcggtcaccctccgcacccgcaagttcatgaccaaccgcctgctcgcccgcaagcagttcgtgctcgaggtcatccaccccggccgcgccaacgtctccaaggcggagctgaaggagaggctggccaaggtgtacgaggtgaaggaccccaactgcatcttcgtgttcaagttccgcacccacttcggaggcggcaagtcctccggattcggtctcatctacgacaacctcgaatctgccaagaagttcgagcccaagtaccgcctcatcaggaacggccttgctaccaaggtagagaagtcacgcaagcagatcaaggaaaggaagaacaggacaaagaagatccgtggtgtgaagaagaccaaggccggagatgccaagaagaaataagaacatttctgtcttcatctattcactatcagcctttgcttggtttaggacggtatccctgtggcaatgttgctgagtgcttaattatgactagaaaagactttgccatttgtgtcaatctcccgttatgttaagagggcattttgtagtatcttatgctaagattttgaggaacttggtcagactatctcatatacacctgctgtcgttgttcttggtttcggccattaagcagtcaaaatgcattgtgtggtttatttaccccttgaatgtttctatgttgaagtggatcacanaagaaaaaaaaaa

SEQ ID NO: 2951 - DNA, 882 bp, Triticum aestivum
  Clone ID: PAT_TA_2951
aaccctactaaagggaacaaaagctggagctccaccgcggtggcggccgctctagaactagtggatcccccgggctgcaggattcggcaccagccgctttcctccccctcgcgccgccgccgccgccgccacctcctccgcagtcagcccaccgcgaagcgaggtcgaatcagccatggcggacgccaagaccaccacggcggtcaccctccgcacccgcaagttcatgaccaaccgcctgctcgcccgcaagcagttcgtgctcgaggtcatccaccccggccgcgccaacgtctccaaggcggagctcaaggagaggctcgccaaggtgtacgaggtcaaggaccccaactgcatcttcgtgttcaagttccgcacccacttcggaggcggcaagtcctccgggtttggtctcatctacgacaacctcgagtccgccaagaagttcgagcccaagtaccgcctcatcaggaacggtcttgctacaaaggtggagaagtcacgaaagcagatcaaggaaaggaaaaacaggaccaagaagatccgtggtgtgaagaagaccaaggccggagatgcgaagaagaagtaagggcctgtccttggtttaggacggtatccctgttgcaatgttgctgagtgcttaattataactagaaaagactttatcatttatgtcatctcctggtatgttaagaggcattttgtagtatcttatgctatgattttgaggaacttgttatacacctggttgtcgttgttcttggtttcggctgttgatcagtcaaaattcattgtgggttattttccccttgaatgtttccatgttgcgcaatggaatgatttcttacgagcaaaaaaaaaaaaaaaaaagccccctaggaa

SEQ ID NO: 2952 - DNA, 1858 bp, Triticum aestivum
  Clone ID: PAT_TA_2952
ccggccgggtttggatccacacacacacacacacacacacacacacacagcctaagcccactcttctcagagcagagcctctcccttcaccttcgtcttccttcctctcggcagttcgacctttgcatggcagcagtggctagctccaaggggcgggtgatcgctgggagcctcgtcgcgcgcgtcctcgccggcaaggccaacgcctccccgaggagggcggtgcacgcgtcggcctacgacaagaacgtggacgagcaggtgcgcccggccttcgtgccggacgatgtgatcggcggcgccgggagcccagacaagtactggggccctcacccgaccaccggcgtcttcggcccggccgcggtcgaccccaagctggccgccagcctcgcgccggctgctggcgccgcgaatggtggcgcctccgtgctggaccagaaggtgtggttccgcccgctcgaggacgtcgagaagccccccgtcgcctgatcgccaacgacgacgaccatagcccagctctacatctctatcactccgcttagctgggctcgacttcctacttataattacatataatctgtagtggtgtgctcgtgctatagtacagacatggcaggcaccagaaccaatagtagtaacgcggtgttgctgcccggaataagagcgagcaggagatgtgtgatgatgatgatgatgacagtgatgttggtggctgtgatgtactcccgtcttgaaccagtaatattgcaagtgtaacacaaccatcatatccatatccagcccaacaaatggcgcctctcaaggtgactgttgccatgtgtgtcgtgctggtcctgatgatccagctgcaggcgccggcggctgcgcaggagataccatgcgaccagtgcgggccgggatgcgcccaggcgtgcaatgcgcagggcccctacttctgcaacagcttctgcaacatctttcccaccctgtgcaactactgcttcctcatccaatccggcttgtgcattcccgagtgcgcaaacctctgcagggtcaactgcgagtgatcgaccatgcaggaacgcatcgacatgcatggattcgagggtgtcgatgagcgtgcctgcgttgccattgttatattagctgctctatgtacaataagtcgatgccggtcaggctgcatgcatgtattgcgtgcgagtgcctcgacttagcatttgataccgtgtttaatttgctactattcccttcactcaacatattacatattaccatgttgtgcatccaatgcatttatgttgtacgcccaccatttggttatgaaaaagactcgtttggaaaaaaaaaaaaaaaaaaaaaaaaaaaaaaccccaaccatcatatccatatccagcccaacaaatggcgcctctcaaggtgactgttgccatgtgtgtcgtgctggtcctgatgatccagctgcaggcgccggcggctgcgcaggagataccatgcgaccagtgcgggccgggatgcgcccaggcgtgcaatgcgcagggcccctacttctgcaacagcttctgcaacatctttcccaccctgtgcaactactgcttcctcatccaatccggcttgtgcattcccgagtgcgcaaacctctgcagggtcaactgcgagtgatcgaccatgcaggaacgcatcgacatgcatggattcgagggtgtcgatgagcgtgcctgcgttgccattgttatattagctgctctatgtacaataagtcgatgccggtcaggctgcatgcatgtattgcgtgcgagtgcctcgacttagcatttgataccgtgtttaatttgctactattcccttcactcaaaaaaaaaaaaaaaaaaggccccta

SEQ ID NO: 2953 - DNA, 2563 bp, Triticum aestivum
  Clone ID: PAT_TA_2953
aacaccaaagacaagtgagcaatagtaaatacaaatcaaacatgaagaccttcatcatatttgtcctccttgccatgacaatgaacaacgccagtgccactaggcaactaagccctataggcaaggaattgcatacacaacaacaacaattcccccaaccacaacaattccctcaaccacaacaaatcccccaacaacaactcccccaacaacatcaaatccccccaagcaatcacaacaattcccccaacaacaatatcccccaaccacaataactccccccaggcaacaattccctcaacagcagcaattcccgcaacaacaacaattcccccaacaacaatttccccaatagcaattcccgcaatagaaattcccacaacaacaacaattcccgcaacaacaaatcccccagcaaccacaacaactcccccaacaacaacaaatcccccagcaaccacaacaatttccccaacaacaacaattcccccagcaacaatcaccccaacaacagcaatttccccaacaacaattcgccccaacaacaacaattaccgcaaaaacaattcccccaaccacaacaaataccccaacaacaacaaatcccccagcaaccacaacaattcccccagcaacaattcccccaacaacagcaatttccccaacaacaagaattcccccaacagcaattcccgcaacaacaattccaccaacaacaattaccgcaacaacaatttccccaacaacaattcccccaacaacaattcccccaacaacaacagttcccccaacaacaacaattaacgcaacaacaattcccccggccacaacaataccctgaacaacaacaattcccccaacaacaattcccccagcaaccaccacaacaattcccccaacaacaatttccaataccatacccaccccagcaatcacaagaaccttccccatacaaacaatatccacaacaacaaccatgctgggagcgacgttataagtatcagtggcagatgaaatgaagagatgtaatactagacgggtgaatcatcgttgttagtcaatggagcataatgtaacgatgataaataaagtgatgtgcaccatcatgtgtaaccccgacctgtactagtcccaaacatgggaagaaaactttgacctccacccgattctcgtcgatcgaaagacatccccgattccccacccacccaccgagccctaaccctaaccccggctaccgaagatgccggcgacggcggggcgcgttcgcatgccggcgaacaaccgcgtgcacagcagcgcggcgctgcagacgcacggcatctggcagagcgccatcggctacgacccctacgcccccgagaacaacaacaagcagcaggccccctcctcctccgtctccgccaacgccgcagccgccgcagccaacgccgccgccgaagccgccgcgcctccctcctccgaccccggcgcctcctcggagaacgcctacaccagcttccagggcctcctcgccgctcgcccgcgtcactggatccaactccgacgagacccggggcgcctgcaagaagtgcggccgtgttggccatctcaccttccagtgccgcaacttcctttctgtcaaggagcttgccatggacgacgacatccaagctggcatgctgtccgccgcgcaggccaaggccaagttcgaggagatcacgaagaaagcctctggtgccagagacgctgacgaggagggttctgacgaggaagatgaggatgagattgacagcgattcctctgattccgatattgatcccgagctggagaagataattgctgaacgggagcgtgccaaaagccgtggagggaagcggtcaggggaggaggacaagaagacaagccgccataggagcaagagcaggggaagatcgaagcacaggatgagcaggaagagtgacagtgaggacgattcggaggaggagagaactaaggacaagaagaagaataggcggaagaagcacagatcctcagatgaggatagcgagagtgactctgacaggaagatgcacaggaagagtaggaaagataggaagaggcggaggacccaccgccggaaggatgattcatcagatgatgatgaatctggaggggaagggaggaggcatcaccgccaccacaagaggcgtcatcaccggagggatgcatctggtagtgacagtgatggcagtgaacccccacatggaagaaagcgatccagcaagaagaagagccacaagaggtcagaaagtcatgtattgggtgaggatgagcgacattgtccgcaaggggcaagccgctctggagaggaagagtaaggagcataagaggggctaaagaggagcgctgaagcggtaaattgcactcatcgatgattgcaacagtgcttatcctttgttatttgtcttgtcaaatggttgttgcattttaagcatgattcttaatatgtgtaacatatttgtgtattactgcttgtcagtggctgaaccatccatatatgcataaatggtgttgccttgaaaaaaaaaaaaaaaaaaaaaaaaaa

SEQ ID NO: 2954 - DNA, 1267 bp, Triticum aestivum
  Clone ID: PAT_TA_2954
tttccctcactaaagggaacaaaagctggagctccaccgcggtggcggccgctctagaactagtggatcccccgggctgcaggaattcggcacgagcacaactagagcacaagcatcaaatccaagtaggtagtagttaacgcaaatccaccatgaagaccttactcatcctgacaatccttgcgatggcaataaccatcgccaccgccaatatgcaggtcgaccctagcggccaagtacaatggccgcaacaacaaccattcctgcagcctcaccaaccattctcccagcaaccacaacaaatatttccccaaccccaacaaacattcccccatcaaccacaacaacaatttccccagcctcagcaaccacaacaacaatttctccagccccgacaaccattcccccaacaaccacaacaaccatatccccagcaaccacagcaaccgttcccccagactcaacaaccccaacaaccatttccccagtccaagcaaccacaacaaccttttccccagccccaacaaccgcaacaatcattcccccaacaacaaccatcgttgattcaacaatctctacaacaacagttgaacccatgcaagaatttcctcttgcagcaatgcaaacctgtgtccttggtgtcatccctctgggtcaatcatcttgccaccaaggcgattgccaggtgatgcggcaacaatgttgtcaacaactagcacaaattcctcaagcaactccaagtgtgcagccatgccatagcgtcgtgcattccatcatcatgcaagcaagaacaacaaggaacaactacagggtggtgcaaatcctgggtgccactgtctcaacaagcaacaggtgggtcaaggtattctcgtccagggtcaaggcatcatccaacctcaacaaccagctcaattggaggtgatcaggtcattggtgttgcaaactcttccaaccatgtgcaacgtgtatgtcccaccttactgctccaccttcagggcaccatttgctagcatagtcgccaagcattggtggccaatgaaaaaaaagcaagagctattctaaaaaggttagatggccatcgttgcttagcttatgcaccaatcgatggtaaccgatggacaaataaagtgggcgtgcaccatcatgtgtgatcctgcaccaagtgctagttcaagattggaaataaaagacaaactcagtccttgtttgccagcattgcctgtcattgttccattccatgtgtatttagatgtctgtccctaatcat

SEQ ID NO: 2955 - DNA, 1498 bp, Triticum aestivum
  Clone ID: PAT_TA_2955
gagagagagagagagagagagagagagagagagagagagagagagagagagagagagagagagagagagagagagagagagagagagagagcacacacacacacacacacaagcgaaacccactccacccaaccgtctcggagcagagcagagcctctctttgtccttcaccttcgtcttcctccctctcggcagctcgacctttgcatggcagcagtggctagctccaaggggcgggtgatcgctgggagcctcgtcgcgcgcgtcctcgccggcaaggccaacgcctccccgaggagggcggtgcacgcgtcggcctacgacaagaacgtggacgagcaggtgcgcccggccttcgtgccggacgatgtgatcggcggcgccgggagcccagacaagtactggggccctcaccccaccaccggcgtcttcggccccgccgcggtcgaccccaagctggccgccaccctcgcgccggccagcgccgccgcgaatggtggcgcctccgtgctggatcagaaggtgtggttccgcccgctcgaggacgtcgagaagccccccgtcgcctgatcgccggcgaccaccaagacgacgatagcccagctcgacatctctatcactccgcttagctgggctcgaccacccacctaattataatctacagtagtgtgcttgtgctatagtacagacatggcaggcaccagaaccagtagtagtattgcggtgttgctgcctggaataagagcgagcagaagatgtgtgatgatgatgatgacactgatgttggtggctgtgatgtactcccgtcttaaaccggtactattgcaagtgtttggtaaaaatggcaccgctgctgttaagcctccagcgatgtctgcgaccaatgcgatccaagccatgcttacgcggtcgctctcactccagagcacttctgtagcaaatggacaacctcaggctgttgcggatccgggctcgatttgcaagcttcaggctgatcttcccatcgccaggagacactcccttcagcgcttcctggagaagcgccgtgacagggtggtgagcaaagctccttacggcgccgggaagccattcgaaggcatgggagcatcttctgggatggaagcggtcgcggagggcaaggcccagtaaccctgaaagaagaaagacggccctgcccctgatgtttggaaggaaaggggcgtgtgttagctgatgtgatgttacaccgtagaatcatcatcgttcgtgacgataataatgatccgacgagaacctctattgtcattgttctgttgtcattgtgtagtttactctgtatctgaactcggtttagtctgcggaaccgtactgctatgatgaatgtgtcgatgtaaatcgtggctgtcgtgcctgtctgactgatacattgttatcgtagtcgataaatgatatcatctgtgtcgtctctgtttcgaatgttcccggttggtttggaaaaaaaaaaaaaaaaaaactcgag

SEQ ID NO: 2956 - DNA, 1371 bp, Triticum aestivum
  unsure (1)..(1371): unsure at all n locations
  Clone ID: PAT_TA_2956
gaaaatgcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcagcagcagcaacaacaacaacaacaaggcatgcatatctttctgccactatctcagcagcaacaggtgggtcaaggttctctagtccaaggccagggcatcatccaaccacaacaaccagctcaattggaggcgatcagatcattggtgttgcaaactcttccatccatgtgcaacgtgtatgtcccacctgagtgctccatcatgagggcaccatttgccagcatagtcgcgggcattggtggccaatgaaaaactgaagagctatactaataggtagatggatcatcgttgcttagctgatgcaccaatcgatgtaacgatgacaaataaagtggagtgcaccatcatgtgtgacaccggccagtgctagttcaagcttgggaataaaagacaaacaaagttcttgtttgccagcattacttgtcaaaaaaaaaaaaaaaaaaaaaaaaaaaaaaaaaaaaaaaaaaaaaaaaaaaaaaaaaaaaaaaaaaaaaaaaaaaaaaagggggnnnngatataaaaaaaaaaaaataaaggggggggccgttttaaagaatcaaattttatatacgggggcttggaaagaataacttttttt

SEQ ID NO: 2957 - DNA, 846 bp, Triticum aestivum
  Clone ID: PAT_TA_2957
ctcgtccccgcctcgccccgaggcgccgcgccccccgcccccccgccgcccccctcgcccgccccgcccgccgccccgcccccctccccgccccgcccggccgccggcgcagcctcggcgccgcgccccgccgcccccggcccctccgcgccggtggtcaccagcccccccggccccggcggtcgggttgtcgatgggcggcctatttctgatatgggtaatgatgatgaagtgccagtatcaggaagaaagcggcctgtccgagagaggctaggaaataatgtgactgattctgatttgtatggaagccagcagagtaacaaaagacggcaaacagaaagcagtagctcacagcttggagatgatggtttggttcgccagattggcagggatgatttaaggctgaagcttatgaggaaaggcttgacacagaagagcaacagtgaggcagaacagaatggagtggatctccgtgaaaagctttccaggaagtcgaagaaactccagggatatgaggcaagaaggggtgatccagaatcaaggtctagttatgatgagggagaaatcccagaatcaggatctggatatggtttgagggggagagtcccagagtcaagagcctctactcttgtaagccaagtgccttcttcaaggaatgcagatgggttgttcaagttggagccttcaggaaaaccttatccctcgtggaccgatgattgtttgaggtatacgtccccagacaagcttccaagtgttcgaagagacatgactcccccaagaagtgttcgaagaggcatctctcccccgagggccattcggagaggcatgtctcctccgataaatgct

SEQ ID NO: 2958 - DNA, 1954 bp, Triticum aestivum
  unsure (1)..(1954): unsure at all n locations
  Clone ID: PAT_TA_2958
tcgacccacgcgtccgattctttcctcctcccgtcgatccgatccgatccagttcaatctcgttttcatcgcgatcacaccacaggtcgccgccattgttgccgttgcttgcaagtagcagcaaaccttacgccggggcaagtcaagaggaagatccacgagagagaccacagccacagccacgaccacacctgccccattgcctgccgcgagcgcgcaaagcctttttaatcgagcaccaccaccaccgcatccacaagaaacaaacaaagcgagaaagcgaggtgcatttcgtttgtgcgcgccctgctctggggtgtatattaaactggtgtttgggtgtgctctgcagctccgttaaatcccatttcgcccgggaagccaagccgcacgccgcggccccgagctagcagcttctctcctctcttttttcttttctctcaccgccccccacccagcaactccatctcctcctctacctgctgctgctcgccgccctcgctccactaccaccgcgctagctcggctagtacaccgaacgccatccatccaacaaacaaggtgcagttatcgttgtgtttcttctcgggagagcggcaggcaatggcggccgtcggcaggctgccgggcgcggcggcggccctgctgctcgcgctgctctgcctggcggggacgtcggcggcgaccaacgtgacgtacgaccaccgtgcgttggtcatcgacggcgtgcgccgcgtgctcgtctccggctccatccactacccgcggagcacccccgacatgtggtccggggctgatgcagaaggccaaggacggcgggctggacatggtagacacgtacgtcttccgggacgtccacgagcccgtccggggacagtacgacttcgagggcaggaatgacctggtgaggttcgtcaaggccgccgccgacgccgggctctacgtgcacctcaggatcggcccctacgtctgcgccgagtggaactacggaggcttcccgctatggctgcacttcatcccggggatcaagttccgcaccgacaacgagcctttcaagacggagatgcagcggttcacggagaaggtggtggcgacgatgaagggcgcggggctgtacgcgtcgcagggcgggcccatcatcctgtcgcagatcgagaacgagtacggcaacatcgacgcgtcctacggcgcgcccggcaagtcgtacatccgctgggccgccgggatggccgtcgcgctcgacaccggcgtgccctgggtcatgtgccagcaggccgacgcgccggcgcccctgatcaacacgtgcaacgggttctactgcgaccagttcacgccgagcctgcccagcagtcccaagctgtggaccgagaactggagcggctggttcctctccttcggcggcgccgtgccctaccgccccaccgaggacctcgccttcgccgtcgcccgcttctaccagcgcggcggcaccctgcagaactactacatgtaccacggcgggaccaacttcggccgcagctcgggagggcccttcatctccacgagctacgactacgacgcccccatcgacgagtacgggctagtgaggcagccaaagtggggccacttgagggatgtccacaaggcgataaagatgtgcgagcctgcactcatagcaaccgatccatcatacatgtcccttggtcaaaatgctgaggcgcacgtatacaagaccggttcactgtgcgccgcattcctcgccaatatagacaatcagtctgacaagactgtcaccttcaacggcaaggcgtataaactccctgcgtggtccgtcagcatccttcctgactgcacgaatgtggtgctgaacactgcccagatcaactctcnnntagcatctacacagatgagnaacctggggttcagcactcaagcgtcagnnnnntcgtccgtcgaagcagaactcgcttcttcn

SEQ ID NO: 2959 - DNA, 257 bp, Triticum aestivum
  Clone ID: PAT_TA_2959
tttgttacatctagcggatttggatttctttaacaactaaggttcctgttacatttaagccaggcttgccattcatagctacagactttttttttttacaaatccaacctttactagacttttgttttactacttacctaagctttaccttttatattgataccctttttttttttaacacatcaccaagttacgccactagtctattatcgaaatgcaactaactctaacacttttgcgtcaacctccctttacca

SEQ ID NO: 2960 - DNA, 690 bp, Triticum aestivum
  Clone ID: PAT_TA_2960
gaagaccaaattaaccatggcgaccctgccgcccaggtcgggagctttctccaagggctataagttggcctacgcctgggacaaggaggcgccgctcacggggcagcagaacgccgccatctccgcgctctcgcacgccctcgccgcccggctgttcccggctaatctgcaagatgcagacaacgactctgctttcaaggaggccggtgcagtggatgcggccttggtgaacacacatcagttctacaaatggtttgttcaactagaatctgccatgaaatccgagattgacgaaaagtatcgcctctatgagagtacattacaggaacatgttaacacatgtgatggtatccttcgacaagtggatgacacactcaacttgtttgaacaagtacaatccttgcactcgagagctgccataagaatacaaactttgcatgatgcttgcgaccaacttttgatggacaaacaaaggcttgttgggtttgctgaagcactccgaagccatccatctgagatccaacgtgccacgtcaaaattttctagttttgcgcgtttagctcagtttctactatagtcttcccctgctgaagcgcgtaggtcaaactatttttatgaattggaaaatgtaagatctggcatgcataaatatgtgcatgcgtgtgtgatgcttagaattgtttttcaaac

SEQ ID NO: 2961 - DNA, 547 bp, Triticum aestivum
  Clone ID: PAT_TA_2961
gacctcttcccgcacctagcaaatgggtaagccaagaaaggtccaactgacgattgcacatgagcgacaagaaatgctgtgtgctattcaacgagatcgattctacctcaagcgcccagatcccaatgacagctcgtcgacatgtccaccacgttgagtcgcccatggccccgaatgcaaccccgtcgacatggctggtccgtgtgccggtactgcgatccggacttgtccattcgaccatccagtctcgcctcctcgtcgggcttagagcttcgcgtgaccctgcacaggtggcccttcaagctgtcagccacagcgagcggattgagatcctcgtctcgacgtgctcccttcgtagacacggtgtcgtcaacctgagagcgaatgcaaacggtggaagcgggagggccctttacaagaccatcacagcccaatgcaggacgttgcacatgaccccgagagcgttagcacgggctaggcagtttacaccctaagatgtcattcgcgattgttcgtgcttgcgcgatccgtactactgcgctaccgg

SEQ ID NO: 2962 - DNA, 655 bp, Triticum aestivum
  Clone ID: PAT_TA_2962
gtaaccccagtgccgacacgctcaaccgcctccggggtgaagtcagtgagatacacaccgtcatggttgacaacatagagaagattctggacagaggcgaccgcatctcgcttcttgtagacaagacctccacaatgcaggacagcggttttcacttccgcaagcaatccaagaggcttcggagagctctctggatgaagaatgtcaagcggccgcccgggctggcgggggtcattgtgctgctactttacctgatcattgctgctttctgcggaggcctatcccttccatcgtgcagatcatagaacactagctctacacctccatacatgatgttccaagttcggctcagcttccagagctaaaaccttatgttttggtcaacagattcgcagttgagttctcggtagattgtttttgctcatacaagtcgatatgaaatgtttgtacaaaaaccgggtccgtgtgtacagtatgaaatgtcgtttgtgcttcctttgggtatgttgtggcactagttaagagttgctcggtgcactggttcgtcgaaattattactgatgtatagtacctccatttctggaaaagatgtgaacactgaccaaagcatatttcataaatattctctttttgcttaaaaaaaaaaaaaaaaaaa

SEQ ID NO: 2963 - DNA, 1224 bp, Triticum aestivum
  Clone ID: PAT_TA_2963
gccccgcgaggaaactggctccgtcccccgcgcgaccaaaagcttcaggaggcggcggcggcggcggcggtcggcggcgcaggtattagttaatcatggtgttcagcaaggtggaagtgaacctgaaaggctgcttgaggcggccccccgccagcagaatcaggctaagcttgtccattacataaccacagccagggagctgttggagcagcttggagctgaaattacaccagaaggaatatcaagtatttcaaaagctaagctgagtgagtattcagaaaagattgaagcactagctgccacgcttgcttctctagtgccagaaaatgaaaatctggttgatcagagtagagagcaagacaactcttatgaaagagaaagagaaaaggttgggagtccaatatccttatcatcaggattgcgaaggagatcgacggctcagatggaggttggaccaagcagtcatgaaagaaaagaaaaagacactggagcacctattaaattggatgcagaagctcaggctcatattgagaagcataggaagctgcaagaagatctaactgacgaaatggttgacttagcacgccagctgaaggagagtagccttttaatgaaccaatccgtgcaagatacagagaagatcctcgattccaccgagagagccgtggagcatagcctggcgagcaccggccgtgcaacggcgcgagcctcggaggtctactcgctggcctccaagacaacctgcttccagtggttgctcatctttctgatgacctgcatgtttgtcatggtggttctgctcatacggatcacctgatgtcgccatggcgtgtcaccagtggccgctaagatagtactgccgtcttgtaaacagtccttgtacgaagataaacttgaacctgtgttccagaggagcattgttgctcaacatcattatgcagtttgctgaagatggagcatagcttggcgagcaccggcagcgcaacggggcgagcctttgaggtgtactcgctggcctccaagacaacctgcttgccagtggttgctcatttttctgatgaccggcatgtttgtcatggtggttatgctcaaacgggtcacctgatgtcgttcgctgcgacccctgaaaacggtgtcatcagtagccgttaagattgaacaatcttcctaaatgacccttctgaacaaaaacacgaaccattttccgaaatgagcatgcttccc

SEQ ID NO: 2964 - DNA, 1377 bp, Triticum aestivum
  Clone ID: PAT_TA_2964
gcgcccccccgctcttcgcttggccgccggcgccgggcggctggcgccgggggccggacgaaggcggcagaggagagatcaccggatggcgtagcccccgctcacttcccgttcgttgaggcagcagggcagccccttcctgctctagctcgacacgcttccctcgtgggctctcagtcggacggcgaccctcaagctccacacccctgtggccctgtaaccctcaagctcgacgcccagatcccctgcggccaagcccttctacccgtgagtcaagtctcggtgcggctgctctgcttcccagctgctccttcaatccggcttcggcagctcacttctcaccacggttcagcacctcaacaagatattagttagtcatggtgtacagcaaggtggaagttaacttgagaaggctgcttcaggcggccacccgccaacagaatcaggctaagatagtcaattacataactaatagcgagaaagttgatggagaaacttggagcttaaattacaccagaaggaatatcaagtgtttcaaaagctaagctcagtgagtattcagaaaagattgaagcactagctgccatgcttgaatcactaatgccagagaataaaaatctggttgatgagagtcgagaaaaagacagctcttatgaaagagaaaaggacgggggtccaatatgcttatcatccggactgcagaggagatcgacggctcaaagggccttttgaccaagcacacagagatgaaaaaaaagctaacctggaaaagcgattaagttggacgcaggagcgctggcagtcattgggaactgaacgaagccgcgcaaacggcagacgccggaatagcttcacttaacacagcagctgagcatgactcgcccattaatgagcgagtcccgtgcaagacacaagagagatcctctctggcacggaaagagccgtgctacatatcctggcgagtccttgtcgtgccacgccgcgaggcccggggggctcctcgctggcctccaacccgacctccttccggtggttccccagctgtctaatgacctgcatggctgtcatggaggttctgctcgtacggagcaactgatgtcggtggccatgggatgacaccagttgcccctaagatagttgcgaagtcttgtagacggtccttgtatgaagataaacttgaacccgtgttccagaggagcattgtagctcgacccttctccctagccctatctttggtagcaaaacgtaaacgagagagactgccttgtcccccctgagacgtgttgttgttcatgatgtttgtttcactggagactggaaccgcgaggccaccttttgcctgaatgctggacgtagccctgtggttgcttcacgcca

SEQ ID NO: 2965 - DNA, 444 bp, Triticum aestivum
  Clone ID: PAT_TA_2965
ctaacactttgttacatctagcggatttggatttctttaacaactaagtcctgtttacatttaagccagctttgccatctcatagctacagactctttttttttacaaatccaacctttactaacttttgttttactacttacctaagttttaccttttatattgatacccctttttttttctttaaacacatcacccaagatagcgcccctagtctattatcgaaatgcaactaactctgaacacttttgtgacaacctaaccttaacactatcgatagactacaacctacagattgggtgaagaagtagtggtgggaacgttatagaagagtctgataaaaggcaaagataaaatcagtttacgtctatcaattggcactaatagatatagtaatgtggaggtaaatacgggcagtacacactgtagttttttaatatgttc

SEQ ID NO: 2966 - DNA, 595 bp, Triticum aestivum
  unsure (1)..(595): unsure at all n locations
  Clone ID: PAT_TA_2966
tcggcatcatcgagcacgtagcgtccgcgctcggagctgacaccaatgccgtccggagaaagaacctccacagcgtcgagagcctcaggaagttctacggcgacgccgcgggggacgccccgacgtacagcctcatcgacatcttcgacaagctggcctcgtcaccggagtaccggagcagggcggaggcagttgaacggttcaacggcgggaacaggtggaagaagcgcggcatttcgtgcgtgccgatcacctacgaggtggccctccggccgacgcctgggaaggtgtccatcctgaacgacggctccatcgctgtggaggtcggcggcgtggagctcgggcaagggctgtataccaaggtgaagcagatgacggcgttcgggctgcgggagctctgtcccgacgccgacgggctgctcgacaaggtgcgcgtcattcaggccgacacgctgagcttgatccagggcagcttcaccggtgggagcaccacctccgagagcagctgcgaggcggtccgtcagtcgtgcaccgtgctcttcgacgcctcaagccatcaaagatatctcaagggggggcccggtaccaattcncc

SEQ ID NO: 2967 - DNA, 945 bp, Triticum aestivum
  Clone ID: PAT_TA_2967
gtcgtctcaccgaacttgttatctggagtttcgaagtgaaaagatttgggttcaaccagaacgctcaaaagtgcttcgcaacattaggggctcatccctgcccacccgggtcgtgcacccattaccctccgaaaacgcccgtcacgtggcaatccccccatcgcaatctccacggacaggcgctggccacgctaactggctggggctccccccccccgccaaggctatgggctcctgtgctcgccaaactgcggcttgtggatttggacaatcttcctgaagaatgtgatgttgcttggacaatgttccttcttgaagctgcaccatacctagaggagctttccatcacagtatgggatcataagtgccaaaaggagtcacaaaagagtcactccaggaaaacggatgtgaagtgggaaccatctgatcctgattttaagcagaagaatctggcaaggctaactatctacggcttccagtccgatgacaatttcatcggatacattagacgcgtcattcaagctgctgcgaacatcagggaggtatccctgcacgacaggaaggtgtgcccattttgtttcgaaaagtttcctcatgcggctgttcgtccttcgagttatccacggaccagcaaggaggtggatttgttgaggaagaagatgacaacagcgtcggcgacggcttctcctgatattcacttccgctcatgaggttgagttgaagatgaatctcgttggaaggactccccaatctcaaagactatgtcaatgctatcgtttttctgcaaaaatgtttcaccgctaccaatttgttggaacaactcatttagctattttggccaatgaaatggctaaaataagcacatctatgttgtgacattgctgtacgtgctcgtgcttatgttgaattcagtgaatattcagtactatgaatgatgctctgtta

SEQ ID NO: 2968 - DNA, 586 bp, Triticum aestivum
  Clone ID: PAT_TA_2968
gctcccgttcttgtttcccctccgtcggctgctgaccggattcgcctcacaggctcgggatccgggcgttccgcgcgatgggcggcggcggcggcggcggcgcggaggaggaggagctgacggcgcaggagacagcgctctacgaccgccagatccgcgtctggggcgtcgatgcccagaagaggctaagtaaggcgcatgtgcttgtgtgcggcgtgaacggtactactattgagttctgcaagaatattgttctagcaggagttggcagtttatccttgatggacgatcacatagtcacagaggatgatctcaattcaaacttcctaattcctcatgatgagagtgtgtatggtggtagatcacgggcagaggtttgctgcgagtccttaaaagatttcaatccaatggtccgagttgctgtcgcaataggtgatccatcactaattgatggaacattcattgacaggttcgacatcattgtactcagctgcgcatctcttaaaacaaaggtgtttattaatgacaactgccggaagagaagcaagcatattgccttttactctgtagactgcaggattcttgt

SEQ ID NO: 2969 - DNA, 1405 bp, Triticum aestivum
  Clone ID: PAT_TA_2969
ataccttcccaacctcctcctttccgcccagtctggtgtcccctcggccgctgcccgaccgggttggcttacccagtccccggctccgggccgggctcgcggcgcacggcggggtgggcggcggcgcgggcgaggcggagcggggggagcggacggcgccgcggtccggacgcgaagcccgcggcgcaggcgtcggggccctacaaccgccaaataagcctcttgggcgtcgatgccccgtggacggtaagaaaggtgcacgtgcttaggtgcggcgtcaacgttgtttcgattgagttctccaagtacactgttctagcgggagtaggcacaattatcattgattcacgttaaaatgcccacatccgattgtctaaagtgagaattcctgttaactcctgacctgggtgtgcttcgaggtatttcaaggttacagtccaattgtccgatgcgcaattggaaacagtgcctcattacgtattgatggtacaatcgttgaccggttcggcattaatgtagtcatccgcgcatctcttaagacaaagttgtttattaatgccaactgccagaaaagaagcttgcatattgccttctactctgtaagcagcaaggatttttgctgttaaatatttgttgatatgcagaatcatagctatcttctgatggagccgggaggagaaagctaacatcagaagaagcctggaggagaacctgaacagcaggagtttaaatatcctagtctgcaggaagcaaattctgtgtactggaaactacgccatgagagacttagaaaattatgatacgtcagaagggcctgagacaggtgagactccactttatgatctgcctgcggtttgagctctgattatggtgatagaatgtctttggatcgggggcgagtttcgaattcttacgtgtctccgggaacggcttctagcagcaaggaacatcctccagtatgtgcaatccttggtgccaggcggcatccttgggcaataagtgatccattcaatacattctaaaggacgaagcgttcaagaatttattatacttcgaagggcgatcggatcaaggatcatcttttacttccgccgaacgcctgatggtaaaggggccttagacgacacccccccaactcctgaagaatgaatcacgtgatacctaactctcatccgacatgtcttgctgataattgtacccaatcattagagtcgaacatgtgtcaactctagttcagtggctgaggctggaaacttaactcagcatgttagcgtatctaataatgtacttggcgttcgttttagcgttggcatcatgctatggcacctgcgtactgcaatgaccagaactgacattctcgtccaaagaatttcaaagctaatggcagccaaaaaaaaaaaaaaaa

SEQ ID NO: 2970 - DNA, 1099 bp, Triticum aestivum
  Clone ID: PAT_TA_2970
cggacgcgtgggtttgatcaatcacttccaagggcctttctgggggagggggttgcttgatagtacaaatgtagttacagtatgatgattactttaatttgagcatcaaactcagaattaatcatagtctagttgtagtcatcttgctgtctattcgattcaatactcactttagaaccaagtcgcggccgcgtcgcctggccggtttcccccctcctattggtcgtgctctggcgaggggttcgcctcgcctccccgcgatgcctgctctgcgcatttctgggccgtccgctcggctcctgcctcgtagtgcaccctctgttgtgcctctttctgcttgggcacttgcctcaagccgctgcctccgcacgccatagattacacccactcggctcttcggaatagtgcgatcccccgtagtcctttgccggtccttgtttttgttttacatttcttccactcgcaaccttttgaaggcaataaattagagtctctggtgcgcttcttattatagcgtaattcagcgctgtacgttgccgagatgaacgtgtgggctaagattctggcagaagccattctttgagatggcttttgcattcaacttgtccatacatatcttagcactgaactgaattttgtttggataggggtattagtgatgccatgaggtatctgatgcttggtcttctttcatggccttgtttctcgttagattggcaaacagtgggaaggaaacgggtttttgcgacactggctgctctcgtaccaggagcttcctgttactatacccccgtttacatcaatcctttggttcttttgttctcaatgatgatcaacactgattagatgtccgattcaatccattcaaaaaccatggggacgaaatgaggcatttgtctgagagaacatgttagtacttttgctctgtcgaaaacacttcttttcacatctgcctagttcttagttctccgtgatgatgaaaacagacgagtctgatgtaatcacctcaaattatatatttcgtgtactcctgctcctgcaaatggcactctagaagggaccattctccttgtcaaaaaaaaaaaaaaaaaggccccta

SEQ ID NO: 2971 - DNA, 710 bp, Triticum aestivum
  unsure (1)..(710): unsure at all n locations
  Clone ID: PAT_TA_2971
tttctctagaatattggctcttatgactataccatttacaatgcactttcccaaggcaattttctgttactgggtaacggcaaacttgttctctcttggcgagggttttgctctccggaagacagccgtaaggtatttcttgaatcttccggaggttgtaccacagcccgaagctgcgcaagtgtcgaccttcaaccttttcgaggcaccaaagccagtgtcagcagttgatacacccactggaaacaacggtgattcacccactggagacaacggtgattcacccaccgcagccaacgggtcagagcagtctaatgctgagctaagcgatcgggttgtgtttcttgagaagaagattgcagaacttgagaggcgggctaaagctagaggcgaatctcaagagtaataaactaacaggtaagttttgatcgagcacgtgaatcctatcctaaagaagcactgtttgtaacctgtgtctggtggcgaagggatatctggcaccgacttacccatatagcaccaagatttgacttggactatccaattttgtgagcatgtgtgtgtctgtgtgtgtgtgtgtggctgctgccgttgcgagcgaataaaccggggggatcctggcagaaaaaatcgccattgtttgttggattaaccgcagtgatgctggtcgagcagaaaccagagggtacctgcncnnggcggccgctcga

SEQ ID NO: 2972 - DNA, 1155 bp, Triticum aestivum
  Clone ID: PAT_TA_2972
actgcccacgcgtccgcacatcgctgcttccatcctcttccccctttccccacccgcgtgcgagcggccacccaagaccaaccgcgtccagatccggcggcggatctccccatggcggccggagccctgggcctggccctcgtcgcggcgctcgcggtcgcgctggcgggggccaactccgagggcgacgcgctctcggcgctgcgccgcagcctgcgggaccccggcggcgtgctgcagagctgggaccccaccctcgtcaacccctgcacctggttccacgtcacctgcgaccgcgacaaccgcgtcacccgcctagatcttggtaatttgaacttatctggtcatctggtgcccgagcttggtaaattggagcatttgcaatacctggaactttacaaaaataatattgaaggaacgatcccgtcggaacttggtgatttgaagaacctaattagcttggacttgtacaagaacaacgtttcggggactatacctccaacacttgggaagttgaagtcccttgtgttcttgcggctcaacggcaatcgtttgactggaccaattccaagggagctggccggaatatccagcctcaaagttgttgatgtttctggtaataatctgtgtggaacaattcccacgactggaccatttgagcacattcctctcagcaacttcgagaggaacccacgcttggaaggaccagaactacaaggcctggctgtatatgaaaccaactgctaaacggccacgggaaggtggaaaatgcttaggaagtaacgggcgtacaaggtttaccggagatcggggtgatatagattgttaggtccgcagtttgccactttgtaatgttcctccctacatagcgttgtcatgccatgtgtcatgtgtgccttgctctcagcagggaagttgagttgttgtatgttgtgtagcagaacgatgctttctgcctgtgaatgtaaaacataagattgcctatgtgtcacgactcaaatggtattgtcatctacccaaaaaaaaaatgtgaataaatgaaaaaattaaaatgattcttcaaaatacataaatgaaaaaactaaaaaaaaaaggggcggcccaaaggattcaagcctaagttagccttgatgccaagttaaaacccctccaaaa

SEQ ID NO: 2973 - DNA, 1224 bp, Triticum aestivum
  Clone ID: PAT_TA_2973
gccgccgggcagcttcctcctccgcagcttccacgcccctgcttccttccccccccctttccccacctgcgtgcgagcggccacccaccaccaaccgcgtccacgatccggcggccgatctctcccgcccgtctccccatggcggccggagccctggctcctggcccctcggtagcggcgctcgcggtcgcgctggcgggggcaaactccgacgggcgggcgcgctctcggcgctgcgccgccgcctgccgggaccccggcggcgtgctgcagagcttgggaccccaccctcgtcaacccccgcacccggttccacctcacctgcgaccgcgacaaccgtcgtcacccgcctagattttggtaaccttgaaatttatctggtcatctggttgcccggagcttggtaaattggaggcatttgcaatacaatggtaactttacaaaaattaaaaattgaatggtaacgattcccatcgggtaaacttgagaagatttgaaggaaggcccatttaacattggacaattttacaaggaacaatgtttcgggcgcaactggtaactccaaacactttgggaagttcaagtgcgttgtattctgtgcatcctcaacacaatcgttttgattgcaccaatccaagggagctggcggaatttccagcatcaaagaagtgttgtttatatttcataatctgagtgtccaattcgcacgactggtacccattgacgcgcactactctgagcgacttctccgaggcacacgcgctttgggaaggaccggagctaccaattggctggctgtatatgacatacaaatgctctggggtttcgggtgaaacgcaaaatgcttggacggatagggcgtacaagggttaccggagtcggggtaatatagagggttatgtcctcagcttggctctttgtaatgtaccttgctacgtacgcgcttttatggcatgacgttccttgctctctcccgggatagatgaggttgttgtacgttgtgtagtatcacgaggctttctctcctgcagggaagtaaaacataagattgccttgtgtagcagaacgatgctttctgcctgtgaatgtaaaacataagattgcctatgtgtcacgactcaaatggtattgtcatctactcatctctattatggcaatggcactttttgctaacttgcacgcgcaagacaccgttctgctcttcactaaggaagaccccactcg

SEQ ID NO: 2974 - DNA, 795 bp, Triticum aestivum
  Clone ID: PAT_TA_2974
agctccggtaagttttttccagtttttcattaagaatactggaggatatgccatatgtttaggtgctaatatttacatatggtgtacgtaataagttgtcttgctggccctttatgtgtatcgtttgaaaaaactacaggtccggaacatcatctttatccaaatatcttcagctataactgacatcccagcagcgcgtgggagccgatgtcttcggccagagctgggtctccttgccggcgaccttgccatcaccagcctatctgcagttttgcagggatggacatatggattgaatggtaccctcctgaaatctacacagatgtcagatatgagaaagaagaaatagggcaaaggaaattagatcggagaaagaagagatgaagaacaattttaattgaagagttgaagaagactaagcacgagtccccctaaagtgcttgaccaccggccggttgcagtggatgtcagcatcacctagctgtggccatcctgggcgccgagagaattagctgaaaatcttgctgagatccaggtcacgggtcattcccattcaggtggctatgaaacttgttcctaacgaagataaatttatggaggtggctagggaacaggaggagcaagtttagcctggcaggtgcttctcaggttcaatggtttccaacaagggagcgatattcatgctctgcatcaaggtcgtagtgctttcttcatgggttcggcctttgccattaaggtgaggaattgtaacacccggatgattaagcaacagtgatcacctcggttactgtggct

SEQ ID NO: 2975 - DNA, 825 bp, Triticum aestivum
  Clone ID: PAT_TA_2975
gcgtttccttctcgtcgtcggtcttcttcttatctcatccccgactccgacgagccccggcgaccgaccggcgagggatggcggcgacggcgacgaagctgagcagcggccacgagatgccggccgtggggctcggcgtctggcggatggactccgccgccgtccgcggcctcatccactccgccctccgcgccggctaccgccacttcgactgcgccgctgactacaaaaacgaggctgaggttggcgatgcgctcgcggaggcattcaaaactgggcttgtcaagagggaggatcttttcatcactaccaagttgtggaactcagatcacggccatgtggtcgaagcctgcaaggatagcctgaagaagctgcgattggattatctagatctctaccttattcacttccctgtagctactaagcatactggagtcggcacaactggcagtgctcttggtgatgatggcgtgcttgatatcgataccactatcacattggagacaacgtggcatgcaatggaagatcttgtttccatgggacttgttcgtagcatcggaattagcaactacgacatcttcctcaccagagactgcttggcctacgctaagataaagcccgcggtgaaccaaatcgagacacacccttacttccagcgcgactctcttgtgaagttctgccagaagcatggaatctctgtcaccgcacatacacccctgggcggctccactgccaacaccgaatggttcggctcggtctcatgcctcgacgatcctgtcatcaagtccctggctgagaaaacggcaagacgccggcccagctggt

SEQ ID NO: 2976 - DNA, 1400 bp, Triticum aestivum
  Clone ID: PAT_TA_2976
tgccggcccccgcggccgggtttccctctcctggtcgttctgcatttcgcgtccggggtgctgagtcgactgtagtgtactgcgtttcctcctcctagtcgcgctgctgcctatctcatccccgagtggcgaccagcccctgccggctgccggccacggctggcggcggcggcaaccagacgccgagcagcgcccactacatgccggccgtcgggctcggcgtctggcggatggacgccgccgtcgtccgcggcctgatgcagtccttcctaacgggccttgtcaggctagcggatcttttcgtctctagcccgctgactacctcaagatcacgctgatgtggttgaaatgtgcctggctagcggcgatacgctgcgaggggtttctcgaagaagctacgattttttcatcccgatcgctaccttgcacactgccctggggctactaggcatagcggatgtcgatcacaactggacacgtgctcttggtgatgttggcgtgcatgatatccataccactgttgccactgggcataccggagtttgcaatacaggatctggttttcatgatgatggtgtgcttgatatcgataccactatcagattggagacaaccgtggcatgcaatggaagatcttgtttcaatgggacttgttcgtagcatcggcaattagcaacttcgacatattcctcaccagagtgtgcttggcctacactaacataaagccccggggtcaaccaaatcgagacacgcccttacttccagcgccactctcttgtgaagttctgccacatgcatggaatctcttgcaccgcacacacacccctgggcggctgcactgccaacaccgaatggttcggctcggtctcatgcctcgacgatcctctcatcaagtccctggctgagaaatagggcaagacgccggcgcagcttgctccttcggtggggtcctccagaggaacaaggtggtaagacccaaggacctccgagctcgagatggccgcaccaagaactctgccgacttctgacgtcgacatctccctacgatggacatggcagaagttcatgcgccctcgaacgaaacaatcgcaccaaccagccggcctagttttggggcaccaatctctacgcttgattgccactgcatgatttgcttccctgacattacaaccaataatatgggagcttgtcattagcgtaaatgaactttgagttatagatgatatatttgcagcacaatttaccaggttaccattctctggtggttacgcaatgcgtaagccctctggcttggtacttttgcatcaggtagtacaggtatgggtgtgatcacaagttctctgggaagtgcagtaggttctttggaagagctcactgaattggtctactattgcctgtat

SEQ ID NO: 2977 - DNA, 1434 bp, Triticum aestivum
  Clone ID: PAT_TA_2977
ttgttgtgggcctattttggttgtgttctatgtaacatattgtccaagaaattggtggtccattatcacataggagacaatgtcaatgtcctagaagaccaaggatttttgaaacaaagtgagcaactacattttcccatcactcagccataaccataaagatcttgatgagagcagtgcatactaagaccactaaaaaagatagaacaagcaaactatgggagattagctgtacaacatttccttccagggagcccctatggtgccactgcagctgcagggtgtttgctatacagaagggccttctttcatcggcacaagctagcatctgttgctgaagatgcaaacagcaggctaagtccgatacacgatgtatccccatgacaagcaaagagcactctcaatccttaacatctgtgacgccttcaggtgatatctgaaaccttgcttcagcttcagccaggcagggagagctcaccaccttacagatccgctcctccgcccttcccttacggagataaagcctcgtcgtggaagcatgagccatgatgttccctccaatgggtttgatctgtggcccagcaaacattgcacccccatccacatgggccactacctggttggagattaccactgccaccccgaactcatccgctaatttctgtataaggctgtggcactatctataaccataagcgcaaaccttgtctccaccatcatggaagctgcttccagcagaagtcttgattgatgatcagtattatatgctctagcataagctacattctcaagtacatcagcaccattcagtccaaacctgtctgctatctggaggagtctttgtggtctgaatgtgccttctgcgtcaatataaagagcctttccttcaccaccaccttggtccagtgggagctgacatgtgacacagagagtatggcacaactgagtctttccagacctaaattcaccataaagctccgtgatagatcctgtttctattcctccctccaatattttatcaagttctcttgatcctgttgtaacttggataatctcgagcctctgcgcatgaagttgggtagcactagtaaatcccagtggaaccaacttcgaagctgcttcaattatcttatcgactttggcttcactaatccctttaattgcaaaagatctttccttggagagtaagctacagactccactgtgcaaagaccagcatctttgagctttttcacatcaactgcagctattccagatgcctggagttgctcgatggggaaaggcccgtgctccccggcctcctcctcctcgacgggagccgccgcggccgccttctggtgcgccgccgacgacgacatggggcccaccactcgaagagacagagagatgctcggggatgtgaggcttttctctctctctctctcttctgagcag

SEQ ID NO: 2978 - DNA, 715 bp, Triticum aestivum
  unsure (1)..(715): unsure at all n locations
  Clone ID: PAT_TA_2978
cccacgcgtccgaagggtgccgcagagaccctgaaattaatatggccctggtccttcttcctgtctgccgtaatacaatcacatggattcgatcaaagacaaagattggagctgttgtacccttcaatgacaacataaacttccataaggtaatagcagcgggtgttgcagttggtgttgctctgcatgcaggtgctcatctgacatgtgattttcctctcttgctccatgcaagtgatgcaaaatatgaaccaatgaagcctttctttggggacaaaaggccaccaaactactggtggtttgtaaaaggaactgcagggtggacaggtattgtcatggtagtgctcatgtcaatagcttttgtattagcccagccatggttccgacgtaacaagctcaaggacactaatccactcaagaagatgactggtttcaatgccttttggtttacgcaccacctatttgctattgtgtatgcactgctcatcgtccatggaacaagtttgtatctgacgaaggagtggtacaagaaatcgacatggatgtacatcgcttatcctgtcttcttatattcatgcgagcgcatnggnntcggttatttaggagccatnatgcagttaagattcagaagtttgcggtatatcctgggcatgtgttggctctttatatgtccaagccaactggttttagataccggagtgggcagtacatcttc

SEQ ID NO: 2979 - DNA, 2257 bp, Triticum aestivum
  Clone ID: PAT_TA_2979
cgacatggttgactcggctcctgggggaccctgcactgcagtggaggtcaaggagattatcgccctcagtgcatcagcaaacaaactttccaagatcaaggaagcgcgctgatgagtacgcagcactcatcatggaagagcttgaccctaagaacttgggctacatagagctcgagagcttggagtcgctcttactgcagacaccatctgaagccgttgcaagatcgaccatcacccacagctccaagctcagcaaagctcttagcatgaggctcgcgcctagcaaggacacaagcccgcttcgccactactggctgcagtttaccttctttgtacaggagaactggaagcgcatatgggtcgctgctctctggctctccatctgcatcgcccttttcatttggaagttcatccagtaccgtaaccgagctggtttcaacatcttgtggttttactcaccacctctttgctattgtgtatgccctgctcatcgttcaccctagaagtttgtatctgaccagaaatacggtaacttaaatcgacatggatgtacatcgcttatcctgtcttcctatattcatgcgagcgcattgttcggttatttaggagacatgattcagttaagattcagaaggttgcggtatatcctgggaatgtgttggctctttatatgtccaagccacctggtttcaaataccggagtgggcagtacatcttcataaattgcggcgctgtatctccatatgaatggcatccattttccgttacatcggcaccaggagataattacctcagtgtccacattcgcacaaggggtgattggacttctcgtcttaggactgtcttctctgaggcgtgtcgccctcccactgaaggagaaagtggactccttagagctgacctttccgtgggaatcactgacagcaacgcaagattccctaaacttatgatcgatggaccatatggtgctccggcacaagattaccgggaatacgatgtgctgctgctcatcggacttggcattggagctacccctttgatcagcattgtgaaggatgtgcttaaccacatccagcgcggggaatcggttggcggaacagagccggatggcagtggcaaggcaaagaagaaaccgttcatgaccaagagggcctactcctactgggtcacaagggaagagggctcctttgaatggttcagaggggtgatgaacgaggtggctgagaaggacaaggacggagtgattgagctccacaaccactgctcgagcgtgtaccaagagggcgatgctcgttccgcgctcatcgtcatgctccaggaactcaaccatgccaagaagggggttgatattctgtccgggaccagcgtcaagacccactttgccaggcctaactggcgaagcgtcttcaagcgtatcgcggtcaaccatgagaaccaacgcgtcggggttttctactgcggcgagcctgttcttgtggcgcagctgcggcagttgtcggcagacttcacccacaatacaaacacaaagtttgactttcacaaggagaatttctaattatatatactatatgtagctgatgtaagagcatgtctatgtatggtctgcaccataataaggtacagaaatagtattacaggttttgatgggtgatgaacgaggtggctgagaaggacaaggatcaagtgatcgagctccacaaccattgctcgagtgtgtatcaagagggcgatgctcgttccgcgctcattgtcatgctccaagaactccagcatgcaaagaagggagttgacatcttgtccggaaccagcgtcaagactcactttgccaggcctaattggcgaagcgtcttcaagcgtgtcgcggtcaaccatgagaaccagcgcgtcggggttttctattgtggtgagcctgttcttgtgccgcagctgcggcagttgtcggcagatttcacccacaagacaaacacaaagtttgagtttcacaaggagaacttctagtggtgtaacttgtataagaacatgtctatgccatgcttcatcaggtgaattatatgggttgtattattattatttgtaaaggtagggaattggactggttttgcctagtcctgtgctcagtcttgtttactctatgttgttaaggagtatacgaaatattaggtttaggaatcctattaggttatgtttcctttccttgtacccaagtcttctgtaagatatattttttttagagaaaaagggcctagccccggctcca

SEQ ID NO: 2980 - DNA, 1327 bp, Triticum aestivum
  Clone ID: PAT_TA_2980
cccacgcgtccgcccacgcgtccgctgcacttgaaaaggatcgatataagatccgccaagcttttgttgcagctccagggaactctcttgttgttgctgattatggccagctggagctgagaatcttagcccatcttactagttgtaaaagcatgctggatgctttcaaggctggtggtgactttcattctagaacagccatgaatatgtacgagcatgtacgtgatgctgttcacgaaaagaaagtacttcttgagtggcaacctcaaccaggtcaagagaagcctccagtgccattgttgaaggatgcttttggtgctgagagaaggaaggctaaaatgcttaatttctctattgcatatggaaagacagctcgtcgactatcccgtgattggcaggtgtctgtcaaggaggcaagggatacactcaaactctggtacagagatcgaaaagaagtttcagcttggcaaaagaggcagaaagagcttgctcgtgaaaaatgcgaagtatacacattgctaggacggtcacgccgctttcctaacatgactcacgcaccccatggtcaaaaaggtcatgttgatcgtgctgctataaatgcaccagtgcagggcagtgcagcagatgttgccatgtgtgcaatgcttgagatagaaagaaatgctcgccttaaggagcttggttggagactcctattacaggtgcacgatgaagtgatactggaggggcctacagaatctgctgaagcggccagggccatcgtggcagagtgcatgtccaaacccttctatggaaccaacatcctgaaggtggacctggctgttgacgccaagtgtggaaagagttggtatgacgccaagtagaagttgttctcgcatgcacggacacggcgggattgggctggtgtagatattgcagttccagtagcggcagaagcagtgcaagagcattgaataacggcagtggtggcacgaaggagttgcaatgcataggactccctccggtccatattcattgtctttgtagtaaatcagcgacaattaatatggataggagggagtagcagaaatttagcacgtcgattgaattggtttccagagtttaataggattttttggtctccagcgctcaataggatttgatgaggttccctaagtggaaacccctagggatcagactgctattgatccctagggtcccatcagaccagggcgtggccgttggattaaagctttgtggaatgttggatgcagggacccagttaattttggaagcgattgtgttgcaatacagaagcattcccaaaaaaaaaaaacccaaaaaaaat

SEQ ID NO: 2981 - DNA, 836 bp, Triticum aestivum
  unsure (1)..(836): unsure at all n locations
  Clone ID: PAT_TA_2981
taaaataaagtatgtcctgtgatagtttgggcgcaggcctgtatcatgaatacatactgctcacagtgcatttgcatgagaagcccttcacaagaaaaaactatacattcacatttttttctgcggaaactatatatttacttattattcagagctcactgtataaaatccgagtggtgctcaagatgttaattaactagctttgtgaatggggtggtgaaaaatactgctcactttatttgtttggtcgcaagcctatatcatgtacacatactgctcaatttatttgaaccttcagaaaataaatcaatttgctcaagcctttctgctgttgattccagttcattggagtaactttaatatttcttctcattgcatcagttaacatgaatgcaaaatagatttgttgtcttatgctatcccgtatcagggatgatgccactaagttgttataattatgcttgtagtccttgtcggagtttgggtactgcactttataatgcaaaggaatggtataaactatagctggttctttcatgtagtatgcctttttctataatgtaagttatggatgcggtacttcttcgaaaccttcataatgctttttgtcatgcaacaacttgctaacaagtcctggcgttgcagttgattgcacatgtggagtgctctggatgcattaatgtccagtcacaaggattacaactttacaaaagcgggtgtaagtatgataatcagatggtcactccacatagacaccacagncacaatatcatcagagaacacacagctgaaanatggtggttaggacacataacaccaagtcatcaatnagaann

SEQ ID NO: 2982 - DNA, 796 bp, Triticum aestivum
  Clone ID: PAT_TA_2982
taggggccttttttttttttttttttcatccatcatcatgagctgcttatagtttgcaataggttgagtttcatcaaactagcagcatcacatcttctacatgaaagaaaacctaacaagaacatgagggaaaaaagaatctacatattgctaagaagaaaatatttttgtgacaaaaacaggtggatcagctgaagaaccagagccagcaactgagcatggtgctgggcatgaccacccaaaaccttgtggcactgcaagcacagaactcggtgatgcagacacagaagatggagctggagagcaggctgtgcgccctgggcgagatcatctgctgcatgaactcaatcaccaacgccgcgcgtccggtcgccgccatgggcgccacaacaagcagtgcctatgacatttttggcgccggcagcacatggagccagcccatagacttgtaccagtgcttctaaggaagaagaagaatggatggttgatgttgtcatagctggtagggcctctatgaaggcatcaggttctgtatcaatcatgtagggccttcgtgtcaccattgatgcgtgcccccctctctctctctctctctctctctctctcttgattgtttattttgtgaggttgggttgtaatggttggtgagggagggtaggaggggaattgatgggccattttgtcaaagagagagagagaggctagggattttctactggctcctgatggtgatgtctagctagtaagatgtggaattggtacctcttgatatatagtatatgcaaagtgcttctcc

SEQ ID NO: 2983 - DNA, 1158 bp, Triticum aestivum
  Clone ID: PAT_TA_2983
tgcagcggtagagacgtcgacatgaaagtggttgaacgtgcagatactttcaagagtccgcagcacggtatccgcgacggcatctgtccttctcgtctactctgttttggttatggcgaagttctgaagcgcgaagcccatgtccaccagcaggaggggcagggcgagctgcagcaccgtgagccagcacgccctggcccgcgctcgcgcgtggcgccggagccgcctccgcccccttggcggggaggacggcgtgggcgagcttgtccgggatggtggcggcgtcgacctccccgatgcagtactgcggcatcagctccttggctgcgtccgagtggccgatgtcctcgaagtcggccgtcgcgtccttgccggtgcacgccagcaggacctcgtcgccgccggggtgctcctccatgaacggcgtcacgtcgtacaccttgccggagatgatgagccagcaatccttgcgctggctgtgcttccgcacctcttggaacgagtacaccttccctcctcccgccatcgcagccacccgcggaagccgagccttcagggtaaacagaggtggatcagctcactagatgctgtcaacaaatgaacatggtgctgggcatgaccacccaaaaccttgtggcgctgcaagcacagaactcggtgatgcagacacagaagatggagctggagagcaggctgtgcgccctgggcgagatcatctgctgcatgaactctatcactagcacagcgaaccccgccgccgccatgggcgccacagcaagcagtgcctacgacatttttggcgccggcagcacatggagccagcccatagacttgtaccagtgcttctagggaagaagaagaatggatggttgatgttgtcatagctggtagggcctctatgaaggcatcaggttctgtatcaatcatgtagggccttcgtgtcaccattgatgcgtgcccccctctctcttgattgtttattttgtgaggttgggttgtaatggttggtgagggagggtaggaggggaattgatgggccattttgtcaaagagagagagaggctagggattttctactggctcctgatggtgatgtctagctagtaagatgtggaattggtacctcttgatatatagtatatgcaaagtgcttctccc

SEQ ID NO: 2984 - DNA, 1180 bp, Triticum aestivum
  Clone ID: PAT_TA_2984
tgctaggtttccttccgctccgccgtgagagcacgccaaacagcagagcacaatctgtttcttggctgctgtccagccccgtccacagtggccaaaagcccgccacctcagccaaatccttcttcccaaatcttaggttttgacttggggaggctctgcccaaattttcttccccggtcgtccatttccaggggaggttctgccaaaaaattctcccctcatcatccatttcccagggaaggctctgccaaaaattccttcactgatcatccatttcccaggggaggctctgccaaaaattccttcgccgatcatccatttccaggggaggctctgccaaaattccatctgaacttcattcaatttccaaggggaggttctgccgaaatttgatctgcgaccgtttcatttccaaggggaggttctggcaaaaaataaaaaatatttttcttgccgcacagcaccaaaacttgcatctgaaaacagaacagatcgataatttcattggaaggtaaagaaaagagtctgttgtgttcttgatgatagagccgcagtagcaccaggtgtagatgttgctgctggttctgttggagcatcccctttccggatttatggtcggcgcatcgatcactcgcctcgtccagtccttctccgtcgtcttcctctactggttctacgtcttctccctaaccaccctgtagctctgtagctgtagctggagttcatactagtaacataatcaagctagctagcactgagtaacgaaggtacccaagtgctgttacaaggtgtgttttttatactcaagatataagaggaagtgaaactgttgtaagttgttgggaggtgaccatgtcaagtgggccctcgttcacgtcgagccaagggacccggagctccaggtcccccgaggattgcccggccctccgggcccagatggagaaaaggaggaagaggaggaaagagtccacccgggagtgggcaccccgatttagggtgggcaagcaacaacccctcgacgacctctccttgcaggtggatcagctcaagacccagagccaacaaatgaacatggtgctgggcatgcccccccaaaaccttgtggcgctgcaagcacagaactcggtgatgtctagctagtaaaatgtggaattggtccctcttgatatatagtatatgc

SEQ ID NO: 2985 - DNA, 1673 bp, Triticum aestivum
  Clone ID: PAT_TA_2985
tttaggtttctttccttttttttttttttttttttgttgttaggaagtatatgaattccaccaataattacgttagttctcataggggagatggaaccacaacgattgcagcggtagagatgttgacatcaactggttggacgtgcagatacttccaagaggccgcaggccggtatccgcgacggtatccgtcctttctcctcattctactctgttttggttttggcgaagttctgaagcgcgaaggccatggccaccagcaggaggggcagggcgagctgcagcaccgttagccagacgccctggcccgtgctcgcgcgtggcgccggagccgccgctgcccccttggcggggaggacggcgtgtgcgagcttggccgggatggtggcggcgtcgacctccccgatgcagtactgcggcatcagctccttggcggcgtccgagtggccgatgtcctcgaagtcggccgtcgcgtccttgccggtgcacgccagcaggacctcgtcgccgcccgggtgctcctccatgaagggcgtcacgtcgtacaccttgccggagatgatgagccagcaatccttgcgctggctgtgcttccgcacctcttggaacgagtacaccttccctccccccgccatcgcaagcagcctgtgcttccttgcctcggaagccgagcctccaggaacgaacagaaccagatcgaaggaaccggatggagtactttggtctgggaacttgtgaatgtcgagcagttcaggcacctgctgcagtgtatttatacgcgagccgtgcgtgtgagagtggacgggcggcgcacgtgtggaccgacgcctggatgaactctatcactagcacagcgaaccccgtcgccgccatgggcgccacaacaagcagtgcctatgacatttttggcgccggcagcacatggagccagcccatagacttgtaccagtgcttctaaggaagaagaagaatggatggttgatgttgtcatagctggtagggcctctatgaaggcatcaggttctgtatcaatcatgtagggccttcgtgtcaccattgatgcgtgcccccctctctctctctctctctctctctctctctctctcttgattgtttattttgtgaggttgggttgtaatggttggtgagggagggtaggaggggaattgatgggccattttgtcaaagagagagagagaggctagggattttctactggctcctgatggtgatgtctagctagtaagatgtggaattggtacctcttgatatatagtatatgcaaagtgcttctcggcgtgttggagcctgccgcggaaggcgagggcgtcgacctccccagaaccggatcaagatcagaatgctgtttgcgtctgaattttcccacgcgtccgagtcggccgtcgcgtccttgccggtgcacgccagcaggacctcgtcgccgcccgggtgctcctccatgaagggcgtcacgtcgtacaccttgccggagatgatgagccagcaatccttgcgctggctgtgcttccgcacctcttggaacgagtacaccttccctccccccgccatcgcaagcagcctgtgcttccttgcctcggaagccgagcctccaggaacgaacagaaccagatcgaaggaaccggatggagtactttggtctgggaaccggacgc

SEQ ID NO: 2986 - DNA, 1288 bp, Triticum aestivum
  Clone ID: PAT_TA_2986
agtgaaccccgctcgtggccgtaagacgcccctgccaagggttcgtgctctcacggtccgcgcagcaaggcatcgtgccccagaacgtcgccgtcgcgctccccggacgcgtctccgcgtcggccggtgcaggagtggagatggcagtgattggcgcgctggctaacagcctccgcatacccttgtggggattatttgggggagcataaaacaccttgtcaacagacatcacgttcccaatggtgaccccaaatgtagccgctcaattggctgcacaatttcggggacatgggttgcagcttctgcagctcataataagctgccgcggtttacttgatgctcaaaaaatgaagacttggagactcgtgcacacgttattctcatttatctggcaaagttatgggtggttggagccctcgaagtaattgatgccgcaagaaaagctggtattgctcttatgattggtggtatggtcgagactaggattgccatgggctttgccggccatctccctgctgggcttggttgtttcagttttattgacctggacacacctcttttattgtccgaagatccagtgtacggtggctatgaagcttctggtacctggctacctggctcaggttgctcgcggcaatcgcggtttccttcatttggtacaacaataatggatggtaaatgcagatagttaacgcacgccttatcctccgggaggaactttgtacagcatatcggctcattcaggctttgatggtagactggtatcacacgcggcgactaccaggtggaaactgatgtgtaacccactcaattgtaagccatatatataggggcaaagcccccgtttatgtactgctgtaagtcctggagataggtaacttcagaaggccagctctgctggcatttggactacaacaatggacggaaattaagatggccaacgcccgcctcctcctcctggaggaactttataaagcatatcagctcattcagtatagagtgtagaagttatcacacccgacgacaatcatgtggaactgaaatgtaacacaatcaattgtaagccatatatagcggtaaagctcctgtttatgtactgctgtaagtcctgtgaggcctatgatatttgatcaggctgtagatagatacgttcagaaggccagctcggctggcattgttgctgtagtgtagtacaagcagtaactgttccctcagtgttctcctttgtatttttctggaataaatgagactgccctttgagctagcaaaaaaaaaaaaaaaaaaaaaa

SEQ ID NO: 2987 - DNA, 864 bp, Triticum aestivum
  unsure (1)..(864): unsure at all n locations
  Clone ID: PAT_TA_2987
ttcggcacgaggtacgcgtagagcaggatgccatgatgcatgaccctgttgttggagacgacactgaataccggagggagaatcttgagtgccggaataacagtctcaggaaggtgatgatcacgggcttctgttctgccaagagcctagttgagctcacagttcacatcctcgagagagcacattcactcgagcgcttcacgctggacataacctatggctatgatacgagaacttgtaacgtcgcccaaatacccaactgcgaagaatgattggcctatgctggccgttgaacaagagaggtctcgaggaagctcatagagccgtggagacagcggatagatacatcaagggaagagtgggctcgtccgttcaattcgaggttctggggccttgtcctcgatgccatattggaaagtaggtagaccatggctgtgtgcaccgcttgatgcaggggccctgggtaatcctccttttcgagaaaaaggtaccagtggatcattgacgtggtacggagggatctcggtagcaatagatgctggttggtgtgtctattgattccgttgctgtgaacaataagagatttattggccaggcttttgttcaactcgggaagtgggacctttgagttatctgttcctagagatattagaagttgcgttaatacaatattaagagattattagtggctgtttgaattggagatgctagtgcagtgatgttttgttttagagttttgaatggcaaatgatgtttcatccaatcattcggcgattaatggttgatgagggttggcaatcaggaaatgtaaagcctcaaccatttgatgtgctgctgcnctggaagtagccgtgggcagtttat

SEQ ID NO: 2988 - DNA, 2397 bp, Triticum aestivum
  Clone ID: PAT_TA_2988
ccgtccccctccccccgccgctctcgcgcgcctgccccgcgcctcctccccggccgcctcctccgccgcggcgcctcggccccgcgggttccgctcgcggcgcccggccgccggcgcggcggcagtttgggccgatgctcacgctctgcgggaatgtccgggcctggtttttcaccccctgtcgcctcgagcggcctctcggcatctgcgcctcgtcaggtcccctccattcgactgtggggggggcttcaaccggcgccccagtccctgcaccctcttcggggctctctgcctcctccccgaggttccctctctctggcccgcgttctggccgcggacatctctttctggcctcccggtcgcctacgtgtccgtcactctcgggtcttccctcccctggtcttcaacgacctgcccccgttatctcggcgtcccggttcccctcgaggtgccctccggcgtcctgggccccggcgtctcctggccgttcggggatctgccactgtgcagctatgcctggtgggcggcatgctgtatgtagttgttccagctttgccattggtggttcagcacaaggtttatcctcaagcatggctaatgttggtaatcgaaattctgctcctgggttgacagcttcttcagttttggggaacttaggcccacggataacaaattctgcgggcaatatagtgggtggcagcagtattggcagaagcataagctcagcaggaatgtccatgcctggtattgcatcccgtatcaattcgagcggcaactctggaagtggggctcttaatatcccatccaatcgactgagtagtatgcatcaagcgtcaccacagttcatgaacattcttgggagttcttatccagcacctggaggaacgctatctcagaaccaagttcaggcaggaaacaattcttttagttcttcaggaatgctacatgatggaaactctggtgacaattctccgtttgacataaatgattttccccagttaactgggcgtcctaattctgctggaggtggtcaagggcaatatgggtcactgcgaaaacaaggagtaagtgtaaatgccattgtgcaacaaaaccaggagttcagcattcagaatgaagattttccagctttaccaggatataaaggcaattcgtcagattatggtatggatttgcatcacaaggaccaccttcatgagaatgcaaatattatgcagggacaacattttcctatgggtagatcatctggctttaatttgggaggtagctatccagcccgccaacaacagcagcagagcactacttcggttcaaaatggtcttgataatattgggctaaggccgataaattctccaagtccgtcttctaattcggggtcttacgagcaactcatccagcaataccatcaaccgcagactcagaattcacttaggtcgcagacgtcttcgggccaacagtcatccaaggatcagagtcaaaagtctgctcagggaaaagaaactgtgccagacccatatagtttacttggattgttgaacttaataaaatcaaaagagcctggaccaacagctcttgctttagggcttgatttaactacactagggctgaatttgaactctccagattgtctttggaagacatttggctctccatggtcaaatgaaccagctaaaggagaacctgattatcagatccctgcttgttattctgctgagcaacctccaccactgcagccattcaattttccaaagtttcaccccttgacactattctacatcttctacagtatgccgaaggatgttgctcagttatatgccgcgaatgaactatataacaaagggtggttttaccacagagagtatcgtgtgtggctcacacgagcttcaaatgtggcgcctcttgtgaaaactccactgtatgaacgaggatcctacatttgttttgatcccaacctgtgggatacaattcagaaggacaactttgtgctccaatatgaatctgtagagaagagacctgtcctcccttccgccagccaaaatgttagattataagctgttgtacttcttctgtattagagaatgtcgtttttcttcatccggatcagtacctgttattatcataggatataggtggcgtacatttgtgcaaaatgattctgacttgtgtgctgttccgaagaaggagcttctctgtgttggctggcagccctgatggtagctttagacatgtagccgaggaaaatgcgcctcattaatccgttggctgtaaaccagtagggtcaatttggtattgttggctgtaatagacttgagtttttagcttccgtaaaattcagacctgtacccttcccctagactcaattaccggtacttggatttacaatgggccctcgttttt

SEQ ID NO: 2989 - DNA, 893 bp, Triticum aestivum
  Clone ID: PAT_TA_2989
ttgatctcatcctcagcaaggtaaccttggtgctttaaaccgcctggccctgtcttcgggacgctccccgcgtatagaacagactccgcctctgatatccttgatctcatcctcagcaagaatgaccctgatgttgataccgattccaacggccaggctggctttttctgtggctcgcctcctgtccgcactaacaaccccattgtgaatgatccgcagtttggtaggaacaccccctgtttttctcctctagggagcccattcagcaagatgcttggtggaagagctgaagtaggctctccgtcttgcggggcgagtagcagcccgaaagtgaggatcgaaggctttgcctgcgggaacaaagagaaccattgtgcagtcacctttgcctgagagcattttcgccataccaccaattcaccattgaccattagcgccattttgcaccccccaccccacccccccaacatgtaaattttccgcccccgagatacagctagtccctttaatcctaagctaagctagtagtacctattcgagtcagagtttatttagtcgagttgagttgagtcgaggtgagtcctcatcgtcgcccgcctggttgtcgcttttgaaactgcgcaatcgcagagagctttcggttatgtacataggcgaggtctcccgtcccgtccattgtgtcctgtatctacatctttgtaatgtgtgtgtgtgtgtgtgtgtgtgcttgtgtcttgtgtctagcaagtgtccccagtccatgggtgtgttcagagtctagcaagtgtcccagtccatgggtgtgttcagagtctgtaaataccgtctgccctgcattcagatgcataattaagaaactattatattattatattaaaaaaaaaaaaaaaaaa

SEQ ID NO: 2990 - DNA, 1295 bp, Triticum aestivum
  Clone ID: PAT_TA_2990
gaccttcgaacaaacaaactcaggttaattcttgcgtaccgagcttatatcatgtcttgagttgtatatatactagaggtaaagtgggtaatatataacatgtgaacattttcagcctcaggaagccagccagttgtatgtccagttctccactataaaattgtttgctgcctgttttcgcctctttctttgatatataacaatgcctagaacataaacgagtgtgtttctatatttactttccctttaggatggtggaaattcatattctattcaaaagcacttcatgtacatggtcaaatgcttcagaaacagtagtatgctacttcactttttatcttcctgggggttctgattcatctgtattaactaaagaagcttgtgatattattttcattagcacagtgcaaatcaaaccgaaaaaatgcacatgcttgccctttgtaaagaaccactattactatatatgctctactttgtacagaatcatatgtatattatgcttgcccctaaattgttgctttatgctgaaccactattactatattatgatttgatatgagatttggtgcttgaatcaagtatttatggagaccatgcccttatgcaagtcttcaggccttgctgggttgttttattgttctgaaggcatcatcatgtgtgattgtagttacattgcctccttcacacttacatccaccatcaatcagttagacactcccttttttccaaataaaatcaagtgaatgttgtactcccaaacccaattggcgcatttcgggtttgataaataccgtgcattgatccctgcactttttgacaaatttatattctcatgacatctccggtttactcccgttcttttttctgtgcttctcggatctggaagctccatagagacatggaacctgtcatcattttgtcagactaagcgtggagttacttgtgcaagttacaccatcagcaaacacatgaagacctgcatgctatcatcgcaagttgagcatttacatgctctaagttaatctgatagggagaaaacaaaggcttgtgcgcccattagtaattttttgttttataatagtgggcaccttatatatctgtaacatgtgacctttgcaactgcaaaggtgttgggcgataaaaattctgtgtaacacatgttcttatacactatgcttatgtatagatattactctcttttttgtggccttgtgtggtatatattgtaaataaattatcatgaactattgagcctttcactttttctgtaacaaaaaaaaaaaaaaaaaaaa

SEQ ID NO: 2991 - DNA, 1282 bp, Triticum aestivum
  Clone ID: PAT_TA_2991
tcggcacgagtcacggaacttcagagaatggctcatttcccagctatgcaattcacacaccccacttcaagttcgtataccccatcccgacaaatatcacacaacgacaaatgaaaaggggcaatcatacaagctcgccgaatccgtcactggcgagtcatgagtcaaatcatcttactggagatgtgaatctacttgctcatcaaccccaacggagggatgactgggatatactacaagcgcatcatctgggaggccatactctacaggaaccggtgaaatgcctcccctgaatcctgtcggtgatgctatcgttaacgcaactcagatcaaggatgttcacaggactgtgacgacgaccattgagaatggcttttccaaatatcgctgatctggagtcaaggtcagacgtgcgcgcggaccacgagcaggtcgggcactactggctgcagctcgggaggcggtccaaagcccggctccacatggtcctggccctgctctcgtacatggtgttcgggctgctcccaccggtcctctacgggctgtcgttccgcgagagcaacgaccgggagaacaagatgatggccgtcgccggtgcttcgctcgcctgcatcgctctgctggcgctcggaaaggcgcatgtccagacagcacccagggcctacttcaagaccctcatgtactacctgatgatcgccgtgagctcatcggggctgtcgtacgtcgccggcgtgctgatcacgcggctcctggtgcactacggaatcattgagcaaggcggctcggctcctgctcctccagggctgtcgtcgccgttcgcttatgctgctggggcagagtcgtctgcatgggcctcattctgaaaagtctgaagttccggggagcacgtcctggtggtataaaaagggaagaaatgagcgagctcgagagaaagtgcctgcaactgcatgaagaaacacctgaaggctttttgagttgctgctacctgctaagctgttttgctgtagttttgttgtacatttgaagctctgatgcttctcatggtgatctttgtcagaatgtttgtgagcaagaagagcaagaagttcagtgttacatactctaaaaatatgccatgttgtaactcacctgttctggatgaagcaaaatatgccatgcttttaggagttgtaattatactttgggcacatgaacttgcacggtgcgtacagattcatacataaagttgatgtggtacaagattcgtacataaagttgaaaatgacacacatcgttcaatgaa

SEQ ID NO: 2992 - DNA, 484 bp, Triticum aestivum
  Clone ID: PAT_TA_2992
cgtccgcccacgcgtccggacgcatttcgttcaagttgtatgactggaatcccgcagagtttcctcggcgtctacgtaaccaaatatttgagtggttgtctatcatgcctgttgaattggagggctacattcgtcctggttgtacaattttaactgtatttattgcaatgccacaacatatgtgggacaagttatcagaagatacagcaaatcttgtcagaaacttggtaaatgctccgagcagtcttctattgggcaaaggggccttttttgttcatgccaataacacaatatttcaagtattgaaagatggagcaacattgatgagtaccagattagaggtacaagcccccaggatccattgtgttcatccaacatggtttgaagcaggaaagcctattgaactactcctttgtggaagttctcttgatcagcctaaattcagatcacttctatcgtttgatggagagtacttgaagcatga

SEQ ID NO: 2993 - DNA, 834 bp, Triticum aestivum
  Clone ID: PAT_TA_2993
cggcaccacgcctccgctctccctccagatctcgctcgccatggacctcctcgacgcgggccaccgccactcgtcggaacttcccgccgccggcgccgacatggaaggcgcttcagtgcttccgctctccggagctgcctaccagccctacgtctccgagctcctttccttctccatcgagcgcctccacaaggagccggagctgctgcgggtggacggagagcgggtgcggcggcagatgcaggaagtggcggtggagaactacgccgcctttatagccgcctccgaggcgctctccttcgtgcgggcacagctcgaggggttcgacaagcacctcgaggcactggtagaggagatacccaatttaacatctggttgcaccgagtttgttgagtcagcacatcaaattttggaagagaggaagctcaatcagacattactagccaaccacagtaccttgcttgacctgcttgaaatcccacaacttatggacacatgcatacggaatgggaactatgatgaggcactcgatctagaagcttttgtgagtaaaatttcgaagttgcaccctgatttacctgtcatccaaggattagctgctgaagtcaagaagacgatacaatcactaatttctcagcttctccaaaagcttcgatcaaatattcagttacccgaatgcctccgtattgtcgcacatttgcgccggattggagtgttcagtgaatcagaattacgcctacagttcttgagatgcagggaagcttggctttctgggattcttgatgatctggaccaaaggaatgtatatgattatctgaaaggcatggtgtcttg

SEQ ID NO: 2994 - DNA, 451 bp, Triticum aestivum
  unsure (1)..(451): unsure at all n locations
  Clone ID: PAT_TA_2994
cggacgcgtgggcggacgcgtgggcagagcaccaccaacctcccgattccaggccacgcaccgccaagtggacgagctagctacctcctgatcttcgccatggacgccgggccatcatcctcgccgctgcgcatcgtgatcgtcccgtggctcgcgctgggccacctgctcccgtgcctggagctcgccgagcggctcgcgtcccggggccaccgcgtgtcctacgtctccacgccgcgcaacctcgcgcgcctcccgccgccggcgccacgcgtggacctcgtggcgctcccgctgccgcgcgtggacggcctccccgacggcgccgagtccaccaacgacgtcccggcacaccaagcgggagctccactggaaggccttcgacgggctcgccgcgcccttcgcggagtacctggccgccgcgtgcgccgacganggcacgacgcctcan

SEQ ID NO: 2995 - DNA, 1201 bp, Triticum aestivum
  Clone ID: PAT_TA_2995
ccccggggggtcgcttcccgtgggggatggcccccgggggcggcgccaacgtgtgcctccgccgcgtcgacgccgccgaggtctacgacaccatcgcccgccgcggggtaacgcacctctgcggcgcgcccgtcgtgctcaacatgctggccaacgcgcccgagggcgtgcggaggccgctgccggggaaggtgcagatcctcacggagggcgcgccgccgccggcggcggtgcttggacgcacggaggccatcgggttcgacgtcagccacgggtacgggctgaccgagagagcggggctggtgctgatgtgcgcgtggaagggcgagtggaacaagctgccggcgtcggagcgcgcgcggccggcaaggatccagaagtacgtgctccgggaacctcgccaaggagatggggtccgacccgcaagggcgtcagcaagatgtagtataattgctgtagaaattcagggttgtgtcgtcttgcttggcttgatctgcagcgccatggcagatcgcattggcatgtctgctccgcatatcagcattcagcaagcctgtctgctgcagctgcaagattctattatgcgcaggcatgatgcatgtctccctgctgggtatgtgagaaatgagagcacccttgtgatatacttgtttaggcgatcgactcgctgctctacggccacccggcggtgaacgaggcggcggtggtggcgcggccggacgagttctggggcgagacgccgtgcgcgttcgtgagcctcaaggagggcgcgtccggcgcggtgaccgcggccgaagtgatcgcctggagccgggagcgcatgccagggtacatggtgcccaagaccgtagtgttccgcgccgagctgcccaagacgtccaccggcaagatccagaagtacgtgctccggaacctcgccaaggagatggggccgacccgcaggggcgtcagcaccaccaccagcaagatgtagaagtatatccagatagtgtcgtggtcatcctcctccttggcttggatcgggtgccctttttaattgccgtagaaattcagggttgtgtcgtcttgcttcgcttgatctgcagcgccatggcaaatcgcgttggcatgtctgctctgcagatcagcaagcctgtctgctgcagctgcaagattctattatgtgcatgcatgatgcatatcaaaaaaaaaaaaaaaaaaa

SEQ ID NO: 2996 - DNA, 1466 bp, Triticum aestivum
  Clone ID: PAT_TA_2996
atcggttcaaatgccataaccaaaaataaggcgctgccgtccgtggatcttgtaccgagtatatcactgcatcaagagactttgcagggcacagattctgatgatgagacgataggatctctgcttagtagaggaaagaagaaacggttatcgacatcagatgttacagagaataaacaagaacacctagattcttcgaagaacattggtctgggggttgagactatcggttcaaatatcataaccaaaaataaggagctgccatccgtggatcttgcaccaagtatatctgagcatcaagagacttcacagggcactgattctgatgatgagaccatatgatctctgcttagaggaaagaagaaaaggttatcaatgtcagatattcagagaataaacaagaaaacctagattcttcgaagaacattggtctgggtgttgagactatcggttcaaatgccataaccaaaaataaggcgctgccgtccgtggatcttgtaccgagtatatcacagcatcaagagacttcgcagggcacagattctgatgatgagaccataggatctctgcttagtagaggaaagaagaaaagattatcaacgtcagatattacagggaataaacaagaagacctagatccttcgaagaatactgatctgggtgttgagagtatcggttcaaatatcatacccaaagataaggagctggcctctgtggatcttccatcgagtatgtcacagcatcaagaggcttcgcagggcacagattctgatgatgaaaccataggatctctgcttagaggaaagaatcggcgcgtggctacatcaagatgttacagagaacagacaagaacaccaagattcttcgaagaacattgttccggacaatgagactgttggttcaaatgtcatggacgcccctctccatccggagctgaactcatctaatgataacggtggtgatgctggtgaggctgaacttctgggatgacttgagtgagcctgagctggatggtccgtgaagaatgccgagcaacgggtcgtccaccacagagacatgcatgaatctggggacatgacaggctctaatgccagtcagaaggctggtttgaaaagaagactaagaatggtgattgacgacgacgacgagtagtagtttacttgaaattatttagtgaggagacatgtttctgagttgggagctggaaattggcagtaagcagatgcaacctgaggttgccaggctcttgtttttgtacatgatttattttccaagttggccctggtgttagttttggatagagcctgttcggccagtgttgccatatttccaaatgtactgtactagccaatcgtattatggctctatgggaacacagtgctctgctctctttgtttaacttgcatgattcattttctacgataatgaagagtgcatcttgatgtcgatgtgattttcgcaaaaaa

SEQ ID NO: 2997 - DNA, 1537 bp, Triticum aestivum
  Clone ID: PAT_TA_2997
cggacgcctcgggtccgctccccccggcccccgcgccgccgccccctcccgtcgccaccgccggagacccagggaactcctcgctcgccctctccacagcccccggctgacggaaactcctcccgtcgccaccgtatccacagcccccggcgcgcgcggaggcccggccagccccagcgcgctcgcctctctcggtcgcatcggcgccgatccaggatcccgcgaggatgtcgtggtgcacatgcgagtctgatcccggtgttttcaccgagttgattcaggagatgcaagtaaaaggtgtacaggtggaggagctttactctcttgatgtggactctcttagtcaactacagccagtatatgggttaatttttctcttcaagtggatgcctggaggaaatgatgaacggcctgttgtcagtgacccaaacccaaacctgttctttgctcgccaggtgatcacgaatgcatgtgccactcaagctatcctctcaatcctcatgaaccgcccagaaatcgacataggtccagagctatcaaacctgaaggagttcacaggagctttcgcgcctgacatgaagggcctggccatcaacaacagcgactccatccgggctgcccacaacagctttgcaaggccagagccattcgtctccgatgagcagaaagccgccaccaaggacgacgaggtctaccacttcataagctacataccattcgagggcgtcctgtacgaactggatgggctgaaggaagggccgatcagcctggggcagtacccgggcgggccagaggacctcgggtggctgcagatggtgcagccggtgatccaggagaggatcgagcgctactcgcagagcgagatcaggttcaacctcatggccatcataaagaacaggaaggacgtgtacactgccgagctgaaggagctggagaagaagagggagcagatcctgcaggagctgagcaatgaggccacagccgctgcagaaaaggagcccctgaacggcgcgctggcggaggtggcgttggcggtggaggccgtgggcgagaagatcgcgatggaggaggagaagttcaggaagtggaagacggagaacgtccggaggaagcacaactacatcccgttcctgttcaacctcctcaaggcgctggcggagaagaagcagctgacgccgctcgtcgagaaggcccggcagcagaaggcccccgccaccgccggcgccagcgccagcacgagctgaccgtgtccgccgtagttggttgggtagttgaacctggtcatcttttgagaatgcatcatgttatcagacactcctacatacagtacctagttggcggcttagagatgttgttgctgctgaggctataaaccattttctgctgaattcttcttttgcggtgtgctggattatcgatattattgctggttagagctgtagaaggggtctatttaatcttaaattaaaggagggtgtggtaggtccctaaaaaaaagataatgtgttgcctgggtaaaaaaaaaaaaaaaaaaaaa

SEQ ID NO: 2998 - DNA, 581 bp, Triticum aestivum
  unsure (1)..(581): unsure at all n locations
  Clone ID: PAT_TA_2998
tttactcacgaacaagctagggttggagccgctgcccctccggcctgcccgccggagctccgtccgcccctcttctccatcttctccccccacctctactcccccaggcccaactgtggtggatggcatgcccgccggcgctccatactcccctcttctccatctttcccctcgccatctccctcctcactccctgttccgcccccacccctactgctgcaggctcaaccatggtggtcaacacggggatgtgagcgtgaacgggcggcgtcggtggacaagagatgcgtagaggacctcaagtgctgcagacgctggcgaagatagtccgatattgcagtggcggtggagcgaagcatgcacggccaagtcatgcagcaacggtcagatgtcgtattgggcggatcacgacatctgcaaaggaatgagggacactacangaacaatatagtaatggtcaaacttgggtanagtgataaatgattttggtatttctatcagataaagggtgataatccccagttacttgcaaaaanaanatgntaattnccaattaatnaaacctcngtnggtcaatanan

SEQ ID NO: 2999 - DNA, 781 bp, Triticum aestivum
  unsure (1)..(781): unsure at all n locations
  Clone ID: PAT_TA_2999
ttgcgtttttcaaaaccggcaccggcaaagctacgttggcaattggcgatggtgcgaacgatgtaggcatgattcaagaggcggatatcggggtagggaccagcggtgccgaagggatgcaggctgtcatggcgagcgatgtttccattgcgcagttccgcttccttgagcgcctgctgcttgtccatgggcattggtgttatagcaggatctcatcaatggtatgctacttcttgtataagaacatcacattcggtgtgaccctgttcctgtacgagtccttttcgacattctccggccagactttgtacaacgactggtccatgtctctctacaatgtccttttcacgtcactgcctgtgatcgccatgggcgtgttcgaccaagatgtttccgcccggttctgtctcaagtacccgatgctctaccaggagggccctcagaacctgctcttccggtggtcaaggctcctaggctggatgctgcacggtgtcggcagcgccgtcatcatcttcttcctcaccatcgcgtcgctcaagcaccaagcgttccgcanagatggtgaggtcatagacctctccatccttggggcgaccgcctacacgtgtgtcgtctgggctgtcaacatgnagatggcntnacngtcaactaccntcaccntcatccatcacatctgcatctgggagtggcatctcctaaggggactgttcccataatctagggnacgatnacgcgttcntctaaacacattcttatggggtctcgagggnctggggggctg

SEQ ID NO: 3000 - DNA, 627 bp, Triticum aestivum
  unsure (1)..(627): unsure at all n locations
  Clone ID: PAT_TA_3000
cctttgggngaattgnaccggcccccccatttggtgtcagcattcgcattctttgataaagatggaagtgctttataacgattgatgagctctcgcaagcatgcgagaaatttggcctttctgacgttcatcttgaggatatgatcaaggatgtggatcaaaataatgatggacaaattgattacagtgagtttgcggctatgatgagaaagggtaatgctggtggctccagtgggaccagtggggctgttggggcaggaaggagaaccatgaggaacagcctgcatgtgaatctcggcgaaatattgaggcccggtggaaccacctaactcgtatgtgagagggttgtgctttccagatactgctgtctgaagtgttcacctggatccatcggaacaagtgatatagtttggccactgggacgctgttgaattctactagtagtgctaaatagttgagcaaagcatactatggtatttttagtctaacaaaaatttaggtgtttaacatgccatataagtttcttattgttttatgatgataaatttatgtttgtatccgtatcaacttttgttgttaatgcacaaattattgttggatttttggttaaaaaaaaaaaaaaaaaaa

SEQ ID NO: 3001 - DNA, 920 bp, Triticum aestivum
  Clone ID: PAT_TA_3001
gaattcggcacgaggtgctaaggaagaccttcggtatccacggtcgttgctgcaaaatgttatttggacttgtcttaataaatttgtagaaccagtgttgaattgttggccaattaataagttaagagatacggcgctgaagaacctcatgaaacatatacattatgaagacgaaagcactaaatacattggcgtatgtccgattaacaaggcactagacatgatttgttgttggatcgaggatccaaattcagatgcactgaagttgcatcttccaaggatctatgattatttatggcttgcggaagatggcatgaaagcacaggtttatgatggctgtcaaagctgggagcctgctcttattgtccaagcatattgctcgacggacctcgtcaatgagctcggcccaacacttcggaaagcccatgagttcattaaaagttcacaggttcttgagaaccatcctaacagtgaagcttattaccgccatagatcaaaaggttcatggacactttcaacagcggataacgggtggtctgtatcagattgtactgcagaagcacttaaggcattgttgttgctgtcgaagatctctcctaatcttgtgggggatcccataaaaggagaaaggttgcatgatgcagtggattgcttactttcttttatgaataaagatggcacattttctacatatgagtgtaagagaactacatctctattagaggttctcaacccttctgaaagttttctgaacattattgtcgattatccatctgtcgaatgtacatcatcggtccttgaagccttaattatgttccaagagctgtacccagggtaccgcaacgaagagataggaatatgcataaaaaatgcgtccatgtttattgagaacaggcaacgaaaggatggctcatggtatg

SEQ ID NO: 3002 - DNA, 1037 bp, Triticum aestivum
  Clone ID: PAT_TA_3002
gggccaatggcccaacatttgggagggcttgaaccgagggggaggggcccgcggggaaggggacggtattgccaccgctaccattattgtgctgggcgatacttgcacgcgcggctgccgattctgcgccgtgaagaccagcaacaagcctctgccgccggatcccatggaacctctgaacacggccttggcagttgcaagttggggagtagactatgttgtgctgacaagtgttgatagagatgacttacctgatggtggaagtggccattttgctcagacagtgagagctttgaaggagctcaaacctgggatattggtggaatgcttaacctcggactttcgaggtgatctggaggctgtttcctctttggccgattctaatctagatgtctttgcacacgacattgaaactgtgaggagtctgcagagaattgtgagggatcctcgcgcagggtatgagcagagcttagctgttctaaagcatgcaaaaatttgcaaagaagggatgataaccaagtcttctatcatgcttggtcttggggaaactgacgaggaggtgaagcaagccatgattgacttaagggcagttggtgttgatattctcacattgggccaatatttacagccaacagaaaaatatttgacggttagagagtatgtgacgcctgagaagttccagttttggaaggagtatggtgaatcattgggtttttgttatgttgctagtggacctctggtccggtcttcgtaccgtgcaggagagctctttgtcgagaatttggtcagaaataagaagattaagcctgcatctggctcctcttaagtctcaaccaagatatgtcaacctacaaaagcagtccatcgggttcttccactttgtatgttcagagcagcaccagaaaagcgggggcggcacaatcattatattattctggaagtttgtcccctgctttcttttttgaatatgcacacacacttttgatagttatcactgtagatgcccagatgccatttttgctgttgtatcattacct

SEQ ID NO: 3003 - DNA, 887 bp, Triticum aestivum
  unsure (1)..(887): unsure at all n locations
  Clone ID: PAT_TA_3003
ggccgtgaacggcaagaggcaacgcctcgaggagtcggcgaatggagcggacagcagcgaccgtgcacagggcctgcgcgcgcgcgcccgggcgattcgacggcacgaggagacatacgagcgcgtggagtcctcaaaaggggagcatgagctcctgatggagcggaaccgcctggatgccgcacgcgagctggaggaccagcgtgtacagttcttcctcaagatgcagatggagatctcgaaggccaacaatggtgctccactcgctgtcccacttgctgccgctgccatggtcggtaattcagcctctacagcagaagatggcgactcgccagctactgctgatggcaacggtccaaggagagcctctatggcaaccgatgacatggccagcagcaatcaccatgtccggtaccgtgtcaaggacgacaggcatcaccatgcctcacagcgcccatcttaccagtacaaccagaacaatgttggtgctgcggataccggaggcattggtagtggcagcgattccggcaacaaggaagaagaggaagagatggaagacgaagaggaagagagccagtaaggtcactccggggatagcagttcaagaatttgtatctgtttttttaggtaagaatttgtatctgttgattggcattgccctggttaaaattgctcccagttatgctggtctatctcggagcaaatggctactgagcttgtagtggtattagcaaccaggagtagcagagttatggtgaacacctgtgggtgggatgtttgtagtaacttgtagctgcctgtttgtgcttttgatgtgattctatgatattaaggatgtccctcccaggcccaccgaatgtagcatgattagttatatggtggtgtnn

SEQ ID NO: 3004 - DNA, 2094 bp, Triticum aestivum
  Clone ID: PAT_TA_3004
aaaaaagcccctcaccaatacgggtgagacgggacgaattggggaccgcgcctctatagcggatcggcgcggcggtggtcgcagggcagggggatgtccacgcggtcgaggtcggtgcagggctccgtgggcggcggcggcagcacggctgggggctcggccgtgccgctcgccgtgcttctgcggcgggaggtggtcagcgagaggaccgccgccgagcgcccggagctccagcacggcctcttcagccaggccaagaagggcgaggattttgtcttcctcaagcccgactgcgagcgtctccccggcttcccgtcatcctccttctctgccttcggtctgtttgatgggcacaatgggaatggagccgctatttatacaaaggagaatctcttgaacaacatcttgggtgcagtccctgctgatctcaacagggaggactggcttgctgcgcttccaagggcgatggttgcagcatttgtcaaaaccgataaagatttccaaacagtagcacgctcttcaggaacaacagtgacatttgtcataatagatggattggttgttactgttgcatctgttggtgattcgcgttgtgtattagaagctgaaggttcaatttatcagttatcttcggatcatcgtttcgatgccagtaaagtggaggttgatcgtgtaacagaagctggaggtgatgttggaaggctaaatgttgttggtggtgctgagattggcccccttagatgctggcctgggggtttgtgcctgtcaaggacaatcggagatcaggacgtgggtgaatttatcgttcctgttcctctcgtcaagcaagtaaagttatctactgctggaggccggcttattatttcaagcgatggtgtttgggatgctttgactgcagaacaggctctgaactgttcaagaggactttctcctgaagctgcagccgagcaaattgttaaagacgcagtgcactcaaagggactgagggatgacaccacttgtatagtcgttgacctagtaccagaaaaaggcaacccagctatgtcagctcctaaaaagcaaccaggaatgggtgttttcaaaaatatgtttcgcaagaaaacatcttccgactcatcatcccatgcagatagagaatatatggatccagacatcgtagaagagatatttgaggatgaatgtgcattgctctctagacggctggattctgaataccctgttcgaaatatgttcaaactctttatatgtgctatctgtcaagtagagttaaagccaaatcaagggatatctgtacatgaagattcatcacaacctgggaacttgcgtcgatgggatggtccgttcctttgccaaagctgtcaggaaaaaaaagaagccatggagggaaagcgccgttcacgagattcgtcatcgagaaatagcgggtccagtgaatagtcgccaaggtttaaagttgtcttgcttttaaaaaagggttatgataccagagagctactgacctcacaatgcctaagcctccaagagacaatcattttgcggcatttcacgttgttttggcacttccgtgatcacatggactggttggggtatttgatctgagattgaaatatgaattgccatgaagcaggtggttactgttcaatagcctattatgccatttgaagtggcaagcatataccttgtttttaattaaagggacaagctttttgctcgacagtttcacacagatcatttgaccttggtggcaaatacaggcccaaagatcattgattgagaacggcatgccatgttgacatatctattcttaggtcaaactatagtgtgaattactgatcacatatagagctccggtcagaagggctttgtaattctcaatatgagtaggtgagtttcttctgaccgaccttgacttgtggtcgagaaatactcaacccttgttgaagttcagcttttcctaactcttctgtaattaattagcatataaataaattctttcaaacaactgtggcttgattgatcagcaggacatttctgtgcttgtttacaatgtacataatcttgctaacaaagcttatttgtttctccaaaaaaaaa

SEQ ID NO: 3005 - DNA, 939 bp, Triticum aestivum
  Clone ID: PAT_TA_3005
cgtccggcagggggctgctctttgattcagagtaaaatcaagttctttacctatggaggaggtagacactgatggagtggatgacaaggtgttctccaggttctgcatcatctccatattctgcatcattagtgagcaacttacctagggaggaggtagatactgacagagtgtatgagcagtgaataaaatagaggagtggcctgttcaccggagcaagcgaggaagatagctcagcccgaccaccaacgtccactcaccggtttctttgatgcctcgacctcgagctgcatcagctcgttgatatgtgatggacatctcccagcagtccctcgattgccaggccaccgcgcccgacctcaacaaggcgtttggatggttgtgaggcaggtgttgctgtaccagcggtgctgctatgttgctctgccctcaaccatccaaatcatttctaccagacccaatcttccactgccgccccgcccgtccgccggatctcatacatatgcaggaagaagatggtttaatatattggtgtcaggaagcgcttgttgcaataaccgtcaaatcttgattgtattatattgatcagaccaagcactttttggataaattagcatgaagtgatcaggagcagagaaatatatatgtcttgaagaaatggatatatatggttttaaggttacatgaagatatatatgtctggatcaagttgtaagttctcttccagaattacttaagattagtgattccgttagctacatagctgtcctttatttatgtggatcacatgtccttgacgatcatattatgatttggacacacattaattcataaaaccatttgttactttcaagacatgtttatttcgtaggtgcatatccatacaattcataaaaccatttgttacattcaagacatgtttatttcgtaggtgcatag

SEQ ID NO: 3006 - DNA, 758 bp, Triticum aestivum
  Clone ID: PAT_TA_3006
ctccggccccccctgcccccgggcggcgaccatcaccaacccgggccggggacgatcacaaccccggtgctcgaggaggtcgatcgatggcgtcggagaaagacgcggcgctcgccgccgtgcccaacgacaaccccaccatatttgacaagatcatcaaaaaggagataccttctacagtggtgtatgaggatgagaaggtcctcgctttcagagacataaatcctcaagctccgacccacattgtaatcattcccaaagtcaaggatggattaaccggcctttcaaaggcagaagagaggcatgtagagatacttggctgtctcctctacgctgcaaaagttatcgcaaagcaggaaggacttgaagatggctaccgtattgtcatcaatgatggccctagtggatgtcaatctgtttaccacatccatgtccatctccttggagggaggcagatgaactggcccccaggctaaagaagctcttggttgtcggtcaatcttcatggcagctatgtcctttgcatcccaatcgaataattcctgtaattgacataacagtttgtgcgaggaacatttgctctatctatggaattggcaaaaccatcctgctgtgaatgtatggacaagaaacttgaagctgaatcgtctcattgatgcgtgttgtgttctttctattcagtctgctattttactggtttagtactcccttttggacactatactcttatattatactggaaggagtagttctggtta

SEQ ID NO: 3007 - DNA, 674 bp, Triticum aestivum
  Clone ID: PAT_TA_3007
ggcaccacgccacacacaacgttgcggcttgtggaagcgggagtgataaccgaagcaacaaggtgagacgggctcgcagccatggagatcgggtcgctggcgccgggtgagagcccgcacgccgtgatgatcccctagccggcgcacggccacgtcacgccgatgctgaagctggccaacctgctccagcgccacgggctcccacgtcaccttcgtcaacaacgagttcaaccaccgccgcctgctgcgctcccagtccgcggactcgccacctggcctgcccgggttccggttcgcccgccatcgtcccacggccttccgccgtccgaccgtgaggcgacgcaggacttccccgcgctgtgctactccaccacgaccacctgcctccccagcttcaagggagctcctccgcaaactcagagaggaggccggggcctccggcggcgcgctcccgcctgtgacctgcgtggtccccgagcgcggctcttgccgtcgcgcgcgaaccgcgcgggcgctcggcctcactcgggcccccctccgccccgccatccccgggcgtctgccactataaggatctactcaatcgcgggctcttccctctcaaaggagaggcacagttgagcaacggatacttggacacgatcatagactggataccgtcgatgcctaaagac

SEQ ID NO: 3008 - DNA, 747 bp, Triticum aestivum
  unsure (1)..(747): unsure at all n locations
  Clone ID: PAT_TA_3008
ttacagaggagtgcaagccttttcgtgaagacgtccaaatacaatcaatttacccctgtgcaagtgcacccaatttgatgtttttgtcttacaaggtgcagatttctagcaaccatataattacgaaatggtcagttccacccgtccgagtgttgatcctctcctctgctttctgcaattccctggcataccggcttcggttggttctggaccgtgccctgcagtatacatttgcagtaacagggtagtctctgctgcccagtatgactatattccgaacaaagatgatatgccgagacagagctgaagttgaggaaacatttgcaatcgtttctcagaatagtaaaacccttcaatttgacatacagtgaggtgcatgccaatcaaatgaaggcggacgcgaagaacaacatgaccaagaagtaggcgangggtcgaggcgggaaaggaccaccgggtagcccggtcggcgcgacaggtggagcgcatccggaagatcgaccgcatgtcttcccagttccagtgttgcgactgattcctgtgctgaaaactaaacaaaattcagattgcatctgatatgcaacctgattgaggaagccacaaggtcacagtgcaagcttctgggacaaaatgtatatgaaattatttgaatcaatnnnactgtnnnngttgctttgctttgtagtctgnnnntctgaatggttttgacttgagctacagtagcatgttacaatttgaatcaatgnn

SEQ ID NO: 3009 - DNA, 571 bp, Triticum aestivum
  unsure (1)..(571): unsure at all n locations
  Clone ID: PAT_TA_3009
cggtactattcgccagcagagtggacgaagcaaggtactaaacatgtcaagattgcttgcagggggagagatgccggacgcgtgggtgaagctgtaaacacgtttgtgtatgaggtgttggcgtttcatgagcgccagaagccatcaagaaatcccaaatacgtacttgttcattgtactcatgggcataaccgtactggctttatgattgttcattacctaatgcgcacacaactgtctagtgttactgaggctttaaatatatttgctcaaagacggcctccaggaatatataaaaccgactacattcaagcactgtatacattttatcatgaaattcctgaaagtatcacatgtccaccgacaccggaatggaagaggccttctgatcttgatttgaatggtgaagctaagcaggacgacgatgacgacaatggcgagcctgcaccatcaccagatcccgtagatgacaaggccattactaatgatgatgtccttaagggatgctgtcctttttngaccancaaattccttgccgtgganagttccaantgcttgattttgtncccaa

SEQ ID NO: 3010 - DNA, 528 bp, Triticum aestivum
  Clone ID: PAT_TA_3010
ctcgttttcatcaaacacgcaagccgtctgcccccgcacggaaagtgatccgtcggaggcgacgcaatcgtcggcgagctaaaacgacatcattcacatctcagtctggggttgcgaattcctttgggttccgtagtagacgccttagcactaagcgttaccggaatatgctttggaactcgtctgtacttaggactaagattagaaccaatagcgctttcacgcagagtcaagcatccgctgcaagctctgcacagtatacagtgggtatatacgatgccttcggcaatacagctagtcccttctggaccgcgggtggaggcgcatttgcaccggatttcggttctggtgttcctacaattactggtaacattgtcgtacgtggcggtgttcttggtatacgcgttacatatacgagtgctgatactcagcctcaaaaagtcaggattacattgatacgatctggaagtcgtacgggagttgcaccttaaaaaaaaaaaaggaaacagtcggatttgacataactca

SEQ ID NO: 3011 - DNA, 1499 bp, Triticum aestivum
  unsure (1)..(1499): unsure at all n locations
  Clone ID: PAT_TA_3011
gtcgatcacgtcacgcacgcggccaggctgtgctgggagcttcgtccccctccactcccgtcagctccgcgggccgggcctgccccgccccgcccccactccgccgccgacgtaagcacacacacccccctccctccccctcccctcaagaaacaagcaacgcacgctcgccccctccctaccccccgcaacgccacgctccggtcctgaccctcgctctcgtccccgcccccgctcctgtcctcctcgccctccccatctccggtggcaggggcagcgccgaattgaagtaggcgcgcggtgcgcgtgcgcgtggccgctccggtggccgcagtggccggcgacggcgggtgcgcggggacggggatggagcagcacctccaggcaggcagcgcctccggcagcgcggctccggcggcccagggcgagagaagccttgggagtccaacattggtaaatccactaatattctatggtatgacagcccaattggacaacctgagcgacagaaattgctggggcagaaaggatgtgtcatatggatgacaggactcagcggttcatggctgagcactgagtcgtgtgcactgatacaggaactaccacacgtatgtcactaatggtgtcaacttcagagtgggcctcaatcgagatctaagcttcaagacagaagaccgtacagaaaatatacgaagagttggttgaagtggcaaagctttttgcagatgctggtaccatatgcattgctagtttgatatctccatacaggagagaccgtgatgcatgccgagctctacttccagattctagatttattgaagtatttatggatttgccactagaattatgtgaagctcgtgatcctaaagggttatacaagcttgcacgcacaggaaagattaaagggttcaccggagttgatgatccatacgaatcaccagtgaatagtgagatagtaattaagatggaaggtggggaatgcccttcaccgaaagcaatggcccagcaagttctatcctaccttgagaagaatggatatttgcaggcttagcacacatactccagatccagaagattgatcttattcttctgtgtccataactcatggacacaggtacaatccatttggtccatccggaataaaaggtgctgttatcgaagcaacaagctgcctttttcacgaggaaagggacgcagatcgatgatcagtttgattgttcggcattgctcctctcgcgcgtgttgtgctattttagctgtagtctatacttactcatttcggctgaaatggtgtgctgtgctgtgctgtgtttatttgttggtaatgtatgatttgattgtgggtgtcaaaagtacgaatgaataaatcgtgcttgcgttttccaagcgctggttgttggcaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3012 - DNA, 433 bp, Triticum aestivum
  Clone ID: PAT_TA_3012
tggtctttgcgaagctgcaatcatggcaaaaatgggagcagagcagtcaaaacctgctgaaagtatgaagtcgtcaggaaatgaagggcatgatgttccaacaattgagactgccgttgagacgcgaccagtttgctctctgtgccaggattcggattccaaaagtcgactctgctgtttgattcgtcttcaggctgccatggaaactatgatggcagagactgttgaagatggtcagaccccaagttcaattgcagagctcgcttccaaggtactctcccatgtcagttccacaagctcgctggagtcgccggctgttcaagttcttgaggataaactcgaggcataaagacggggtgcagctgcgctccgggaagaaattagcgccctgaagaagcgagcagaaaaagctgatgtggtcatcgcgaaaccc

SEQ ID NO: 3013 - DNA, 1001 bp, Triticum aestivum
  unsure (1)..(1001): unsure at all n locations
  Clone ID: PAT_TA_3013
ccacgcgtccgcggacgcgtgggtgtcagtctctggggagactagttctgtagagtaggatagcatgctaaccttgcttgtgtcactgatgcacaaggaaaagaatgacagcaccttttctggatgcaatattccttctctagttgagaccttgttaaagagatttgccaagctaagtaaggcagtgcatgtactgcagtaagacaactggcaccacaactactcccatccattccagatcatgccagcgccaaactgaatttaggatctccagnattcgacgggaaaacgccaattgccgaagctgcaatcatggcacaaaatgggagcagagcagtcaaaacctgctgaaagtatgaagtcctcaggaaatgaatggcatgacgttccaacatttgagccagatgcgcccaaatcaactgccgttgagacgcggccagtttgctctctgtgccaggattcggattccaaaagtccactctgctgtttgattcgtcttcagagtgccatggaaactatgatggcagagactgttgaagatggtcagacaccaagatcagttgcagagtttgcttccaaggtactctcccatgtcagttccacaagctcgctgaagttgccggctgttcaagttcttgaggataaactcgaggcggaaagacggggtgcatctgcactccgggaagaaatcggtgccctgaagaagcaagcagaaagggttgatgcggtcatcgccaaaacccaacaggagatgaaggaagtcaggaagaagcaagccgagactgaccagattcttcagcttctgttacgcagatctcagggtaaccccacttcttagtctctgttgagactgtggttctactgggtatatcagtgtatgtcgaacttatttgaactcgttgtgtgaaccacttcgtatcttgtgtatatcttgaataaaacgtgagttgaatgctggatgtatgtgacattcagtattgggatgtactgtactattgtgt

SEQ ID NO: 3014 - DNA, 1763 bp, Triticum aestivum
  unsure (1)..(1763): unsure at all n locations
  Clone ID: PAT_TA_3014
cggacgcgtggggcttcccactgatccgccccaagtcgaccccgtctccggtcgatgccggcgctcccgcaagccgtcgccagccgcctatgaccctctgggccgttcgccaggctcatggaccacagctccgcccctcccctcctcgcccctgccggtcttcccccacaccacagcacgccatgggaatagaccaaagctccggctgtccctcccgcacgactgccagtcttcctcccgaccagatcgacgacggcgatgaccggatctgccccgctgccgtccgtttccaagggacgtcaacggatggggtttcttcctctcagcgtccaccactcgcgggctcaccggtgatcggacctgctcagcatgcaggattgcgtgcttcctggcgaactggccgtgtcttgcccgacgcgccctcggcagtcgagtctttttccacggtgccccatcctccagtacctctgtcgccatttgcaccaccgtgcgccactgcccgctcgcgtgaaccatccagccatcctccctggcgctgcaatctgtgagtatgttggtgcgttgccgaggactggagagaaaaggtcagggtctgatatgcatatgccatcacttcatgttgagaacaattccgaggcaccaccggcacccgagtactgcatcgatgctggctccgttggaagtttcgcaaggttcataaaccacggctgcaaccctaacctcttcgcccagtgtgtcctaaccaatcaccacgacatcaagctagaaaaggtgatgctttttgctgccgacacggtacttccacttcagctcgctccttttgtgtgcaacctcgacgcttgctgcacgcctaactatagtgcgtctctggagtttgcccgggtgtccggccgtggccgcggcggtcctccgtcgtgggctacggctcgatcgtcgtcgtttctgccgatcctgaactcgtctggccgccctccttctgtggggccccagtctgcctcaagcggccagggcggttctggcccgctttggcgattatatgtagtattgggggtatgaatgcggcaatgcctgttgtctatatgaaaagcacgacatcctaaaattattagcgaaagaagcgcgttctttttttgtgtagggtagatggcatgctggacacgctaattatagttagtaaacaaagtttgtctaggtgacatgcctgtgggtcacgatggcatgacattttgtgaacaactggttcatataagttgatggaagatttaatcaatctttagacatttacatggccagcatcctgcttttgaagtacctctgttcatgttttagcatatttgttctttttgttaccaggtagcacctaacatcgacaactgcgatgtcatgaactccctcgcaattgccgaatatgtcgctgaaattacaacttctacagacagaccaaggagttgagttgtgaggcccccaccgacatgacacaccaaactgatatcaatgagaaaaggcgtagtattcccattgactggttgactgaggtgcagtacaagcttgagctactaggtgaaacactattccttgttgtcaacatcattaatagatcaatgcatagaaaaacatgtctcgatttttctcttgaatggaacctgcaagtttctcaactgtttagtgaagcttaccttgaaaagaactataaatactacaggaagtagagtaagacaatgacagttaatggaatatnatttnagaggatatttagggtttag

SEQ ID NO: 3015 - DNA, 1367 bp, Triticum aestivum
  Clone ID: PAT_TA_3015
cggacgcgtgggcggacgcgtgggctggaaacaaggtcaaatgctaaattgtcaagaatatcttcgatggaatcttttaagaatatggacagtagatattcaaagaaaaacaagaagttcgaatttaacagcaatcgcttgtcccctgtcccaaatggcgctgcaagatccttcaatcctaagtgtggatcttcaaaaaagtatttatcaacatctatccctggatccagatggatttcgaggaacacgtcaccggtgtcccagaggtcaagtcttcacagttttataaaaccaacacctaccttgaatcgcgttatttcgactgattgactcaacattgtgcgtgagggctctcttgtcagtcaaggttttccgctaacgtggctaccatttaagttggcccatgacactaggaagtctcaatatcttgaacttgagttggagagaactactaagcaattgaaggaagctattgccattgccggggaggaaaccgcaaagtgcaaggcagcgaaggaagtaatcaagtcactgactgtacaattgaaggggatggccgagaggttacctggaggagtagccaagaacggcaagctaccaccccttcctggaattcctataccaagtgacatatcagccatagtcaccgaaagtttgggcagcccaggaagttccggagaacaagaacaaatttcagatgatcgtaatggactgcttgttcctaatggatcaagttctgttaggaacaaggcaggccatccagaaatgaccaataatggaagtgtaccacccgatgcagaatccaaccatgaggccgaatgggtagagcaagacgaaccaggtgtctatatcactctcactgccttgcctggaggggccagagatctcaagcgagttcggttcagccggaagaggttcagtgagaaacaggcagaacaatggtggcaggggaacagggcaagggtgtaccagcagtacaatgttcacatggttgacaaatcgattgccgccatggatcgcgagattgcgacacattgacttgacttggacaaaaaaaagacttgattgcaagtggagttgaggccacatatacggtgcgtgaaggctctcttgtcagttaatgttttccgctaacgtggctacctatagttggcccatgacaagtgattcttgctattaggagagacaagacaagtttttagctttacacaattatttttaaaccattttcttctttttcccttgtgtggaaagtagattgctcatgcagaagtaatgtaaatgcctggtagatgttactgctttgtaaatgcttatgcaaacacatcagttttataataccatttactaatttccccctaaaaaaa

SEQ ID NO: 3016 - DNA, 767 bp, Triticum aestivum
  Clone ID: PAT_TA_3016
cttcattcgtgatataggcctgcatctttctcagccgtcctcttcttccttcctgctactggtaacctacgagagggtgttggcccccaatggcgagggctccggtgcttcccgcgctcttgtgcctcgcggtcctcgcgctggccggcggcgccgatgcgaggaggaagatggtcggcgtgtacgagctcaagagaggggatttctccgtcaagatgaccaactggggcgccaccatcatgtcggtcctcgtccctgattccaaagggaatttggctgatgttgtgctgggcatggacaccctcgctgagtatgttaatgatacctcttactttgggccgctaaatgggagggtggcgcagaggatggccaggggccgcttcgtcctcgacggaaaagtgtaccatacctacatcaacgacggaaagaacgcaattcatggtggcaaaagagggttcagcaaggtcatatggacggtgaaagagtacgtcgccggcggcgactccccatacatcaccatgtactaccgcagcttcgacggagagcaagggttccccggagacctggacgtgtacgcgacgtaccagctgacgggcccgtacgagctgagcatccgcacgaacgcgacggggctgaacaaggcgacgcctgtgaactttctgcaacacgtgtacctgaacctgggcggggagggcagtggctatatcctgggccacacgcttcagctcttcgtgttccgttacaccccgctggacgggagaagctcc

SEQ ID NO: 3017 - DNA, 1467 bp, Triticum aestivum
  Clone ID: PAT_TA_3017
gtgcctccgagtcccgcgttaggcctgcatcgctctgacccgtcctcttcttccgtcctgctactggtaacttacgagagggtgttggcccccaagggcgtcggctccggtctttcccgcgctcgtgtccctcgcggtcgtggcggccgccagtggcgccgactccggtgggtccagcgttgctgtgcacggccgtcctcgcgctggccggcggcgccagatcgcgaaagggggtggcagcgtccgatggttaatcgagggtaattctccgtcaagtttgccaaatggggtgctgccatcgtgtacctccgcggccctggttccagagagcacttaggttgagcgttgatactggagcatggggcaccaggcggtccaggggtgtcatcgttccctccgaaaatgtggacgatacctagagaaaggaggggcagagagcaatccatggtggcaacatacgcttcagcaaggtcaaacggacggacaaaaaagaccgaaggaacggacgtcttcgcggcaaaaggggggtcagcacggtgatatggacggagaaggaggacgtcgccggcggcgactccccatacatcaccatgtactaccgcagcttcgacggagagcaaggattccccggagacctggacgtgtacgcgacgtaccagctgacgggcccgtacgagctgagcatccgcacgaacgcgacggcgctgaacaaggcgacgccggtgaacttcctgcagcacgtgtacctgaacctgggcggggagggcagcggcgatatcctgggccacacgctccagctctccgcgtcccggtacaccccgctggacgtggagatgctcccgtcgtcgggccgcgtcgaccccgtggccggcacgagctacgacttccgcacgccgacgcccatcggcgcgcgcatccggcaggtcatgggcggcaaagtctacgggtacgacatcaactacgtcatcgacggggaaggcatgcggaaggtggcggcggtccgggacggcaagtccgggcgcgcgctggagctgtgggccaaccagccggccatgcagctctacaccggaaacttcctgaaccacaccaaggggaagggcggcaagctgtacgagcagtacggcgggttttgccttgagacccaggcgtacccggacgccgtgaaccaccccgagttcccgtcggtgacggtgaggcccggccaggtgtacaagcacgacatgcgcttcacgttctccttctagctaaggctggaatgaatatggctgcggtacggtagtaccaccattggttaatggatcgtagatgtgttccctctggatttggaggtggcgcgattcgtgggactggatgcggttatgccgtgagcccagagcggctacggtgtttgaaaaataaaatcatgcgtttgtgcagtgcaaacaaaaattccgctcaataagaaaatgaagatgcaaaaattagccc

SEQ ID NO: 3018 - DNA, 496 bp, Triticum aestivum
  Clone ID: PAT_TA_3018
acggcaactacgtgctgtaggatttcggcggcatcaacatgctgcacaagggctcggtcgagcaggccgggttcgcggtgctgaaggcgcccgacattccgtcgatcctcgtcgagaccgcgttcatcagcaacccggacgaagagcgccggctcaacgacgacagctatcgcgacgagatggccgacgcgatcttccgcggcatcaagcgttatttcgccgcgaacccgccgctcgcgaagaaccggatggcctgacggccgaacctcccccgccgccggcacgcagcgcgtgccggcgcgtcacgacgccgcgaagcggcgcatcagtttcccgccgaacacgttcaccgcgagcccgcccatcacgagcgccgtgccgatcagttgcgtgcgcgtcaggtgttcgtcgagcagcagcgccgacgacgcgagcccgacgatcggcaccagcagcgagaactgcgcgacctgcgcggccggatagcgcgacagca

SEQ ID NO: 3019 - DNA, 563 bp, Triticum aestivum
  Clone ID: PAT_TA_3019
gccggccggttaccccacgcgtccggcagctaccacaaagacaagtcaacctcaccggagagaaaggagaagcgaagatgtcggggcgcggcaagggaggcaagggtctgggcaagggcggcgccaagcgccaccggaaggtgctgcgggacaacatccagggcatcaccaagccggcgatccggcgcctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcgggggctaggctccggcgaggcgaatcgagctcgcaccacttgatcagatgttcagattagcagtagctaggcgttgttcagtgttcacggtgatcgatgtaatttatgatgtatggtgcttgttcgctggaatggatcaaatcgcagttatttaccaaaaaaaaaaaaaaaaaaggccccta

SEQ ID NO: 3020 - DNA, 591 bp, Triticum aestivum
  Clone ID: PAT_TA_3020
gccgggccggccgggccgtgatcagccaccgcagccaccacctacctcacaaagaaagacaggtcaacctcacccaggagaagaagagagagaagcgagaagatgtcggggcgcggcaagggaggcaaggggctcggcaagggcggcgccaagcgccaccggaaggtcctccgcgacaacatccagggcatcaccaagccggcgatccggaggctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggtttcgggggctaggccgccaccaccaccagattagagtgcctagggttcgtggtcgttgctgtaatcgcagcatctcgctgttgttcgctatcttctgtaggatcgaatggaattgaaattggagcagtttatcgttgaaaaaaaaaaaaaaaaaatgcccattcatgataaaatcggcccgatcgcgtg

SEQ ID NO: 3021 - DNA, 653 bp, Triticum aestivum
  Clone ID: PAT_TA_3021
ccgagcggccgcagccaccacctacctcacaaagaaagacaggtcaacctcacccaggagaagaagagagagaagcgagaagatgtcggggcgcggcaagggaggcaaggggctcggcaagggcggcgccaagcgccaccggacgggcctccgcgacaacatccagggcatcaccaagccggcgatccggaggctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggtttcgggggctaggctccggcgaggcgaatccagcttgcaccacttgatcagattagcagtagctaggcgttgtcagtgttcatggtaattgatgtaatttatgatgtgtggtgcctgttcgctgaaatggattaaatcgctgttatttaaccataaaaaaaaaaatttatgatgtatggtgcttgttcgctggaatggatcaaatcgcagttatttaccctttaaaaacattcaaaaaaaaaacgaatctaaaaaaaaaaaaaaaaaaact

SEQ ID NO: 3022 - DNA, 1316 bp, Triticum aestivum
  unsure (1)..(1316): unsure at all n locations
  Clone ID: PAT_TA_3022
cccgggctgaggaattcggacgaggaggtggtggtggatggtagatnttaggaagaaggccagaagcgggggctgaaactgaaaataagattgggaacccgcatttgaggcggctggttagtggagctattgcgggggcggtctcgaggacttgtgtggcgccgttggagacaattaggacacacctgatggttgggagcaatggggattcaatgacagaagtgtttcagacaattatgaagacagagggctggacagggctgttccgtgggaattttgtaaatgttatccgtgttgctccaagcaaggcgattgagctatttgcttttgatacagccaaaaaattcctgactccaaaggctgatgagtcctctaagaccccctttcctccatcacttgtcgcgggggcacttgcaggtgtcagctcaacactctgcacatatcctctggaactgatcaagacccgtctgactatagagaaagatgtatatgacaactttctccattgcctcgtcaagattgtacgagaggaaggcccctcggagctttaccgtggtctgacgccgagtctgataggagtggtgccatacgccgcgaccaactactatgcctacgacaccctgaggaagctctacaggaagacattcaagcaggaggagatcagcaaccttgcaaccctcctgattggttcggccgcgggcgccatctcgagcactgccaccttccctctcgaagtagctcgcaagcagatgcaggctggggcggtgggcggtaggcaggtctacaagaacgtgttccatgcgctctactgcataatggagaaggaagggatcggcggtctgtacaaggggcttgggcccagctgcatcaagctcatgcccgcggcggggatctcgttcatgtgctacgaggcctgcaagaagattctggtcgaagccgaggagtagagcgaagtgcgccaccggtgtcgggtccttaaagaagaggcggcaggaggattaagcctcgtcttcctttctatcaagaaaagaaaaattggatgatcaactactcagcagaagcttaggtcaaaggtatttgagacacgtctgttagatgatgaagttttggcctctaaattagttctgtgttcgagttgaaatccataaacaatattctgactggcggaagcagttttgtcatgctactttgcttcttgtgctactagccctgtttctccctttatatcaccggatncttggttaatctttacagagaacggctcacgatctttgcttgaaaatagcagtnctacgacaggcagttcgatatccaaa

SEQ ID NO: 3023 - DNA, 1545 bp, Triticum aestivum
  unsure (1)..(1545): unsure at all n locations
  Clone ID: PAT_TA_3023
cgccccggcgccgacggtccgacggtcccccgttccccccgtccccccgtcccccccacccctccccccccgcccccgccgtggcgccggcctcggaggaggcccagtcggcggccgcgccgaccccgcccccgcccgctgctctcgcgctcggcttcgcagggttgtgtacggagggcggcgaccatgctgggccgaatgcgaccaggaggaccctcctcccgccggcggccgtcggcgctcggcggcccccggccgcgcgcagcgtgccccagccgcccctcgatcccgcctccaagcccggctctctacgtcgtggcgggtctctgagttgtctggggccctcaattaccgtgccagccagccatgatcagccttctcgacggtcttcaactttgcaagcgtcgcatcgagctcacttgctatcaaggagcaagagctaatggggagccggtgccaatgggaaccgccggaccgctggcccttgcccgcgacaagctcgacgacggatccggcgagcctttcttcgtcctcaacagcgacgtgatcagcgagtacccgttcgcagagctcatcgagttccacaagtcccatggcggcgaggccacgatcatggtcaccaaggtggaccagccttccgagtacggcgtggtggagacggggaaggtggcccggtacgtcggagaagcccaaagccctcgtggggcaacaagattaacgccggcatctacctgctgagccagtccgtgctggaccgcatccgccgcccgccaccgcctgtacgccatggtgctgccggggttctggatggacatcgggcagccgagggactacatcacggggctgcgcctctacctggagtccctgaggaagcgggcgccggcgaggctggcggcgggcgcgcacgtgctgggcaacgtgctggtgcacgagacggcgacgattcggggaggggtgcctgatcgggccggacgtggccgtcggccccgggtgcgtggtggaggccggggtgcggctgtcgaggtgcaccgtgatgcggggcgcccgcgtgaagaagcacgcgtgcatctccggcagcatcgtggggtggcactcgacggtgggcaagtgggcgcgcgtggagaacatgaccatcctcggcgaggacgtgcacgtctgcgacgaggtgtacagcaacggcggcgtcgtgctcccgcacaaggagatcaagtccagcatcctcaagcccgagatcgtcatgtgatcgggaccatcgcccgcgccacatggtgaaaaagggtcgtatatttcttcatgcgtttgttggtttatttgtctgtctgtctgcaagtgtaaccagaggtgtccaccaaactgccaagtgtctatcaagctctatgtatgtctagacgtgtcgcaagtttttttttctttcttttttgaagacaaaatgcgtctcggttaaatttaaaccccgggcttcaatttgtagataggtgtcagatgcatgggaataaaccctctgttttacaagtcgtacaaaaatggcctcnttttanaaagtcc

SEQ ID NO: 3024 - DNA, 1138 bp, Triticum aestivum
  Clone ID: PAT_TA_3024
gagaactgtctcgaccttgtgatgtcgaaactcttttcctgagtttggcctgcccttcattctctgctatcaagaacggaatatcagcatttctctggtactagagttgctctcgatgtcgctgaaacaccctcaaacctttttgagttctatgcgtgggactaccgtgtcttgaggacatttgctctagatgaaacaactggtgatccaataccagaaaagctggtaaaggcactaaatgcttctcgaaacatgtttccggctactgacctccagcgacaggttttttattctataatggacttaactttgtttggggagcacacatcgaagccggtggacacaatttctgctgttgcggatttgaaaagaaagcacacgagttggaattatgtagaaggcactcactggcacactcggttttctcatcttataaactatggcgctgggtactatagctatctctatgctagatgttttgccacaactatatggcaagaagtatgccaaggtgatccattgtcccgcagcacaggtagcgcgattagggacaagttcttaagacatggtggggctaaggatccatctgtcttgttgaaagattttgcaggtgattccgtcattaaaaactctggcggcggaataatccctgacattagctcattgtgtaaagaagttggtttgtgaaataccaccaagggcgcatactgggatcattattttttgacactgagattgattaaaagcaaagggccaataactcgaaaccaaaggcagggagagcatgttggagtttcaggagcttgatctcctggccaggtgccacaggatagctgaaggtgtagaagatacagctgggatagttatatgaggttcttgacaaggaacttatttgcgatttcgagatcctaaatatatttcttgttcacatattagatcaactgagtgtatcctctcttactgatgatcaaactctagaagtcaactatatatgctgatgcatgctgagagaatgatctgtcagatgtgttctttgagatcatcctagctttcacttccatggtaactgatgacacgtaggctaatggtctccaagaaaggtccattgaaggactcagctcaaaatcaccaactttaa

SEQ ID NO: 3025 - DNA, 1662 bp, Triticum aestivum
  Clone ID: PAT_TA_3025
gggaaatggtatctgcagttattgagccggtgaaggtccccgcaacggcgctccccacgagcaggtgcccccctccaggcgacaccttacccccaagctcaaagagcgaactccactggcttggccgtcctgtgctggcggttggtgtcggttccatgagcgagatcatgaatctgtgcctcaggtcggtgatgacaattcaggtgaccctgaagagcggggtccccttgattatcatatgagtcttgaggatttgtgtagatacgcaaatcgggctgatggatatgaagggcacgttggcactggcatgtatgccgatccctctgcgggtcagcagcaatcttgtccttcagaagctcatggctagcgtacacatgcctatcgggctcttcgtgccgaggagttcaacgacacaggaaatgccaccagtgcgtattcaggacagcagctagcttgcccttcggattaccagaacttgtattcaggtctgcagcaagcttgtccttcagatgagcagaacttgtatttgccaaccaatggtctgccatttccacagcaactggacgacaatgcgccgttttatgaggcatcaaggcgatcacaaatgggaaaatgggaaggatgattatgtaaatgtggatgacatttctctctttgaggatgatgatatcatggctctcttaaatgcctcagacaacgatttcagtttagatcttttgggcccagttgacggatccaattcttcaacttccagcagcatcgaactttgaccaaaaggatgaagcaaaggctcaatatggcgcctcttcgtctgtttcccgtgagaacctttatccagacaccatggttccagatgtgccaatggatgacaatgctggcaaaagatacttcacaaacatgctgggttcatacccagccccacctgcaatggcttcggaattcccgccaaccacaggaaaatccatcgctgcgctcagcgggcctagtcagattcgtgtcacggcgggcatcgtccagctcggcgaccacagtttcaccggcaacgagggcagctggccactgcagaagaacggagtcttcaacctgctcctttctttcaccgtggagagcaacgtgtcaacgaagtccattagttttgacgacgagccagccaccacacgggtgagcgccgtgccgatggtgctgcgaggcggcctgtacctcttctttgtctcggccatgatcctcatgttgagtttcaaagtagggtcctgcatctacagcaggtaagttaagagcccgccctcggggccgttcttattcttgtttagcggaactatacatggcgccccctcgacgacggcgtgggagcaaacgactcgatgacagttttacttttacgcacttagtttgtcatgtcatatgatcctgacttggtgaaaggtatagtaaaagcaaataatctctcgaactggagaaagcccggtcgctttgcacgcgctcggtgctgggacctttgtgcttcatcctaggacctgtaatttattctgtttatttggtcgctgctcagagtgtttggaaacccgaacgatgtaacattgattataaaccatggtatctcttggttgtttggcgtgtttaaaaaaaaaaaaaaaaaaaaaaaaaaaaaaaaaaaaaaaaaaa

SEQ ID NO: 3026 - DNA, 594 bp, Triticum aestivum
  Clone ID: PAT_TA_3026
gtgttgttcatccgtcagaggcctaattgttggagaggcagggcggacgcaggctcctcgcgaggctgtgccggcgggtggcagccacggcgaggctgggcggccgtccccggcgtccggcggagcccttcgccggcgccggcgaagcagaggcgaggcagccggcgacgcggcggcgacagcggcggcaccggcagatgggggcgcgcgtcatggcgtggtggcgggcaagggtggtcgcgcccatgcgccgcgcctgcaggctcgccgtcgccgccgcccgcgcccgcgtccgcaagggcgagtgcggggtcctgaaccttcaccaggacgtgcagacgtgcggctaccacgacgtgcaggtgatgtgggacatgctcagctccgacaaggaagccgctgccgccgcctcggcgccggcgaagcagcagcagcggctgcggaagaaggcgttctggaggctgcctcccgtcttctgggcccgcccggtcgccgtgcgccgctgcagccagtgaagcgaacggcgttcgaggttggtgtccggcaatgtggaacacaaggaatttatcaatggaacctgccgcgtgctgcatg

SEQ ID NO: 3027 - DNA, 732 bp, Triticum aestivum
  Clone ID: PAT_TA_3027
actgaatccatgtacccagtcaaccatgtacatacaacaatagtctcttctagtatgaagtgtgttctttcccccgccttattacagaggcagtcatccgtggttcatgtacccagtcaaccatgtacatacaacaatagtctcttctagtatgaagtgagtactaacccccgccttattacatcagaaccaaagaatgaatgaatggaattaaattaagtacataaagaatggtactacgaaaagagttgaatgcctgcaaaatggtgcaaccacacctaatattttgcttgcaaattaacatatgggtatcagtctatcctgcccaccccgatacaccactctgttagcgctacttcctacagtttgagtccagttcctccagcaatggcaagttaagaagaacctgagaacttctgcaattgtatgatcaaaacactgatgtcatcggtagaccccctggaacccgcggtttcaacaagccttctgcaggcggccatgcgagaagccttatcattgccgatgcagagaggcctggcgatgtctatggcttcctggttatccaccttatcccacaagccatcagaggcaagtactaagaattcgcactgtgggtcaacaaggagtgtcctggtatctggatcagccaccacccattgcttgaggtgtgcatcgccgatgcctcttgacactgccaaggagccctgcactcgccatgtccctcggttgttc

SEQ ID NO: 3028 - DNA, 794 bp, Triticum aestivum
  Clone ID: PAT_TA_3028
gagcaaccttccaaccgcctccaaacaaaacgcaaacaaacttgtgtaaactggcaccgaccaagagcttgtttcacgcgcgcgcggggtgcccactcgtcgtgcgcgcgcgcacccgcgcggcccccgcgcccccggccgcgccccccccgccgcccgcctcgcgcgccgctcccccccgccccggccgcgcccccgccggacggtcccccccgccccggccgcccccccggcccccgctcacctgcccccccatatgacacctgccgccggccccaaccccccccatcccgcagccgaccccccggcccccgccggccagcctcggccccgcccccgcccggccgccgctgcccaggcccccccgccccacgctaacggtggccccgatccgcaggcctcgcgtgccccgggtcccgccgtggcccttgccgttgttgcccttgcgtcccgggcttttgccgttgcctgtgcccgtccgtggggcttcccccctccgctgtgggagggccccgcggtcgctccgtggccccggcccacaccgtggtttctttcaaggaaagctttgcgttttgagcgtgatgtgtcaggagattacttcgttgttaaggagttgtttctttttttatttgtcttgtctgcctgtttggcgtgttttaccggatgattcattgtttcatttatttttgactgtatgttatctctctgtgttgtgtttgtatgttgtgggtgttgttccattgtatgtacttcttgatcttcttaaatacacactatttaccgtaaaaaaaaaa

SEQ ID NO: 3029 - DNA, 1027 bp, Triticum aestivum
  Clone ID: PAT_TA_3029
cggacgcgtgggctctcacccccatccgcttcgccgccgccggagaggacgccggcgaagccgcgcgtgccccagggatggtggcggcggggctcctttgtgtcggcgctcgccagctagcggggatccatccgacggcgctgcaagatccggtgtggtggccctcttcgccggcgtcggggggtggatccggggcttctcaggccggatccgccgcgtggtggtgcggtgctggtggtgcggggctgatggcggcggggttgagcgcgcgaggtcctgctggtccggtgtctcggggcggctcgtcatgactctgtggtgggcgctggctggaggaggagaggcccggcgcagctggctggtgatggcgtgtcgctgcgaagcgcgcaggccggtggcggcttggtgctcctcaccgcggaggcgctcgtgccaggccagatctgcgttgcctggaggtatgtaaatatttcgatgtgtagaactcatcttccaagagtggaacttgttggtgatgttgctggccgccgcgtggagaaatggcctcaaagacttgctgcagtgccaccaagaatagccaatggggaaattaaggggatgtccatccaggcatacaaacatgactgttcagtttggaggagaagagttgaactctatggaacatatttgaaagatttatctcataggagttacagaaatgtcatggacatgaatgctggttttggtagctttgccgctgccatgttgaaataccctgtttgggtcatgaacgtggttcctgcaaatataacagacaataacacccttggtatcatctatgagcgcggcctgattggaacatacatggactggtgtgaagctttctctacttatccacgtacatatgatctgatacatgctaatggagtattcagcttgtatatcgacaagggtggtacccttgacatactggtcgagatggaccgaattctccggccagggggcgcggcagtaatccgggatgcagctgatgttgttctgaaagtga

SEQ ID NO: 3030 - DNA, 1769 bp, Triticum aestivum
  unsure (1)..(1769): unsure at all n locations
  Clone ID: PAT_TA_3030
tcggcacgaggggaattacgtcgagcagcttgngcgcgtggtgccccgccccggcgccccgcggcggcccgcgcccgacggcgctcgccgtcgggcccccgcgtcggatcctctggcggctcgggggcagccccatcgcgccgccgccggcccactccctctcacccccatccgcttcgccgccgccggacaggacgccggcgaagccgcgcgtgccccagggatggtggcggcggggctcctttgtgtcggcgctcgccagctagcggggatccatccgacggcgctgcaagatccggtgtggtggccctcttcgccggcgtcggggggtggatccggggcttctcaggccggatccgccgcgtggtggtgcggtgctggtggtgcggggctgatggcggcggggttgagcgcgcgaggtcctgctggtccggtgtctcggggcggctcgtcatgactctgtggtgggcgctggctggaggaggagaggcccggcgcagctggctggtgatggcgtgtcgctgcgaagcgcgcaggccggtggcggcttggtgctcctcaccgcggaggcgctcgtgccaggccagatctgcgttgcctggaggtgagggctcatggccggcgcacggcaggtgaggtggtgatgcggagggcctgacggggtgtggcagaggagatgtggctcgatctggtgggggtggcgccagcgggaggcagtgctgggttctcacgggcaggttggtggcggcgctgcgatggctcggtcaagatggagtcttgcgagcagcgagctttcggtcatccctgtgcggcgtggagagcggcggtgctttcctggtgatgccggcctgggatttctccgtggagaggcgggtctgattgtcgcaaggtcgttccttggagtgggcgacggccgttgcgggcagtcctggacctggccggaggtgctggttggctgcggaccctcgtgcaggctgggagtggatgtgtggccgcggtttccctgccgggtggtcggtcgttggtcctcggctatgcagctacttcggcaagtgctgcggtggcggcggtgtgaggcttcttggcagtgctaccaatcccatggaggcgtggcgatgggcgaagcgcggatgaaaattttgcacggcttctgccgggccggcggtgatggcatctgtggatgtcattcccctccttggaggcatcgtcgagcgtgttcgcctcatccctcgcgctctcggtgttggtggatgtctccgggtgaaagcctagattcgatgttctgatcggcacgatggcggtgtcctcgacgccgctcctctgttgggagcattgtgtttggagacacgactggttcctcgttgctctcctccggtgttcgccgctatccttttctgatcttcagtggcgctatgtacgttggtcgttggtgaatccaaggcggcgtcttcccggattggatcgagtcctgccattcatctgccactttctcttaggcgctcagggtggatggtgcgtcgacaagagaagttctgtggaagtgtggtcttcggaggtgtccggcgtcgatcgagacgcggtgctgtgtatcagtttaggataggctttttgcatagtagcttgcctagcggtggtgtttgtttgtggtcttgtcggtgtggtgttcgtgctacactcgttgttcgcatcgagcggtagctttcttgtaactaaattctgccttctataaagctatggtacgcctaggcgtactctcgaaaaaaagaaaa

SEQ ID NO: 3031 - DNA, 1239 bp, Triticum aestivum
  Clone ID: PAT_TA_3031
gtcgtccgtgaaggagtccctaccgcggcctctgtgcaagaaattcttttctttcaggctcagacaatggagatgatgtatggagtaatcgcacgagagctcaaggccatgaatattgaggatgcacaccttcaagattacttgaacttttactgtctaggcaatcgggaagaaccgtcaacagatggtagccctgagtcagataaatctacagataaaagtgcagcgggcctggctagaaaacatcggcggttcatgatatatgttcatgcaaaagggatgattgtagacgatgaatacgtaattttgggctcggcaaacatcaatcagagatccttggctggctcgagagataccgaaatcgcaatgggtgcctaccagcctcatcatgcatggtcttcgaagaagggtcatcctcacggccaggtatatgggtataggagctccctctgggctgaacaccttggtatggttgatgaccacttcaaggaaccttctagcctggactgtgtaagattagtgaaccaaatagccgaagaaaactgggaaagattcgcgtcagaagagatgcaaacgttgcaagggcacctcctcagatacccggtgaaggtagagcccgatggtaagatcgtcccgctgcccgaccaagaatgcttccccgacgttggcggcaagatctgcggcgctccgacctcgcttcctgattcgctgacgatgtagcatcacagcactgacttctcttcagggtccaagctggttcttttgctcacctgtaaaacctctctgaatgtcttgtcttgccgacggatggtaatctgtgatcacacattgtgtggcgtataggggaaagcacgggctgttcacggtgcgttgtagagttgtgcctttgtaagattttttctacagtctgtacatggacaggacaggacagggtcattgatagtgcgctccgtccccgcttcctgattcgctgacgatgtagcatcacagtactgacttctcttcagggtccaatctggttcgtttgctcacctgtaaaacctctctgaatgtcttgtctcgccgacggatggtaatctgtgatcacacattgtgtggcgtatagggaaagcacgggctgttcacggtgtgttgtagagttgtgcctttgtaagattttttctacagtctgtacatgagacagggcagggcagggtcattgatagttttggacatctctactgcgaactgttcacagcc

SEQ ID NO: 3032 - DNA, 1997 bp, Triticum aestivum
  Clone ID: PAT_TA_3032
cttcttctcccgacgctaaacaccaagccaaaactctaccggaacgggcgcgctcccggcattttctccacagccctcgtcgcggacgaaggcagtagatccggcggacggcggcccggcgcatctcctcgcctgcgaaggtgcataatttgctggcttgtgttagttcgggggaccaacaaagttactgaaaatggtggttcttgctgcttccatcatctcaaaatctggaaaagcacttgtttcaagacagtatgttgacatgtctcgaattaggatcgaaggattacttgcagcattcccaaaacttgttggaactgggaagcagcacacttatcttgagactgaaagtgtccgttatgtttatcaacctattgaaggcctatatctgctgcttattacaaacaagcagagtaacattcttgaagatctggacacactgaggctactatccaagcttgtgcctgagtactcttctctggatgaggatagtatctgtaaaacagcatttgagcttatatttgcatttgatgaggcaatctctctcggaaacaaggaaaatgtgacggtgcaacaagtcaagcaatactgtgagatggaaagccatgaagagaaggcgcataagctgatgatgcagagcaagatcaatgaaactaaagatgtcatgaagaagagagctagtgagcttgacaaaatcaggatggagaaaggcaaacttgacaaaggaggatactctatcaatatctggtccccgtgttattgaaaaaactttcagtgacatgaacatcagtggtactggctttggaagtggttctggattaagtggaataggcgctgatatggactcatttgcgagtaaacccaaaggtcgtccgtcagctgctgctactgctcctggcaaaggttttggtatgaaattaggcaaatcacagaagacaaatcagttcctagaatctttgaaagctgaaggagaagtcattttggaggatgcacaaccaagttcagtttcttcaagggcctcgcctcttataccaagcgatcccatcacagtgactattgaagagaaacttaatgtaatagttaaaagagatggaggtgttaataactttgatgtgcaaggaacccttgctcttcaggtccttaatgatgcagatggatttatccagttacagatcgaaaacaaagatgtacctggactcagcttcaaaacacaccccaatatccacaaggagttgtttaacagccagcaaattgttggagcaaaagatccaaacaggcctttcccaagtggtcaaaatgaaacaccacttgtgaaatggagaatccaggggatgaatgaatcgaatttacctctgtcagttaactgctggccctcggtatctggaaatgaaacctatgtcaacattgaatatgaggcttcagagatgtttgacctgaacaatgttgtcatatctattcctctacctgcacttcgggaggctccaactgttaaacagattgatggagagtggaagtatgacccaagaaactctgtattggaatggtccatcatccttattgatcagtcaaaccgcagtgggtcgatggaatttattgttcccccggctgatccgtcaacatttttccccatctctattggatttgctgcttccaatactttcagtgatttgaaggtcactggaattcatcctctgaaggaaggcaaccctccaaagtattcacagagggtccgtttggttgctgcgaactatcaaatagtctaaagccataattaaagcagttactgctgtttcttgttagtggcacaaggagtataattttgcatcaaatttgtttaaatatgtgtgatttggcctgtcccatacgtagcgtgtcgcaccattgagaaataaaagcatgaattctcctgtaccctgtttgtagtattccttgtgagattgttgtttctgtttcgtacatgaactgttgggtctttgaaaaaaaaaaaaaaaaaaaac

SEQ ID NO: 3033 - DNA, 1808 bp, Triticum aestivum
  Clone ID: PAT_TA_3033
gtcccgcccctcccccacctttcgccggacacgcgtgcacgccacctggaaggtgttcttcctccgcagctctactgtgctctcgtggcgtggatactccaccggagctggactgcctccttttcgcggaacccgtgtgctagctacgcaggctgctcatggaagaggtttcttccagtcactcttgcttcgcatttcatcaaacccctaccacttcgcggcggtctctgggcactggtcttggtccgcggcataccaagcttgttcgccgaagaaaaagctcacgttctcaatgttaggagaccttcaaatcctggtgattcaggtaaagcttaaggtcaaccgcagcttggttcaaggcaactgcagatgcgacgcaccaggggtatatgccaacgaagggaggggctccatgcgagaaacgtggctgaatccctgggcctgccacgaagggccaagacaggttctcaaagtcagcactggtgttcgtgggagtgggagccgaagccgacggtgtcggacgagaagtctggcaccgagactagcaaggcgccggcggtgctttttcttcctaggttttggggtgggcacgttccattttgagaagcaattgatggatcttggcacgggtgacaaggtgtggacggtggattttctgggacggggaatgtcatttccgtgtgaagaccctgctcctaaggccatggcaggggaggaggatgaggaatcatattggggttttggacaagattcgcaaccatgggcagatgaattggtgtactctgtagacttgtggcgtgaccaggtccagcacttcattgaagaggttatcggtgagccagtttatatcgtgggaaactctcttggaggttttgttgctctatatttagctgcatccagtccacaccttgtaaagggggtcacattgcttaacgcaacgccattttggggtttccttcctaatcctgcaagatctcctcgtttgtcaaagatttttccatgggctgggacatttcctcttccatcagttgtgaggaaacttactgaaacagtgtggcagaagataagcgacccaagaagtatacagaagatactcaggcaagtatatgctgatcactcaacaaatgttgacaaggtgttctcgcgtattatagagacaacagaacacccggcagctgctgcatcatttgcctccattatgtttgctccaatgggccagatatcctttcaggaggcactatctaggtgccaaaggcaggacattcccatttcccttatgtatgggaaagaagacccgtgggttacaccttattggggtatcagagtcaagcaacaggtgccagaagcaccctattatgaaattagccctgccggtcactgtcctcacgacgaggttcctgaggttataaactatttgctccgaggatggcttaagaatgtggagtctgagggttcagttgacctcccatttcttgaagattccagctttcaagaacatggtgtgtcgaaggagctggagtttgtcaggacagggtccaagaaatcagttagtgtgcggctcttcgagcctggtcgcggccgaggtagccaactgagctcattcttgaagcggcatgcctccaacataagggtagtgtccagatgattcgtccgtagttcgttagatagtagaagcttcaattgtatattgtattcattattctttatgtaaagtagtcaggttgatgcctagatgtacgaaatagagacaagttcaaatattttagtgaatgtgaatatgtgtagtacctgcccgggcggccgctcga

SEQ ID NO: 3034 - DNA, 418 bp, Triticum aestivum
  Clone ID: PAT_TA_3034
gcaagggatgcaccatgtccgcccacgccaagtgcgccgccaagtgctccaagtcctgcatcgccacctgctaggcgcctcccgccgccgccggcgacggtcttgatcatccatctttagcttgttttggtgaagggaataagggaaggggcacgctgcagctagctgcatgtctgcatgtgtggtgtagcgtggcctctcgatatatcgtcttcgtgtcgtcgccgttggtgtagtgttttgatgtgtccccgtgtttgttcgtgtgtgattagggctaatattcgttatgtcatttccatctttgttttgttatatgtcctttctggtgaaaaatttggatgaaattaaacttgaataaaaataaaaacatgcaagccacaaaaacgcggacggtgggcggacgcgtgggcggacg

SEQ ID NO: 3035 - DNA, 914 bp, Triticum aestivum
  Clone ID: PAT_TA_3035
cgtccgcccacgcgtccgcccacgcgtccgggagcagccgcagcacggcaagcgggcggaccacgtcgcggcgagagcggcgatcatgccatcggaggagcagccgcaggacggcaagcaggcgggccacctcacggcgagggcggcgatccagccatcggaggagcagccgcagggcggcatgcgggcgggccacctcacggctgccaagggcctgctggaggaggagcccgccgcgcggctggcgtacgtccggacggaggagaagaaggacagcgaggacgcggcgacgatgccgttggaggggatgaagcccggcggcggcgtggcgatccagcagggcggcgacccgggcacggtgccgtcggggagcggcgagcacgcgaaggaggagagcggcgagcacggcaaggaggggagcagcagcaccagcaaggagggggagaagtcggccaatagctgcctgaccaaggaggagtgccacaagaagcggcttgctggccggcaagggctgcaccctctccgcccacgccaagtgggccgccaagtgctccaagtcctgcatcgccacctgctaggcggcccccgccgccgccgtcgacggacggccggatccctgagttccacggcggccgtcttgatcgtcattaggttgttttggtgaagggaataagggaaggggcacgctgcagctagccgcatgtctgcatgtgtggtgtagcgtagcctctcgatatatcgtcttcgtgtcgtcgccgttggtgtagtgttttgacgtgtccccgtgtttgttcgtgtgtgattagggctaatattcgttatgtcatttccatctgtgttttgttatatgtccttcctggtgagaaatttggatgaaacttgaataaaaattaccccatgcatgcatgttaaaa

SEQ ID NO: 3036 - DNA, 1154 bp, Triticum aestivum
  Clone ID: PAT_TA_3036
cgtccgcgcccacgcacgcgctccctcctcgcgccgccgccgccgccgccgcataaaccccaggccacggcgcttgcctcctgatcggcgcggcgaggggaggtcgtcgtcgcgcgcgcgatccgggagggcgagaggggagggcggtcgcggtagaggagatggcatcggaggacgtggtggggaagagcaggggcgacacggccgtcaacaccatcgtcaacctggccgagggccgcaggctggccggctggcgacgcgtgcggcggcgggagcggcgatcaggccatcggaggatcagccgcaggacggcaagcgcctcacggcgagagcggcgatcacgccatcggaggagcagccgcaggacggcaagcgcctcacggcgagagcggcgatcacgccatcggaggagcagccgcagggcggcgtgcgggcgggccacctcacggcggccaagggcctgctgggggaggagcccgccgcgcggctggcgtacgtccggacggaggagaagaaggacagcgaggaggcggcgacgatgccgttggaggggatgaagcccggcggcggcgtggcgatccagcagggcggcgacccgggcacggtgccgtcggcgtcgtcggggagcggcgagcacgcgaaggaggagagcggcgagcacgccggcaaggaggggagcagcagcaccagcaaggagggggagaagtcggccaagagctgcctgaccaaggaggagtgccacaagaagcgcctgctctgcggcaagggctgcaccatgtccgcccacgccaagtgcgccgccaagtgctccaagtcctgcatcgccacctgctaggcgccccccgccgccgccggcgacggtcttgatcatccatctttagcttgttttggtgaagggaataagggaaggggcacgccgcagctagccgcatgtctgcatgtgtggtgtagcgtacgtagcctctcgatatatctcgtcttcgtgtcgtcgtcgttggtgtagtgttttgatgtggccccgtgtttgtttgtgtgtgtttaggactgatattcgtgatgttagtgccatctgtgttttgttaaaaatcctttgtggtgataaatttggatgaatcttgaataagaattgcatgcgcatggacgcttgttaaaaa

SEQ ID NO: 3037 - DNA, 2400 bp, Triticum aestivum
  unsure (1)..(2400): unsure at all n locations
  Clone ID: PAT_TA_3037
gcgattgaagatcctgcttcaggttcaaaatcctcacagtatcaagtacaatggtaccgttcaagggcttaagtatatatggagaacagaaggccttcgtggactgtttaagggcaatggaactaactgtgcaaggattgtcccaaactctgctgtgaaattcttcagctatgagcaagcatcaaggggtattttgtatctgtaccggcaacagactggggatgagaatgctcagcttagtccaatcttgcgccttggagccggagccacagctggtatcatagccatgtctgccacttatcccatggatatggttaggggtaggattactgttcagacagagaagtctccctaccagtaccgtggtatgtttcatgcattgggcacagtgtaccgtgaagaaggcttccgtgctttatacagaggctggcttccatcagtgattggnagttgtcccttatgttggccttaactttgctgtgtacgagtctctgaaggactggctcctccagtcaaatggcattcgatcttgcaaaggacaatgagctgcacgtagtaacaaggcttggatggggagctgtggctggaaccataggccagactgtggcataccctcttgnatgttgtcaggaagaggatgcagatggtcggctggagtcacgctgcttctattgntactggagaaagcanagaggcactccagtacaatggtatgactgatgcattcaggaaaactgttcgccacgaagggtttggtgctctggacaagggtcttgtgcccgcgcgcccccgcacccgcccccccccgccccccccccccagccccccacgcacgcgccccctccctcctcgcgccgccgccgccgcaaaaaccccgggcaggcatcttcctccgaggcgcggcgaggggaggtcgtggccgccgcgcgcgatccgggagggcgagaggggaggcgggcgcgggagaggagatggcatcggaggacgaggtggggaagagcaggggcgacacggccgtcaacaccatggtcaacctgcccgaggaggcgaagcccgcgcgcgagcgcgtcaaggggcccggccaccaggtcctgaccctctgcaagtccctcttcgccggcggcgtcgccggggacctatcgaggatctgctgttgctccgcttaagcgcttgaagatcctgattcaggtgcaaactcctcacagtgtcaagtacaatggtctccggtcaaggggcttaggtatatgtggggaacagaaggcattcgtggactgttccagggcaatggggactaactgtggcaagggattgtcccaaattctgctgtgaaagttcttcagctatgagcaagcatcaaggcggattgtgtatatgtaccgccaacagactggggaggagaatgctcagcttagtccgaccacgcgccctgcaggtggcgccgcagctgggaagcagaggcatggctgagactgatcagaagggtagcgtcagggctaccgaggagggagcagaagtcgaactagagctgcctgacccgggggcagtgccagaaatagcgccgagctgtgcgtcaagggcggcaccctgtccgaccccggcagctccgcctccgagtgctccaagtccgccgtcaccagctgctaggcggcccccgccgccggtttcgtcggtccggcggatccctgagatctacggcggccgtcgtgatcatcattgggtggtgaggggaaacaggataacggaacgagaccgctgcatacacctctggatgtggtggggagatggatccatgtggtcggctggagcgtcttctggctgtatggctagtggtggagtctttgcgggtctccgtgtatatgggaatgggacttgcattcagaataactgttcgatacgaatgatttgattctctgtacaagggtcttgtgcccaacgcggttaaggtggtgtctaacatcgccattgcgtttgtgacgtaaggggccgtgaaggatgttctatgaggagagataaggatagactgaagaatcggacctagcgctgtccgtgttatcaacttctatttttttaggtgttggggttcccttgttttgttgttaggcagggcgagtagaaggacaatataggtcccgaggctccattcagcataaggccctctcagcccttgtccatatatccgcctactggccccggagcccttgtcgatattgcctactaatggctcaagaaccctaattactctttaatcggaattgactgagtcagctggtactcattacagtgaggaccttagtcttaaggtctgatttggtaaggaaccctgtcttgactgtgtgcgaaacataagctgcatgctgtgtgctgctaatagttgattttcatgattctcttctaaaaaac

SEQ ID NO: 3038 - DNA, 886 bp, Triticum aestivum
  Clone ID: PAT_TA_3038
gacaaccctcctgccgccctcggcacgagctgaggcccgccacgcaacaacacggcacgatgcggcggtggtgttgctcctccgccggcggcctcgcccgccgcttcctctcctcccccatcgtcgtccatgcccgcccgcccgtgccctccctccccttccgccgcgaccactcccacacccacgcgcctctccccatcatgggctcgctgttccactcggcggcagccgctgcgatcgtccggcctccggtgatggcgatgcaggtgcgccactacgccatcaagggcaggtcccgcgcgccgaccacgcccaccatctccaaagtcaagaaatacaagatgaaggccccctcgtccatgaagttccgcttcagaacgatgaaggacggccagatccgcaggtggagggccggcaagcgccacaacgcacaccaaaagtccaaggaagcaaagagaagacttcggaagcctgctttagtgcatttagcttatgccaaagttataaagaagctcaacttctgcggctaggaaattgatggatggaggatggtgattggcacatgaatctgatcaatgaatactgattgccaacttatcttggtacatttgtccttttgatgcattgccatcagatttttgtgctcccatctcttcaccgatgccgatgattattttattgtactaccatccacttgttttctaaacaatcagttgataaaggctcccctgtgttttgttatgcacacggagaagactcaccatagtgatgatagacaacctgctgccagtaaggaaactctatgtcccttgtcctagcttcagattcagtgagcttcacatgccaatgttttgaccggagttcaattgtagaaattcagaggaca

SEQ ID NO: 3039 - DNA, 1909 bp, Triticum aestivum
  Clone ID: PAT_TA_3039
tcggcagtccccgcggcgtccgccccgcagccgccatcgaccaagagcggcggcgaccggtcggcggccgactcggctcccctgatcccctccggtatggacggccaggctccacaccccgtcgccgtggcacccggaatccctgccgcagccacctccgcctctggagacggaggcggaggacgaccccgtcgtcgtccccgacgcctccgatgccgcttcttcggagccctccaaggtcggcgccctttcgacgtcgcctcttattaaggcggggggacgacccggtcgtcgtccccgactccgtcgaacccgcttcttcgggtggcctccgtggttagcgcgtcgcggcctcttgacactgaggaggatcccctcatcgtccccgacacttccgaggccaccaatgttggcacaggtagcgtggtgcccctgttgccatcgccacctcgtgcgcacgaggaagcgcccctgctcgtgctggtcgcgcaggcccctgcggaggccgacgacccggtcaccgtcgccgtcgtccctgcccatccgctcccctcccaggtggttaccccgggggccggcctcttccgcgaccgccatcgcccgatagttaaacaggtggagtactacttcagcgatgagaatcttcccacagatgagtttatgttgaaatttgtgatgaagaacaaggagggccttggtaatgttccgcttggagttccagcattatgcccacgcgtccggaaacttgttcaggaccactcgacaattgaagctgcccttaggacatcatccaagctggttgtgagctctaatgggaaaagggtcagaaggttacatcccttaccatgcaatgaattgaaagacgtgaagaaaaggactgttgtggtggaaaatctacctctggatttctccctggagagtatacaggagaaatttggatcagttggcaaaattatgaagataaccatccatgatccacatgcagttggagaatctgcagcatcgaagaagcctgacatcatgttgagtaataaggtacatgccattgttgagtatgaagcagtggaggcagctgagaaggctgtggccaccttaaacgatgagaggaactggagaactgggatgagagtcatacttctggctaaacgaagtgtagtgggatcaggaaagaatatccagtcttctaaagaaaatcatggaacatgtttgagaaagaacaacgagggccagttttcaaaagaagtacagcagtcggtatcagaaaaaaatggtggtgctgattcaggagaggttgcttcagataaggagaatgtgaactctgatgttaaccatgaggaggtgcgccaacaccaaagggcaaatgctagcggtggtcgaaaaggcagatacagaagccaaggaaaaggcctgagtggacaagggcacggctcatcccctactattcctggttctgactctgcaaacaagcctatttctggaccgagaatgccggatggaacaaggggctttacaatggggcgtggtagatcgcttccacttccgaaagcggagaaggcccagaagaccgaggaatagaactttatacaaatgggtagtgctttttcatgccactttataaagacgtaagcataaccatgcttctatgctacatttcctttatgacttgtatatggaaaagctcccagttgccttttttgaaataactgtcacttcagttggagatttcgaaaaaaaaaaaaaaataaaaaaaaaaaaaaccacgcgtggctggtcctttacccccttactagtataatactactatgtatatttgtgacaagctgacacctggtttgatgactgccaaagctttgccggttgccatatgctttggcttggaaatgtctgcttaggagacccagttatgtcg

SEQ ID NO: 3040 - DNA, 1286 bp, Triticum aestivum
  unsure (1)..(1286): unsure at all n locations
  Clone ID: PAT_TA_3040
gcatcaaagccgcttctcttcccctaaaacctagccggcaattcccgatccggcccacgcgcctcccccccataccctcgtccccaagctcgcgaacctcaccgccgccaccgcccgcaccgccaccggccgctccgcgcgaccgcccaccatggcgcgtaacgaggagaaggcgcagtccatgctgaaccgcttcatcacgatgaagcaggaggagaagcgcaagccccgcgagcgccggccgtacctcgcctccgagtgccgggacctcgctgacgccgaccgctggcgtggagagatcctgcgcgagatcggcgtcaaggtcgccgagatccagaacgagggcctcggggagcaccgcctccgagacctcaacgacgagatcaacaagctcctccgcgagcgcagccactgggagcgccgcatcctcgagctcggaggccgcgactactctcgcagctccaacgccgccctcatgaccgacctcgacggcaacatcgtcgccatccccaacccctccggccggggcccaggctaccgctactttggcgctgccaagaagctccccggcgtccgtgagctatttgacaagccacctgaggtccgcaagcgccgcacccgctacgagatccacaagcgcatcaatgccgggtactacggatactatgacgacgaggacggtgtgcttgaaccccttgaggctgctgccgagaagcgcatgcgggatgaggttgtcacggagtggcaccgtgtggagcgtgtgcggcgggaggccatgaagaatgtggtgagtggcgaggtggctgcagcaggtgggcgtggtggggaagctgctagggaggtgctgttcgaggaggtggaggaggaggttgaggaggagaggaggctggaggaagagagaatggaaagagagaagggggaagaggccgggagggagtttgtcgcacatgtgccgctccctgatgagaaggagattgagcggatggtgctagagaagaagaagaaggagctgctcagcaagtacacaagtgataccctgcaaggcgagcagaaggaggctaaggagatgctcaatgtgcaacgctaggagagatgtacgctcttgtttatcttggctctagtagattacttaactggtgtagactaggcatgcatccaaaataccataccataaagactgctctactgattttttgttgccctgtaatttgtgtgtgcccatttactctttagtaccttcatgctgcgaatatttaattttatgaggcaaagncctgtgttcagtc

SEQ ID NO: 3041 - DNA, 686 bp, Triticum aestivum
  unsure (1)..(686): unsure at all n locations
  Clone ID: PAT_TA_3041
ggcacgcgcccgggccggagcggttcctggccggcggggaggccgcggatgtgtccgtgctcggcgccgacggccggctcgtgccgttcgggtccggccggaggagctgccccggcaagtccctggccatgaccacggtgaccgcgtggatggccaccctgctgcacgagttccactgggcgccggcggcgtcctccggcgtcggcctgtcggaggtgctccgcctgtcgtgcgagatggcagcgccgccccaggtccgggtgcgcccgaggaggtgctccgcctgatgtggctctggccacaggtttgatcggccgtcgactgtgctgaccgtcgtttctacagttcgtagctcgtagcccgtgaccccgtggcttcacgaaagtgaactaattaaagctgacggcgtaaaatgtaacctgcgccgacgcgcagctcagttctgagtttctttctaacgtgtgtgatgtgatgtgtatgtaatgtaacgcatcatctgtgaggatgagagtgactgacaggggttcacatgtgtacaaaattgcanaacaaaatctataanagatttttgcggagtgtgcnatagtacacgttgggggggcccggtaccattcccctanntnatctatancgcctaangcctctttanacgtntnctggaaacctgncttnccaatanncctgcn

SEQ ID NO: 3042 - DNA, 1676 bp, Triticum aestivum
  Clone ID: PAT_TA_3042
gtcggcacgaacgcatcggcccccggctgccacgctctggggtgctgttcctccccccggagcaggcgtgagcgtgggtcgcaacagcgacttatccatcgtcgggtcctcggaagagaacctgccgcagcgcgagaggctcgacgggctgtgcgagaatgggctgcccaagctccagacggcgtgcgccagcggcgaggcagcgcgggacctttccgaggtgccttcggaccccgcagcgaacgcacacggtggtgcaagtgggatgtcacgtgctaccgggggggcctgttacaattcccggatcctccacggaatgagttgaaggtggcgtccgtgcggctcagcccttcttcgggcgtgtgaatcgcctgcctcagtgtcttgtacgttgtcggctccaccgaggacgagcggacgtggatcgaaatgaagaggaaggtcttggagaagtgggtgaaaagccacaagcagaggatcgccagctttgaagaaacgctggagaggcctgaggtgtggggcttgaacctcccgggagtcgttacaagtcatcggggtctgctcaggcgaccatcctcggcgtcatggacggtgccggactcaacaacgacgcagtgctggtgtctgcattccccggcatcaatgccttgccggctcgccgcggctccagacggcgcttcaagttcgagggacatgaacgccagcgacctgccctacgtctggggggaggggggctagcggcgacggtaagaaggccgagtccaaggcggtgacgatcagcggcttcgaggacttgccggccaatgacgagcaggcgctgatcaaggctctcgcccaccagcccgtctccgtcgccatcgaggcctccggcaggcacttccagtttcacagcgggggagttttcgacggtccttgcggcgcgcagctagatcacggcgtggcggcggtcgggtacgggtcggacaaggggaagggccacgactacatcatcgtgaggaactcgtggggtgcggactggggcgagaagggttacatcaggatgaagaggggcaccagcaacggcgagggcctctgcggcatcaacaagatggcctcctacccaaccaaggacaagtgatgttccagcctcaaatcctgcatccagaggattgaagatttgaaccatccttgagagtccttgttcccgatctttgcatttccctgctttttctttcacgtttttccttttctcaatggttcctttcggttaatgcgacgaacatggactgaattaataaaatttatcaccaacggcgagggcctctgcggcatcaacaagatggcctcctacccaaccaaggacaagtgatgttccagcctcagatgctgcatccacaggattgaagatttgaaccatccttgagagtccttgttcccgatctttgcatttccatgctttttctttcatggtttttcttttctttttcaatggttcctttcggttaaaacgacgaacatggactgaaataataaaatttgtttccaaatttctagaaaaggcgctgcggctggcctgcccttcctttcatgtcgagtatgtccgtagcctacttccggtcgccagggtccgtgccggctctgaactgaaaaccgaagtcattttgtaacatgtatttttgaaaaaaaaacaaaaaaaa

SEQ ID NO: 3043 - DNA, 514 bp, Triticum aestivum
  unsure (1)..(514): unsure at all n locations
  Clone ID: PAT_TA_3043
tgttaatggaattatctattgattgtagtattaagtttgcttgtgttttcagctaaaagaaaggaaaaaaaggaacaacatacatttctgcattgcttcatccttgcggctgagagaggcatgcgttctcctgtgaagagtgcataaattgtttttattcgcttgatatttatttatgccagctaatttgcaggtcttacaattaatactaatctttaggcacaggaccaggaccacatggattgcatcatctggtttatgaaatactggataatgttgttggtgaagctcaagcaggctatgctactgagattaatgtagtctttcatgatgacaattcagttagtgtaactgacaacggccgtgggatccctacagatatacacccgcanncgaagaaatcatgcgtggagactgtcttaacgctaatgcatgctggcggtaaaacctatgaaagacttcctgaatgttcaatgcttctacaaatattgtggaaaaagaattggtatgtgtt

SEQ ID NO: 3044 - DNA, 312 bp, Triticum aestivum
  Clone ID: PAT_TA_3044
tttctttggagcagcgggcgaggacatctcctcgtcgagctcctctttccgtgggcgaggacatcccctgtatctcactgcaccatgacgaacagggggaggcgcttagcgcaccggcggcgagtttctagagctgcaaattgcaagtgagctttccaatccaccttttagttgatcctcttcccgtgagcagttgcaggtctatgcatggcgagactgcttatatatgagcacgccgcggtcgtgtactgctaggacggtgaccgttcaggactagagcgacccgtggccggcgatttacataccataggc

SEQ ID NO: 3045 - DNA, 288 bp, Triticum aestivum
  unsure (1)..(288): unsure at all n locations
  Clone ID: PAT_TA_3045
aganaaaagagngngcnctctccncgcgnntctctctctctctctctctctctctctctctctctctctctctctctctctctctctctctctctctctctctcatttttttacagtacttctgcgtgggtgtttattcaagtgtttggaacaaactgcattcgccattggtgcatctacctgctccggtgaattcttttggtggaattgaagtgtaatttgattggatccatgtaggcgttgatgatctcatctgttgattgtaactgtgattaaagaagaaactag

SEQ ID NO: 3046 - DNA, 805 bp, Triticum aestivum
  unsure (1)..(805): unsure at all n locations
  Clone ID: PAT_TA_3046
gcgcccgcagctggccctacccatctagcacatccacataggccccctcgctcgcactgttgccccccctatcgccctgcgcctcgccctgccccgcctcctctccccagcctccggacaggcctgccgacgccgcccggtcgccgtcccgcgacgtcccaccgacgaaccccgcacggtgccgacgcggagtgggcgagcgacgcgctaacgccgcgcgtgagcgccaccgtgcccggtgccctaccgacgccctcaacgtgctcatccggcgcacgctgcctcggcacgagcgtgctgctgcccgaggtcggctttccggtggccctggcccttgtgccccctcctcccggcgtacggcctccgcgtccacctccacgggccctgatccgcagccgcctgctgacatcacctgtccgcccctcaacctccccgtctgaacttcacccgcccactcaattgccggggggcattaatgctgctctggctagtacgagtaaaagcgtgttgatcagatttctcaataaattaagcttcttagtatgaaattccttccgtcatttttatttttgttttcaccaattgttattctgtaaccatttaaaattctaattttttttatcccagaactacatattttgttttttggtaaaacaaacattaaacaatcaaaaaaaaatataacaataataaaatgaaataataaaaattactcctaaaaaaaaaactctcaaaaaaaanaaanaaaaaacnccagggggggcccggtaccccaatttggcccttatagtgaggtcgtattacn

SEQ ID NO: 3047 - DNA, 380 bp, Triticum aestivum
  Clone ID: PAT_TA_3047
tagcgtggtcgcgggctttatatgataacttctgcagctgttgtacagtatagaattgtatatatatgtcttaaagtcaagtgtatatttgataacgagtgtctgtagagtaggactaatatttatctggctgatagctgtgaggcgtctggtgttctcgtgtgaccatagtaggagatggtataaagatcggtctccttcggtcattcccggaagaaatggatctggcattctggctggaaaacttgctagtcagttcctgtcatggtttctagtggatgcactgaacagtccccccccccccccccctgtaccgttttaaatatgaggagcaacaaacataggggaatacggcatatattttatttaaaaaggggggg

SEQ ID NO: 3048 - DNA, 1013 bp, Triticum aestivum
  Clone ID: PAT_TA_3048
gccggggcccaccgccgctctcggctagagcttctccgtcccgtacccctgcagaccgcgatctccgcctgaaccaccggccgggactgctgctccgcttgctctcccccgtcggagatccgcccggagcgactttcgtctttctgggttgttccgaagctgcagaagcccaaacccggaaacagagtagacggcgccgcatctatatttgcactcccacgcttaaagccgaggcggcggaggaagctgtgacagccatggcgtcgtcgttggcaacggcaccggctgctgtacgcgatatgcagtgcgacctcgagtcccaggccaacgccctcagcaagatccagaaagacatctccaagaatcacgaggtccgcaagcagttcaccatccaggtcggcgagaatgaactcgtcctcaaggagctggagctgctgaatgaaggggcgaacgtgtacaagctgatcgggccagtgttggtcaagcaggacaatgcggaggcgaaggccaacatcaaaaagcgcatcgagtacatcacagctgagctaatgagaatggatcgggcgcttaaggacttggaggagaaacagaatagcaagaaggaatcgataatcaagctgcaacagaagatgcaggctgtacaagcaaaggcgcaggcgtaaatgaagggctccctgcattagggccttcgtcctcccaaatgtatgggtctgtacaaggcgaagttagttgccttgtgttatctatcccctaaaaaggtgaaagaaatctgtagtgttcagagattgagagaagttccaggtttgtgtagtgagagattttgtttgggagtggatacttggttgaagatgtacatcttgctggtttactagtgatatgcttgaattgactttttttttgagaaggaattggatcaatttatgaaatgtaccaatctattcatgtaccatttgcttatgttgattaatgcttatgttgattaaaaaaaaaaaaaaaaaaaaactcgagactag

SEQ ID NO: 3049 - DNA, 612 bp, Triticum aestivum
  unsure (1)..(612): unsure at all n locations
  Clone ID: PAT_TA_3049
cccgtcggaagtgtttcccaggaatacagcttggaagccggcaaaaattcgtgattctggtgcttgtactgtcatttattgttatgctcgcctttgcgatcctcatctgggttggtaggggagaaaatcctattgattcatcgctactgaaaaaggtttatttggatgtattttcagtagttgttctagtacttggcgctgctttggcatgttatggtgcattattgttctcgaagatgagcaaagtacgttctgaaaccgtgtcaactgagaagtggaaggttgccagtttagctgctgtctcacttatctgtttctcgtcttctgctatactagcacttgttactaatattccaagtgcttttgtattggtactccactgaggcggagatcataaaaaatgctgttatattatttttatattatttaataggctcatcggtaccatcaggatttgtttaatgggtcatgagagatatgcctcaacgacaacgtggaaaggccacccaatcgagatggtaccttgtcaaggacagacatccctaaacacaggaatggaaacgcatagcctcnacaagcccaatcaancaattaccnaagaaaanataggag

SEQ ID NO: 3050 - DNA, 721 bp, Triticum aestivum
  unsure (1)..(721): unsure at all n locations
  Clone ID: PAT_TA_3050
cgtccgcccacgcgtccggcgccccgcagccgcctcctctcctgccgccgccgccactcatcctcgtctgcctcttctcctaccgccgcctcctcggcctcggccgtccctgctctgccggcgcccgtcggccttgatccggcctcggcgggaggagcttgccctcgagtaggactcaatataaggaggggagcagcagccgcgccccgtgctccaccggtgcccgtcgccatcgatccgtcctcggcaggaggagctcgagccgaggagcgcgtcctcgacccagactccgcaggaggagggaagcagtagccgctccagccgacgcgcctcgccgcaacctccgctatatcaggagagagagaagataagacggagagagagaaggaggagaggagggagaggaaaggaggtgcagtggcagggaaatcttcgtcggatgcgtcctatatgtgatgggtgtgttcccatcaagtcgatggtggggttgatgtgcccgtccattcgctgatccgctggctgagctcgtcttctcagtggcagacttgtgttctatgggagtcgggagcctttgtttgtgtntattcacctgctgcttcccctcccgcctccctttttctcctttttctttctccttttttttctttcttttcccttcttctcctctcttttcctttttccctctttttttctttttttcccttcctttttctcccttttt

SEQ ID NO: 3051 - DNA, 1764 bp, Triticum aestivum
  unsure (1)..(1764): unsure at all n locations
  Clone ID: PAT_TA_3051
gaaggaggcccgcggcctcgtcgcctttcacaccgaggtggagcaaatatgtctctgtacagccctcatgctcgcaggggccttgcgagaagtggaaggtagaggtcgtacgccagccggagcaacaggagcaaggatctggcgtcatctgcctcccggttgcgccacaccgcgccacctccctccctgctctcctaccgccatcgccaccccagctcgtttgccccacctcatcccgttgccgtcttggtcttagatgttacaggtccgccggcgcccgtcggccttgttccggcctcggcaggaggagcttgccctcgagtaggactcaatataagggggggagcagcagccgcgccccgtgctccaccggtgcctgtcgccatcgatccgtcctcggcaggaggagctcgagccgtggagcgcgacctcggcccagactccgcaggaggagggaagcagtagccgcgccagccgccgcgcctcgccgcagcctccgcgatatcacgagagagtgaagataacacgggcagagagcaggatgacagtagggagaggatattctgtggtagggccggccattcgatgtgtcagtgcggttactgatgtacaggaggcgtccatggtgtcagtgctcgggcgtctatgcttgtcttctgtatgctctagcagccaggtggctcaagaaatagaagacgttcatgttcatttggtccctcatcgccgggaggacgggcgaggaggtcgaggcccactggggttcacgaggaggcgcacgggcggcaatcactacaaccatcatgtgctactgcaggctttcctagcctcgtcacatgatcaacacggcgagcatcggcaaagggcagtgccaaaccaagtacgcgaggagcgcccgggccgtccttcaccctccaacaatggcgacaacgactgtgcgtcatgggacgaacatggagctcaccctctctacgccgtgcatcacatctacttaatttggagggttacaccgggtgtttatatacttcggtcgatggtttccgtgccttgaggaacaatcctattattgtactatgcgtactgactatatatgtatgacgcataaatcctcacaagttggaacccatcactgctcatgctcgaccgtgactccacgcgcaaggtccgcctagccacgcgtaggtcacgccgccggctgtcgagcctcctgttccaccctgcagtgtgttcgaacagccgaagctgagtatgcgaagattcatccccggcccatccttgttcaacgcatggaagcaatgactgctgctggctttgaagctggttgaggttgctgcttgccgttggttggagccttgtaggtagaggccttgcggtggtccaagattcttacatagtgttgtgcctggtttcttcttgaaggatttgctgcgaaagctgggaatgttaagaggaatctgctttgagaggtgtcgtagtatgagaggaaacgatttcttctaggccagtggtgttcctttgcgctatagccagtgcgctatctcctaggttatctcatataaagccatgaacctagcatgaactcgaaatataaaccattgtatatgaagatgctatctgagtacgtatttgcatgttcgtagatctactacagatgctttattatgtataaatatgccataacctatcatggannnnnnnngacatcacagacaagttcatgcttgagctcactttcattaagctgcagctcgcgtaaccactattttt

SEQ ID NO: 3052 - DNA, 1050 bp, Triticum aestivum
  Clone ID: PAT_TA_3052
ccgaggtacatgccaagaggcagccttggagagctacttcacggagaatcttcttcttcactcgattgggagacacgcttcacgatagcccttggggcagctgaagggctttcatacttgcatcatgattgcaagcctcggatcatccaccgtgatatcaagtcaaataacattttacttgatgacaactttgaagctcatgttggtgactttgggttggctaaggtaattgacatgccagtctcaaagtctatgtctgcaattgctggttcatatggctatattgcaccagagtatgcgtacccccccggggtggccgcgaaatctgacatatacagctatggtgtcgtgctgttggagctgctaaccggccgtgcgcctgtgcaaccgatagaattgggaggtgatctggtaacatgggccaaaaattacatcagggacaattctctgggtccagggatatttgacagtaatcttgatttggaagataaagccgtcgtcgatcatatgatcgaggtcttgaaaattgctctgctatgtagtaacctgtcgccgtacgagagaccgccgatgcggcatgttgtagttatgttaagcgagtccaaagatagggcccgggcgagctcggcgtcgtcgcctgcttctgataattcttcgaagaaggatagctcatgatgtatttatatatataagttcagttagtgaaaggcaaccaataccagttgctccctttcccctgttgcttatggtggggatgttgggagcatgcactcattctttctgtcaattgttttctagtgggataaataatactgactgataacagtgggattgtgtctgtatgttagcctctctgatgaagaaggtagtctcgagtccagacagtaaccccgagtagttcagccagggttcctccctggacgtggcgctgtgcctcttgcttagatttgggtttagtattgagatttctcaatgttgaaatatgaatgtgcttttgctggaacaacatggtctttctgaaaaaaaaccaaaaaaaaaaaaaaaaaactc

SEQ ID NO: 3053 - DNA, 920 bp, Triticum aestivum
  Clone ID: PAT_TA_3053
ctcctcatcgagacgcaggcagagtctgcggctctgcgggaggccatggcctccatcaactccaagggagacggagacgccgtacacgggcacgatcctgagtgcgagaaagccaacggagcacccaagccatcctccaacggacacggagctagtgcagtctgatcaagagattccaactgcttccaagtgctaactgcgggtgcgcgcgcgcgtctgaacgaaatgtctcggtcactgccggcgcggcctcgtgggcctgcaggccgggccggtcgtcgcgtcggcgttcagcccactgatgatgatcgtggtggccgtgatgggctccttcatcctctccgagaagatatacctggggggcgtcctcggctccgtcctcatcgtcatcgggctctactccgtgctctggggaaagcacaaggagacccaggcggagtccgcggccctgcgggaggcgctgcctatggccatggcctcctacacctccaaggtgaccggagacgccgcgtcggccggacacgatccggagtgcgagaaagccaacggagcagccaagccatcctccaacggacacggagctagtgcagtctgatcaatcgattccaactgcttccaagtgctaactgcaaatgtctcgtcactgacgttgcatgcactagggccgtgtgcgctgcatgcaaggggagagtggaataattttgcgccgtgccttttatttttgtcctcttgtatgatttccacaaccaacgactatagtactccagtacgccttgtatttttcttcttcttttttttatcgggggagaaagaaatgttgtgctccggcaaggggcatgtaccgatgtacgtgttggtgtaagagaattttgagtgtttttgtaaaaaaaaaaaaaaaaaaaaaaaaaaaaaaaaaaaaa

SEQ ID NO: 3054 - DNA, 658 bp, Triticum aestivum
  Clone ID: PAT_TA_3054
gccctaagtactaaaaagctgcgggccgaccaccgggctggcttacacccttccagctcgcgacgccacctgagacctaaccacctcggctgctagtgctagacgggcacggcctcgccgactccttcttccatcagggtttggtctcatctgtgggagctcacgctcttggatccaagttcaggtttgatctgtgaggaagttcgatttgcaactctgcagtgctattccgaaccggaagcttgatcatggaaggggccactcccactcccgctccctcaaacacaaggattgctgtggtcaccggcgggagcaaagggatcgggctggaggcgtgcaagcagctggcaggcggcggcgccatcaccgttgttctgacggccagggacgaggcgaggggggacggcggcggtcgagcagatcaagcggctgggccacgcagatgtcatctttcatcagctggacatcacggatgcttccagcatcgctcgactcgcagatttcctcaagacccgtttcgggaagcttgacatcctggtgaataacgccgcgacggatgggattgagcatgtcattgatccagtttatggcttaacgcccggcgatgaaacgttcaatggcatggacgcgggccagaggatcaattggatgtggacca

SEQ ID NO: 3055 - DNA, 705 bp, Triticum aestivum
  unsure (1)..(705): unsure at all n locations
  Clone ID: PAT_TA_3055
ctttggcgctacatcgcctaccgacatgacttcatcgagaacgccgaggacatggggcgcccagcctctgggtgatgagagcgacttggaatgtgagattgaaccctttcctaagccgagcaacgaagctgcagctgaggcctcccggttcgcgaagatcttaatctatggaccttcacgtgagcaaggttctagtcattgtgttaactcagaggggcctctgctaaacactccaaatgagaagataccgcgtgttccatctgacaaacagcttgctcagagccatcgtctaacaaatggtacaggtccagtttccaactcaaaacaggcatcccatacagggttatctcctgatccttttgatgggaatggacctcataaaaagacaaagaagcctaaagcatggtccaacaaggaggatgcagacttaatggatggtgtacataagtgtggtgaaggaaattggctgaacattctgcgtaaatataacttcgatagcacaagaacttatgttcaattgtctcagagatgggcagtcatttgcaggcgtcaaggaacaaccaagcttgctaaagttaaatcagtcaccacggagttcgatataaaagctactcaaaaggcattctctatggctcttgatatgcctatggngacagcctgtggattctctacattaagattaggagcttcacaacanagcgctca

SEQ ID NO: 3056 - DNA, 1440 bp, Triticum aestivum
  Clone ID: PAT_TA_3056
acccctgctttcccagcacagcgtcggccctggaacgtccatgtgcggaacgaaggtagccctccttactcccgcttaaccttcctcgccgtcggatgcgaccgcggcggccccaatggcgtcctcctccgccgccgagccaggcgcccgcctctccgatcggacgaggaggtcgcccctgggcctgagggccatggttctcctgatgcacgtggtcttcgtcggcgccgtcttcctgctcgattcgaccctcgataggcggatccacgaggagccgtggtatattggacgtgtatggtgtgcttgttctgatcaccttaggcgcaatacttctacactgctggttcatctccacggctatgttatttgatgcaatgcaaagccaggtgtgtggggggtgcattttaacctaaatcaactactgcaactcttactaaccctctctacatcaaatcaatgcatttgctttaaagtccaacgcaaagccggaaccattttattgggtgtattcctgttgggtattcttcatattcatccttatgttaatgcttttgtttttattgtcttgagacattcaatacggattggaaatgacaacattgcatgaatatgcagcaaggtagtggctagcatacctaagatggatacaagattgtcctccagtttgcagtacacggatattgacttgcatcgatgactggtaattcaatagagtgaatttattggttgtagatgccgtgcccccaattgaggagctggaagccagatcagccctgcacacatgccgtgaacttatttgctgccgatgctgcttgtaaatgcgttgttcttttccttttgttaccactcagcatgttcagccacccatcattgcagcttgctcgcgagtggaagcatgactttccgagcaccaccagtagatgctcttaaatttcatttccatatgaaatagtctgtttattcttagtgacaggtaaatgtgtgtgtgttccgtggtatagatgactgtccctatgttacgactgcttctctgcagagaatggatttgttctcgaggccgtgcccccaattgaggagctggaagccagagcagccccgtacacatgccgagatctgttttgctgccggtgctgttgatacatgtgttgtactgtaccattcgttacccccacagcatgtgctgcagtccatcattcaaacttgctcgccagtggaagcatgtcctccgtgagctccgccagtagatgccctttgagttcattttcatgagaaagtgcatgtacattcttagcgacaagaaaatgtgtgtggtccatggtatagaagactgtccctattgtatcagcaacattcgactgaaagtaggtcttgaggacagtaactgtatcgggcgactgctcgcgcttctgtataaaaatgtccattcgagttgtggttgtt

SEQ ID NO: 3057 - DNA, 619 bp, Triticum aestivum
  unsure (1)..(619): unsure at all n locations
  Clone ID: PAT_TA_3057
gcacgaggaccaaaaggagcagccgccgtggacttcgctctgtagcagctctcgcacggatcaaaccaaatggcgacggcaatccaccagctctccttcgccgcgccgagcgcgggcgccaggcggcggctgacccgggcgtccgcgtccgcgacggaccggcacgaggtgctgtcgcccaagcgccggctgccgctgcggaaagtgccgggcgagcacggcccgccgctgccgggcgcgctcaaggaccggctggagtacttctacgggcccggcgggcgcgacggcttcttcgcggcgcgcgtccgcgcgcaccgctccacggtggtgcgcctcaacaagccccccggccccttcgtggccaaggacccccgcgtggtggcgctcctcgacgccgcctccttcccggtcctcttcgacacctcgctcgtcgacaagaccgacctcttcaccggcaccttcatgccctccaccgacctcaccggcggctaccgcgtgctctcctacgtcgaccccgccgagcccaaccacgcgccgctcaagtcgctcctcttccacctcctcacccaccgccgccagcacgtcatccccacgttccgcgaggtctannnnngcctct

SEQ ID NO: 3058 - DNA, 713 bp, Triticum aestivum
  Clone ID: PAT_TA_3058
cacagacaattcgatccatcccaacaacacccacgtcaactttctgaggagtcgaagatttgttagcccgctttgttcacagggaaccgtagtttgtacgcccatcggtcgattagccatggccccctgcgattctttctcaagaaaacctaccacccgttggccagatcaggagaactcctgcatgcgcctgctccgtcagcagccgccgccgccgccgccgccgctccggcggccggacctatctcggtcaggagctagttatcgaagatttttgaagaatgttaggctcgtcgcctatggtttgagcttggtgtgggcctttacgctataatctgcatggtcaaaccagcatagatgttcttgcaatggtcgatgtggccattcaaaatcctctaatatgaaaagaggaggtcaagtagtttgaggcggcaatggcctattttggtagtttttctatcctcgtgagtatccctcttgacttgcctgtgctcgacttgaatcgttctccctattagatgggtgaacaaaaattcatgttatcttgttacattgtcctttttaccgagtcatccacatatctgtcatcattgaaacaagaaaagaaaggtgtgtggacgtcagaaatgatctaactgagagcttgtgagctctggaagtatatacccatgtaaactttttacaaaggtattttaccggccaccaacagaact

SEQ ID NO: 3059 - DNA, 702 bp, Triticum aestivum
  unsure (1)..(702): unsure at all n locations
  Clone ID: PAT_TA_3059
cccacgtgctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcccaaggagtcaaaggagaagaaccctaagaaaatctgtcgctgcggtggggaaagctgctggcgacagtggaatccctgagcgatccgacaagtccctatgtaccaaggtaacaactcaactcgagtacaacaaggcatcgctgcctacaacaagggcgagaaacgcaactaagaagtcctgcaaggaggaagagagaagtgaagagatctacaatcaatccgagtaatgacaagatataaaggtatgaggagtgaaatatgacaatatggcccccaaatgtcgcctaccaatggccggtaaaggccctggttaaaaggccttccanttaatntaattncccnngggttntttanttgggaaagaancccctnggn

SEQ ID NO: 3060 - DNA, 852 bp, Triticum aestivum
  Clone ID: PAT_TA_3060
gttgttggagccggaccccgcgcccgcgttatatctgctggagcgcgagcccgatcccgtcagtgtcccggtggtggctactcagagtgggagccaagctagagcggccagatcccactcacccacccaatgcgcgcgcgcccctcgtgagctaccagagccgaccgacacactcaccagagcaccgccgaacggacgaacgccatggtgaaggcgaagctcctcgctgtgctggccctcgtggccgtcgccgcgccgttcctccgcgccgccggccaggaggagggtgagggcggggcgaggccgtcggagctgctgccgttcgcggtgggcgcggcgccggcggggtgcgacgtcgggcagggcgagtgggtgtacgacgaggcggcggcgccggcgtacgatgaggaggcgtgcccctacatcccggcggagctgacgtgccaggcgcacggccgccccgacaagtcgtaccagcactggcggtggcagccccgcggctgctcgctccccagcttcaacgcgacggtgatgctggagatgctgcgcgggaagcggatgctgttcgtgggcgactcgctgaaccgggcgcagtacgtgtcgctgctctgcctgctccaccgcgccatgccggagggctccacctccttcgagaccgtcgacgcgctcagcatcttcagggccaaggcctacgacgccaccatcgagttctactgggcgccgctcctcgccgagtccaacgccgacgacggcgtcgagcaccagctcaacgaccgcgtcatccgcggcgcgcccatggaccgccactcgagattctggaagggcgccgacgtcctcgttttaaactctacc

SEQ ID NO: 3061 - DNA, 569 bp, Triticum aestivum
  Clone ID: PAT_TA_3061
cccacgcgtccgcttggcccaggatgggccccagggcgacgagacacacgtgacaacacgtgtcatgggaacgcatggttatgcggctccagaatacatcatgacgggccacttgactaccaagagcgatgtatatagctttggtgtagtgctcttggagctcatctccgggctacggtctgtggaccgtgcacgacggccgagggagcagaacctgatggcttgggctagaccatatctcaagtgctctgacagattgtacaaagtcatggacccatcgcttgagtgtcaatactcatgcaaaggcgccgaagcggcatcactggtggcatacaagtgtctcagccagaacccaaagtctaggcccaccatgagggaggtggtcaaggccctcgagcccgtcctcagcatggaagacttcttccctatgggcccatttgtgttcacagtcattgtggacgaggacaaggtagtggacatgaaggtggaggtcgaggagaagcaccagcacccacgccagaaccatcaagacaggcaccggcagaggtacctcggccgcgaccacgcta

SEQ ID NO: 3062 - DNA, 695 bp, Triticum aestivum
  Clone ID: PAT_TA_3062
gccccgctgcggctgcgcgcacaggccgccgccatcggcacgggcctgaaccggctcatgcgcggcgccaccaccatgtccttcctgtcgctcagcgaggccatcaccatcgccgggagcttctaccgtgtacgcctgcgtggcggccgccgggtgggtgttcatgtacttcttcctgccgggcccggtgggccccggcctggcgctcccccgggggctcggccgccgacgaacatggacgccgccgaccccgactgcaccgccggcgcgcgccgcccgcccagctggtcccccggccggatcccccagcagtctccgccgtacgtccgtacacatgtcgtgtgacacatgtcgtgtgcttgtgttgtgtgtggtgtggcctgtgtccaaagctatcttggacgtgaatctctagattctggacacgttggtcagatttacagactttaggacgtagggaaggacacccagcgctctacggggaggaagatcacatgatattccgcacgcgtgatgaatccacgtagaaaggtccggttcaccggccgctcgcgctgcttgccgtggcgcgcactgcccagcttgtcacagatctttttcaccgaggtgacagtgatactgtctggtatgtacaggcttgtgttatatatgaccgagtcgtctctgatctctgtacttttgcttcaaaaaaaaaa

SEQ ID NO: 3063 - DNA, 616 bp, Triticum aestivum
  Clone ID: PAT_TA_3063
catcacacataaggagagcgaacaagctcagagttggagtaagatatacagtgaagatacaaaagagcagtccattcctgtcataacagcttggcaactgaatgaacggatgtaagagtctgtctcctgctactattgtttagcttgccagtcaggtttggcaaagaacaagttcatgaatggcgccgtagttacgacacccctcccccaaatggtgagagcctagagatgtgtgcagacagagccgtttcctatttcaaagatcaggttgttccacatctcacggctggaaagcatgtgatggttgctgcacatgcaaactcacttcgatcaatcataatgcatctagacaaattgacttcccaggaggtaatcagcctcgagttgtcaacaggcattcctatgctctacatatttaaggaaggcgagtttattagacgggggagcccggtaggaccttctgaagcaagtgtttatgcttatacaagggtaagggtctattccattttctatccctcgacagaacaatttgtatccacagtatatattaaaacaaactgattgacaccaataaaggcatataactgctctagtggctggatctgaataatctcat

SEQ ID NO: 3064 - DNA, 1333 bp, Triticum aestivum
  unsure (1)..(1333): unsure at all n locations
  Clone ID: PAT_TA_3064
tgtccaggttgtgcacacaagaagaggcagttttactccacctcagnagctctgctgctgcagagactaatccgactgattatatcctcgagactttggaactaagtaatccacggtcgctgattcaatatcttgcattccaagatttgtgtgcagtatctgaatgtaacatcgaaccttggcgtcgagctgccttatttgaggaatctggtgaaacttacaaaagaattgtgacagcctgtttgaagccacttgaggagttcacttcaaaaattgctgaagcacttgaagggtttactagtgaaaggccagaactattgttacaacagtctaagctctatggtgcatttagtgattcacagatatgctcatggtgtgctcggacattggcaacattaactgcacgctcacgacaagaggatcggtatggagttgctcaactcactggctgcaatgctgctgtgatgtctactttgctgtctgctctagttgccgttgaagcatgtttggggaagaaaactaacccacaacctgcgcactcactgggtccagcaagcattaggtggggtaataacttctccactgcaagaaaaggcaatgtaacagccatcgcaagcacacaaagaggtggtctgcacactaaagctcattcaatggctgatgttttccggacttcaatttatcagatagtctcagccttcttggatgacatgcgggcaaatgcaaaagcttcgagtttggagaagaattggatcagtgaaggaagaaaacctatatatggttcacgtgctgtgttggttcagaagttgagcttgtttattgaataccgagctgtctgaactctgtgtgatgtctctcaaatcgacagtctgttggggtgaaggaattttgtcatgaaccaaaatgcttgtttgagtgaagtttggagctgccgacactactatctcatcgaggttcaggaatatttgttttggcactatgatccactggcgagaaatcattttccattccccatcttttggaggacaagaagggccatgacctattattattgtgatttcttgcaaaacaatctcactatttttcaattgttggaagcatcacgctggtgaatggaaaattaagcgctcaattttgcatggtactcgagaggtgtgttagtatgttgctgtagtagggggaatgccgaaatgtcttgggctatcagtccacttgattggcttgtcagaatggtcatacttgcactgtaacttaattacgcagtactgctagtcaagatcgaatgattttctttaaaaaaaaaaaaaaaaaaaaaaaaaaaactcgagactag

SEQ ID NO: 3065 - DNA, 1608 bp, Triticum aestivum
  Clone ID: PAT_TA_3065
atcgatttctcaagtggtgattacgtactttgttattccaaaacggaccgcagaatctaccctatgaataatctaatcttataccttgcccccatcagtacacttgtaaccaggttcattctaaaagtttttgtttcttgcgacaacgcacagcaaacgcgctacactttcccgtggctttttatcttcatgagatgaactattatcacaagacgatcgcggagaatgtacactgaagaataatctaatcttataccttgccgctatcagtacactagtaaccaggttgaatctaaaaggtctttttttttcttgcgagaacgcacaggaaacgcactacacttgaccgtggctgctgctcttcctgtcttcttcaccatttcttttctggccttcgtgtcttcttgactccagtgaaaggctaggaacctgagaatggagcaagggaatttgctgggagggcaacgccgccacctcgcagagaaactgtgggacggctccaggcatccatggctatggcattcgaatcgaaaaataccacaacgaccgttatatcatcatgaaagtggcgcctcactccacggtcaattttcttgagatctgaataccgcatctccctcttctttgctgcttcctgcattgcagccttcactagctttcgagcaatcccattacgaggactactgtggactagctcaacagctttctggttactaagatgctcccagagtccatcagatgcaaaaatgatgaactgatcagttaactgtatttggtgtacagtaattgctggctcagaactaagaagcggtctccggaaagtttctggaagccgaaacttgctatgcaaaggttctctgttgaattctggtctcttcagatacacatctccaatggaccttgtcaggcgacataatacccttcacacttgtaccacagggagtcccgtcctgccggccggccgcatccacccccttgcgagggcgcccgtccggcgacgacgtcggaccccagcaagatctcaggtaatccatcgcagacgatagcatccctcatctccgccacctccccatcgcccgctgcctcacaaaagccatgtctattcgcctcctctcccgatatcctctcccctttccttcgcctcgccaaatctttttcttggatggctagcttcctgccgagccgcgcgcccagatttcctgcgatctcgcaacgagggaggggcgggcttggatctggaaaccaatcgatctcgagcaagcggaagattgggttttggtggaacgaggtgggctcctctccgggatccagacgaagcaaccgcgaagctgaggcggggagactaaaataagatgcgcttttccgctctccttttcggtctcccttctcgcggctgccaaattttgcaggcaggcagggcaggctcgatcgacgagcagatcagggaatctctctatcttctccgctccacagcaaagagagagggagagaggactagcaagcaagagagaagacgaacaaggcaacccaaggagagcccgggggggggtcggggccagcaaggcaatggcaaaggcgataggacctatttcatgccggggtggtgac

SEQ ID NO: 3066 - DNA, 410 bp, Triticum aestivum
  unsure (1)..(410): unsure at all n locations
  Clone ID: PAT_TA_3066
gctagctccatttccacacagcctttagctaattattaagctaccactcttcctagctaagcatctttttgagttatccgtggtgatcggatggacagcgcgaggagctacgtgagcagcggcgcgagcaccggcgcgtccacgggcaagaaggcctctccggcgccagccaagccggcgaccatgccgctgcagcgggtcggcagcggggccagcgcggtcatggacgcgccggagcccggctccggcccggactccaggctcggcgggtccaagtcgtaagggcttgatgccgcatcgcagcggccgccgggccgccgctagggcgggcagatctagggcggccgtccgcgcgtggcccggggccccttaactccgcgcgccttccggggcgancnntcaattccccg

SEQ ID NO: 3067 - DNA, 2864 bp, Triticum aestivum
  Clone ID: PAT_TA_3067
cggacgcgtgggcaaatcccaaatcaccaaccaaatcccccctgccgcgtcccaaaggctaaggtggtgcggtgaaggtgctgagcctgggcgacgtctacggcgcctacaccttcgacgcctcgcgaatggaggacagcgcctgcgccggcttcaaggtgggcgctcgcaccgtaggctcactcgctcgtctacgtctccaccaaggagctggtgacgaggctccgcacgccgtgtaccgtggtgtacatgaccaacctcgccgacggcagaccgtgcgccttaccccgccaggccagtacgacgtgagcccggccgtgtcgccgtccggcaagatggtggccgtggccaacttccgcgggaacaagtggaccggcgagatcgagcgcctcaacaccgacatcgccatcatgaacgtggacaaggggcgacggggtcgccttccaggatcctcatccgggaccgcggctggccgacgtggggcagcgacaacgtcatgttcttccaccgcgggaccggggagtccccgacgaactgggccgtgttccggtacgacatcgccaccaaggagaccgtgcgggtgacgcccgaggccatcgacgccatgactccggcggccctcagcgagaccagggtggccgtggccgccatccgccagaagtctaggcaggccgccatgaccaccccgccagaggaggcgcagtaccgccccatcgagatcttcgacgtcgcgtccccggacgggccggccgtgcagatcagccagacaatcatgcccaaggacgaccacaacaaccctttcgtggccgacggcggcagccgcatcggcgaccctcggggcagaaccgacgatctcgtgatggggagtaatctctccgcgcctgccaccagcttcgacaagatacactcccctcacacagcatgtggggctgttccgagtgtcgggtggtgtgccatccctccccaaggatggcgcgaagctcgccttcgtcgccaacgagttcaaggaccgtgtggctcgcgcacacccaaggcctgcgtgttgtcatacgagacgcggggctccaacgccgtcttctccacggcgtggaaccagaacccgacaccagcacacattgtacgtggccgtggggcggtcgttctctgctcccccggccactggagaactacgccaactccaacccgtccggcccgccccccggtcataagcttgggcaacgcgccgcagggcaccccgccaaggaggatcctcacaccaacccgtaggtcggccagcgcggggcagcgagaacgtcagactctggcacggtgagaccgcgcactcaccgacgaactagggagtgttccggtacgaggtcgcccggccggggcacggtcacgtggctcaccaagcgggccatgccccgacacccgctgcagctggccgcccaaggggggctgggtcgtcttctcctccacacgcgagatgccagccagcgcgccggagatggccttccttgacgcgggctacttcgccgtgtacctggtgaaggtcagcaaccccacggtggtggtgcgcgtggtgcaaagctcggctaccctcgcaggacacgtgaaccaccccattttcagccccgacatgaggagcattgtcttcgcctccgacctcgccgccgtctccaacgagcccatctcgatgcccgtcttcctgcactccgttaggccctacggcgacatcctttcagtcgacctccgcgacactgatgacatcaccaagaacaaggacatccaggagttccaccgcatcacgcacagccgctacgagtactccactccgacatggaccaagttcgccaccgacgaccccaacgagcagtggaacatgctcgccgtcaagggcagcaccccattcaggccggcgtgcccttacatgtaccctgacggaggagagggctggcacatggccggccacctcaccatcccgaagagatgctgctagctttcctcaactttttccattttataattccgcttaattgcgcagtctactaaagtatgatcgcgcagggggacaagttcgtgttccggtccacgagggacggcggcaaggagaagttccacaagaacctctacatcatggaggacgcggagtagggggagttcggccagggcacggtgacgcggctcaccaacgggccgtggaccgacacccactgcagctggtcgcccaagggggactgggtcgtcttctcctctacccgcgagatgccagccagcgcgccggagatggccttcctcgatgcgggctacttcgccgtgtacctggtgaaggttagcgaccccacggtggtggtgcgggtggtacagagctcggcgaccctcgcgggacacgtgaaccaccccattttcagcccggacatgaggagcatcgttttcgcctccgaccttgccgctgtctccaatgagcctatctccatgcctgtcttccttcactccgttaggccctacggagatatcctctccgtcgacctccgcgacaccgatgatatcaccaagaacaaggacatccaggagttccaccgcatcacgcatagccgctacgagtactccactccgacatggaccaagttcgccaccgacgaccccaacgagcagtggaacatgctcgccgccaagggcagcgccacattcaagccggcgtgcccctacatgtaccctgacggaggagaggggtggcacatggccggccacctcaccatcccaaagagatgctgctagctttcctcaaattttttctatttcataagtacgcttaattgcgcacttgaataaagtttgatttctattttatgttctcgatatgcagtctgcttgttaagctccaa

SEQ ID NO: 3068 - DNA, 1073 bp, Triticum aestivum
  unsure (1)..(1073): unsure at all n locations
  Clone ID: PAT_TA_3068
ttactcgtccgcccacgcgtccgaccaagcatctggtttggctttgctttcctcctgcatggctcattacagaagagggagctgggcactttgacccagagatggaacttgaggaccattggctacatgccggacgcgtgggttccggtgttcttcgttcaggcccttcttgtgtttgttgggcctacatttgttaaggaggagaacagtgcacagggaaggagagtgtttgctaaatacttcattcagacgtccatgccagttggggacaccaatgtttgcacctatccgttgtttggcaccatttttctgggacttatcgatgccgtcctgatgagctatgtctcctatgttggatctcgggtgttatccttggtcatcaacaaggcgctgcggaaagagggttacgtggctgataatgtcggtgcttttcttccttcctataaggggtgcttcttctagggttctcagtgatgcccaannccgcaggagataaagcatttggaggtcatcgtccttcttgtcattttgtgatgatgcctatcccggcacaaactggttgggatactctttgcctgggtaatactgggccctgtccaatgaattcaattggcaactcaaaagaatgcanggcaacaaggggaagaatagcaagagatggtgccttatgacgattactactattagggctcatcgcttgtggccaaccagagcttccgagaaatcgagcggaactctgacacgtcaacaaagcgtggctccatatcgttccgcacaatgatcagggaggaccagcttccgccggatggcacagatgaaatcggcttctcctctcgcangcggcggtnccaatattgggattatcctcgccttgcanggttcttcaccaagcgccgcaatgcccatgctgcctctcaaggaggnccctagatactaagtagtgttcacctggggcttctgcccttctaccaagtgctccccccttccattttctcctcccccttcctcttacctaccttaatgataacaagttttgtggcaatcaaaaggnttttgttaaagttttgggagta

SEQ ID NO: 3069 - DNA, 543 bp, Triticum aestivum
  Clone ID: PAT_TA_3069
gcacgaggcacactgcaaggtccgcctcctcacgcactccacacaaacagacgcagcagccggcatgacgcataagatcgtgatcgcggtgcagatggggagcagcaggtgccggtccaaggcgctggcgctggtggcggccacgccgggggtggactcggtggcgctggccggggacggcaaggaccaggtagtggtcgtcggccacggtgtcgactccgtcaagctcaccagcgcgctgcgcaggaaggtcggacacgcggagctgctgcaggtcggcgacgccaaggaggacgggaagaagccggcggccgcggccgtggtcgaatactacccgtacggctactactacccatcgcaaccggcgccggtcaacttcttctacgggcagcactaccctgctgctgccgccgtcgaggcgtacgggtacccatgctcgcggccggagccgggcacctgttcggtaatgtagagcacatcacatgctgatagtgatagggtagcacgttgattacttgtatggacctttgccggtcgtacttg

SEQ ID NO: 3070 - DNA, 594 bp, Triticum aestivum
  unsure (1)..(594): unsure at all n locations
  Clone ID: PAT_TA_3070
attnnnnnnnannnananatnnatnnnnnnnnnannanaattnngctgcaaggacgacttcgaaatccgaactcatcatccgtcatggctttggatggcagggccttgccgcagccggcgcccgcgtgcgttcccgccgtccaggcggtgaggccgtgggcgggggacagcggtgctaattcgtctacggagggaagggaaaggggcatgctgcaggggagcgccgtggaggtggatgtgccgctgctgcgggacgacgaggggaggatgaagcgggagctggtcgcctgggccaaggccgtggcgtccatggccatcagggagtcgatgcggtgctaaggtgcacgcgcgcggcagaggcaatgaagccatggaggaaccatggatttattttatttttggagggaatggatcgatgtttttcttcttctgcttcgtgcatgcacccggatcgagcgttggccgctggactacattttgttacctctgaatcctttgttcacggagcgaccgttctagtcgatcgatcattccggatgtaaatgtttttgcaaatgatggaggattacttatagattttttccaaaaaaaaaa

SEQ ID NO: 3071 - DNA, 1756 bp, Triticum aestivum
  Clone ID: PAT_TA_3071
ccacgcgtccgcaccgacgccgcgctcgccgtcctcgccgcgcgccacgggggcctcgccgagctccacatcggccccgacccgctcgaccgcatctccagcgacgccctccgcagcgtcgccctctgctgcccgcgcctccgctgcctccgcctctccggcctccgcgacctcgccgccgccccccccgcccgccgcgcccccccctccccgccctagatgtgtcccgcaccgatgtctcccccggcgccgtctcccgcctcatctcacactccacgaccctcaggctcatatgcgcccttaactgtgcctccctagaggaggaagaggcgcacagcccggccgccttcgccaactccaggggcaagctcgtgctcaccatcaaccgcaccatctctaaatacatcgctgcagacgctgccccgctgtgtccagacacggctgtcaaggacactgtggtgttcgatgagtgtcgctcttcgagtggcaagcgcaatggggtgtctcagctcattacatggctcgaatggatcctgtcgcagtccctcctgcgaattccagagagcaacccacatggcatgaaccagttttggctggaccagggcgcggcgctgctgctaaccctgctcaagagctcccaggacgatgtgcaggagcgggcggccaccacgctcgcgacattcgcggttatcgatgatgagaacaccaatgtggaccctgcaaggtctgaggctgtgatgctcgaagggggcataccgatgctgttggatctcgcaaggtgctccagggagagtctgcagtctgaagctgcaaaggcaatcgccaacttatccgtgaatccaaaggttgcgaaagcagttgcagatcagggaggtattgccatactcactaacatggcaaagtcggtaaaccgtctggttgctgaagaggctgctggggggctgtggaatctgtcagtgggagaagaacacaaggtggctatcgcagcggctggtggggtaaaagctttggttgatcttatatttcgatggcctgcaggaactggagtgcttgaacgtgctgctggtgcacttgcaaatcttgctgctgatgacaaatgtagcttggaggttgcaacggctggtggcatccatgccttggttacgcttgctcgctcctgcaaagttgaaggggtcttagagcaggctgcacgagctttagctaatctagctgcacatggagacaacaacaacaataatgctgctgttggccaggaaccaggtgctcttgaagctttggtgcaactaacacattctcccagtgaaggcgtcagacaagaagctgctggcgctttgtggaacttgtcatttgatgatagaaatcgggaatccatagcttctgctggtggtgttcaagctctggtctcactctgtcaagaatgtttaaatgcttcggacggtcttcaggagagagctgcgggtgctctctggggactatctgtttcagaagctaacagcattgctattggaagggaaggtggtgttccacctctaattgcgttggcacagtcggaagttgaagatgttcatgagactgcagctggtgcactatggaatcttgctttctattcttgtaattctctccgcatagttgaagaaggcggtgtacctgtcctagtgcacttgtgctcatcatcacactcaaaaatggctcggttcatggctgcactaacccttgcttatatgtttgatggaagaatggatgagatagcattggt

SEQ ID NO: 3072 - DNA, 560 bp, Triticum aestivum
  unsure (1)..(560): unsure at all n locations
  Clone ID: PAT_TA_3072
gcacgttgctcagggagatcgaagctcggtacggcgtctgctacgatgctcggagcaatgaagcttgttctcaggagggagaagagcagagctgcggggacattttcgtgtgacttggccggttacttctcgacgtcgtcgagctgccagaggctgtccggtaaagtcgccgtcatcaccggcgcggccagcggcatcggcaaggcgaaggccgtcgagttcacccggaacggcgccaaggtcggcctcgcggacacccaggagttcgcgggccgctccgtggcggccgagctcggcccgatcgcggagtacacccgccgctacgtgaccgacgagccgggccccggcgcggagtacgaccacgccgacgtgacccacgaggcgcagaacgccgcggcgatggacgtcgccgtggcgcgccacggccggctcgacgtcctctacagcaacgccggcgtctccgggtcctcggcgccggcgcccctggccnnnctcganntcgccgacttcgaccgcgtcatggcgnnnaacgcgcgctcccnnnnnncnnnngtcaagca

SEQ ID NO: 3073 - DNA, 533 bp, Triticum aestivum
  unsure (1)..(533): unsure at all n locations
  Clone ID: PAT_TA_3073
acngcgggnttcggnnccaagagccagnacnnccttacttgcccgccggttggnggaagngcgccttgcnttaanggcnttccttcccgtggcccgccgcgnancccggnttttcccnccgcggntggtctttgcccagtacctcatgcaaatgccgagagctgctccgcgtccgacgcgctgctctcggcggcggcgccaccaccggccctctcgtcgtcgctgcagtcgccgtcgccgacggaggtttcgtcctcgggccaccgctcccggtcggcctcctcgtagaaccccagcaccatgttcgacaggctcatctcgtcgccggcctccgccacaaccatttcctcgtgcttggttgtaaatctggtgtgcgtggctcacgttgctccgtggtcagctgcagggtccttcccgccggcttgtatacccggagacgcggcggacgtggcgaggcggcaatggatggtacggtgctcgcgggacccgcgcggagtggatgaggcagttccagatggcgtgggccccccggt

SEQ ID NO: 3074 - DNA, 1092 bp, Triticum aestivum
  unsure (1)..(1092): unsure at all n locations
  Clone ID: PAT_TA_3074
ctggcgccgcgaacagggtagctgacgcgatggcgtcgcgattcctcgcccgatccaaaaccctacaacacccccgctcccgccctcttccgccgccggcgggcgccggcggctccggcgcgctcccctgcctcccgcgccctcccgccgctcccgccccgccccgccccgtccgcgccgatccgggcccctgcaggcctcagggacatgcgcgaacatcagccaacagcgccactcagcggcacccaagttttaccgcttttgtagcctactatagcttccaaaggatctaccatgcagactacgcaggattcagagacatgcaaggaagtggatggaacgggacactataaggcactaaaagcgactgaaggagacttccctaaattcaccgaattcaacccactagaagcaactgctaaacctagaagtagaccgttgaaaagtgaaagttctaaagtcaggcgatcagagatattaacaggagttaaccttttacatgatcccagctctgcttctttcctcaaggaacagcatcagtacatctcttatggtcgcggcggtataccatcaaatctacatgttccacaaggagatctttctggactatgtgcaccacgacattaccaggaagtgggctttgatatacttcaagctgcttctgctggtcatggcaaaggacaccatcgtgtacttcggtttggtctgagttcaccgtgttagtttgtcaaaggacgggctatgcactcatttgtacgccgagaaaaataatgagcatcggcacatgctggggcgctggtggttcttgtttcccgcatgaactttcttggtttccaaccttttcccctcccaacgttgctcgtcttgtttttgtctatgcattcgaaagggtttgtttagtggccctatcagataacaagtttctgcaaaccatgatattagagcgggtgactgcattcatgtttgtaataattagcaagtatgtgaactctgcaactcgtatttagtatgtttcctagcaccgcgtcgtcgcacgtattttccatgtaaaaagtgnaactctcatcatactcttaagcttctccctagggc

SEQ ID NO: 3075 - DNA, 591 bp, Triticum aestivum
  unsure (1)..(591): unsure at all n locations
  Clone ID: PAT_TA_3075
aagcactatatccacctcacctcagctacctcactggacaagaagaattgttagaagagaagcagatcttgtcatgggcgagcaagctgcaaaggttcccccaaagaaagagaaggcatcgtcaagcaatacacagttgacgaagacagcggcctgcaggaggaatccgctccagcctcagaagaagcagatgaaacagacgacgccgtctaagaagaattagcctcgaaaaaggtgacagcagccgcgcgttgatcgacgtcctctggccaggatgaagttaagtgtgtttctgtcgagtagttcagtttttgttacaataagttaatttgtaaagttgattcgatccgatcactcctaaagaatccgtagctagcttgtctataggccagaagcgtgctggttcacgttgcggccaagtgaagtccttttcttttccttgtgttgtgttatgagtcatgtgggaggttattgtcgcgtagttgaataaaaagaaagagtaggaaaagagatacatatagggttaatacgtcgcaaaccattctcgcgtcggtcatacaaaattttagtcctgtggggagcatcaacggn

SEQ ID NO: 3076 - DNA, 623 bp, Triticum aestivum
  unsure (1)..(623): unsure at all n locations
  Clone ID: PAT_TA_3076
tctcccactgcataccatcacgatagttgcgagacatggcgatgtgttgccactcttcctgtagcctcatatgcatcgtcttccttctcgtttttgttgctgtggcagcggagggtgcaggatatgtgcaggcgcggcagcggaaattacagcaggtgccggcaccaccgccagtgccgctgccaaatcctaacccgcagcctgacccaaacccacaacctttgcctatgccagacccaaatccacagccattaccgcagcctttaccgcaaccactgccaggcccaaacccgtagccacaaccattaccttagcctctgccgcgcccaaacctgcagccacaacctctgccacaaccgttgcctgacgcaaacccacagccaccgccattaccacaacctctgccacgaccactaccggggccaaacgcacaacctctaccacaaccactgccaggcccaaaccaccgccactggctcaaccagacgtccaaggtcatatccgcaggtagaaccgttgccaagatcanacancctggacgacaaaataacgcactacagggacgcaaccacttggtgnncctcaacttatatcccgtggngnncatataaaagatacttttg

SEQ ID NO: 3077 - DNA, 863 bp, Triticum aestivum
  Clone ID: PAT_TA_3077
tttctgtggaacaacgatcatattgagggtttgatcaaacaaaacagcaaggtgttactgcccataatccttccttcattagaacgaaatacaaaaggtcattggaatcaggcagtgcaaagcttgagtcttaatgttcgcaaaatattcttggaccatgaccctgtactcttcgaggggtgcctcaagaagtttcaggatgatgaagctcaacttgtcgcggggccttcatttcggggtgcctcagggatgcgccttcagggtgtgccctcggcccttccgcatgccgggaggccacaggcaatggctcatcagcagggttcttctacctaacctcctggctgacttgcatatgagccgctctttctcaggatcaagttgaatcgctgacatgaatgctcatggacgactgcttgcctcttggtacttgttcctaaacatcttacaggctgacatgtacatacaacctagatgatggaccgtgaagctttagcgctgctcttgtgttctgtcggttgcgagatcaaggattcagttttcatcatcgaggggtgaagtaagggaggcaaattacccgtcctggcttatataaggtgcatgtgctgcaacaggtctatgtgcagcctgcagctcaaggaataggtcgagtggcactcgcacttgcttgccggtgctgattttgctgaactgtaatgcgttatgtatgaacaacttctagtcttttgtctttgtaatatgtactggtgtacatttgtttgcttcagtagacgtatacacaaatctggaagcaggcagaggttttctttacttaccaaaaatcagcttccgggacttggtctccctctcgagatcatccttggatg

SEQ ID NO: 3078 - DNA, 981 bp, Triticum aestivum
  Clone ID: PAT_TA_3078
tctcccaaatcgccgccaccaaccgcctcgtatgcctcctccgacccacctcgccgtcggccctcccgctccccactcccacatcacagctccggaggctaccggatccgccgcatccaccatccacccatccctctcccgtcccatccctctctcttcacgcggcttctcgatgcgccacctgcgtcggctaattcacgcggcgtccggcgaatcccgccaccgtaaagcacagctcgaggccccctcgcatcatggacccccccaacctcccacacacacacaatcaggctaggtccggcgctcgcagccaccaaagaccaccgactagcctccccctatggctagggtttcgggcgccgggcatcggctccggcgctggtggccatgtcgttttcttttccacttgcttgcccctgcagtcatctcttgttacctagttctgttatcgttgaagagattgtttggaaattgctgcacacaaacctgcttgcacgtcgcccgggcggcgttgtcggcgtcgtctcccccttctcgccttccctccgcccgctggactgggctctgctgcacgcaccaactcgatgcagggggacgccatggagcaagtcgagttcgtggaacaagtcatggacgatgccatggaagatgaatgggcatgtcgataaggcacttgtgaaaactaaagatttggtagggagtcacaaaaactgcactactcccagcaatacagaaaaaacaaagatggcatggccttcaacctttattcaaaagatatatggatgaatatatgggtttagtggcaagtatactgcaattgatgacgtagcatcgctagcaagaatgaacgggtccgcgtgatatgccatcactgtcctgttaacacaggtcttcctgtaatcattaacctttacctgaccaagagggatccatgtgcacctgaataatgccaccttaacttccttttggttaagcttctaa

SEQ ID NO: 3079 - DNA, 563 bp, Triticum aestivum
  Clone ID: PAT_TA_3079
tttcggtggttctcaaacttctctgaagcagaggaactattaaaactggctgctgctcgtcaacaggtgcaggctcacattgctaagctgagaaggcagctaagcatgatagagggaatgccccagcagtccagagttatctctggtcctggtcaacagtttgggcacggctaatggaacggtagctgctgtaaggaagatgctgaaacctgataacaactcgctaacagaatgtgatgaatgtgtcttcattgacgtcttaggctcgcaattgatgtttagtgctggccagtgtgcataaagcgcaacctatggattgtaccgcctttgtgcattttgaaatcaacgggagcatgctatattgtgtacctgccttaagttatcaccctctctgttcctattcttttatgttccagtagaagcatagcacaagaggggtgcaaagcccattttgctaacatagtggaatgtgccttgctttgtgtcagcaccagcaagtggtgttttttaaaatcatttatcagttaactgaggaaaaataaaaaaaaaaaaaaaaaaaaaaa

SEQ ID NO: 3080 - DNA, 1243 bp, Triticum aestivum
  unsure (1)..(1243): unsure at all n locations
  Clone ID: PAT_TA_3080
tcgcggccccatacacccccgccgcgtcccacgaaaaacagaggagagagagagggagagagagagagagagcgctccggagatgtcggcggacgagttgcggctggacctggaggagctgcggcggctggagggcctcgccaagcgtccccgcgtcgtctccctcctctccaacgagatccgcagcgtcgacgccaagttggcctcgcgggctgcgcctgtgcagacgcaggcgccgcaggcggtggcggtcgcggcggcggcccctgctggtctgagctatgtcacgctggggtccttcagctgggaccaggacaatgagaagatcagggtctacgtattccttgagaatgtcgaccaagagaaggtggagactactttcaagccaatgtcagtggacatcaagtttcatgatgttaaaggcaagaactataggtgtgccatcccaaaactaaacaaagaaatagttcccgagaaatgcaagattggggtcaagcctacgaatatggctatcaccttgtggaaagcttcttccggcaattggttggacctacactacaaggaagacaagtttaagccaagcatggacaaagagaaggatccaatgtcaggaatcatggatttaatgaagggcatgtatgaggaaggtgatgaagatatgaagcgcacaatagccaaggcgtggtctgacgccagatctgggaagacggctgatccaatgaggggactgccttgagctggttgtagttttggttccggagagctgctatatgtgctgagctagtccgtacattcagtgtggtttactagagtagtgtcatgagtaatccgcatcgcatgtgtgaaatcgatacctgtctgatgatgatgggaatgctcgtttcctcgggtgtttgattgaccaaatttgcacattttcgcatttgaactgaaaaagatgaaagcatatgcttatgcgatgagaagagaacactaaaaaaacaattcactcgttctttgttgtactctgtcgtttgtggcagaacttctgttggctaaagattatatttgtggcttgatgcattcgttgaanctaatcccgttgcaattcaattgttggnttaacnaaaaataaatgtcatgagtatccggcatccccaagttttggaaaccnatttcngtcctgaanaaaaaatggagtggcccccttnccccccggggntttgattgggnccaaatttgccnaattcccccccatttaaan

SEQ ID NO: 3081 - DNA, 792 bp, Triticum aestivum
  Clone ID: PAT_TA_3081
actatgaatgttggcggggcacctgttagcttccagaacgaggccaaccctgatgacagtttcatgaacctgatgatgaaggatcagcgatccggtgaggcggatggaggcctcctcctccacaacgccgtcgcgcagcactcggacgagaacgcgcggttcatggcctaccacttggcagagcttgggaggtacgggaacggcaacgtatcactgacgctgggcctacagcactctggcagcggcctgtcggttccaaatgcccaagcaaacttccccggtgtcagtgacgatgacatctacaatgccggtgctcctctcggtgttagcattgcatcttcagactacgaatctttgaaccagatggatcagcggcaacgcttcgagcaatcgcctcttttgcatgattttgtggcctgaatgatgatgatacgtcagatcaggaccattgacacaaagattgggtggggggtgacagcatttgtaaaagaaactcctagtggcagaataataacatgcctgcaagagcatggggttgtagctttgtagttgccatttgatacaggagagggggtatagcaggaaatgtaatataaagcgtaggtggtgggggtgatagggggtaaagatggaaaatcttttgtaaagataaaatgcaatttactatacgtgtaaaagcttgtgctcagtattgtaaagtaatggccacttcacgggtgatagtatacattgctaaatgatggctattcttcttcttttctcaaaaaaaaaaaaaaaaaaaaaaaaaaaaaa

SEQ ID NO: 3082 - DNA, 1609 bp, Triticum aestivum
  Clone ID: PAT_TA_3082
ggcacgaggtccacccaggcccacccagccgcaccgcacgcccgacgcgcagccgaaaccctagctccgccccgcccctccctcccccgcgcactccgccgtctccgccgcccccgccgtcctcgcgccatggccgactccccgcgccggaggtacacaaggccctcaaggtccccttctccttataagggacgccaaaagcaaatgtcaaggtcaagatcacctgtagctcaatcccagtctagatctccatcgcctgatcctagagctcaggcgaggtcacgatctcgaagccctgcgagggagcgggagcctgaagctgtaaatcatggaaatactctgtacattactggactttcttctagggtgactgataaagaacttagagagtacttcaataaggaaggaaaggtggtttcttgtcatgttgttcttgaaccccacacacgtgtttctcgtggatttgctttcatcaccatggacactgttgaagatgctgaacgctgcatcaagtatctcaaccagtcagaactgcaaggccggaacatcacagttgaaaagaagacattgtgcaagctatgtgccagcaatcaagatgctgagttcatcaatttcaactttagctcatacagcttgatcaatggacagcccaaagggttactatgcaacacgagattcacaacaactaaacgtagcaaattttcaactaaacctgagcattcaccttcaactccccatcaactaatcaacgggcatttccaacactttagtcaagatgtctggtgacatatgcatagcaatgttggatgtctgctagttggagtttgtgctcttcattaagtatttccttcctccttggtccgttaatgcagggtgtatatccgccgatcgtaagggaaactcataatttcctacacaatccagcatgatatttattttccttctttctttagcttggagcctgatattgtactgattgttggtatggtcgtttcagtcacgcagaggccgcccaaggacgcctactcctgggagctatctgggccatcgctatgagcgcagagagatgcagcgtggaggtagattccgcagaggaggctacggtcgtgacgactactatggcaacagctaccgcaggtctccgcctcccatgtaccgagaatacagggacacccgggactaccctccctacagggacacccgcgactactccccgccccacagggatgcccgagactactatgacggcaggggtggccggggctactccccccacaggtctccccctccttacggtggcagggcaagaagggagcggtctaggtcgctgccgtattccccgtaccgtatgcccgaaaggggttatggccgccgtgctggtggcggtggctacgacaggtgaagggttgttctctttgcgtcagcagaggcccgatgtcaagttggataacatgctgcgcatgatgggcctcatgctagattatgtgtaagctgtactgtcttgaacgatatattcctggattttgcaatgttgtacctccacctagtttgtgtaacttggatgacattagacatgttcgttctatttggattcatcttttaactattc

SEQ ID NO: 3083 - DNA, 650 bp, Triticum aestivum
  Clone ID: PAT_TA_3083
tttcccactcctaccagtacctcctctccgtcgttgtggatctgtccgggcgagaccggggtcgatcgtgctgcatctcgcgcggtgagagggagctctggagtctggactggcggcggcgatggggtcgtctgcggtgcagaaggaggccgtcgtcctcaacggcggcggaagcggagcgggggaggaccaccggctgcgggcgctggcggcgaggacggtgacagactcgctcagggcggccgtggccaggtccagcgcggcggacaaggcggccaggctcgaggagtgcgcccggagcctcgaggccgagaaggccaagatggaggtcttccgccgcgagctccccatcagcgtccacctcatcgccgacgtgatcgagtggctgaaagatgaggtggcgcagcaccggagacccgcgccggatcagctgctcgcaccggcgccgtcgccgtcacctgcaccgccggaaaagaggaaggcggaggtcgtcaagacggaagcagacgcgagcgacaagcggagctggatgagctccgcgcagctctggacctgcgggagccacagcagcaccagcaacagcaatggcgacagcgtcaagaaacacgcgcaaaaggtgtccaatgcattcatgccactgaatggcttgc

SEQ ID NO: 3084 - DNA, 1025 bp, Triticum aestivum
  Clone ID: PAT_TA_3084
tcgacccacgcgtccgattttctggttctaggcctacttttgtgtatggtttagctgtctgcatataccatgggtgtgtgtgcttgtgtgctaatgatgatgttggcatgatttattttctattctttccactagattagcttacaatcagattggagtagtggagataaaaatacattggctggctgtgtctcttagattggcagaaatcacaacatgtcagattgattggtggccatcttcctcagtttgtgcgtatttattactgggaagagaaccaggctactcatcaattaataaaagctttatagctttgttctctttccattcatttctttagtattattctcttagattaaaaatattattgtgatgtcgtcctgttgttttgtatgtattggatgaccattcagacatgttttaatgcgttaatagatagatgcactttatgtctgcattgatgtgccttgcattgttgtccctgtgttcttacggttttgcaggttagacgaactgctctgttcctagacccgcggctcgtttctgctcctcaagagcaggtgtccgcgtcttcaccatagctggtgtccacatgttcatcagagctcgtgtccgaggcttcagcagagctactgtccacactttcgtcagagctaatgttcacaggatcatccatgcgagctcccctcatgctcagcagtggtggaaacctaaaataacgtagattatcaataaacatagagtgatcaagtcacaatactgtgacgacgtgtaaatcagcccgaggttttgaatgggactttacaccaccaaattagaatgtgtgtatatatatctcattgtacacagctaaacaccatttttttgactaaaggagattatgtttactatcatatgtacttgcccacaagaggtcttttatcgtcggggcttgttacaggcatgatcagttcatgattttagaatatttttatacatgtatctataaaaatttgtagaaaaaaaaaaaaaaaaaaaaaaaaaaa

SEQ ID NO: 3085 - DNA, 1197 bp, Triticum aestivum
  unsure (1)..(1197): unsure at all n locations
  Clone ID: PAT_TA_3085
aggatttgatgaggcaaccatggcatcactacatgatagcaaagaatttctcagtggtagcatctcatcttttggtacggccgagcagtcacaactagctggtagtggtttgaaggctgaacaacaggaacaaaatgcgatgtgcaatattccactccctttcgcttctggtagtcagatggcagtgagtgaagcacaaggggcaatgattcncttcgaagatnagctcaacgatgcataacaataaaagtgagtaccctgtccctatcagccattctgctgatgcgcagaacaaggcaaattcagctaatggaaacagtgccagtgctaagccacgagcaagggctcgtcgtggacaggcaactgaccctcatagtattgctgaacggcttcgcagagagaagatctcagagaggatgaaaaatctccaagaccttgtaccaaactcaaataaggcagataaatcatcaatgctcgatgaaataattgattatgtgaaatttcttcagcttcaggtgaaggtcttaagcatgagtaggctaggagctcccggggcagttcttcccctccttgcagaatctcaaactgagggccgtagcaattcacctctatcatctccaaccgcttcacaagggcttctggacgcagcaggcccagaagacagcttggtctttgagcaagaagttataaagctgatggaaacaagcatcacaaatgcaatgcagtaccttcagaacaagggcctctgcctgatgcctatcgctcttgcttcagccatatccaaccagaaaggcacttctgcagctgcaatccctccagaaaggtgaaaacagaaagcacatcatgctcctcccatcggcccgcggaaacaactgtcgaaatgtgctagagttcatagaagttgtgagaaaacaaaaatccgaggctgaaggataggaagttatgcgactaatagtccaagcttatggtataatctagtagcttactccaagaaacctatactttttctcttctctgttgcacatcggttggtgtgtattcttttgttttttggacggcattctaactgggtacaagtgtctggcaccgccttgggttgtacatggatctatgagggttattaccgactgttcatgcaggttacagctttacttaatcagtcttggttgcctcggttgctttgggtttcacttggtt

SEQ ID NO: 3086 - DNA, 1108 bp, Triticum aestivum
  unsure (1)..(1108): unsure at all n locations
  Clone ID: PAT_TA_3086
tggcgtntccgccgccgtcgtgctggcgcttcttgtcctgtgtagctacctccgccaactctttctgggcaacactgcaccggggtggtcttgcgccggaccccgggcttcggcagaggccggctcggctccctgccggtgagcgcgccccaccacctgacccttccccggtagtgggtggtggacccgagggtcgccgcccgaatggctgctgctgcggcaccgccggccgttcgggtgatccctcctggtggggcgggcgcttcccctcggctcctgtgtcctcctccaggtttgctgatagcttcagcgagtgtgggagcagggcgaaagagagctcctgttttgaagtcggcagctgtttatagttgctttcttggaacatcagcaaatttgcggtatcagatcattgctggcttattggagcatcgactaggagagagcctggcaactcagtataatcagccacttcttgctggtctcttgtcctttgtagcaaggacagtcaactcatacttgggaacacagcaatgggttgatcttgctcggtacactggagtacagaagattcaggaacagcttccttccgatgaggtcaccacaccacctgaaacatcccagttagaggacggtagaaccgatgtacagaacccggatgagagcagcagcagcaacgcagaccgatcgagtgacccgaccaagtgatttggttgctttccgtggctacaaagtccccaaccatatatgtatataggttcaagacagcgaaaggagtcttgttgctacgatgctgagcctcactcttggatcggccaggaatggactattcatatgagaaaaacaataaaatactgcagttagccattttttctagagtaaatatactcttgtagtttgtactttgtactcactccataaagaaatataagagcgtttagatcactactttagtaatctataaacgcttttatatttctttacagtgggagtacatatgtaaggagaagacgatgagtgtctagtggattaattggcatgggcaattacgggctttgagttgtagacttaaatctgctgtgggaacccacgattgccatccatttatata

SEQ ID NO: 3087 - DNA, 396 bp, Triticum aestivum
  Clone ID: PAT_TA_3087
gtttaccgttttgccgactgtggccgctccggggtcagggaggaggcccccaagtcggcgccgtggccttccgtgcaggagcatggtttgattcgaccgaaaggccccggtgtgtcaggaggatcggaggcgggagtcaattagacgaccgcaagtgctactcgctcacattcatgtggcttcccttgttctgaaagttgaaacaaaggctttgtttgctggtgattttgaatgtgtgaagtgtgcatgtgcgtgctgtgttttcaagtgttcaagaagattttttgttcatgccatgacatgacaaattgagtttgataattacattgtaacattgttatttgatgaagcagtaatttgatcaaaattttacaaataaaagggggggcccggtac

SEQ ID NO: 3088 - DNA, 1128 bp, Triticum aestivum
  Clone ID: PAT_TA_3088
ccagcacctacagaccaactagtgcacagtccgttcacagtgtacagtccaggaagtgctcagaatggcgtgagcccaccgtcatcgcttcccctaagcttctcctcctgctcgccaccctcctcccgcggtgcggcctcctcctggcgtgccccgccccgatgaccctcaccgtggtgaacaactgcgcgtacccgatttggccgggcatccaggggagcgccggcagcgaggtcccggcgcggggcggcttcttcctcccgtcgctctcccagcgctccttcccggcgcccacccccgcctggtccggccccacctgggcgcgcaccggctgcacgcctgcaggggccgggcagctccgctgcgccacgggcgactgcggcgggcggctccagtgcgggggcctcggcggcgcggcgcccgccacgctggcgcaggtctccctccaccacggcggcgacgaccagtcgtcgtacggggtgagcgtggtggacggcttcaacgtgggactgtcggttaccccgcacgagggccgcggcacctgccccgtcctcgcctgccccgaccagctgacctgcaggtgcgcgccgcggcgcccggcggcggcggcgtggggcggcggcgtagcggcgggcaggcgttgctccccgacgagcggtactgacgagctgcgcacccgcgacgcgtcgcctggcccggccgcctgccgtccctccaagtactcagactgtgccaacaacgagtgcccgccggccttcacctacgcgcatgacagcccctcgctcacccaccagtgctccgcgccgcgcgagctcaaggtcatcttctgccactagactagaggtagtccagcggcgctcgcggtgccgccgccggccgtcagcagctatgtctgggtctgggatcgaatgtggtgtagtgcgtgtcatctcatctgtcatgtgtgagtgttcgattaggctttggagactgccaggctgaccggtgtgcttggtgtagttcgtgctctgtaggcgttcacctctcgtctagtagtatggtgttagctgctctgattccagtctgaaataacatgtttagatgggcattgatctgatcacatgatcgcattaatcacggggtttgtgc

SEQ ID NO: 3089 - DNA, 1011 bp, Triticum aestivum
  Clone ID: PAT_TA_3089
ccacggcgccgccccacgcgtccgccctccttggagagaccgatcgatctcgaccgcggcggcgatggatttctccggcggggcggggggcgccagggcgcccgagatgtaccagagcgcgcggcggctgctgctgtcggcccgcgacggcgtggcccgcgtggagcggctcgcctgcgcacccgccgggccttcgtactccgcctcgccgccgctcgtcggcgcgccggacccggcgggcgccgaggccgtgcgcagggaggtggcagcagctcagggcctctgcgcgcagatggaccgaaaccgtcgccaaacccccgtcacgggcctgagcgacctctggaagagaaaagtgaagcgcctatctataggagagagggaattgaaggaaacccttgacaagcacttattgcggcaaccaaagcggcttttggagccaaggaaagggcgaagctatttgagagagctaatggtgagtcgtcgcatgtccttcaaatattcgacgacgaagcccaggcaatgcaatcggcccgtagctcctctcgaatgcttgacgaagcctttgagacaggagtggccatcctccacaagtactctgaccagagggatcgtctgaagagtgcgcaaaggaaggccctggatgtcctgaacactgttggcctgtcaaactcggtcttgaagcttatcgagaagcggcaccgggtcgacaagcggatcgcgtatggcggcatgatcatcaccgtcgtgctgatggttgcgttttggcgatggacacactaagtttcaaatgttctctagaggtgggcacaccagtgggggttcttgttcagtttaaagtttgctatctctggtccttccttgtgtagtaggcacaactctgcccggttactgatctctcttctttgtattactattatatatatactgtgtgtatagcgattatgaaaagatgttgacaaccctcagatgatatacagtggcctgttttgttgctatgaaaaaagaaaaaaa

SEQ ID NO: 3090 - DNA, 1275 bp, Triticum aestivum
  Clone ID: PAT_TA_3090
cctcgcgcccgccccccgccgcgcgtccgctccacccctcgccctccatgccgaaccaccgcgccaccccccgcttcccaaattcctccgccgtcctgcctgcctgccgcggccgcgagagtcctccactccacaacaaccatcgagaagcagcgcgcgcgcgcgcacgcacggaggcggccgcgatctctcgcccacccaccgcccgcgccatggcttccaccaatggcggctttgtcagtcctcttgcagcgaccgttccagttgaggcggttctgtttgacattgatggtaccttgtgcgactcggatcctcttcatcacatcgctttccaagaattgcttcttgcgattgggtacaacaatggtgtgccgattgacgatgagttcttcataaacaacatcgctggaagaagcgatgctgaagctgcccagaatttgttcccagactggcccctcgaaaaggggctgaaattcctagaggacaaagacgtcaaatacagaagtttggcgatggagcgcctagagcctgtaaagggcctccacaaggtggtacagtgggtgaaagatcacggctacaagcgtgccgcagtaaccaatgccccaaggatcaatgcggagctcatgatcaaacttcttggtctatcagacttcttccaggccgtgattgttggaggcgaatgcgagcagccaaaacccgcccccttttccatacctgaaggccctcaaggagctcgaagtgtccgcagcacacaccttcatctttgaggattccgcttcagggacacgcgcaggcgttgccgcgggaatgcccgtcgtcgccgtctcgacgaggaacccggtgaagtccctacaggaagctggggccgcattgatcgtcagtgactatgaagaccagaagctgtggaacgcgctcgaggagattgatagggaggaagcgaagctaaagactggtggggcctgaaaaagatgatggtgatgaacaattgattagaccattgcaaatttacccattcttattatttataagggaatctacgccctgaagttattatggtaggacagagctcatctaggtattttgagctattagtttggtatatgtgtttctttttgttgtctagtagagaatcaaataaaaaactttagtgcccagcacatgagatttgttcgattgatggggcctatgaaaatggcatatctgtcgggctcattgcctaccagctctgtattttgactgttgaccactctgttgattagcttctcttattaatat

SEQ ID NO: 3091 - DNA, 595 bp, Triticum aestivum
  unsure (1)..(595): unsure at all n locations
  Clone ID: PAT_TA_3091
gaggaacgaacagttcttcatgatcgggtctacgagtgcatacccagcanccgtgcttcacatggtggtgaatctccttacaaagaagggtattcacttcagagttacttcgaagcaaacagcggcagacaccaatgacaagttcgccgacttgtatgacatgcgatgggtgccaatgttaatacctacaacagtagtgctgattgccaatgttggtgcaactggtgtagccatgggtaaaacgatagtatacatgggagcatggacaattgcacagaagacacatgccgcattgggtctgctcttcaatgtgtggatcatggtgctgctctatccgtttgcattggcgatcatgggacggtgggcaaagaggccagtcatcctgctggtcttgttgccggttgcctttacaatagtttgccttgtatatgttgctgttcatatcttacttcttagttatcttacattttagccaagtgatatagtagaaaccattgtattgtttagcttctgtagtaagctgggagccaaatatgctccgtgtatccaataaaccattgtaatacttgtactttgaaccttaatatagaatggt

SEQ ID NO: 3092 - DNA, 1299 bp, Triticum aestivum
  unsure (1)..(1299): unsure at all n locations
  Clone ID: PAT_TA_3092
gccggccgggccttgtcccccgccaacgcccctcatctccggcggtcatcggacacgggctccccgtcggcgcgctcgtacccggcctcacctccgcctccgttcctggtaccccggcagtaatgcactgtatcgagcccacctcagtatccgcgtcactggtcatctcgcagtgaaggattttgacatttccagcaccactggatacttggcctatccgtattacatcgactatgtcgtggacgttgagggatgaagggatgctgaaactggccattggtggctccaagatgagccggcctggagaagcgagcggtttcctgaatgggctcgagactaatgaggatgaacaaaacgggtggcggcatggacggggatttccctgctgttctggacatggggtacctggtcagtaaggggtttgggggaattcgctcgctcactgctgtgtggtttagtcttcgccgggctgtttttggttttggtcatgctggtgctgaggttgaggaccgagctgaaaaacaatggaacgctttggttcagccagtcagtggatttggtgaggggaagttggctaaagcatatcagcttgtgcccaccaagacagactattaagcagcatgagatctgagaagcttcaacttgtgtctgttatctgtatcccatggcctaatcttgtgcttcgtttgtaagtatttagttttctagttctacatttctagcctttcatggttgaagtttcaatggttgagcttggaatgtcatgacaactgttgggtgtaattaagaattatgtcgcttctgtatgattatgcttacttggtcattaaggggtttggatatgctcctaacaacttgagctgaaaaataatggcacgctttggttcagccagtcaatggattctggtgaggggaagttggctaaagcatatcagcttgtgcccaccaagacagactattaagcagcatgagatttgagaagcttcaaattgtgtctgttatctgtatctgatgacataatcttgtgcttcgtttgtaagtattgtagtttactagttttacatttctacgcctttcatggttgaagtttcaattgtttgagcttggccagtgcagaacacaactactgtgtgtacttaagaattaagatgtgtttgtattgctactacttcgcttacctctatcaagaaattgaaaaaaccaaaaccccaagtgacctttcacctccagcccggcgttacaccccgactggaaattgaccctggcaaatttntcactactcgtccaaannggggaaaa

SEQ ID NO: 3093 - DNA, 704 bp, Triticum aestivum
  Clone ID: PAT_TA_3093
gtcggcggcggcgtgaggctggcgggcaatggcgggtacgaggactggaggctgggcacggcgacctacatcaaggagtcccagggccacccgctcaatgacggtggcggcgcttgcgggtacggggacctggacatattcaggtacgggaggtacacggccggcctgagcggcgcgctgttcgggcggggcagcgcctgcggcggctgctacgagctccggtgcgtcaacaacgtcctctattgcctgcggggcagccccaccgtcgtcgtgacggcgaccgacttctgcgcccccaacttcggcctcgccgacgactacggcggctggtgcaacttccccaaggagcacctggagatgaccgaggccgccttcctccgggtcgccaaggccaaggctgacattgtccaggtgcagttccgaagggtgagctgtgacagggccggcggaattcggttcacgatcaccggcggcccctgcgccctcccggggctgttcccctccggggctgcccaccgcgtggtcgtcgctgcgtggctctagcggtcctgaggccgggcggccgcggtttggggtaggtgcgccggcgctagtgctggcggtccgacgccgggcccccgtgccgacgcctccggatggatcgtagaatatgtggaacatgtctgaagccactttgcatggtgggctgctgggtagaaagttat

SEQ ID NO: 3094 - DNA, 552 bp, Triticum aestivum
  Clone ID: PAT_TA_3094
tgggcgggcgcaatgccaattcacacagcagaactgcagtgctgggcaggacgaggagacgctggtgaaccttgacacagtcacccctaacatcttcgacaacaagtactatggcaacctcttgcgcggccgcgcccctcttccttcagatcagcgtgggcggtcgcgtggggtcgctgctgcgaccaccgcacccatcgttcacaggttctccggtagtcaaaaggacttcttcaagaatttcgcggcctcgatggtgaaaatggggaacataagtccattgacgggaagggctggggagattaggaacaactgtcggagggtgaacaacaaaccctattgaagaatgagattaatgttatgagttgtgaactcattgtccttgtgtatatcattcttttaattaattctaactgtaagtgttcccttattattttctttggaaacacacgaggcctaaacttgagactggccagtcttttacaactttagtgtctgggaaaatcccgctttcccccacctcaatcgcctagcacttcatgcccctttctc

SEQ ID NO: 3095 - DNA, 515 bp, Triticum aestivum
  unsure (1)..(515): unsure at all n locations
  Clone ID: PAT_TA_3095
tgagggcttaccaaaccttacgnggattnttgcttcagaaattgcacttggggactaatgttgcaagtagtaggttaaggtttctctgggcaggaagtcgtgaagttgagaccagacacgtgacgaaagcccagcgtcccagggaactggcccacggagttgagatntggagtcaagttcctgatggcacacactcgcaagaccgtctccagatctatagcaagantctgctgctattagacctacgtttcctcagtagttacagtttcattcggccctccttttgtttgagccgcagtcttgacaataacatgtaaacttgggagtttgtttttgttggtatcgcctgtctagcagatatttggatggcagatgcttgatctttagactgttgctttcgttgaagttgtcagcgcagaatttgttctaaaggagggaggaatgtctgcaagttatgacaggacaagttataaatctaaaactgtcatgaactgtaaaaaaaaaaaaaaaaaact

SEQ ID NO: 3096 - DNA, 237 bp, Triticum aestivum
  Clone ID: PAT_TA_3096
cccacgcgtccgcggacgcgtggggaacatacaagattagatacaggcaaggaaagagtttcattactaagagatcatgcatgttcaattctttttccttcagagggggtctgcttcaaatcctctaattacaagtagaaactgtgacctgctccaaaggctactgctttgtgctctgttttatttactgtgtgctctggaaaacaaacaaaacaaagactcataggcccggaacac

SEQ ID NO: 3097 - DNA, 1576 bp, Triticum aestivum
  unsure (1)..(1576): unsure at all n locations
  Clone ID: PAT_TA_3097
gcgggaacgggcaccgaactgtttatctcgggaggtagcgtccaagtcttcattaacaacatcattaatagcatggctgtaatcaggtgtctttatatgagtctctctgaaaagaaagaggtggcagtattgtacacaaacaataaaggaaatattaaaattcaacaaggtgatattaaactagccaataaactccaggtcgataactttgtaaccaagaattccgtcattggcatatctagctttgttgagatacgccagggcacacactttatcagacaaggttgactccaaatatatcttaccaggtacatttacagggaggcttcctcattgaaagaaagtaatgactatagctcaggggttacgtgacgagcatggttttagtaagaaggagggccatactttctttgtagaaataatagctttggtagaagagcgttctcatgtgaagcctcactaagggaaacaataaaagaaagccactcgggtttttttcgacgaaggaaatttgcaaagatagcaagcatttgagagcttgctcgatagtattcgcaagtatgaccagtggaatgcctcagacttgaaggtagaccaaaagaccaacgatggatggaggtagctggagcggctactcatactgggtccgatctcataaggtgtacgggtgtttgtaacttaagttgtgtttgagaaaatccttaagatagagcaacttaatccctgcatatatttgtaagaacgtttgtacggtggttgtgtctctctaggttgcggaaattttgtacgctgcaatattaatcgtgtttggaagccccaaaatggtgcttgaattacagaaaagaactgtgtgtgcgtccacccccatatggctacgtgaagacaccgacggagttttttgacaaggacattgcaattgcggaggatttagagcttcttgatagtctggcaggtattgcagtgcaatgccttagccttgatgtagatcaaagatacacgatgatggaggtagctgagcagctacacaaactcagtcgatctcgtaaggtgtaagatgtttgacaaaaccctactttgttttcgtgaagaaaatgcaaccgtgtttctatggtgcccgaatgctggcaggctgcattcgtaattgtgtttcgaaggttttgtaacgatatgtcacagcactacatttttaccaaatatgtaaccgtgtgaaactattggctccaaataacattttatttataaatagattgcaagaaacaattcaaacttgcaaaaaaaaacaacaaaaggatggggcgcggcggcaccggcgtgttctgccgtggacggtggggccaagagtacaacaacactcccccgcgcatcanaancgcngtctcgggatntntcgccanaantccaaggctaacggccggccgaactnactcncnccgaaaaccttggtttntggaagctcnaacccgtggttcgggnaattttccccggaaaatnggaacccggaangcccccgtttcttggaccccggggggtnntttcctngggttgcggccnaacattttggcctgggaaggccggt

SEQ ID NO: 3098 - DNA, 251 bp, Triticum aestivum
  Clone ID: PAT_TA_3098
tgttggagaagcgcgcggagcatcagaaacatcatccctccttgccttgttcttttatctcttcctaatagtttgttggtcgaatttataggattcttaatcgacagatcaggaatcacctccccattcagctaagctgcatgtcttttgcttatattttgtcctttcttgtacttacatctcatgctgtgtggatttcctatggctcaagtttgttgctgcgctcaggtttcagcaattgctgcacctgc

SEQ ID NO: 3099 - DNA, 1391 bp, Triticum aestivum
  Clone ID: PAT_TA_3099
ccccgcgtccggccgctccttgctggcagtcggcatatggatcgtacaaaattaagcgctacgaaacccacgtacaataaagcttattttcctatagcaattagagtttccatgcttctgtttctttatttgactttgttggatttctgtttctgttcatatagaccacaagtatgtgtttttcatgtaatccttttgaaattttaggggtgctactgctgctgcttttttttttgaaccgggcgtgcccccttccttgcaaggccttcgctatgcctgcgctctccgatccatcctggctgcgggggaagaggggcagcgtgtgctctgctctccccgctgtccccctgtccccgcccgccctcccaacgcgcaccctgcggcgcctacctgcctccgcctgctttgttgctggcgcgctactgcctcccagggtctacgcactcacgcttgtcgtgccggttagcgtagggcctttccgaaacgctttgatacgacatgtgcgctggaaagctccatcttgttgttggacttggtgaagctaatgggcccgaggtcggtaagaagagttggatgccactgatttgttcatgtggtgcgcgctgtatgactgaaaacttctatgatggggtggctgttttgcgtatgcatgcctcgcctgatataatcacaaccttcacatgtagtccaaagtggcctgaaataacggagagtactgaacctgggcaaaaaacagtcgataggtctgacattaccgttcgagtgtatcgcttgaaacttcttgagtacctacagaaaatgaggacagggaggatgtttgggcctatagttgctgttatccacacaggggagtttcataagagggagctgccgcatgcgtgtgtccttgtttggcaagagaagcatcatgaccgggtggtcacaccaacttcataaattcctttgtttcaatcactggttctcaactgactgatattgatgctgatgctcctgctactatgcctcctaacacgatggaaactacagttcctatgccacttaagcttaacaggggtgctactgctgctgcttttttttttgaaccgggcgtgcccctttccatttaagataaatggaaatacaacagtctccgatacaaccaggaagcaaggaaagagaggcagcgagttcaatgcactgccaggaaacccactgtgctcgcccgccatcgaaacgagcaccatggggcgaaaacctgacatcacctacttagtttgaatctagctattacaaaccagggaaaaggcacaaacaaagaggtgccagataacataaagtatgtagattcatttcatcaaaaacgctgaagtagtggttgatccaagttttcagataaaaaaaaaaaaaaaaaa

SEQ ID NO: 3100 - DNA, 419 bp, Triticum aestivum
  unsure (1)..(419): unsure at all n locations
  Clone ID: PAT_TA_3100
acttccacgcgtccgcccacgcgtccgattctgatgtgattcagtgcaccaaaggttacataatacgagtaaaaattgttaggtcatagatgtgcttcaaaatgtaattctgagcgcatatgttgcgggaaatctgtagcatgtagagcaaattggtaattgtttgtattgttttgtacacaatagattacttgtgattcttttcgttnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcctttttaggggaccaattttatcttcccggggttggcacgaaaaaattttttttttggggcccccaaaatcaaattcatgggc

SEQ ID NO: 3101 - DNA, 242 bp, Triticum aestivum
  Clone ID: PAT_TA_3101
cggacgcgtgggctgtcggagtaggggatgtgcttgatagttcgagctcccaggagaaacctacagaagctgcaagctagccctccttggaaatcatctgtttctttgtccgactcatttttttgccccactgtaatcagctcaggacaatcttcagttttcctgtatagagggggttcacgtacgcatcaggtgttgtgaggattactgttttactctcagggaaggaaactgtgtatcat

SEQ ID NO: 3102 - DNA, 1211 bp, Triticum aestivum
  Clone ID: PAT_TA_3102
cggacgcgtgggccgcaattaaggaaggaggcggtggagacggcaggagccgactagtgccgcgtacagcctgcttgcagcgacgcctcatcggatgctcccgtctccgataccaaatagttcggtggttgcggcggcggtctaggtgtgctcgccggagtcgttggccccgtcccggagtgacgcagagcacatggccgaggccctcctccaccacctcccccgccgcttcggtgcttccaccaccgcctcctcgtcgccgtcctcccacggggtcctctcacccgccccgcgcgccgacctgcgggtcacgcgcttggcggctgccgccccgcctgggcggccaccccggctcatggcccatgccgcaggtgcgttcaagagacggggtgagcgacctaaatggtgggaaaagaacgctggtgcaaatatgattgacatacactccacacaggatttttggatgcactaagggatgcaggcgacaggcttgttattgtagagttttatggaacttggtgtggttcttgccgggcactcttcccaaggctgtgcaggacagccacggataatcctaatatcgtgttcctgaaagtaaatttcgatgaaaacaaacctatgtgtaaacgactgaatgtgaaggtcctccctttcttccatttttatcgcggagccgatgggcaactggaggcgttctcatgttccttagctaagtttcagaagctgaaggatgccattgccgttcacaacaccgatcgctgcagcattggtccacctgtcggagttggggatgtgcttgatagctcgagctcccaggagaaacctgcagaagctgcaagctagccctccttagaaatcatctgtttctttgtccgactcatttttttgccccactgtaatcagctcaggacaatcttcagttttcctgtatagagggggttcacgtacgcatcaggtgttgtgaggattactgttttactctcagggaaggaaaatgtgtatcatatatagaatgtcaactttttcttgtgcttggcagaagcagtagtgttatactacatcattttaggggtggtaaaagtcatgaactccatcctggggctgtcacacaccgttggtttggctggtttggccaaggacgtgtggtgaagccaggcctaggtaacgaataaagcgaccgtttatttatttctaattagactgattttcgt

SEQ ID NO: 3103 - DNA, 801 bp, Triticum aestivum
  Clone ID: PAT_TA_3103
cggctatccagcgccaacatgcagggcacgctcagcgacagcatcgggcagctcggccagctcatgttccttgacctttcattcaacagcggtctcagtggtacgatccccgcttcgattgggaaccttgggaagcttacgacactgatcttggctggttgcagcttcagcgggggcattcctaaagaactaggcaacctcctgcagatgacattcctggcgctgaattcgaacaagttgacgggcacagtaccgcctcagcttggcctactctcaaaactcttctggctagacctggcagataatgccatcacaggaagtgtccctatctcaacaggaacgacaccgggccttgaccttcttaccaacacgaagcacttccatttcaacaagaaccagctatctggaacgcttacaggcctcttcaagcctaatatgaccctcatacacatattgtttgatagcaatcagttcacaggcccaattccgcgtgagcttggaagcattacctcgctccaagtactccgactggataggaaccaatttgcgggagcagtccctaacatcaccaacttggtcaacctaaatgagctgaacttggcaaccaacaagctaactggatcagtgccaaatctcagcagcatgaacgtgttaaatgtgtggatttaagcaacaacaccgtttacgctaccagccaggtgcacaaatctaacaaatatttcttcaagatcgatgtcttctgcgaggctcacttggcgggtccctcaggaactcttcaatttgccccagcttgcatgaagt

SEQ ID NO: 3104 - DNA, 440 bp, Triticum aestivum
  Clone ID: PAT_TA_3104
tcgtgcctctcttccttttctcctttcaaactgaatccttctcttaaaccctctcctcctcccctatccctctcccttttttaccctgtctttgtctctaaaagaaagaactcggaagatcctcttgaaatgcaaaaccgcccaatttttcttcaattctttttttctcttccacttcattttctcggctgtctggttctggtgtcggtttgtttgggctgggtactggttcggatggatcaacacaggactttgggaaagctacggttgattagggtgtattgggtgtgttttttgttgtcttcctgggagggctttgaggggcgaggagatatgaaaaccttttgggggtgaagggaaatggggaatgattgagggtcatgccatgggctcgttagagcggattcagatgtgtagtcctcgcaatgacaagaggcttc

SEQ ID NO: 3105 - DNA, 738 bp, Triticum aestivum
  Clone ID: PAT_TA_3105
tcaccgtgataatctccatatcgcaatggtcctcgggaagcttgatttaggtctccgtaagattgccgctatattgttctagtctgatggcgatatggttatagtggcaagtaagattgttaaatagtgctggttcgacactgatttttctacaaggacttacaggatgttaaagaacctatcgaaggatataaatagcctttctttccatcgtagacagcggattgttgagtcattgtgctcggattgttcagctcttctgttccaaacgatagtttatttatagcgcaactagaaaccacttattgtgccattagtacatactgcgtggccatttaagttcacaaagtccaccaaagttaactgtcgcatttcaccgctgacgccgattcggtggcaaggcttgactctgattgatgactatgctttaaaggaacatgcagctataggtgcaaatctcaaagtggtcttgtcccaatgttgatgatgatctgccctttttgcaaaagtcctaccccttagccaggaatgacttaccgcgcccaggcgagtttttctcctttggtgctgtttggggggtcgcggttttgtttggtgagttcgtggtatcttttttcttagtcattattgagtataacaattagatgaggtgcagagccttggcttgtaaggacaacagggagcggaaagagaagtttgagctggcgctggcggcttttaaaaaaaaaaaaaaaaaaa

SEQ ID NO: 3106 - DNA, 964 bp, Triticum aestivum
  Clone ID: PAT_TA_3106
aaggtaggaggcctcggcgctcattgtgctgtgcctaccaccgctactgacgctcgtgacgaccgctaccgacgcgcctaagattccggccgaggagctgcgccacggcccactcggcaaagatgccggccgaggagctgcgccacggccccgtcggcgccttctcctggctcggcatcgccttcctcaccgtcaactcggccatggcgatccacaggtccaaaggcgacccgtccgcggtcggcttcgtggccttctcctacctcgacctcgtactgctcttctacttccataggaggttcgagagcgccgcgcccggctcaccggcgagacggaggctcaaggtggccgtctgggtcctcaccaccatgctcacggccgttctaagctataaggtgggcggctatcatgccgctgccagtgaagatcctcgtttgggccatggccggcgccgcgacagcaggaggattctacgccttcttcctgttccgggaatggcaaggatgtttaaggaagcgtggcatatatttgctgggaaagcccttattttggatcctacatgctccaaacgtagctgggaaaagaaatcaaaggtacatatgttctttcaggaaaatgggacgttatggacaaggtttggcgcactctcacttccaggtcgttggctgctgccgcaactgttgccgctgagcacgcaaatgttcgacttttgtccttctagggccatgggcactgagctcgggagggcgttctctctgtcaaattcttgtcacgctatatgaaaccttacatctaagctgctaaagtgaatgacgggtattgtctgtattgtgtattgtgtattgtgtaggtagcaagcagcttccttttgtcaggtcatgtaatatcatcagcaaaaatagaacttaagacagcaaggtcttacatttttttttgttaaagaaaaaaaaggggtagcaagact

SEQ ID NO: 3107 - DNA, 2361 bp, Triticum aestivum
  unsure (1)..(2361): unsure at all n locations
  Clone ID: PAT_TA_3107
ccgacgcgtggtcagacgcgggccattcactctctccttcgtctccaacctcatccacccccgaaacccgcgtcgtccgtcgccgcgtccaccaccatgtgtgggattttggccgtcctcggctgcgccgactggtcgcaggccaagagggctcgcgtcctctcctgctcccgcaggctgaagcaccgggcgccggactggtccgggctgttccagtgcgagggcaacttcctggcgcagcagcggctgacggtcctctccccgctctccggcggccagcctccctacaacgaggaccggaccgtcggtcgtcggggccaatggagagatctacggcgacaggcagagacgtaatcagctccgcccccaagtacaccttcaccaccggcagggacggggaggtcatcatgccgttgctcgaggagtagggcaacgaacttcgtcaacgcgcgggcccgcaacaggacctgtccgctaggcgactcgcgcaacaagaggtacatgtccgcccgcgacgccgtcggcgtcaacccactctacttcggccggggcagcgacggctccgtctggattgcgtctgaggtgaaggcgctccacgaggactgcccaaagttcgagctcttccctccggggaacctctactcgagcgccgccggcgggttccgccggtggtacaacccgcagtggttcgccgagcacgtcccggcgacggcgtaccagcccctcgtcctcagggaggcgttcgagaaggccgtcatcaagaggctcatgactgacgtgcccttcggcgttctcctctccggcggcctcgactcctccctcgtcgcctcggtgaccaagcgccatctcatcgagactgaagccgccaagaagtttggaactgagctccactcctttgtcgtcggcctagagggctcacctgatctcaaggccgcgagagaggtagctgactatcttggaaccatccatcacgagttccatttcaccgtccaggatggcatcgacgccatcgaggaggtgatctaccacaacgagacgtacgacgtgacgaccatacgtgcgagcacgccgatgttcctgatggcgcgcaagatcaaggcgctcggggttaagatggtgctgtcaggagaaggctccgacgagctccttggcggctacctctacttccacttcgccccaaacaaggaggagttccacaaggagacctgccgccaaggtgaaggcgctccatcagtatgactgcctgcgcgccaacaaggccacgtccgctcgggcactagaagttcgcggggggctactcgacaaggagttcatcgacgtcgccatgagcatggaccccgagtggaaactgtacgacgccaatctgggccgcatcgagaagtgggtgctgaggaaggcgttcgatgacgagaaggagccttacctgccgaagcatatattgtaccggcagaaggagcagttcagtgacggcgtcggctacaactggatcgacggcctcaaggcttttactgagcagcaggtgactgacgagatgatgaagaacgccgcagaggagtacccgtacaacacccccatcaacaaggaggcctactactaccggatgatcttcgagaggctctaccctcaggattcggcgagggagacggtgccgtggggtccgagcatcgcgtgcagcacgccggcggccatcgagtgggtggcgcagtggaaggcctccaacgacccctccggccggcacatcgcctcccacaacgatgccgcccccgctcatgcccacgccaactggaacggggcagtggccaacgggaaagccaacgggaacggcacggcgaacgggaacgccaacgccaacgggactctggtcccgtgctagccgtcgccgctcgcactagctggttcgtaggagcgtgcgtgtgcgcgtgtcctcggactgatggcccataatgccattggcgccgcggccggtgctgttgttgtgtactcctacctgttgtacctttcttcagtgttgttgtgtgtgcgtgtgcgtgggatggagctcgcggtccgagcatgtggcggggacgatggatcgcctgtacaacaagatcgtgaattaagtgaactagtatggtgtactgcccaaaaaggctttcgaccccgatttagtataaagacatccacagcaaaaaaaggggggcccggtaccaattnncctaaangagtctattacggcgctcactggcgtcgtttaaacgtcngactggaaaacctgggttaccaantaacccttganaanccctttccagtggtanngnaaagcgnacgntgcctcaaanttccncttatgaatggaccccttngggatanccnggggtgggt

SEQ ID NO: 3108 - DNA, 691 bp, Triticum aestivum
  Clone ID: PAT_TA_3108
ccacgcgtccgcccacgcgtccggcgacagcgagggttcctagccaccgccggcccgccgccactacttccgggccgaggcctccgccgccccgctgccggctcaggagccccaccagcagcgcctccctccctggaccagccgcccccgccagccgccgccctgagctacgccggcgaccagtccgtaggcagggcggccgtccacctctgattgtgcgtttgcactctgaggccggccaagacgttcacccacccatggcgggaacgatgatggccgtgacggccaagagcaagaactgcacgctggcctcggagaagaaacacgggtgggctatcccgcagcttccggagctccggttcccctgggattcgcaagaagacaaggccttctccttaagcttgcatgactctgcctcccctcatcatggtgcgctgtttgctagcgttggtctgaaagtgtcgacgcctgctccggcagtgtcaaccagtccggcggagcaggagttcaagatcccttttgctgatcattgcataaagtttgtctcgtcagcagtcgggtttccggttgttggggccgtggatgggtccgtggaggaggaggtggtggtggatggtaaggttattaggaagaaggccaagaagcgtgggctgaaactgaaaattaagattggtaacccgcatttgaggcg

SEQ ID NO: 3109 - DNA, 710 bp, Triticum aestivum
  Clone ID: PAT_TA_3109
tcggcacgaggacgctcacagcctcacactccgcactcacacagcgagaagcagcagccaggctagctaatcgacaaaggctagcacatcgtgcccgcctgcccggctccggcgggaggaggatcgatggcgttcatgcggtaccgtgcgctgccgcagggggaggtgaccgcggaggagttctgggcgtggctggggcagttcgacgcggaccacgacggccggatcagccgggaggagctgcagcgcgcgctgcggagcctcagcctgtggttcgcgtcctggaaggcgcgggaaggggtgcaggccgcggacgccaaccgcgacggtgccgtcggcagggaggaggccggccggctcttcgcctacgcgcagaggcagctcggcggcaagatcacccagctcggctcctatggatcaaactgggcatgagttgatctgctgatgtgactctgatggtgggacgtactcatatcagcttcggacacgcggctgtggggagtatgagattttttctttttcttttttcgaatgatgtggagtatgagatggatgttcatgttttcggagttcttggggtaacctttgaagtggtttcccaagggtttcctactttgtattttcagcactgtgaactctgtggagatttgcagagttgttagagatgatgtaattttctccaagctctgttgattattttgcttaaaaaa

SEQ ID NO: 3110 - DNA, 1152 bp, Triticum aestivum
  unsure (1)..(1152): unsure at all n locations
  Clone ID: PAT_TA_3110
ccctcctgtgnatccaaaggatatggtacggagnattaacacatccttatcttcggnaggtgtgcattgctttgggagctgctaaaatcctcttcctcagcacccttatatgacagttccaatatttgggaagggtcacatcttcacttagatagtagcacagcggaaggcaattcttcactggcaattgagctggatggaatacgagaactggaacacctctttcaaattcagccactggacctgattctcaaagatgagtgtgtacatatgcttgccttaagatggtctcaacatttctgtgaagactacagatctcgcaagtatagaggcatcctcttttctacccccgcggtcccattcaggctgatgcagttaccacctgtctaccaagttctcctagaaagatatgtcaagatgcaatgccctgattgtggttcagtgcctgatgagccagcgttatgtttgctttgtggcaagctatgttcacctagttggaaaccatgctgcagggctggtaaatgcctaaatcatgcgtctcagtgtggtgctggtgttggcatatttcttttggtgaggaaaacaacaatcctgttgcaacgatcggctcgtcttgcattttggccatctatgtaccttgatgctttcggtgaggaggatcatgaaatgcacagaggaaagcccttgtatcttagccaagaaagatacgcagccctgacatatctggtggcatctcatagccttgaccggacttctgaagttctgcggcaaacaaccatcagcttttatacatctgattaagtgcatcgttttgaggaacaatgcccaaaggatcatgtgatgtgcatattttctgggaactgtcatctagcttcatattcatgctttccagtgatagcgaattgcatccattcccaaggtggcgcagattctgccagactatcaagccatgcgtcggtgtttcagacctcgttcgcgcacaatgtacctgcccgggcggccgcccccttttttctttccttgttctttctgttagcatgtgaccggatggttggttgaactgttgacattgtacaaattcgccgtgcgaaactatctgcaagaaatgtaggctaattaaactggtaaaaaaaaaaaaaaaaaaaaaaaaaa

SEQ ID NO: 3111 - DNA, 245 bp, Triticum aestivum
  Clone ID: PAT_TA_3111
gaagtaaagaacatatcgcatggatgcttgttggcatgtgtaaaatcatcagaccaagacagaagaaccatgattatcatatgtactggaactaaaattaacataggggcagccattgatctagttactaaagggtagggctactgttaaacaacaactctaaaaaaaagttactgaatctactaaagtagaagagaattcagttatttacactgggaagcaacatcacttcatttccaataaaa

SEQ ID NO: 3112 - DNA, 586 bp, Triticum aestivum
  Clone ID: PAT_TA_3112
aaaagtttgatgtcttaatgcttcctccacgcaagacctatggagggcattgttctttgtctgagctcgagggaaaactatgtttgttagttgtggatggtgcgcttgaaggtatacctcgtacaatggacatattaatgctcgataacgatgataagcagagttggactcatagataccacatatctttgcctccgttgatgcaatcatgttatttcactccaagacacacactttttcatgattccaaaatttgggtgcagttgtttgctcggaacctatactgctatgatccaaattcaaactctgaggaattggagattgcctgtccagaatctgagtttcctttcagcattcatacgtttgttgaaagtataattcctctgcgtcaagataatttcatcaagaagatacagtgatgttggtcttctttattcttgaagatagatttcagcttacagatttacattatctttggtgttttttctcttcaaaaatggacttgttaactgccttaatttggcctactttatcactttgtgattagttataagaacaatcttgaaaatttcctaaaaaaaaaaaa

SEQ ID NO: 3113 - DNA, 615 bp, Triticum aestivum
  Clone ID: PAT_TA_3113
gcggaagagagctccgcggcgaccgtcttttctcctctctcgtcgccccttccaaggctgtcaaggattgttctatctgtctcggaagaatgtgttcagagtgaattcttctgagggctgagacttatttattaaattattaacttattaacttatataaggccttgccttctatggctgcaatccagaagctttatgaggtctgcaaagtatcattatttgaaaaagggccatcatctcctgaagccgtcgaaaatgctcgtactgtattagatatgatcacaccttctgatgttggacttgagtgtgaagcacaagctgttcgtgtttggagaagaccacgggccttgaataggaaaacagtgctccattcaagcccagcgatcagatatcgtcatatatatgagtgcaaaagcttctctattggaatatattgcataccagcatcatccatcattccactgcacaaccatccaggcatgactgtgctcagcaaacttctgtatggtaaagtgcatgtcaaagcgtatgattggattgatatagaggaacccggtaacttatcaaaagtcagaccagccaaggttgtgagggatggtgaaatatctgcgcctt

SEQ ID NO: 3114 - DNA, 566 bp, Triticum aestivum
  Clone ID: PAT_TA_3114
cgtccgctcgtgcccgtccgtcccggcggctctctcaaacccacactccccaccttcttgcggcacaagccggagccgacgatccccccacccgcgccgccgtcgacgcggcctcctccgcccgccgggatcggagagaactgtataaacgttttagtggttgaagcgacttgagtctttaaccatgagtagcattggaaccgggtatgatctcgtccgtcaccactttttccccggacgcccgtgtcttccaggtcgagtatgcccgcaaggccgtcgacaacagcgggacgattgttgggatcaagtgcaaagatggaattgtcctcggtgtggagaagctgataacgtcgaagatgatacttgctgggtcgaatcggagacttcactctgttcaccggaactctggcttggctgtggctgggttagcagcagacggtaggcaggtggtctcaagagcaaagtcagaagcagccaattatgaaaaggtatacggagaacccatgcctgtgaaggaattagctgatcgtgtagctagctacgttcatctgtgtacactctactgg

SEQ ID NO: 3115 - DNA, 599 bp, Triticum aestivum
  Clone ID: PAT_TA_3115
ggccacagctctacatgatcgaaacttcaggggctcctcatataaatattttggtgctgctctgggtaaaggaagacaggctgcaaaaacggagatagagaaattgaagctttctgagctaacctgcagggaaggcatgttgaggttgccaagataatttatggtgtacacgacgaagcgaaagacaaatcttttgagctggaactgagctgggtgtgcgatgaatctaaccgtcagcatgagaaggttccaaatgatcttctggagcaggccaaggcagcagcgcaggcagcgttggaagagatggatgccgactaagaagagaccatgagctctgctccccatttactttcacgtgctcggcgtaacagataccggactggagcggttcgttttcagtgcaaaaaactaccttcaggcgttgttgcttacggttccatgattccatcccagttgaggtagcaagcaggttctcgtgttttggggggttgtagcgaatcgtgttctgcttgctgttggtcacactgaatcttaatccattgaacatccgaacatgtttgtcacagatcttaatccattgaagatttcagttttactcc

SEQ ID NO: 3116 - DNA, 1260 bp, Triticum aestivum
  unsure (1)..(1260): unsure at all n locations
  Clone ID: PAT_TA_3116
cgccccccgcctgcttgcgccacaagccggagcagagcgtccgacgtcgaagcccacactccccaccttcttgcgccacaagccggagcagacgatccgccgtcgacgcgacctcctccgcccgccaggatcggagacgactatatagacggtctaggggttgaagcaacttaacaatgagtagcataggaactgggtatgatctgtccgtcaccactttctccccgagacggacgtgtcttccaggtcgagtatgctggcaaggccgtcgacaacagcgggacgatcgttgggaatcaaatgcaaagatggaattgatccttggtggtggagaagctgataacatcaaagatgatacttgctgggtacgaaccggagacttcattccgtgcacccggaaactctggcttggactgtgggctgggttagcagcagacggtgaggcagatagtcttcaagaggcaaagtcagaagcagacaaattatgaaaagggtatacggaagaacccatgcctgtaaaaggaattagctgatcctgttgttgctaggctatgttcatctgtgtacactctatctggtggctcaggccttttggctgtggagttattcttggaggctatgatagggatgggccacagctctacatgatcgaaccttcaggcctctcctataaatattttcggtgctgctctgggtaaaggaagacaagctgcaaaaacggagattgagaaattgaagctttccagagctaaatactgcagggaaggcagtcgttgaggttgccaatgataatttatggtgtacacgacgaagcgaaagacaaatcttttgagctggaactgagctgggtatgtgaggaatctaaccgccagcacgagaaggttccgagtgatcttctggagcaggccaaggcagcagcgcaggcggcgttggaagagatggatgctgactaagaagagaccctggtcctgtttactttcacgtgtggtgtaatagagatacaggaccggtcgatgaatttcatttcagttccaaaaactagctcaggttgttgttgcttccgattccatcccggtcgaggtagcaagcagtctgtcgtgttgtttgggtggtgttctagcgaattgaatcgtattaagcttgctgtgttggtcgcacttaatcttctatttaatcctgaatgacctgaaaacccgcccgggcggccggtaccaatcnccnaatgatctatacccgccaangcgtctttaactccgacgg

SEQ ID NO: 3117 - DNA, 593 bp, Triticum aestivum
  Clone ID: PAT_TA_3117
gttgatcacaccaaaggtcctcgctgttaatgccgcaaaagatgcaactgaccttgttgcaaagcttaggtcatatcatcataaagctcaaacaaatgctgataagcagcacttgtcaagcatgggtcttgatctgacaaaaggtgtaatccgcaacaaccttgaacatggcgtgattgagccagcaatgagcaaagtgaagatcattcagtttgcaacagaagcagccattaccattgtgaggattgacgacatgatcaagcttgacaaggaagagtctggccaagaagtgtagccacatgccattttacgatccctggctgctgtttgttatgccatggctggctgcttatagactcataggttgctgcttgtgattttccttttcttcctccttgtattggcggacgttctcgtagaatgttgtacggaagatggatgtatgagtgattgagtgtgtatcattatgtgtgggtagtaggactcgggagcaaattttgcctgagcattgctgatagttcatgcaagtaacattgttgtcatatatgtattgatcaactgttaccactgcttcacaggaagctgttgcaaaa

SEQ ID NO: 3118 - DNA, 1307 bp, Triticum aestivum
  Clone ID: PAT_TA_3118
cgtccgcccacgcgtacgcccacgcgtccgaaaggatttctgatgatgaaataattctggtgaggggcacaaagaatacaagtgcagtctccattatacttagaggagcaaatgacttcatgctagatgagattgaacggcctttgcatgatgcactgtgcattgtgaagagaactttggaatacaatacggtagttgctgggggcggtgctgtagaagctgcattatctgggtacctagagaatcttgctacaactcttggatccaaagaacagctcagacattgctgaattaaaagaatgtttgatgatcataccgaaagtgctcgctgttaatgccgcgtccgatgcaactgaccttgttgcacaacttagggcatatcataataaagctcaaacaaatgcggataagcaggacttatcaagcatgggtcttgacctgtcataaggtgtgttccgtaacaaccttgaacatggggtgatcgagccagcactgagcaaagggaagatcatccagttggccagacaagcttccattactgtgcaaagactagcctgtcagatcaagcttattacaacagacgataatttctttgcaaatctggttgtagaagcagttcaagctgtgaagactacaaactccaagggagaagtaaagtatccaatcaagagtattaatattttgaaagctcatggcaaaagtgccaaggaaagttatctgctgaatggttatgcgctgaacactggccgtgcagctcaaggaatgcctacaaaagtaatccctgctaaaatcgcatgtcttgatttcaaccttcagaagacaaaaatgcaaatgggtgttcaagttcttgtatctgatacaagagaacttgagaagatccgtcagagagaatctgacataacaaaggagcgaatagagaaaattctcaaggctggtgctaatgttgtatttaccaccaagggaatcgatgatatgtcattgaagtactttgttgaggctggagcaattgcagtaaggcgtgttcgtaaggaggatttgcgccatgttgccaaggcaactggtgcaacaatggtgactacttttgctgacatggagggtgaagaaacatttgatccatcattccttggacatgctgacgaggtcgttgaggaaagatttctgatgatgaaactcatagctatgatgaagcagtactaagtatttcaatattgtaattcttttaatttcattcatgacttgttgacttcgatctcatgaacttacttgtgattgcaattgtagtaaagttgagcgattctgtgcttaag

SEQ ID NO: 3119 - DNA, 2031 bp, Triticum aestivum
  Clone ID: PAT_TA_3119
cggtgcggcaccagcagctcgccccccagtctccccgcccccccgccctccctgccccccccccccccccccccccgcgccccgccgcccccccgccgccttgccgatcacatcgccggttcccgcccccaccggcgcccgccagtccggcgagagcgtccgcaccccgagcgtgtcggcgcaccaggcggtgcccaatgccggccagtgggccctcgcccccgtcggtcccgagtacctgctggtggacgatatcggtgatgtcacgatcgccaacgacggggccgccattatgaggatgctggaggtcgagcatccggccgccaaggttctcgtggagctgaccgagctccagtaccgggaggttggagatgggactacctgcgtcgtcataattgctgaagagttactcaagaaggccaatgatgtagtgaggaataacattcacccggcctcaatttttagtggctgcaggcttgctatgcgtgaagcttgcaagtacgttgaggaaaagctgactgtcaaggtggatagacttggaaaagactgcctttttaactgtgctaaaactagcatgtcctcgaaactgattaccacggacagtaatttcttttcgaatctcattgtcttaggagttcaagcgatgaagactaactatagcatcctagcaagtgtattattattttcagagctttattttattgaacgcacgtggtaaaagtgccaaggaaagttacccgctgaatggttatgcgctgaacactggccgtgcagctcaaggaatgcctaccagagtaacccctgctagaattgcttgtctagatttcaaccttcagaagacgaaaatgcaaatgggtgttcaagtccttgtatccgatccaagggaacttgagaagatccgtgagagagaatctgacataacaaaggagcgaattcagaaagttctcaaggctggtgctaatgttgtatttaccaccaagggaattgatgatatgtcattgaagtactttgttgaggctggagcaattgcagtaagacgtgtccgcaaggaggacttgcgccatgttgccaaggctacaggtgcaacaatggtgactacttttgctgacatggagggtgaagaaacatttgatccatcattccttggacatgccagtgaggttgttgaggaaaggatttctgatgatgaaataattctggtgaaaggcacaaagaatacaagtgcggtctccattatacttagaggagcaaatgacttcatgctagatgagattgaacggtctttgcatgatgcactgtgcattgtgaagagaactttggaatccaatacggtagttgctgggggtggtgctgtagaagctgcattatctgtgtacctggagaatcttgctacaactcttggatccagggaacagctggcgattgctgaatttgcagaatctttgttgatcataccgaaggtcctcgctgttaatgccgcaaaagatgcaactgaccttgttgcacaacttagggcatatcataataaagctcaaacaaatgctgataagcagcacttatcaagcatgggtcttgacctgacaaaaggtgtaatccgcaacaacccttgaacatggcgtgatcgagccagcaatgagcaaagtgaagatcattcagtttgccacagaagcagccattaccattgtgaggatcgacgacatgatcaagctcgacaaggaagagtctggccaagaagagtagccatatgccattttacgatccgtggttgctgtttgttacgcgatggctggttgctataggctcttagactgctggttgtggttttctttttacaacttgtgttagcagacgttcgtatgagtgattgtgtgtgtatcattatgtgtgggtagtaggactcgggagcaaattttgcctggcattgctgatcgtccttccaagtgacattgttgtcgtctatggcctgagcacctgtttcctcggcttcacaggaaacagctccagaaaaaaaaaaaaaaaaaaaaaaaaaaa

SEQ ID NO: 3120 - DNA, 951 bp, Triticum aestivum
  unsure (1)..(951): unsure at all n locations
  Clone ID: PAT_TA_3120
gccaaactattcagcaaatgtcccttatccggcaaacgggaataattatcttcagatggccggtgggggttcacatttaactgcaggccaagtgaagtatggagtatcacaatataaaccacccccacctggtcaccctcctggttatggaaattacactcatccagctggttatacaattagttctcctggtgttattggagctggagttggtgttgatgacgtcaataggatgaagtacaaggataacaacatttatgcaccaaccccacaggtagagacatctgatatctggattcagaatagagagatcccaactttgcagtgtcccccatattacaacttatcaggtcaagccacacctggtgcctatatgccaaatcctgggaatgcatctttcagtgctacagctcaatcctctcacgcacaattcccaggcatgtaccatccgcagcagcctccgtcgatcgtaagtccacatcccatggtgcatcaacaggtcccatctgccattggtcccaatgttggagttggtgtggctgcaccaggtccccaagtgggggcctatcaacaacagcagcttggtcatatgaactggagacagcccaacttttaaagatggtttcttaattatctgtaattaggggggtcacaagagcctttaatgtaacaacaattggctccttttaacaggaaccacctctgttttctagtgcagctctgtctgatctatttaaggtttaacaagtttttgttagcttttccccccgccaatcagaaaccaggaatccgnttctngcccaagtgaaanattacccgttgcntgcaaaaaaaaaaaaaaaaaaaaaaaaaaaaaaaaaaaaaaaaaaaaagccgaaaaaattaaaaaaaaaaagacggctgaacaatagatgctaccttaggtactatttcatagaggagcctaattac

SEQ ID NO: 3121 - DNA, 467 bp, Triticum aestivum
  Clone ID: PAT_TA_3121
gggcctccatggttgctgacgaccagatgccaccatggtctccgatgtcgtcatggcccttgccgccagcccacaacacagtgccgagcagggggtgtggccggcggtggtcattgatatcttcagcagcgtcgggtgttggccacttgcgctggtggctttctcccgcttttggtatgactgattaacagaaaaaaaatcgtggccattggtcaccgcttttcatcaagatgattctgtatcattgtaatagtgagactttactacacccattctgtcggtagaacattctcttaggagattgttttatttgttttggttgagatatactaaaggctgtgtacctatggaaagaaaaaatacactttcaagttttgtatgtagtacttgatgtatgtctcaagtataacttataatgatccaaaaaaacgagacgatatactggccgcccactaagaacaacaagc

SEQ ID NO: 3122 - DNA, 506 bp, Triticum aestivum
  Clone ID: PAT_TA_3122
cttaccgccggactcgcaatcgttccggctaatccacatcgccgaacagctccagcccaaaccctagcccagcacatggaccacgacgccgccgctgcttccccgtctgcatcgccctcctcctccggtgcctccccctcgccgcgctccaagcgtcgccgcaccgaccgctatgcgctcggcttcgagttcgctccacgctctgcgccctcagctccggccccgcgcacgacgcctgagtggacggaggagtccaccttcgcgctcctcgacgcctggggcgaacgcttcgcctgcgacggccgccgcagcctcagcgccgacgagtggctcgaggtttcccgcatcgtagccgccgccgcctcccgccccgcgggatacttctccgagtcgcagtgccgcaaccgcatcgacaccctcaggaagatgtttcggaaggagaaggagaggtcccgcctggctgcccaccgctccagcaaccccgcgccctccaaatgggtatactt

SEQ ID NO: 3123 - DNA, 758 bp, Triticum aestivum
  Clone ID: PAT_TA_3123
ttctttttgtgagtgactgagtgagctagtctttcttcttctgaaaccatgtgcgagtccgcctccctactagctgcagccggaaaccaagatggccaccaccaaggggaaatcaagacagccgagatggacacgagtggcctgctggacccttcctcggcagccctcggcccgagccctcttcccacgccgcctccaccgctcgtgttctacgaagacgattaccggtactactacgacgacgacagttgcttccaggagaaccaggagggcgacgacgacgcctatcaactcctcgaggacgaggaggaggacgtcgccgccaccgggtcgcttgctgccaggctacgtgagctcgtccgccagaagctggccgaggtgaacgcctccagcgcggtcgtcgcggggctcggcctcgtcgggagcgccgtcggcgcctacttcctctggcccgcggccgcggccaccgccaccgccgccaccatggcagcaccccggggccgccggtttcctcatctcccgtgcggcgtttgcggccaagccgaagctctacttccagatcctccgcactgccggagcggcagcggctgccgccgctttcgccctgtagctgcacgggagggcaggccacgcacccactgcttagtttcgtctcgcgcgcgccgttcgtgtgttggccgtttgcgttgcttatatatcgccaataatggagcagtcagtttgtcttgaaaaaaaaaaaaaaaaaaaaaaaaaaaaaa

SEQ ID NO: 3124 - DNA, 876 bp, Triticum aestivum
  unsure (1)..(876): unsure at all n locations
  Clone ID: PAT_TA_3124
cagncaagagaagtgtnatccctttcanaancaaccctactaaagggaacaaaagctggagctccaccgcggtggcggccgctctagaactagtggatcnttngggctgcaggaattcggcacgagcccaaccccatctcccttatctctgcgccagtggcgcccagcggcgcagcgcaacctgcgcaaccagtggtcgcgcctgcttgccgccaagacccagtggctggacgccgccgccagcggccgctcccatgctgccacactcgtcaacgcctacctctcccgcagttacatgccagggatggatttgggggtgctcaaggacatgcccaggatccgcgacagggcgagcgccaaattggcccacaaggaggtgcaatgcccgcgagatgcttctatcagcctacaaggagatggtctgtgccatgtccgacttggttaaagcttctcatgccatgcggtgtttctccaaagtatcttctggtagcccactagtccgatttactgatcgccaggatgatttgaatgatttaggggatggtggaggagctccagtacacagatgggtctccatgttagaatttgaaaacctcgccaaagagcttgttgagatttttggtttcagaactacaaattggaaaagagtttttggccctgggggtctggatgacagctttccccactacctggagaaattggaaagggctggggggcctttccacgcccgggaattcancgaatttcanaagattggcctggggtctggagacaacttcccactacctgagaantggaaggctgatgtcttacaagnaacgngactggacatacccaacccaagaaggnttncaaaggttatttaccccctngggt

SEQ ID NO: 3125 - DNA, 442 bp, Triticum aestivum
  unsure (1)..(442): unsure at all n locations
  Clone ID: PAT_TA_3125
acgagagcaaagcattcccaacgaagaacaagaatcctctctcactcactcctcagtcggtgcttccacacagacagcgatggagccgagcatggcgccgcggaggctgtggcacgtggtgcgcgccgtgctgttcatgctccgcaagggcatgtccaagcggaagctgtccatggacctccagctcctcctccaccgcggcaagatcgccggcaaggccctcagcaggctcatgagcgcccacggccaccacgaccaggccgcctccaggtcagccgcggaggcacctccgccggcgtcgtggtcgcgtcgcaccctcgaccccgcgctcgccgtctatggtccgcgcggcgccggtcgacaggtggagttcagctgcagcaacaccccgtcctacccgaccgtncaactcattctcgccaagcgccgtcgtgcgaacaac

SEQ ID NO: 3126 - DNA, 1456 bp, Triticum aestivum
  Clone ID: PAT_TA_3126
cttctgaacagaaaaaaaaaatctcctctctgagcgctgactcatcctctgtctctcacacccggggaagagaggaacggccgaagggagatgggcggctacgagaacggtgactcgccggcggccgccgcctgggagggcggcgtgatcctgggcgtggacggaggcaccaccagcaccgtctgcgtctgcctgccggccgcaatgccaccaccggaggcgcccggctccgtcgccgtgctctcccgcgccatcgccggctgctccaaccgtaattccgtcggagaaaacgctgcactggaaactctagaacaggtcatgatgcaggccctcacaatggccaacacagatcgttctgctgttgttgcagtttgcttatctgtatctggggtgaaccatccttcagatcagcagaggatgctggactggatctgcaacctattccctcgcaatgccaagttttatgtggaaaatgatgcggtggcggctttagccagtggtacaatgggaaagctacatggctgtgtattgattgctggcacaggaagcattgcttatggggtcaccgaagatggaaaagtagcgagagcagctggtgccggtcctgtcttaggcgactggggtagtggctatggcattgctgcacaggccctcacagcagtaataaaagcacatgatggccgtggaccacaaactaatcttacaagagatatcattaggaagcttgaaatttcttcaccagatgagttgattgggtgggcatatccggatccatcttgggcccgtatcgcagccctggtacctgttgtggtatctgctgctgaagatggtgacaaagtagcaaacacgatactgcatgatgcagtgcaagagttggctgaaagcgttgtagctgttgttcggcgccttacattgtgtggtgaagatgggaaagaccaatttccacttgtattggttggaggtgtccttgaaggaaataagaaatgggacatcagtggtgaggtcataaaatgcatttccaaagtcttcccaggtgtctgtcctattcggcccgaggtggaacctgcaattggtgcggcgttgctagcttggagccatcttcgtaaagagtcaaagctgcaaaatggcagctgattcccagcatcggagaatgatgaatgtaagttggacagccaagttggatggattgcaaaactaacgtgcattcattctgtaaaaagaaaagaaaagcgcattcatcagcgccaattctgctgatgtgtaaagaatgatctgtcgttatagtgtgcgttgggaggatattatgtgattgtacaattatgatgtaagttgtaggcaaagaaacgaccactggatcttgattcttaaaaaaaaaaatccctggttctgacctgtactttctttatccttgtaccggccagtgtatcatggatatagccgcccattctcacaaaaa

SEQ ID NO: 3127 - DNA, 829 bp, Triticum aestivum
  Clone ID: PAT_TA_3127
tcgacccacgcgtccgaccgaatccccaaaccctatcttgccgccccggggagcacgagcccgccgaccatggccgacaaggagaacgcggcccccgccgcggcggcgggcccccggctcacccgtgccgcggccaagcgcgccgccacctgctccgcgggcccctccggcggcgccaagcggaagcgggtggcgctcagcgagctccccatcgtctccaacgcgggggtcgtcctccgccagccctcgaagcccgccaagcccgcggctgcggccgagggggaggagcagcacgggggcttgagcaggtgcgcgtccacctcgccgacccccgtcggggaggaggtcagcggcggcggcggcataacccagctcagcgggtcctacgcctccgacatctacacctacctccgcactatggaggtggaggcgcctcgccggccggcggcagactacatcgaggcggtccagacggacgtgacggccaacatgcgggctatcctaatcgactggctcgtcgaggtcgccgaggagtacaagctcgttgccgacacgctttacctcaccgtctcctatgtcgaccgcttcctctctgccaacccgctcgggcgcaataggctgcagctccttggcgtcgccgcaatgctcattgcttcgaagtacgaggagatcagtcccccgcatgtggaggacttctgctacatcacggacaatacctacaccaggcaggagcttctcaccatggagagcgacatactcaagctcctcaacttcgagataggcagtccgaccatcaagaccttcctcaggcggttcacaagatctggcc

SEQ ID NO: 3128 - DNA, 660 bp, Triticum aestivum
  Clone ID: PAT_TA_3128
cgaaccaatcccccctcctacatatttagtcagtctttgcaacacaatccctcgccaaccagaacgcaagcatgaggccacaggtgctgctcgccgcgctggccgtcatcgccgtcctcgcagcagctctgcctctcgcccatagccaaggcgcgacgctgtgctgcgacaactgcggctcctgcaccaggtccatcccacctcagtgcacatgcatggacacctcaccaaccgggtgcaacccggcctgcaagacctgctcgaggtccaccgtcggcggccgcaacagcttccagtgcaaggaccgcgtcgccaacttctgcaagacccgctgcactaacgccgcgtgattggacctgttgtcgcccgaataatgccgattagcttgtgcttttcctttattttttgcagtctttaagagttccctctgcatcttgatctggtagatgcagagaagaaatgagggttcgatgcatgctcatcattcctttcttgtgtactgaaataaaagagcatattctttgctcaaaaaaaaaaaaaaaaaaaaaaaaaaaaccccgtcgcacagacaatgacgcattaatggtaaaaccgcgttctactaacacctgagaatcccttccaacggggttatacaaaagcgccgttaaaaaaaaaaaa

SEQ ID NO: 3129 - DNA, 915 bp, Triticum aestivum
  unsure (1)..(915): unsure at all n locations
  Clone ID: PAT_TA_3129
cttcctcctctccgngcgaggcagcggcgagcagagcagaccggaacagcacaacaccggctctacgnncaaggcgnccacctccctccaaggctgcgcaatcctcgtaagccgcgccagtctcctcctatgctttagtttctctctcgcttcgctggccttaattgtgcttggttcctgactgtccctccccgcggcggcaggctcttctctgacgagcgcgggatcgagcttcctctgacccaagcaacgactccgtccgggagcttcctctgtccagtgaccagttcgtggcttcgccggcgatggaggcctactcgagggacctgctgcgcggcgtcggcgggggaggcgagaccggtcgcggcgaggagaagccgcggcgcctggattcgcaggccgaggaggtcgagcttagcctcggcctgtcgctcggggggcgattcgggcaggaaaggaggaggggcaaggggctcgccaggtcctcgtccgtcgcctgcatccagcaggtggcgccggcgccgcccgcgctccccaggacaagctccctgccgcctatggcggaggcgaaggcggggaacaacgccgcttcgcctaggagcggcgctgaggtccaaccgcaggggagtggtgtcgctctgaacggcgtcgtggtagagcccgcagctttgccacgggcgaggttgagccccccgtccacaggctcgtcgggcggcgtagggaagctgcgggcgagcgtgagccccccgtccacaggctcgtcggacggcgaaggtacgtctttttcttttctgtcttatgtttcaatgtgacggtactaattttgtattagtcatgtggtagtattttattagctcaattaattctcaagctcagcaatgtggtagtattagtaccttcatacatctcatttcc

SEQ ID NO: 3130 - DNA, 1236 bp, Triticum aestivum
  Clone ID: PAT_TA_3130
aattatttttgttgcgagggcgcgtctccttcctcctctccgtgcgaggcagcggcgacggcgagcggaccggaacagcacatcgccggctctacaccactggcgtccacctccctcctcggctgcgcagttctcgctcttctctgacgagcgcgggagcttcctctgacccgagcaacgacaccgtgcgggagcttcctctgtccagtgactagctcctggcttcgccggcgatggaggcctactcgagggacctgctgcgcggcgtcggccggggaggcgaggccggtcgcggcgaggagaagccggggcgcctggattcgcagaccgaggaggtcgagcttagcctcggcctgtcgctcgggggccgattcgggcaggagaggaggaggggcgaggggctcgccaggtcctcgtccgtcgcctgcatccagcaggtgacgccggcgccgcccgcgctccccaggacacactccctgccgcctatggcggaggcggaggcggggaacaccgccgcttcccgtaggagcggcgctgaggtccaagcggcagcggagtggtgcccctctgaacggcgccgtggtgcggcccgcagctttgccccgggcgagcttgagccccccgtccgcaggctcgtcggacggcgacggcaacctgacggcgagcttgagtcgccctgctggcatctcgtatgggtgcgagaagaggaagctagcagaaactctgatccctgctggcatgaagaggaggattgagaggatgaactcttccaacgtttctgtaggggaagttggagagaacgcagatgagatgagtgagcaggcaggaggaaagcaaaaagcacagagaatgaaccatagcaatgtgaggcgtcgcttgagtgggcttcctccaccgtatcagcctccagctgcatcacaaggtccgaaaaggaattccgctttgaaaggaactcctggcgctctagagcggagcctgtcatcggctgttctgccctcgtctgagggtgcaaacagcggcgccgtgacaaccccttcatcttcagcattggcggtgagagcagcagcccctggcatctccacaggggagcagcgggatggttcagaaaggccggcggcgagagctactaggaccagggagcgtggcagacatggtgcggaagatgccagtggtgtacaccagcgggctccccaacggcgagaggatcgacggcttcctgtaccagtacagcagagc

SEQ ID NO: 3131 - DNA, 444 bp, Triticum aestivum
  Clone ID: PAT_TA_3131
tttcccgttctggctggatggtggccggagctcgcggaggactcgagatatgcatgtggcggcaccgagcatgaggcaacaactgcattacttgcggggaaggcgcaagtaggacacctgcattacttgcaaacaaggcgcaagtaagacactgaaatgtagtataattcttcatctcaatatgtataaccttaacgggtctgatcgtgacaccaagctattgttccacgactgaccattttcggcatgtattactgagtgttaacgagaatctcgttggactaatttttgtttgggggtgtatgtggcgctagagttcaccttggtggagcctctccttcacccttgcatgtaaccaatggtttttatacgtttccatcatagatccatgctttctgaatcctggacattgttgtacttgtggaagtactccctccgtaaact

SEQ ID NO: 3132 - DNA, 1531 bp, Triticum aestivum
  Clone ID: PAT_TA_3132
ctcgcacgcacgcacccaacaacccccgttctggctggatggtggccggagctcgcggaggactccgggcatgcatgtggcggcaccgagcatgaggcaacaactgcattacttgcggggaaggcgcaagtacgacacctgcattacttgcaaacaaggcgcaaaattaatagaacatcaccatacttgtggctttctggctggtcgtgccgtcaccctattggtccccctctcgccatttgcgcaatctatcactcaagcttgacgcctctcttggtcgacccaatcttgaaaaacataaagttctgttagtttccctaaactttaaaacatgttctacaaaattgatctagaaatgattggcttactgtgctaatttaaagcaatataattactcgacaactgcatatgcacatgttagaagcaaggcagtagaatacttatgttttcatctgctggcaggtagcaacacgtatagatatatcactctgaattgagttatggaccaaacattaagaactgcccactttgttggcacatcccatctgtgaaattgcatataaatttatgtacagccagtgctctcagggtatggattcaaatattttggtgaaaacagaattgctgctgtaataattttagaaatattatgcacacggaggatttttagtgtgatggtgcggctgcacacctataagcctccacccttccccttaccctctcttctaaccatttaatttaagtaatcccaactagttcaagccttactgtacatcaacatggcctcatcctgtatttgcatgattcctctggaagaaagacaacgtaactttcatttcaagtcatatcctctcagtcttaggcagctactatttatgaacttggaagctggcgcagcaggtatgggaggtaagatacttgacagattctgaggttcagtaatgtgttgtgcgctaattttggttgtccacctgtgctacaggatcttcacagagtagcagggtgtagcagaatcagtggagctcttagacgggagcagctgcgtcaaatgctatggtcccaactttgactttattttcgaacaagaggtggggcggcggctgttctttgatcccgagccgctgaagtgtggcttcaggaggaagggcgcaacggcgcaacggagtgtcagtcttctagttattgcagttacatgcacatgcacatgcccgagtaccaactaccgacggacatgtcttcagtcttgagtaacaagcatgttattccgaagctgcccggcactcctgtactaatagaaatctgtttatatttctgtccacgacttcaccagcaaggtgcaatttagaaggaaaaattgagagcttgccaaacttaggtatgtccgatagtcttatctcagccgtctgtaagacttgctagttaggaaagaagaaaagagagcaatagtctttctgtagttgtatgcacactctctacgattctatagacaaattgcctgaaaaaaataaaaaaaaaaaaaaaaaaaaaaaaa

SEQ ID NO: 3133 - DNA, 456 bp, Triticum aestivum
  Clone ID: PAT_TA_3133
tttcgcgagcgccgccctttttttttttttttaaccaaaaaataccaagaaatttcaagaaaaaaataaggagggaaacaaacaggctgatgcaattcgcattcccgttccctctctgctttacggccacataaataataacactactactagtactacttgagaactctgcttcttcttctttatcctacgctgatgttgtacagcagccccatcggagcaagccaatcgggctagagactagctcaatcgagcggctcgatcagtagctccagagcgggacctcgccggcgccgtacccaccgctgtcgttgcagtcgtcgtcggctccgtccatgtgcgagccgctctgccagtcgccgccggcggcgctcatcccgtcgtagtagtaggaatcctggtccaagtccccaatgccgccgtacccgtactgcatcgggtagtcgtcgtagtgca

SEQ ID NO: 3134 - DNA, 1208 bp, Triticum aestivum
  unsure (1)..(1208): unsure at all n locations
  Clone ID: PAT_TA_3134
gggtcgttttacncccngggaagggtttcncggcatacggnggacagtgtttnncacgtnagcttnacgntgccccgnttttagcgtcncatnttgggcctgtgggttctcggcccccccggggttagttctgttttttaataaagcagagttcgtctcttattactctactcccaacacatgttacaaaatttccagccaacaaaagaattatcaaaaaatgaaaaaaaataaggagggaaacaggctgatgcaatttgcattcccgttctctctctgctttacgaacacataaatactactactactacttcagaactgaagctcccgactaactctgcttcttcttctttatcctacgctgatgttgtacagcagccccatcggagcaagccaatcgagatgaagaatggcccaatcgagaagctcgatcagtagctccaaagtgggacctcgccggcgccgtacccaccgccgcagtttgagtcgtcgtcggctccgtccatgtgcgagctgctctgccagtcgccgccgccggcgctcaacccgtcgtagtagtacgaatgctggtcgaagtccccaatgccgccgtactgcatcgggtagtcgtcatactccaccgccgagggctcttgcatcatcgccatcatcgcgggcgccggcgcggacgcctcggcggccacgggcgcggcggggcaggcggtctcggcgagcgcgatggcggcggcgcggatgtcgtcgggggtgcggagcgtggcggggtcgacggcgagcagcgtggccgagtcggcgaagttgaggcaggcggcgcggccgcgcagggccagcgcggcgacgtcgtgggcgcgggcggcggcctcggggctggcgaaggtgccgagccagatgcgggacttcttgttgggctcgcgcacctcgcagacccaccgcccggccgcgccgcgccggcgcacgccgcggtacaccgggtggcgcgtctcccggaacttggtccgccccgccggccgcttgggcggcgccgacgtcaccgtcgcgtacccgccctggccggcctggtcgccgtcgccgccgccgtagctgtactggtccatggtgttgcacgaggtggtgtctagccggtgccgatgggtcgatctgctctgcagcgcggcaatggtggtgactggtgagtgaggtgatgttggttgggtgtttgtgcctcgtgccga

SEQ ID NO: 3135 - DNA, 1165 bp, Triticum aestivum
  Clone ID: PAT_TA_3135
acaatacactctttcctaagtttttgtcccacaccattccatggccacttttgaggtcactcgtagctttggtgcatccgtcgacaacaccaagattaagttcagtaagttgtatctgcggcagatctgggaagggccaaacacgaatcagacaggccctctagtatcaggagatcctgccttacagttcggcctgtctggtgttaacagttggggaatatatgatgatctcggctcagaggcgaagctggttgcgaaggcacaaggctggcacacagcaatccaccccaactggtactcttggttctccatgacattcttcgagggtgaaagatttaaagggtccactcttcaggtaatgggagcatcaagatcggcaaatgatggtgagtttgctattattggtgggacaggtgacttcgcaatggcacgtggtatcctaacgaaacgactagttgtggacgtagctggtagtaaaatatcgagcttacgtggatggattttgccacatgaacattccggtccctgcacctacgaagatgggaccgtggggtgcaaaggatgccccccttcgtgaaatggacaaaaaatcccaacgtatactgtagtgtcacaatatactttacagcgtagtaagtgcgattcagttttcctacattggtgaagacgggcaaatctgcaactctggtctttggggtactactggatgtactaattcaccctctactattgaaacattaagttttgcccaaatgaagtttgtgaagcagataactgggacagttggtgacccagactatttgtctcaccttaagattgtcacaaacattaaaacgtatggtccttttgggccacaggacggcaagtctccgttcagctttaccgtgccggaaggaaagaccgttgttggcttctttgcgcagtgtgacgattatatccgtaaaattgggtgtttacaccatctaaactggccgccgcgcgtgctgtttatggccgtctgtttgattttcttcaatttcccttcttccagtaataagctggcaagctaaggtgtccccctatttatgcccttccgcgttctttcataattcagtcatgtaccgtccgttgggttgttgtaatgttcaataaatcctctgagattgttttgtttaaaaaaaaaaaa

SEQ ID NO: 3136 - DNA, 1437 bp, Triticum aestivum
  unsure (1)..(1437): unsure at all n locations
  Clone ID: PAT_TA_3136
acttcgaggctctccaaaggccctggctccttatcttgacaaggcaatcagctatatcctacacacaatggatccaagcaatttaataatgcgtaaagcttgcattatcagctcaatgatggctctaagagaaattgcccgtgtatttccaatggttgctctcaatgaatcaatgacaagattagctgttggtgatgctattggagagattcacagtgccacaattcgtgtttatgacatagaaagtgtcacaaanataagaattctcgatgcatgtggaccaccaggtcttccaagctttctcaaaggaccatcggatacaacaacaaccatgctgattgcagcggcgagggtctcgccagttggactgggccgtgtcgcttgctcggagttcggtcgcttgcccagtcggtggtctcttgcttctgccgggtcggcgtcgcttcgcagaagccttactcctattcagtgcacaacacttatctatgttcctccatggggaaggattttcacccaactcagctcgcctaagtattagctcttacatctggcacgaggataaacatcaaaattcagagagcaagacgagggaactagatgaggctgataatctaaaactgctgttacataatcttgacctttcttaccgccttcattgggttggtggaaagaccattaaacttacaaggcatgatcaggacctgggtacatttcagttgtgattaaaagatgagttatggtttgttgatagcttatggatctggttgggttgccttgggagttttagtaggcagatgtactgaagtctgacgagggtggcccaaagtaaagcgaagccaccaagtgacagtcatatatcatcaccaacaggattgttgattacaatattacatggaggtctctggaaggagcagttctgtttcaccatcaggctacaaatgcagcatgctttctgattgacagatcaagtagtggcaacctaagtatcgttggtgggaactgtcgagagtcaggagcttctctccgttaactatcagctgacggcttgaagatttgaaggatatcagactctggtattaacttgcttgagttgcaggcacacatctttcttcattctgctgcttgtcatcagcgctgtactaccatcacagatacctaccacctgaagagttggacttgtagtgttgagatgacaggcaccaaactagcaatacttttataattgaatatatagataaatcctgattccctggcaaggcatgttttcccgcttatgtaagggaatgtacaactgagattgatatgaagtgttagaatttgcctgacaaacacgttgtaaagtgtaaaatgtaaatgtttgttcttgtataagaagttcgttttggcattttacgcccatgtaagaactattcattttggacttacgtaatggtttta

SEQ ID NO: 3137 - DNA, 858 bp, Triticum aestivum
  Clone ID: PAT_TA_3137
gtgaatcacagattcaagtatagtggtcttctctttgggagccaacaatcctagcaatggctgacgctagacttgccctagcctccctctttgtctccattctgatgctttccatggcccatcccttctttgcatgtcccactcgttgtgaaagtgagataaaaatgcagatgtatttgcaccaggtggtgtccggaccaacccataaccaagaagttgtgtttaagtctactcccactatagagtttggtaggacggttgcttttgattatactctacttgatgcacctacaccggacgccaaaattattggtcgtgccaaaggaacccatgtccaggctgaccaggtcaatgctggagatttctcccatttcagtatgatattccagcagggacggtttactggttcaacatttcaagttatggggatgactcctccaaatggagtttgggcaattgttggcgggaccaatgaactagcgatggcacaaggtatcatccagtttgcaatagtcaaagggactccaaacgtggagagctatagagaacttaatattactgccttcattccaacagttagcattgcaactggtagcttcgtccaatactttgacatttaaaccgtttcaatgcacaaaacgttatcttgtaactatgtgataagttatgtcatggattcggtgaagttttatatctgaaataacacatggacgtaaagcatataggatactatagtattcatatgctccatgttagttgttctgtgtaagacatgtattgcactctattgtacatttaattcagctcgtatcttaaatatatgtgaagaccataaagattgtttgaaaaaaaaaaaaa

SEQ ID NO: 3138 - DNA, 586 bp, Triticum aestivum
  unsure (1)..(586): unsure at all n locations
  Clone ID: PAT_TA_3138
tcgtttcaacgtccatcctggcgaggatcccctctcctcccaccagcatgcggcccgtcgccacgggcttccccgtgcatccctcgcggcagtcctcctctcttctcgcctttactgcgagcagtgcagtgcagtcctcggcgtcggaagaacggcggcctactccggcggcatgggatgcaatacttgggcacgcgatgtgcggtccgcagttgcggttcgtcggacgtttgtgtgtggctcgcactaaccagcaaggtgatgaagactaccctgggtcaacgctattctgcctcctctgtcgcgtgcagtttgctgcctgctgcaccgtcggagattgcctcgcagtccatatttcaagcccgtgcagcttacagactacctatgtgcggtggtacaaaagccagcgagaaagctccaaacgatgggcataaatgcatggcgcaccaccctacgcctgatcgacttgaatcaantgcggcatcgttcggctcgctaaccggcttggcccgcccctttgcctgacccatgggcaacgcgtacccactcccttaaggtcaaattnaaaaagaaactggtacacann

SEQ ID NO: 3139 - DNA, 435 bp, Triticum aestivum
  Clone ID: PAT_TA_3139
gcgcggcggcgttcctggactccggcagggtgatggccgccggcagccggagggatcgtcggatgttcgcgtccatcagcaacctcgccgagctaaggtccgcggcggcagcggcggccatggatgattactacgagttcgaccacttcgatgacggaagacagtacggtggcctagagcatgccatgaagcacaagaagaggaggtccgtcctacgcaagttcggagacttgtttaggaggagaagcctgctgcacaagtcagacgactttgctccggttctagctagtaggtagtactccctctctgtaccataatatttgtggggagtactaaatatttgtgtgattcttgcattgtgtgtttgctggataagaatactatgaaatacacgcagaataaattgagccctgcttgggtaccaaaaaaaaaaaa

SEQ ID NO: 3140 - DNA, 386 bp, Triticum aestivum
  unsure (1)..(386): unsure at all n locations
  Clone ID: PAT_TA_3140
tttggaattggttctatgcccntatctttctataaaatatgatatgctctctcgtggttgggggaaaaaaggacaccggatttataaaaattaataaaacctcaacaccagaaaacgcaacagacacgggaatgtacagtgcctagcctacaccaagcccgttacagagcccagctgtaagcctgcgacgacctcacgctaagcaaaagtcacgatggccgtggggatgcaggggccgccgtcgaggtcaagcacgacccgttgcgcagccggctcggcatgggccggaagctccacctcctcagcgccgcgccgcgcgcgcccgtggccggcggcgaaagcgcccgccgcaccagctcccggttccccgccggcgcccggccagc

SEQ ID NO: 3141 - DNA, 626 bp, Triticum aestivum
  Clone ID: PAT_TA_3141
ccgaggttagttacgcagcagccaaaaagctagctaaacatagcccttcggcatgggttccaacaagaagcgcagcaggagtgctgcggctccctggtgtgtagtcctaggcatactcctgcttgtcgtcggggcggtggccaaggaccttggcaacatcttccaggactgcgaatttgattgccaagattttgatccatcctccgactcctacttcatgtgcatggctgtgtgcgtattcggcaatggcgccgttcatctggcgaccgatgggggcacagaaagagaagaccgcaagatgaagcgagaagctggcgaagacgacccattctcctgcgaagaccattgccgtgaggtatttgagccagattctgccaaattcaggaagtgcatgcgtatctgtcaggcttaacattactagctatagtttgttgttccattttgcttatcttggcaccccttctatttcacgtgtacaagccttcccttcagcatcttgtgtgtgtgtgtgtgtgtgtggatctttaggatcgtcggggcaggcatgtatcttttccctttggaaataaaaaagttgcaataatttgcggcacaaaaaaaaaaaaaaaaaaaaactcgaacctcgg

SEQ ID NO: 3142 - DNA, 745 bp, Triticum aestivum
  Clone ID: PAT_TA_3142
ctcattaattgtgagaaccaagccaatgaaaatgggcatgaatcggtcttgtcaaaagtctactattcagggcttgcatatgtcagattgctgatgttcacaaaactgcatgtaccttttgccaacaaaattgtcgatgaattgcagatttagaaaattagtttggcatagctcaaaactatttgccttgactcaaatcaaggttgttcgatatcatgaaataagcaacatgcctcttgtgaaaccatattttaaatttgcaatttgcaaactgggtttttgtttctcgcactttttcttttaaaacatcaccagaacttagggtcacaattaatagtaaggtgcaatctcagtcatttagtgacatacttcagttcagactttgcagagccagagttgtttattaatactttccgttacattgcccgcatctgtatacataagttcttatgtttttagaacactctagctaggcttaactatttctgttgacaaatcacattcttatcttaaaatacatcgatgattactggagttccagagaaacattctttttattgtttccagagatcaagatatcgcgaaccattcatgggattcaaagggatgtgcaacatatgtggtgccttattcaagctaagccgggttattgaagcgccatattagtgtttcttattatctaccttgatgccatactaatttctgtgattccaaaattgctggcaccacttcctattgcctgttg

SEQ ID NO: 3143 - DNA, 1743 bp, Triticum aestivum
  unsure (1)..(1743): unsure at all n locations
  Clone ID: PAT_TA_3143
gaatccaccccgcttcccctgctttcctgcctcgcctccctaattttagcagcatgcggggggacgaccgatccatgggggccgctgattaaatgaggccagcagatcgcggtgcgccccccgtctccgtcttcgtcgccgcccccgtctccgtctccgtttttgtcttcgtctcctccttcgtcgccgccgtcgtcgtcgtcgtctcccccgaggttgcattcagcttccgatgattgccgtgttccccaggaagagagagtacttggggcactctcctatgcttctccgagacttgctcatttctttccttgccaatgaaacaagacagtcgcatggcgggaaactcggtgaatctgcctcatgcaactagaagaagaagtactttggcttttaagttcctgatacccttcgttctagttctttcagtttctgttattgctgtcacccagtacttccaaagtatctcctactttctgcggccgctgtgggacacaccaccaaagcccttcacccgtatcccgcactactatgccccttatatgtccatgcaccagctgtgtcagctccatggctggggcatcctctcctcccctcgccgtgtctttgatgctgttctcttcagcaatgagctcgatgttctggaaatccgctaccatgagctctttccatattttgaccgcgtcccccgcctccgggcgaatgctaccttcactggcatcccaaagtcactcaccttctttgaaaacctcaaccggcccgcatttgctagctcaaagattgtctatgacatgcttcccattggagagttggatcctgattctcgccgaatgcccttccttgtagaagctggtcaccgccgtgcacttaacaacctgctaaaaagatcaggcattgctgtgggggatgtcttgatcatggctgatgccgatgagatccccagtcctgaaaccgtgcagttgctgaagtggtgtgatggaataccgccaatcatgcatctcgagctaaaaaactatatgtactcctttgaatatcatgtggatcaaaacagctggagaacgacagcgcatgtgttcaccgagcggaccaagtatcaacactcccgccagaccgacctgatgctggccgacgcgggctggcactgcagcttctgcttcagggagatcaaggagtttgctttcaagatgaaggcatacagccatgcagaccgggtgaaacatgacattttcctgaacccggacaggatccagagagtcatatgcaatggggataacatttttgacatgctgcctgaggagtacacgtttagtgatctcttcaagaagatggggcctataccgaggtcagcgtccgctgttcatcttccatcctatttgatcaggaacgcggacagctacaggttcttacttcccggtgggtgcttgagaccgggctaaatcagaagtgtcttgtaacttgttagccaacagtattacttttagatgcaatgttgttgttactgtggaaataggtgtctttgtttgatgtggagcagtaatagttttagataggatggtagaaactttctgtctgtgtgtgtgtgtgtgttcaaggaaccatgtgaacttcagcttagaattcacactaaggtgatacaaaggtaaaatagcgacagggatcgccgcccttttgggttcatcctgatgagcaggaagcacatcnaatgatgtaatttgttcttgatctaaaaaaaaaaaaaaaaaa

SEQ ID NO: 3144 - DNA, 752 bp, Triticum aestivum
  Clone ID: PAT_TA_3144
atctcggtgatgtgtatgtttttcatatttatgtatttgtagtgcagtatgcccgccgccagcggggaaaccccgaaagacgggggctcctggtggccaaggtcgatgccaaggaccgtgtggccatccggcggcttggacccaatggagtttatgggtgcacgatacagtatggctacgctgacccgctcgactctgaggaggatgaactcaccggcctggtggtgggcgccctgcgggactacatcaccgaggaggaggaggaggtggctctgcttgaggaggcgagggaggctggggtggtgcacgtcaggggcaagatgaggttccacatcggcaaagacacgggcttcttcgaccgtattctgcttggcttctacgagttcctgcacagcacgtgccggtccgcgctgccagctctcgggatccccctgcagcagcgcgtcttgatcggcatgctctccaaggcctgacgctacgcttgcacacacttgcatatgtatgacgcagtgcgtgctaataaatcgttctggttttcggttgtttcagctacctgtagtagccacgcaatggcgtttgtaagtaaacctcagtatgaaggttgccatggaataaagcatgtatacatgctgcggaaggtaagcttttgcaacataacttaagagtgtcggttactctgtctcctttcagctcaaaatattgcttccaaatttcttcgccaccccaatcatggcatttgtttctgatatact

SEQ ID NO: 3145 - DNA, 581 bp, Triticum aestivum
  Clone ID: PAT_TA_3145
aggccgccatgcatggtttacctgtaattgcaacaaaaaatggagctcctgttgaaattcaccaggtgttggacaacggcctgcttgttgatccccacgatcagcatgcaattgcagatgcactctataagcttctttctgacaagcaactctggtcaagatgtagagaaaatgggctgaaaaatatacaccggttttcttggcctgaacattgcaagaattacttgtcgaggatattaactcttagcccaagataccctgcttttccgggcaatgaagaccagattaaggcacctatcaagggaaggaagtgtatcatcgttattgctgtagactctgccagcaagaaagatctggtctgtatcataaaaaattctattgaggctacacggaaagaaacgttgtcaggttcaacaggttttgtgttgtcgacttccctgacaatgtcagagatacattccctattaatatctgcaggcatggctcctacagattttgatgctttcatatgcaatagtgggagtgatttattttacccttcgcgggctggtgattcaccaagcacttcccgtgtgacattt

SEQ ID NO: 3146 - DNA, 772 bp, Triticum aestivum
  Clone ID: PAT_TA_3146
gagcgcggcgcggacggcggggcggcctgcccgctgccggtgtgggggcgcgcccgcgccggccacgagagtgcagtggggacccgtgagggcgggcggggccccgggctgggggggacaggcgccccggggggttcctgtgcgacgcatacctcgcggggcgggtcgcccgcggccggcacgtcactcatcccccggccactgggaggacgcccgggacgggccggtgccgtccaggaactcattgtcgtccgttagccatgcgatcctcgccgccctgatggtcagaatccggaccttcctcagaccaagccacacatggatgcccgaagcccccatgggccgtcaggccaaacactattgttgttaacggcctctgatctgagaaacgctagttccccttaccattatcccggcatacctcaatgacattgcattatatacactggagcccggttgattcatggacgatcatatcggcaggtattgctgggacgttaaatccggtcgatcgggtaacaagcactctcgatctcgtaatccgcataaaaatcaatgtgatgtgtcttccttctgtgaatgtacgggttagagttgattctagctccatggttcctggttgttgatcagtagtggaacatgtgtcatgcaaactatatgttgtacttatcttcaatatttctattagtatattagccagaaatttttgcaaaatatttttccaaacggtcaaaatgagggcgagctgcacggggggtgggatgaaaaaaaa

SEQ ID NO: 3147 - DNA, 791 bp, Triticum aestivum
  unsure (1)..(791): unsure at all n locations
  Clone ID: PAT_TA_3147
cccacgcgtccgcggacgcgtggggatcttgcatcgtttgtgcggcagtcaaattgccgaacaggtcatccgaagtatggagtcctgaaagtaagaaaaaattaaaaaaagaatccggcagccgctcgcgatctagaacatcttgctcaattgctgttgatgctgcagcagatcgtcatcctggagtcgagcagtatgcaatcagggcatttgctgatgctttggatgccattccactagctttagctgaaaacagtggtttgccgcctattgatactctcactgtcgtaaaatcccaacatgtcaaggagaacaattcccgctgtggcattgattgcaatgatgttggtaccaacgacatgaaagaacagaatgttttcgagactctgatcggcaagcagcaacagatcttgctggcaacacaggtggtcaagatgatcctcaagattgatgatgtcataacgccttctgagtattgatgacgccttcaagaacggaaatcgactgtgctaagtggcatgcgctccattagtcagcatattttatatgggttgattttgatttgctcctagaattcttacatggagtggtcacttgttttgtttgatgagctatctagttttgtgacgtgcgttcacactttgtagagcttgagacagtagcacaagtcatgtcgataccagtccattcgttgtgttgttcagatgcttaatgtatggttttggaccactaatttgtctgctttatcgtaattgttttattttnnnnnnnnnnnnnnnnnnnnnnnnnnn

SEQ ID NO: 3148 - DNA, 2133 bp, Triticum aestivum
  Clone ID: PAT_TA_3148
cgtccgcggacgcgtgggcgcaagagattgccaaactgccgtccggcggcgcctcctccctccccccagaaacataccgccgcctcattccctcccaccacagcacccctcctcgtcctcgtccgatccgcccttccggaagcacctgggaggggcagcgccagcgctccggccgccatggcgctcgccttcgacgagtacggccggcccttcatcatcctccgggagcaggagaagaagtcgcgcctgcaggggctcgacgcgcagaaggccaacatcgccgccggcaagtccgtcgcgcgcatcctccgcacgtccctcgggcccaagggcatggacaagatgctccaatcccccgacggcgacgtcaccatcaccaacgatggggcgacgatcctggagctgatggatgttgacaaccagattgcgaagctcatggtggagttgtcccgcagtcaagactatgacattggagatggtaccaccggggttgtggtcctggctgggtcgctcctggagcaggctgagaagctgctggaacgtggtattcacccaataaggattgccgaaggttatgagatggcgtcgaggatagctgttgatcaccttgaaagcatctccacgaaatatgagttcagtgctacagacatagagcctttggtgcagacctgcatgacaactttgtcctcatagattgttagtccgttgcaagccggtctctaccggagatggctgggcaaaggaagttccttgcgggtactgaattggggtggaaggatatattggtgggctagatcgaggatactgagctagtacaaggaatcattgttgacaaagatatgagccacccccaaatgccaaagagaattgaggatgctcacattgccattctgacctgcccatttgagcccccgaagcctaagacaaagcataaggttgacattgacactgtagagaagctccagactctgcgtggccatgagcagaaatacttcgatgtcagggttcaaaaacgcaaggatgttggtgcaaccctagttatttgccaatgggtgggtgatgatgatgccaatcacttactttggcattgggagcggcgggatgtcagttcgcatgctgggggagctgccgactgaaatgccagtgcgagatgagggagtattattaaaagcttttgggacgagaaaagcgacggatgcttgacatcgagaagtgtgcaaagacaagagctgtaactactttcataggcggtagcaacaaaatgatgattgaagaagaccaagcgaagtattcatgatgctctatgtgtggcaaggaatctgaacatcaaaatctcgaattccgtatggtggtggctatgatgcgtaaaatcttgctcaaattgctttatatgctgcaagtagattcgtgatcctgggagtctcagcagacatacattgcagggcatgttgtggatgctttagaatgccagtccaactggttttagcgctgaaacagatctttgccctggattcatagtcgcatccagtcaggacaatcgctacatgttaagagagcattccacccgctttgagatgaaaacagtgtgttgccgcctatagatactctcaagagcagtaaaatctcaagatttcaatgagaacacttctgcatagtggcctcgcaatagcagtgagtttaggtgacccttagacttgaagagatccaaatctttttgctgactcttggtagacaagtaccagcacatcatggtggcaaccctaaggggcatggacgacattagaaggctgatgtatgacaggacgctttcttgtagtatttaggatgccttcccataacggaagcgcactttgctatgggttgagcacgctattattctgcatattttatatgggttgatttggtttgtctcgtataatgctcacatggagtggttacttgttgtatatgatgagctatcttggtcctgttaggtgaggtcacatcgtgtacagcttgatagacagtagcacatatcctgtcgataccagttttagcccttgttgtgttgttcagatgcttaatgctatggttttggaccactaatttgtctgctttgtcgtaatgtttcaaactttgtttacttgtctaaag

SEQ ID NO: 3149 - DNA, 782 bp, Triticum aestivum
  Clone ID: PAT_TA_3149
gctccgacgcgccccgacaaatggcatctacggtggggctcctcttcgtggccgcgctggcgtgcgtgctcggcggcgccgacgcgaagctcgccgcaggctcgtcgtcagcggcgtcgtgccgtgcaacaccggcagccctcatagacatcgccacctcccccgtgttcccgaacgcggaggtggggagctgcggtgcgcggggcaggtggtggccggcgcgacgaccaacaccaacgggtccttcacgaatggagggggcccgtgacaagcgcgctggcggcgttcatcggccggtgctcgctggtgggggcacacgccgctcaacaagtgcgacgcgaagttgccgccggtggggaagctggtctcctacctggcagggcccgctcaccaggctgctcggcggcatcttccacctcttccccgccggcttttccttccacagccgatgaaattagtagttcattgtgtcgtcggtccaaccatctcagcatactgagatctggcctaattacctcttctatctttagtttggttttgaaatgaaatgcaaggcaagttacaggagctgcaaacgcttgacgtaagtgttgttgttgtaggttggctaagttgagcaactggatagataatcgtagtactccctccgtcctttaaagagtgtacttccaactttgttggagggtcaaactatctcaaagtttgaccgagtttgtgcaaaaatatatcaatgtttgtgaaatcaaataggtatataatgaaagtatattttatcaaaaaaa

SEQ ID NO: 3150 - DNA, 1002 bp, Triticum aestivum
  unsure (1)..(1002): unsure at all n locations
  Clone ID: PAT_TA_3150
gtactaccgagcgtaccgagcgtagatagatagaagagttggggacggagacggagacggagacggacagctccccgccgccgccgccgcctcctcctctcctctttctctccttataggcagaagaggaagaaggaagccgaccgcccgcaatccacagctccaccagccctcccctgctccaagacaagagattgagacagatggaggagttcatcagcctcggcgcatccgagcctggcgcctcggaaggcatcatagatctcgaccatgccctccaagtcgatgccgtcgatttgaatctgaatctcaatgcacaaccacaaggcaagcctagtactagtactagttccctcctcgacatcatcgacctcgaggaagggcaggtcgcctccgaagaagccagtgcccaacatgcgcaggggacagcagcagataacccccaccaggccaagccccaacaagaagccctgggtgccaatggaggagtggggccgcctccttctgatggggtcatcgatctcgaagaaggtcaggttgaggacatggacctctccgacgacaatgccctangtcgttggtacaaagcagcatgggtcgctgtttcagctgaaacacccaagggcaacaatgttgggccttccctttcgacaccgaccagcgcctttatcgaccaaagccccacaagaggagttaaaagagcccgtgccgaatcaaccgagccctctgtccgtgtagtctacaacaacttgacaagggaaagcaaaaggaagctcatggaactgatgcaacaatggtccgagtggcaagctagaaagcagcacgcctcgacggaaactgtggaacaagtcttggactgtggtgaagagacttattatccagcattacatgttggttcagagagatcctgtgctgtgtcattctgggtggatagccaagcacgaggaaatgctgctgtggatgatggtgcggtgccactgtatgatcgagaatttacattgg

SEQ ID NO: 3151 - DNA, 1388 bp, Triticum aestivum
  Clone ID: PAT_TA_3151
caggggacggttgccctgccctaggacactcccggtatactgtgggtatactagaagaagagctggggacggcacagctccccgccgccgccgacgcctaacctcgcctgtccttatagaggaggaggaggaggaggaggaggaacaaggtcaggggcctcaccgccgtccgtccgcccgccggcagcccatgattcgcggcaccaggcttgattagttctgaatctgaatctgcagccatccccgcccccaagagacagaggagtttgagattcatggacgaattcatccgtctcggcgacgaacctcaccctggtgtctcgcaagatctccaccaccccctcctagtcgatgctgtggatctgaatccgaatccccatcacgaacctccaaagtatagagcggctccggcgcctctccaaggcgtggagcacttacaagtcaccaaggcagcactcggaggtcaacggactggcgcatctttggttcgctaagaagacccacatttggctatgacgatggtgcctggaccccgagcccttcgttttcgacctggcaacactcgggctcgggttcgggctcgagggaaagggaaagggactgggagagggagagggagagggagagggagagggagagggaaagggacagagagagggacaggcactactacagcagcaggaggtgaatggaatgcaaatttcccagcagttgaagaagcctttacctatctatcatgtcattgttggtatagtagacatttggctgtggtttataacaaacaaacaaaaaaacagcctctcagaatggatattagttagcacttgcaatctcactgtttaagcctctcatgtggatgttattttgtcaaggacagtagtaatgagcaaagaaagatcaaactagtactacaatgatggccaaacattactggttggttcagatccgccctgtgctgtttcattctgggtgggtagccaagcacgaggaacttctgctgcgaaggatggtgcgcctcctgtccatcatcgagtcgtccaattcgcgtcatctccgaatcgcgagtaagaatatggtgcggccatccaaggtgccggtaatactcgctctttcgactgtggcgcgggcgcccgggccccgagccccgccccttcgccccggcaccacgcggcctcgggctcggcccccaagcagcacaacttgaaaaggaagagggagagggagagggaaagggagagagagagggacaggcactactacagcaacaggaggtgaatggaatggaacatgtttgtgtagctgagagaccccaattttgtttagtacgtaccaaatttaccagcagttgaagaagcctttgcctatcatgtcattgtggtatactagac

SEQ ID NO: 3152 - DNA, 915 bp, Triticum aestivum
  Clone ID: PAT_TA_3152
ttcaaggcgtcaaagcagagtaagagaatcagcgggggagtggggcgtgatatcaaagttggaggcagctgagtataaacttgaagaactgaagtcaaacatggtggggttaggaaaggaagcggtttcagctatggctgctgtagaggggcagcagcaaagattgacattacaacgcctgattgcaatggttgaggcggagagaacttatcatcagaaagtcctggagatccttgaccatttggaagaagaaatggtgtctgagcgccaaaaaatcgaagcacctccaccccctgcagcagaaagttatatgtcaccgccgccaccatcatatgacgaagttaatggcatgtttgcctccacttctgctgatcaggcagttaactctgtcgacttcttcctgggagaggcgctcgattccttcgaggctgagagtgagtttgagcttaacttatcagttggcgacatcgttatcgtccggaagatatcaagcaacggttgggcggaaggtgaatgcaaggggaaagcaggatggttcccacatgcctatgtcgaaagacgcgagcgtgttctggcgagcaaagtcccgcatattttctaggggttttgaggaggaacataggttataggtgtttgatttcaatagttgaacagcgtactttcagacttctacagtattcatgtgtatagattgaattttcgtcccgtgagccagtttttgtgaagataatgtacatctgacatttcagaacaccaaactggccataagcaagctttgtattgttgtttgaaacgattgaatgctcactggtggagttcatagccttttcacataactagatgacccgctccgcccttggcccctcggccaaatgtaagctaatcggtgtaagagtatgcattaacatattattg

SEQ ID NO: 3153 - DNA, 2110 bp, Triticum aestivum
  Clone ID: PAT_TA_3153
ggtcgcccgagggcgccccgtcccgacccttgcatggatcttctttaccagtacacactgctcgtggatgcatttggtgttgatccccaacaagagatgacattggtaaagaaggttccttaccgcgacgcccttcgggaagcagcgtggccacttggaagtgccatcgaggttgcatcatcatcataggcagcgccagtgtagcaacagaaacatcaacgtgggagcatggacatggccaccgtagaagttttggattctgggggtttcgacttgagccggttctgtctgtgcttcccccctgaagtcgccattttgtcacccggtcagtccagttcgtccagcccccctcccatacagtataggttcatacgcaaggacatgaggattacggcaccaattgtaccgcacccagacgccgctcgaaggcgcattattatttttgtactgatgatgagagtaggcgagagcattccattctttctgacttccacttgagatgggcataatcccccggctcactcgacgccggcagctccggcagccgcgtccacgtcttctgcttcgacggcaacctggatctggtccacattggcaccgacatcgagctcttcgtccagaaaaagcctggacttagcgcgtacgcccaggacccgcgcgaggctgctcaatcgctcgtctccctcattgagaaggcccgggaagtggttccggctgaattgcgcgaccagacgcctgtcagagttggggcaacagcagggctaagagctttgggagcaggaaaatccgaagagatcttgcaagcggttagggatcttcttcgtgaaaagagttcatttaagaaccagccggattgggtcacagttcttgatggaactcaggaaggtgcatatgaatgggttaccattaattatctgttgggaaatctgggaaagacctatgcagacacagttggtgtggttgaccttggcggtggatctgtccaaatggcgtatgctatcccagagaaggatgctgaaaaggctcctaaaccagcagatggtgaagaatcatacgtgaagaagcttttccttaaagggacaacatatcatctttatgtgcacagttatttgcgctatggattgctggctgctagagcagagatcttaaaagctggcaatgccaatggttacagcaactgtgtattggctggacatcaggggcaatacaagtatggtggcaatacatttgaagcatcggctgcaccttctggcagtagtttttcggaatgcagggctgatgtagtgaaagctcttaaagtagatgaagcatgcactcacatgaaatgttcctttggtggcatttggaatggtggtggtggtgctggccagaagaatctctttgtagcgtcgtttttctttgacagggctgccgaggctggtttcattaactccaatgcggctgttgccaaggtcaaaccctcagactttgaggaagctgccaagcgtgcttgcaaattgaacgtgaatgacgcccaatctagctaccctggtgtccagaaggataacgttccatacatttgcatggatcttgtgtaccagtacacactgcttgtggatggatttggtgttgatccccaacaagagatgacattggtaaagaaggttccttacagcgacgcgtttgtggaagctgcgtggccactcggaagtgccatcgaggttgcatcttcatcataggcagcaaccagtgtagcatcagaaacatcaacgtgggagcatgggcatgaccaccgtagaagaagttttggattcaggggtctacatttagccggttctgtctgtgcttccccctgaagtcgccattttgtcacccggtcagttcgtccagcctcccctcccatacagtataggttcatacgcaaggacatgaggattacggcaccaattgtactgcagccagacgccattggaaggcgcattattatttttgtactgatgatgagagtagacgagagcattccattctttctgacttccacttgagatgggcataaacacattgttcacttaccgcaaatgcattgttcgttgccatattttaaaaaaaaaaaaaaaaaaaaactcgagac

SEQ ID NO: 3154 - DNA, 260 bp, Triticum aestivum
  Clone ID: PAT_TA_3154
gaggcatccaggtggaagcactcacccagacctcgagttcttccagcaaggcccagacttctgagactcggcttcatgcccacctgcacctgcaccctgcgctgaatgactttgctttgttgctgtgcgctcatgaactttgtttcagtagaccctgcttgagtagttgggaacatgaatgtaaaacttttgtattcaccttctagacagtgctttgtgacggttgactgtacaattgtatatagacctgtcttcgtatc

SEQ ID NO: 3155 - DNA, 496 bp, Triticum aestivum
  unsure (1)..(496): unsure at all n locations
  Clone ID: PAT_TA_3155
gccgtctctgaacccatccccttccccccctctctccttctccatcaatccccgacgaaaccaaccaaccaacaatggaagttgctgcgcccaagcaactcctccccatggcgccgcgggaccccaactccccgtcctcctccacctcctcctcctcgccgtcctccgccgcgttcgccctccagccaccggcccagcccgctgccgccgtccccgaggcccgtgccccgcaccatcgacaccacccccttccccaccaccttcgtccaggccgacaccgcctccttcaagcaggtcgtccaagatgctcaccggcgccgacatgcctccgccgtcctcgcagccgcaggcccagagccagaggcccccgcnggccgccaacagcaaggccggcgccccgtgcccggccaagaagccggtttcaacgtctacgagcgccggagcacatgaagaactcaagatgatcgcgccctcgcatggcggcgcgcgggggttn

SEQ ID NO: 3156 - DNA, 752 bp, Triticum aestivum
  Clone ID: PAT_TA_3156
gtcgtcctcgccaagaagagtgacatggcccctgcggcggcagcagaagcagaagcaggtggcaacaagggcaagtttaaggtgccggcggatgatgtgaagctcatcctggcactaaagaggaatgaccttcccagcatcgactacctggatgatctggccgacctgtacactccggaggagattgcaaagaggaggctgcgccaccagagcgatctggagctcttcaagaggattgacgacgattttgaggagtaccagaaaaaggtccgcgattcggtcgacaaatatggctactttgaggtcgattatgactacgttgaagcgaggaaaaagaaaaatgcatggaccaaggcacagtgggccaagatcattgaagatgtcaatatcactgtttgtgcccctgatgctgatcaagccacgctgggttacatcgagtatgtcgactcggatgatgatgctgagtatgacgatgattctgagtactatgatgattccgagtctgaagacgaagactgattttttcagcattggagtgagctgaaaatgccaagtggaagaagattaccaactgagatgctccattttctatctagtctaatagtctaactatctagcagtgcctgttatggcctagtactggtggttatctatctgtgttgtaggcccatctttattatgtctgtatctatctatgttatcggtatgctcgccctgttgaacaccaaggtgcaaatatgttttgctgtcgc

SEQ ID NO: 3157 - DNA, 1163 bp, Triticum aestivum
  unsure (1)..(1163): unsure at all n locations
  Clone ID: PAT_TA_3157
cgagaaatccccaaaccagtgcaagcaaagcaaccaacctcgaaatccaacatcgccggtagtcggtagagggcaatcttgtcgattgtgcttcggatggcgggtaaggaggaggagctttcgatggaggcggcggggaagtggatgctgatgccgtgcaccgcccccaaatccaaatctatggaggccagcgagcatggtccggcgacgcggttcccctccaagaggaaggcagccgccggatccagctacaaggagggtgatcagctgcctgagggttggatcgatcttccttccgcggcgggacaagatgacccagaggcgtacaatctgttcaagttcgagaggagggaggcagcgattgacaagatgctgggggaggcgaagttgtcggccgtcgtcctcgccaagaagagtgacatggcccctgcggcggcagcagaagcagaagcaggtggcaacaagggcaagtttaaggtgccggcggatgatgtgaagctcatcctggcactaaagaggaatgaccttcccagcatcgactacctggatgatctggccgacctgtacactccggaggagattgcaaagaggaggctgcgccaccagagcgatctggagctcttcaagaggattgacgacgattttgaggagtaccagaaaaaagctacgccgattctggtccgacaaatatggttactttgtaggccgattcatgactacgttagaaccgacggaaaaagaaaaatgcatggaccaacccacattcggctaagatcatggaagatttcaataacactgtttgttcccctgatgatgcttctgagtatgatgatgattctgagtacgatgatgattccgagtctgaagaccaagactgattttttcagcgttggagcgagagctgggatggaagactgattttttcagcgttggagcgagagctgaaaatgccaagtggatggaagaaagattacccactgagatggtccattttctatctaatctaactatctagctgtgcctgttatggcctagtactggtggttatctatctgtgttgtaggcccatctttactatgtctgtctgtctgtatctatctttgttgttatcggtatgctcgnccctgttaacaccaaggtgcaaatatgttttgctatcgcaa

SEQ ID NO: 3158 - DNA, 666 bp, Triticum aestivum
  unsure (1)..(666): unsure at all n locations
  Clone ID: PAT_TA_3158
ttttttattacttgaaaaaaaaaagttgaccttgcagcctttcaagnaatacaagtgttgctcgcgtttgacccaacgtctttgccaaggtgaacaaataaactatatagttgaaaccatctcacattccacctattgattaggttcattcgtaaaacaaaaattgaatacaccacggggtaccaaatttcaaattacaggttacaacattgtgcacaacaagaagactaaaccaatatcgattatgacgtgctcgtcgtgttgtaagccatgtccgcagaggacgtgtccatgtcattcaagcccagctcctcgttttgctcccagctcctctcatactcctcaattgttagctgtttgtcatcttctagcgaatctgtcgctggagcaataaacgaagccgctaatgcgtcatcaagaattagagtccatggctcttctagatttagaagctttgctaatctctctgtgaaaccatcccatttcttcttcttccattcatatgtgctgtcacccaactggaatccatgaactcgctccagtgcctcgcatattttcacaattaaaccttcaactgttgccgccgcgccgcccggccctccgcttgacagctccaactcaagttcaggtacactaactgctgctgaatctgacttgatgacatca

SEQ ID NO: 3159 - DNA, 984 bp, Triticum aestivum
  unsure (1)..(984): unsure at all n locations
  Clone ID: PAT_TA_3159
gcgcccccaccctccctcttgtgccgctctccttgctccccgcctgccgcaccgctgcccgcgagccatccctactggattcgagcggtgagcggagcggagatcttcctgtcggtcattgagaatgcacatctttgtcaagaatcccaccggcaggacaatctgcctcaaggtccactcatcacgacaccctggccaccgtcatggctgggaccctggagcgggtgcggcccgcccgtcgtcgcggggcgtcgagggcaccacggttcggtcggcgggtttgcgcatctgtgcctggaaccccgccggcccgccaatctgccgctgcgtcccctcatctgacacccggcgccaccggctaggcccagctccctcatcggtagcgtctcgtcgtcgccggggggcacctggagggcaactttacgttgcctggtggtggctcccagcggcaatctacgcctcgacctccgccaaacgatccactgctgcattgcaaccgcaccttggccgaccacaacatctggaaggagtccaccattctccttgtcctccgcccgtgtagtacaataggaggtacgatgcccatcttcgtgaagacactattaggaaagacccacactcttgaggttgggagcttggacaccatcgagagtgtcaaggtgaagatctatgagaaggagggcactcgcccgatacagcagcgcctcatctttgctggcaagcagctggaggacgggcgcacgctggcagactacaacattcagagggagtctacccttcatttggtgctctgcctttgtggttgctgagatgcatggccattcaacaaccagttttattttgctgcagtcctccttgcagtagttgtgtgttgccaataaaactatcattctagtactactctgaattaagaatccctggctctgccttgggatcatttgattngagaaatacagcgcgggtgcagcttctttccttccaaaa

SEQ ID NO: 3160 - DNA, 957 bp, Triticum aestivum
  Clone ID: PAT_TA_3160
gattcggacgagggcggcgactcactgagggctcgctctggagcgtcgccgcccacaaggtggccaagctcatggccaagtcggtgctcgccgtgctcgcgcgcgtctcccttgccttcggcgcgttagtgccgggattgccacctccgttgacaggccggggatgggcgctcggccactcgtctggccccatgcaccagtcgacggcgcccgacgcggcgatccggcactcggccccgatcttccggcaaaaagacactgcctcgacatcgtcagagccactcaagccgcctgcgtccaccgtcgcccggtcgggggcccaactgcgttccgcgttcgtgtgcctccccgccgtgacgccgctcctggcgcggtcgccgccccacggcatcggtgaggcgcatgacgggatgacggagctggcgatgagagacgagctgtacaagatgctgcccgtgaccatacgcgcggcagtgaatgagaagctgagggagaggctgagaggagggcaggtggacgaggaggccgccgcgacagcgatggacgccgtggacggagtgctgcggtggttggggccaatggcgcatgacacgctgcggtggcaggacgagaggagcatggagcggaagcaacggttcagcatgcagccgcgcgcgccgatggtgcagacgctgcatttcgcggaccgtcggaaggcggacgctgccatcgtcgaggtgctcgttggtctcagctgtatgtgctggtacgacgatcaacggcggcggccggctgactggaacgagtagccggcctggtcaacgacgatgcgcagctcatcatgtgtaaatgtgtagatactgtatacgtgtaggaaagtcatttgtatacatccacaagatcattgatggcacgtgttgttgtgtcaatatatttttccaacgatgaaagaatttttataaaaaaaaaaaaaaaaaa

SEQ ID NO: 3161 - DNA, 1480 bp, Triticum aestivum
  unsure (1)..(1480): unsure at all n locations
  Clone ID: PAT_TA_3161
gtagtgaaggttcaatgcaaagatagatggtgttgaggtatctggtattgttgagcatgtcggcctgtggtcaccaacagtcattagaggcgatgacagggaagctatatacatccctaatcataaattcacaatgtctatattgaggaataacactcggagaaaccattggcgtattaagacatatcttgctataagccacatggacgctggaaaaattggtataattgttgcagacatgaggaaagtgttggccaagaatcatcatatagaacaacagaagctgcataggagagtattctttgaaaaaattgatccaaaaactcaagctcttatgatatacatatcctgctttgtgaagacatcgcattttgaagagtatctaaatgtccaggaagctgttatgttggatcttcttacgatagttgggcaccacagggcaaggcttgctacacagatccgaacagttcagaaatcatatggcaacgcagacattgacaacattccttttggagaggatacatatagtcctcgtgcacgtggccgtccgctcctgatcgatacttctgcaaggatcagtgacgacaagaaacctcctcgaccagcggtagcacgtgaagatcagaaagcaaaggtggcaagtgtatcagcggtagagccgaagtcagatgcacctgatgcttctagtttaaacagctcggagaagcaggaggagaaaaagttggttccagacgatgctgggttgaagaaggatcatgtgaaaacaacaataccatctcccacaactcccatgggcagatcctgttgcgtctactacttccaagactgatgaagggaaggctcaaggatcagaaggacaaggggatggttcttcagttgctacgccaaagaaggaatctagtagacctgcctttgaagacaacattgttcttggtgtagctctcgagggctcgaagaggacactcccaatcgatgaaggaatgaaccctcatctatcgctatctgaacctgagcaagacgctggttcgtcgcctaagaagaaaggtcaaagctactcactttcaggccaagagaaggcggactagacaggtgacggatccatgtcgtcggatctctatgaatgatttgtcaccaagccgaccttttttgtgcgcttgtgcaaatgcaatcagtcactcggtcatacagctagctcttctttttccatgtttaagggcatgaatacatgtttatttctgggaaccaatgtaccttaggcatcgatcgctgtcaggcttgtgacgtcacaagagaaatattctgtacatatggtgcatctgctggctgtaacgatcttctagataaagttgatttatgttggttcttggtggtctaggtggattcttgtgatattggaatcatgttccgctgccatcagctacagactgactgaaatgcnctgcttgatgcagagcgnagtgtgtaaagggcatttcgaaac

SEQ ID NO: 3162 - DNA, 2025 bp, Triticum aestivum
  Clone ID: PAT_TA_3162
tctggcccgcgggacccctgcagcgccagacaccgcggaaggggtgcgccgctgtcaccccctccgcggcaccccacgccagcctggcccgcgccggcacgtcgacgggcggcacccctcctctccaccccccaccagccagctctgccaccaggctcccacaccctgccttcttccctcccgagcgagcgcccggaacaggaatccaactgcctctgtcttcccgctcccaggcttagccaggtccccctcacaaagctcgcgcccagggccaggcggagagcccggcccggccggcatccactatcccctgccaccgcccagcgagcccacaatcgtgacctcgccctgccatccatccatccagcctaggctccgaaagctgctcctggtggcgcccccggggccgccagccgggggctagatccccgcccgcgccacacgcctcgcgaagacgctgcgcccccccgaggcactccagccaccgtcgaccatcccccccgccccaccctcgacgaccacgcgcaccggcacacgccgcagaacgcaagctacaacccccgggagcaggcggccccggccccatcggatacgttgctccagcagcgatgctagccgccgccgtgcttcaatccgctgtacggctttgcgctgcggcggcaggccctcatcctccagcggcagcaggcctgacggcgcccgcagccgcagcagtacccgcagatgaggatgatgggcgcgccgtccctccatcgccagacgtcctccaacccgtcgccccatcgtcaggcgtcactccaacccgtcgctccatcgccaggcctcctccaacccgtccttccatcgccaggcttcctccaacccgtgcgtccggtcagccgtcccggctggcatactcaatcgtggtgactacccttttgctccgccgaggcacctccccaccggcgcccccgatataggcaccggcgcgctgtagcgggccgggcggcggtctggcttttttgattcaccgttgccctttctttttgggcgggttgggacgctgtgtacagttgagctgcctcctgcctcgggctggcttgctccccggctttttgtgggcggggcgccccctgctgctgtgcacccggctggactggcaatagagtacaacagaaaaccagaagaggaagaagcatcaactccaccacccccacctcctcaagtatcaacttcagagaaagaaccagcacctgtgcccgctcctctgggcctgccgagagtccagccattagatttgctggggatggatgagccgatccctgacaccgccgagctagatcaaaagaatgctttggccttagcaattgttgaaccagataatgcgcgtaaagctgctgctggttccgaaaatgtcgccaccagctgggagctagcactcatcacagaacccagtgcaagtgaaaatgttgctacttcaagaaatttggccggtggaatggatctgctcaccctcgacagcctctacgacgacgcacaccagcatgcccagcagaatgtgagctacaatccctgggagcagccggccccggcttcggctccgatgatgcagcagcagtatcagcagcagccgatgcacaacccgttgtacgcctcggcgcagcagcagcaggcgttcatgctccagcagcagcaggccttcgtgctccagcagcagcaccagtaccagcagatgatgatgatgggcgcgccgtcgctccatcgccaggcgtcctccaacccatcgctccatcgccaggcgtcctccaacccgtcgctccatcgccaggcgtcctccaacccgtcgttccatcgtcagggatcctccaacccgttcgacagatcatatgtgccggcagccgcccccggtggtggttacccttatgctccggcgatgcagctccacaccggcaacgcctacaccgggaccggcatgatgtagagatgcttgtggtggtttttctttttgtttccccgtgccgaattttttacgagttagtaggaacc

SEQ ID NO: 3163 - DNA, 470 bp, Triticum aestivum
  Clone ID: PAT_TA_3163
gagaaggagcaggagcagaaggagaatgagctcgcgcgggggcaggaagaggggaaggagaatgagaacgacgagaaggtgaaggagagtgaggaagaggaggagaagaaggaagagccgtcggccgtggcggcagagtgggagagcctgtgcgcgctgagcctgtcgcccatctcggcgcaggccgtggccaagatcgtctcgcagttgcaggcccaataaatcctatctcggcgcaggccgtggccaagatcgtctcgcagttgcaggcccaataatcaactgctcgattcgattgatcgcagcgattctgtccgcgattcgtagtgatgcatgctatctcgcatgatctgctgccccatgttctagtagcctcaaattattggtgtttccagttcccccgatataaattatctattattattacaaaaaaaaaaaacatggttcccgtagtcacgggagtagccatt

SEQ ID NO: 3164 - DNA, 1321 bp, Triticum aestivum
  Clone ID: PAT_TA_3164
cgtccacccagcaatcaacactatcgaaccgaagccggagttctggcgattcgaccctcgagaggcggccgaaccgagcagacgccatggaccgcgagtggggctccaagcccggcagcggcggcgccgccaccgcccagaatgaggccattgaccggcgggagcgcctgcgccgcctcgcgctcgagaccatcgacctcgccaaggacccctacttcatgcgaaaccatctcggcagctatgagtgcaagctctgcctgacgctccacaacaacgaggggaactacctcgcgcacacgcaggggaagcggcaccagaccaacctcgccaagcgtgccgcccgcgaggccaaggacgcgcccgcgcagccccagccaaacaagcgcaagctcgcgccccgcaaatctgttaagattggcagacctggatatacagtaactaaacagtatgatcccgacacgaagcaacactcatttctctttgagattgagtatcctgaaatcgaagataatagcaagccaaggcaccgtttcatggcatcatatgaacagaaaatccaatcttgggataagaggtaccaatatctgctttttgcagcggagccctatgaagtcattggctttaagataccaagcacagagattgacaaatcaacagacaagtttttctcgtattgggatccggacaagaagtcctacattctgcaactatacttcaagccaagaccaccggagattaacagacaaccagcagctcctggtactgtcccaaatgggacaggaggccctcctggtgctccaccaaggccaccatcccagccacaggctctgccgccacctccaccgaatgcacctatgggaatgccccctaggatcccgccaccaccaatgagcggtcttcaacctccaccccctccgcctccgcttgcaaatggtcctccgcgttcaataccacctccacctccttctggtggtccaatggctaactttactcctggagcacctccgccacgccctccgatgcaaggctaccctggacctcagcagtaggtgatctgagtgtgggcaagagagatcaggctacaaattttgaacacttgctttatccaaaccagtatgtgctacattgttgtctgaaattttactgtataagcaggattaaattatttaagtgcgctttcaagcaaagcattttatctgtttgtgtttgtcatctctttgtaacttcgtttttggacgttatccctttggcacacgattgtgtaattgtcatattcctgggcaagcagagtgctcttcaaggtaaaaaaaaaaaaaaaaaa

SEQ ID NO: 3165 - DNA, 691 bp, Triticum aestivum
  Clone ID: PAT_TA_3165
ccctttcgttcggaagagaaaggtcattttaagtttcttgggcgggcattgaagggatcccaagtgtgtgccccctaaaatcatatctgggcatcgatttactgctatcagtcaacaccagtccgctgttcgggattatctggaagcgtacaagctggactcggagaatcctctaatcaatctctgcgttggttcgtccttgatcaacctctccctgggcttcaggcttcagaacaagaaccagtgcatcgtccaggcgtttgcgttcctctacaagtgcctgcgcatcggcagcaacaggcaggaggccctgtacaacatagcccgggcttaccaccatgtcgggctcaaaaccctggcggccatctactacgagaaggttttagccatggaggtggaagatcaccccatacccaagcttccattcgaggaggatttccatgagcaccaggctcttaggcctggctactgcgacctccggagagaggctgcgttcaatctgcatctgatctacaaggaaagcggagcaactgatctggcaagaaggatcctcaagacctactgttctatttaggaattggtcgtttatttatactatatacaagtacttggtctagtctatgtggatgctgctacgcaacatttccatgtaatcgtgaaggcaatcgatttttcattgtggagtccaacc

SEQ ID NO: 3166 - DNA, 705 bp, Triticum aestivum
  Clone ID: PAT_TA_3166
cccacgcgtccgcccacgcgtccggtgaaaagcattccatggcatataatcagactgcatttgtactatcctgcaagactatgttgtattcacttcggaagcctccaaagcattttgagacccttgtcgtgcaccatttccacgagcgggagcgtgccatcctggacgcatgcagcgcatacgcgtctggcattatcgtcggatcatcggtcagggatggcgcgaagtacgcctgcgataagtgctttgccggtttcaagaagtctctggatgcacacaccgaacttctcgcaaaggagttggctaagaacagagctcaagcgctggaactgaagggagacacgccagctgcagatgagatcgcgtctaccagctagggttcttgggctacctgaccattgctaaattcacctacttagggagtaactcggaagaaaaagggtgtgtaaatcacaatccacacgaaagttatggaagaagtccaggggtggtggtataactgtagatgaattggtcgtagtttaggccgtttctggaagatgaaatttcgccacgttatatgtctacctcactttgtgattttatacatgcttggtgcatgaggtgttgatagcttcagtgcctctggaagtgtgaatagaacatgtgccacttttatgaccactagcaaaataaaaacaaggaggcaaaacaaaaggatattcc

SEQ ID NO: 3167 - DNA, 1809 bp, Triticum aestivum
  Clone ID: PAT_TA_3167
gcacctgcctgcctcaacccgcgcttcttctccctttttctcgcctactactgccgcatgcactcctactactgattgaacccccttcggcgcttccctccactccctcggcgaccggtccacgggccaggaccgacgtagccggcgagggttccggcgccatgtctgtggcgcggattagatgcgaagatggttttcacgaatctgcttcaagtcgttgcagttggcaaggaatagaagaaggattgccagagaaaaggcaagtccatagaccaccaatggcaaggtgccagtcatcgaccaccctccacaggagatggccgagaaaagagctctcgcgcgggaactggagggagacacgccagtcgcggatgagatctcgtctaccagcttgggcaatgcctgaccattgtcacattgacgttcttggggagtgaaggggcagaaaaagaggatgacaatcaatatacccacgaaggcgatggaataaatctaggggtgctggtatgtccgtagatctcatcgttgtagatgagcaatggtcgcttcagcacgatccaatttcgacgcgtggtaggtctgccccacttagtggttttatacatgcttggtgcttgtagcactaaccttttctggcaaagggaaggtcgtcacgctcgatctgcaactcactatccatttgatccgttcgtcgttgttcttcgtttccccccccaccacccgccatggccttcaccagggaagaccacgaaagatggacgaaaacaatccaaaatgaatggaagcttctacagagagatctacctggatctatatatgttagagtttatgaggacaggattgatctgcttagggctgctattgttgggccttctggaactccatatcatgatggtctgttcttctttgatgtttgttttcctcctgaatacccgcgatgtccaccgaaagttcatttccattcgagtgggcttcggcttaatccaaacttgtacgagagtggtaaagtttgcctcagcctgctgaacacttggttaggttctggatctgagaagtggggcaagtcaaattccaccatgctgcaggtgttggtctccatccagggccttgtgttgaatgataaaccatactttaatgagccagtcatctttagctctaaagaaaagcattcccttggatataatcagactgcatttgtcctaacctgcaagttgatgttgtatttacttcagaagcctccaaagcattttgagaccctcattgtgtgccatttccatgagcgggagcgggccatcctagaggcatgccgtgcatatgcttctggcatggtcgtcggatcatcggtcaaggatggccggacttacctccgcaacaagtgctttgcaggtttcaagaagtccctggatgcccaggctgaacttctcgcgaaggagctagccgcgaacagacttcgtgcgctacaactgaagagaggggtgcctgctgcagataagaccatgtctaccagctaggcttctcgtgtttcagaagacacctgaccattggctgtagtttagcacttgcttgctatttgttcgctatttgatgacgaaaatttgccccttgatttctatgtctacccacttttgtggttttagcatgtgaccttagtgcaatacatgttggcagaaactcgttacactagcttcggtgcctgcataaagatggcaatagaacctgttatgctttgatgagcagcacaaattgacttcttttgtgtgtgcaactcaagacagtttgtgaagtttttaccaaaaaaaaaaaaaaaaa

SEQ ID NO: 3168 - DNA, 712 bp, Triticum aestivum
  Clone ID: PAT_TA_3168
ggtgcagacacacgagcacaccacacagacccacaccacaccacacgtcaacacagaccatgaggaatgcggcacttgacgcgcagatgaacagcggcggcgcctcttcgtcgcccatgatcccgccgccgttctggtcgacgccgacgccgtacctcttcatcggcttcgcggtggtgatgagcctcatcgcggtggcgctggctgtgctcctctgctcccgccgcagggagggaggccgcgaggacgaggaggcggtcccggccgggatgatgtctgtgcgcgtgctgacgccgctggacagggaggtgcccaaggtggtggtggtgatggccggcgacgacatgccgtccttcctcgccagcgccacgccgctcgccttcgccgaggcggccaaggtgcagcgcccgtactgccagtgcggcgccaaggacgtcgccgcccccgtatagctaactgtggctctcgcgcccgccgatcgacacccaagtatatatgtgtatcgatcaaatcaaacgggaggagttaaattttgtttctcttatatagattagttctcatcattttcctccctatttagtagttttggtgcaaggatgcgacgctgtggccttgtcgaggaggcttgttgttcagagctgcacagcatgtagcgagtgccgagtgcgcaattaatatgctaatttggttgcaaaaaaaaaaaaaaaaaaaa

SEQ ID NO: 3169 - DNA, 767 bp, Triticum aestivum
  Clone ID: PAT_TA_3169
gaggctcttgctccttgagttccctatccagaagcttctaggctttagcctctagctctagctaacttatcttctacttaaccaagcctttgcagccagcaagaagtaccatctatatcatcaccatgggtggctacggcgacttgttcgagaaggccaagccctacatcgccatgatctgcctgcagttcggctacgccggcatgaacgtcatcacccaggtctcgctcaacggcggcatgagccactacgtgctcgtcgtgtaccgccacgccttcgccaccgtctccatcgcgccatttgccctaattctcgagagaaaggtgaggccgaagatgacgtggtcgtccttcctccagatcttcgtgctggcactgctcgggcctgtgattgaccagaacttctactatgtgggtctcaagtacaccggcccgaccttcgcatgcgccatgagcaacatccttcccgccatgaccttcgtgatggccttcatcttcaggatggagaaggtggacctgagaaatttgcggtgccaggcgaaggtggcggggacggtggtgacggtggccggcgcgatgctgatgacgctctacaaaggcccgctgatgcggatggcgtggacgagccacggacaggcccacggcggcgaggccccggccgtcgatcccacgggcagggagtggttcctcggctcgctcttcatcatcatcgccaccctcgcctgggcttctctcttcatccttcaggctcacaccctgaagcagtac

SEQ ID NO: 3170 - DNA, 568 bp, Triticum aestivum
  Clone ID: PAT_TA_3170
tgttgtgacctctgccaggccgccgccgacgccgtgctgcgcggtgactccctgcgctcgctctccgccgtgcccgccgccttcacggaacgcgacatggccggcctctacggcaacgtcggcacaaacaccggcagctcctcctccctccactcctcgccggagaactccacgtccgcgcccgccaggaagcggagcaagaacaaccctggctgcggcgccgcaggagggcagcaggtgaagctgccggggccggtgctgccgtcgtgcgatctggacctctgcctgacgcccttgtcgtcgccgctggccggcgggaggcgaggcggcgcgtcggacgagtactccaccacgacgtgctgcgaggaagccagcggcgacgcggcggaggccggggcgcccccgctgctgaacctcttcaactgagagcctgagtgtaaactgtaattgtgcagttcgtgtgtgtgtgtgtgggtggtgattaattagttgcatcggtgttagtcaatgaagctttttgggacgtgcaacaaggtttacaaatgttcgatccatgttctagcgctct

SEQ ID NO: 3171 - DNA, 706 bp, Triticum aestivum
  Clone ID: PAT_TA_3171
accggtccggaatttccgggtcgacccacgcgtccgggactgtcacgagaacaaggagcatgccctgcgaattaaagatgctgagacgagtggtctcgggagttcgtcaggaaaggatgccatgatcggacgcgtgggcggaaatgagggtggcaatgatgagagaacatctggagaaggggttagtcctatggcacaagagcttgtagaacctgcacctgacaatgtccatattgacgcggttttcattacagaagttagtggctccatgtcccagtctgatttccactcctcgctgatggcatctgaaaggatcgtgcctggcttggaagacggcgaggcagctctccgcaggacttcatccagagatgttttgtcaagtgaaagatcagatgtttctcaatccagcttaacatctgtgttgcctgctacttcaagtgcatcatccatcattggagaatcaattccagatgcaactgctagcagagaagatgttccaaccatattcagcgtgtcacatggtcagattggtggaagtacagtgcatgaagacatggttagcattttctcaaatgatggcccagaacactctcgagattccagcaatggtgaaacaagaagaaatcatagaagagtcctatgggattcgttttcaagacgtggttctagaggttatctagattcagacactgatgatctgggattt

SEQ ID NO: 3172 - DNA, 390 bp, Triticum aestivum
  Clone ID: PAT_TA_3172
aaggccagcaaaaccctaaccctaagcatcccaattcccccaatcccgaatcccccacccccgtcgcccccaaaccctatccctgacctgccccccgcctcgccgccgcgacgatggcaggctcctccggcgccgccgccgcctcctcccgcagccagctcaaaggcgaccgcttttactacccgccccaccgccgccagagccagcagcaccagcagcagggcctgcagagccgccgccccccgacgttgcccttgctctccccgtccccctcccccaggcggaagacggccgcggcggccgcagctgtagtcgtgtccgtcgacgccgactgccgtgcggattccgacgacttcttgttcaccttcttcaaagcctttctggcctcca

SEQ ID NO: 3173 - DNA, 459 bp, Triticum aestivum
  Clone ID: PAT_TA_3173
tgttttgccgccggcgccggcgggttcaggcgcggctactgcctcaagcgcgggcgcgccgaccaggagcggaagaagggcgtcccgtggacggaggaggagcaccggctgttcttgaaggggctgaagaagtacgggagaggcgactggaggaacatctcccggaactacgtgacgagccgcacgccgacgcaggtggccagccacgcccagaagtacttcatccggctcacctccggcggcaaggacaacaagcgccgctccagcatccacgacatcaccaccgtcaacgtgcccgacgacgacgaccgcggcagcccctcggggtccccgccgtccgcgctcaccaccgtcgacacgaagccctcgccgtcgtacggcgggcaacggcacgccttcgtgccgccgacgctgcagccggggacgctcggcggcggccacccctacggcagcgtgaag

SEQ ID NO: 3174 - DNA, 880 bp, Triticum aestivum
  Clone ID: PAT_TA_3174
ggaggtcccttgtcccgcacccgcccggaggccaaggctgcctccctcaaagccctccagtcctcgtcctccacggcttcaccaccgagaagcaggattctcatgggctgcgcaggatccacccccaagggcgctgcggccgccggaggcgaagctacgaagaaagtcaggaagcctaagccctggaagcacccccagccgatcacaattgcccagctcaggcagatgcgtgatgagttttgggacacagctcctcactatggtggtcggaaagaaatttgggatgcccttcgtgctgcgtcagaggctgatgtagcccttgcacaggcaattgtggaaagtgcgggcgtaattgtttcaaatgctgacctgactctatgctatgatgaaagaggtgctaaatatgaactgcccaagtatgttttgagtgagccaaccaacctggtccaagacagttgaagggcagctgcactatgatccattcatgtaaaaaactgtaaatcgcttcagatgctaaaaacaatgccttgctcaagtgtcctggtgacaggagcatggttgattaatgatttcaagcatgcttctggtaactgtcagcttacagtttcccccctatcgttagcatacaatgttctcttctatctcagactgtcttccgacgatttagataaagttgttcatagcatcccctaaattggtgctcctgtaaatacgaggtttagaaatcttcggtatgggttagaaacttcagactggtgcgttgatgttttgttacaatgatataagttgaagtatggcaatacatttcagaaagaaagaaagagaatgtaacatctgttagttacaatgatatattttaagttaaaaaaaaaaaaaaaaa

SEQ ID NO: 3175 - DNA, 985 bp, Triticum aestivum
  Clone ID: PAT_TA_3175
gggccggtgttccgggccggccctcgcgtccgttgtgcccctgatatgcagttccctttccttgcccccaccttgcgccctgtggcccccggtctattctccctcgctaattcatttccttgtagtacagttgtgttagttatttgcttgcaagatagcatcttcctgaatgatttctttatatttttcagataaggagaactttaaccttgcgcccacctatggcaatattgccctctttatattctccctcgctcatcagcagcagcgatggtggcgtcattgtcggccttgcagcatgtgggcataatcatgtccattgcctactctggggcagatctttgaaagttccaagttggttaatgttgatttttgctcatgcacaacccatcataggaattagtaggatcctctttgatggatgtaaggactgcaacaggtttctttcagcagcctggggttgttaagaagagggtcgggattgctctgggcagatgcttaaattcctggatgtaaacgcacacttgtctcctacacaggccaaaatactattggagataaggatactcgcgctgctgctgttgcgtttggttagggaggggcttcttcgtctgctttgccgtgcggtggctgtgcggctgcttgttccttcttgtccggtgtacctgcgcagctcccagtttgtcggcaatagccactggagaaagtagtgattgggtttatatgggatagttatgtatgtccattgtgtgatgggaaatacaatgcagtggttaattgtcacatggcttctcaatagtggcttctcagtaaaaaaaagttatatgatgtatgatagccatgagtatgatgatttttcggatgggcggtaagcttcccatgtttgatgttttttttttctttttatgattgtgcgacgccggtctgcttcggcccctcgtgtacacttctatttggtcatatattttgtccttccctggttctc

SEQ ID NO: 3176 - DNA, 1324 bp, Triticum aestivum
  Clone ID: PAT_TA_3176
gtcaccccgcacgccacgcacaagcgacgacccctccctcctccgccgccgccctagggttccggcgatggcgcccgcccccccgcccccccgccccccgcccccccgcccccccggcccctccccccccccccccccgcccgccgccgcccgccgccgcctgcgcggcgccgtcttcaagactgccacgctcaagaaccagattcgctccaccgagcgcctcctccgcaaggaccttcctcatgacatgagggttgctcaagagaagaaattggcaacaactaaagagacagcaagagaaacagactcaagaggccatgcaacggacaatacagttgagggatagaaagataaagttttttgagaggcgaaagattgagaggatgataaggcgtcttgataaacagcaacgtttaaatgctgatgaggccagcaacaagtgggcaacattgcgagaagatcttgaatatgttagatttttcccaaagaaagaaaaatatttccctttattcaccgggggtaatacaccagatgttgtggagaaaaggaatacatggcgtaaacagatcaaggagaatctcatcgcggaggcagcaaatagaaaggacctagaagagacggccagtgacgatgtcaccgtggatgggagtgaagatgatttctttatgtctggaagttcaagtgatgaagaggcagatgatgagcttaccgacaaaagtacctgggggcctcgtgcttcggctacggcggcgtctggtatgtcgagtgatgaaaagaaccagcggcagagagatgctcgggtgcttatgccaccacctcgctcattaccacctaatagagctagatctgcggataaacgtgcggtgtccagctctagcaatgcttcgaccagcacaagcggtaactcattcaaaaataggagagcatccaatctttctggagatcacaacagcactctgagttcaaattctgatgctcataagccacgccgcaaaaggagaccgaagaaaaagaagcaggcatgaatgaatattccgatcctccagaagagcagaagccaagatctgttccatcccaaagcgcggcttcgttcatggctcgtcggttcgaaaagggaggaagaaacccagcaaaagtgtgcctgagcaagcagatgattttgtacgctcgctctctctgatgtaaaatgaaccctccctcccgtcgccccgcccccgtttgtcttgcagatacagaacaaattaccgtcgtaaaccaccgaccgacattgcccgttctaaaaaaaaaaaaacccaaaggggggccgtaccaatcacctatagaa

SEQ ID NO: 3177 - DNA, 502 bp, Triticum aestivum
  unsure (1)..(502): unsure at all n locations
  Clone ID: PAT_TA_3177
agttctttgctcatcacgacggcaagtgcaatgacgccgccagcggcccgcccgttacagtgttggacaaatgcgccagccagccaacaagcggggtttaatatggacggattccaagctcatcactgtacggtatgtacactactcgatgagcctcgatcatcagaccagatggatgccttatattgaataactcatccttccttcacgtcctaaacattacagatacgtatcttgtgttagggaataaaacttttatgtaatgtaagccaggaggctgccaaacggcgccctagcagtttgtgtacgagcgctactgtggccgagcgagccatcacatggtttgtcatgctaataagcacagggaactgaatgacgaccttatattgattgatgtgtgtgtgtgtgcgtgcgcgcgtgagtgtgcctagtgggggtgatctgtatatgtatctatgngtactgaataaattgtctcaagatattccttatttcctgtttg

SEQ ID NO: 3178 - DNA, 436 bp, Triticum aestivum
  Clone ID: PAT_TA_3178
cgcacctgtttcccttccttcccttccttccctttacaccccccccccccacccccccctctatgtgtctctctgcctatagctgtaccctccctctaattgggtagtacgtactccagtagcggctacctagcaagctagagatcagcgtcgttccttccggccatggcgagcaccacgcgcaaggaggaggggccggacaagcagcagcagcaggggagcaccaggctctactccaggatgctctccaaggacgtggccatcgccgtgccgtccttccgggtgtactacggcgtcgcctccgcgggctccgtgcccttcctgtgggagtcgcagccgggcacgcccaagagctcgccctccgccgccgcgctcccgccgctcacgccgccgccctcctactacgcggccggcggcaagggcggctccaagaggg

SEQ ID NO: 3179 - DNA, 544 bp, Triticum aestivum
  unsure (1)..(544): unsure at all n locations
  Clone ID: PAT_TA_3179
ttttaaacccctcgtcgggacgaccgaccgaccgccgcgccgtcctcccaaaccccgcaagaaaatggcgaccagcgccaccttcctccacctcctcgcccctccgggcctccgccccaagcccatactccggccccgcctccgccgcctcgccctctccgtctccccctcgggccccgacgagatccccgccgacgacccgcccgtgctcccctccatcctcgtcaagaacaccgagcccgaggacgtcgcgcgccgccggagctgggtcgagcacgggtgggcgccctgggaggaggcgatgagccccgaggtcgccttcgcgcgccacagcctgaacgagggcgaggaggtgccgctcacctcgccggagtccgtcgaggcgttccgcatgctcacccggcgtaccgcgagaaggtggagtcaagccggggtactcgaggctcttcataatgcgcgagaagcctgatccctcgagactcgttggncggccggtgctnncagtcntcctgccgcgggatgggcgccgcccggctggaagtgg

SEQ ID NO: 3180 - DNA, 661 bp, Triticum aestivum
  Clone ID: PAT_TA_3180
gcaaggggcaggtgcaccaaccatattccaggccatgagacgaattgttgactccttgatgcatcagtccatgggggagggggctttggagcgtgcactaacttcttctttccttgtttccgcagatatggctcatgccctgcacccaaactatccagacaagcatgaagagtaccacagaccagaactacaaaaaggacttgttatcaagcataatgctaaccagcgttatgccacaagtgctgtaacagcttttctcttcaaagaaatagctcgaattcataaccttcccgtccaggaatttgttgtaaggaatgatatgggttgtggctcaactatcggtcccatacttgcttctggtgttggcatacggactgttgattgtggtattcctcagctttccatgcacagcgttcgggaaatgtgtggcaaagaagacatagacaccacatacaagcacttcaaagctttcttcgagatgttctcggacattgaccagaaactgaatgtagacttttaggtcctgacatctgaatgtgcaatctctaaataatgtacggatatccagctcggtctccgaataattcttgatcatagtatcagttttgttgcatattcaatctggttaagacaagagcactggctctgaaatcattttcca

SEQ ID NO: 3181 - DNA, 732 bp, Triticum aestivum
  Clone ID: PAT_TA_3181
ttctatgcatccgcagacgcctgggcggcgatgcagatcctggtccggtgcgggtgcggcgaggcggcgtgcccggagtgggcggtggtggaggtgcagggcgtgctgcagccgcagccctgcttctccggccgcatccagggcctccacatcggccgcctctgctccacctcctccgccccgacttccaagggcgggtacaccttcaccgtggggtaccatgagctcgccggctcgaaggtgactctcaagaagcccctgcttgtgctgaggaagaagaagaacgacaagggagatgccggcgagctcggccaaggtggacaggcggcggcggaggtggagctggaggtgatcggcatcatccggcacaagatcctcttcaaggaccgccccaaggccctcatctcaaagccggtgcccaaggagaagaaggccctgcctgcagcggcgaccccatcaaccgtgcctcccgcttcctgaagaataagtttgttaaggatctgtagctccctgggggttctgattgtccccgtttgtttcccctgtctagttagtggtcacatcttcctctaccattgttgtgcttgtgccgtacgtataccagtatgaatttcccgtctcgttgaagcacactaagtgaaaaattagcacaaacttctggggctgtttgggtccactgctatgggaaccaaataccaccatcaaatttgcttttaaaaaaaaaaggggggg

SEQ ID NO: 3182 - DNA, 509 bp, Triticum aestivum
  Clone ID: PAT_TA_3182
cggacgcgtgggcccccgcctgcctccccccgatcgccacactcgccgaccccgccgcgcggccaccgcgcccgcgccataaatcaagctagcgctgcttcacttgaacaacgccgcacctcaccgccaccgcacacctcccctgccgcgccgccgtgacagagtaggaaggaagagcgagcgagcgtttgttggcgcagcggcggcggccggcacggcaagatgatcacgggcacggacttctaccacgtcatgacggcgatggtgccgctgtacgtggcgatgatgctcgcgtacggctccgtcaagtggtggcgcatcttcacgccggaccagtgctccgggatcaaccgcttcgtcgcgctcttcgccgtgccgctcctctccttccacttcatctccaccaacaacccctacaccatgaacctgcgcttcatcgccgccgacacgctgcagaagctcatgatgctcgccatgctcaacgcctggagcaactctcccgccgcggc

SEQ ID NO: 3183 - DNA, 986 bp, Triticum aestivum
  Clone ID: PAT_TA_3183
aagttcacgcgtgggcgctgccgccgcccaaaatccaccttctaagaagaaataaggggccccttatcttcctctctcgcgtccgatggcctcgagcccgggcgtcggcggcggaggggcggacgggggcgtcggggatggaccgacgacgctggacgagctgtaccacatcaacgtcgtgcctgccgagctgcacttcaagttccgcaaggagctccagggcctccgcgtcggcctcaacttcgagttctacaatctagaggtgaatgattttgaggcaaaggtagttctgaagcccctggacttcgaccggaagtggaagttccagtacaagcccatcagcggtgacatacagctactctccaagaagataccagtcacaaaatatctcaaccttcaggtcggcattggtcacaatttccaactgaaggcaactggatggaagtggaagctctctacttgcttggggggagatggtgtttctcagataagaaacaaatcaaaactcaacctgtttccagggtttgatctgaggctcggctggaaagctgaatatgttcttcctgagattcatggggctgttggcacaggagaacctgccttcagtatgaactatggacgattgcaagcatccatagaccgtgttgaggctattgtgacccaatcagatcggtgctgaacctcctaggatgagaagcacacctggacagtgatgttgttatggccgcgaagcgagggagttattcaactgcaactatctcagcaaaatctcatggttgtttattagtgtcttttgaggctttgcatctgatgtacagaaatgagcaaactttattttaatggagtttctccggaccgtttggcagaaaaaaaaaaattaaaatccctttgttttgaagagcataatgaataatgctcttgctgcttgtagttggcaaaaaaaaaaaaaaaaaaaaaaaaaaaaaaaaaaaaaaaaaaaaaaaaaa

SEQ ID NO: 3184 - DNA, 331 bp, Triticum aestivum
  Clone ID: PAT_TA_3184
caagtcgcccaagaagaagacctccaccaagtcccccaagaagaaggtcgccgccaaggagtagaattccccatagcatagccattgttgcttagatccatttctcatggacaagatgagcagtcttttggttagttagatgagtagtggttctgcccttagattcgctgagaaagggtggcattatgtctgtgatttctgtaggaatggctaaatatgcaatcgctcagatcttaattctcttgttctatctgtgggtgaaattgatcctgttaatccttgcttcctgtgctgttttatcctagtactaaattctcacttatatcggctg

SEQ ID NO: 3185 - DNA, 787 bp, Triticum aestivum
  Clone ID: PAT_TA_3185
caactatcccacgcgtccgcattccgatccagccccgccgcccccgcatctcgagtagtttccagctcgccggagaagcagcaagcaggatggccggaaggaagggcggcgacaggaagaagtcggtgaccaggtccgtcaaggctgggctccagttccccgtcggccgcatcgggcgctacctcaagaagggccgctacgcgcagcgcgtcggctccggcgcccccgtctacctcgccgccgtcctcgagtacctcgccgccgaggtgttggagctggccggcaacgctgccaaggacaacaagaagacccgcatcatcccgcgccacctgctgctcgccgtccgcaacgaccaggagctcggcaggctgctcgccggcgtcaccatcgcccacggcggcgtcatccccaacatcaactccgtgcttctccccaagaagtcccccgccgccgccgagaaggaggccaagtcgcccaagaagaagaccaccaccaagtcccccaagaagaaggtcgccaccaaggagtagaattccgcatagcatagccattgttgcttagatccatttctcatggacaagatgagcagtcttttggttagttagacgagtagtggttctgtccttagattcgctgagcaagggtgacattgtgtctgtgatttctgtaggaatggctaaatatgcaatcgttcagatcttaattctcttgttctatcagtggatgcaaaaaaaaaagttaatcctcgctacctatgctgttttgtaccaaattctcacttctatca

SEQ ID NO: 3186 - DNA, 482 bp, Triticum aestivum
  Clone ID: PAT_TA_3186
tttttcacgcgtccgcccacgcgtccgcccacgcgtccgcgccgaacaactctcaccggaacgcagcaaattccccagccttccctcgacccagatccgcaaaatggcccgcacgaagcagaccgcgcgcaagtcgaccggcggcaaggccccgcggaagcagctggcgaccaaggcggcgcgcaagtcggcgccggcgaccggcggcgtgaagaagccccaccgcttgcgccccggcaccgtcgcgctccgcgagatccgcaagtaccagaagagcaccgagctgctcatccgcaagctgcccttccagcgcctcgtccgggagatcgcgcaggacttcaagaccgacctgcgcttccagagctacgtcgtgtccgccctgcaggaggccgacgaggtctacctcgtggggctgttcgaggacaccaacctctgcgccatccacgccaagcgtgtcaccatcatgaccaaggacatacagc

SEQ ID NO: 3187 - DNA, 1089 bp, Triticum aestivum
  unsure (1)..(1089): unsure at all n locations
  Clone ID: PAT_TA_3187
tcgttcacgcgtccgcggacgcgtgggctcgcgcacgcgtcctacgccttcaacgactactaccagaagaacggccaggccagcagcgcgtgcgacttcagtggtgctgccaccattgtcaaccaggcaccatcaggccggtgcgacccgagcccgagctggtgtgtcgcgaacgcggccgtgggcgccgcgcggctgcagaacgcgctggactacgcctgcgttcatggcgcggactgcactgacatccaacctgcgagcacggtgcttcgatcccgacaccaaggtcgcgcatgcgtccttcgcgttcaatgactattacgagcgccataaccaggccgccggaacgtgcgacttcgccggtgccggtaccattgtccggcaggcaccaaagataggcaactgcgtgctgccgtcaagggcctgaactgaagaaactgtagccaaacgcgaagctttactaccacgagattaaccaataatcccggacaagattattgtctgctgccggccaaagtctagtcttcaactgtaaaactgcactgcttttcatcactgtgcttagagcaagtatttcaatgtggcgtatggcctgggttcctgtcagcacggtccatctttgaagccctagtcctgactgaccgcggtcaggaatttatatttatcgtcttgccctatctactcctgtaatcaattggcctcaacaagctatcagggctttgagcttgctccagttttaataaaaaaaaggccagcggggtccaatgataaacaaatggcgtgctgccgtcaacggcctggaagccctaaactggagaaactgcagccaaggccaagctttgctaccttacaggattaatcatttgctgtcaacaaatctagtttcaaccggtaaaactagataaataaatctatctatttcttttttgcccaacaaaaaaaccaaaggggggccggtaccaattcgccnangtgatctatacgccgctcacnggcgtctttaaactctgacnggaaaacctgggtaccacttaacccttnanaaatccccttccagnngntaatacaaaggcccacgttnccttcaaa

SEQ ID NO: 3188 - DNA, 1262 bp, Triticum aestivum
  unsure (1)..(1262): unsure at all n locations
  Clone ID: PAT_TA_3188
ttcggcacgaggcatcaccgtcgccgccgatgatcctctcggccttcctgctcctctgctgcgccgtcgccacctggacggtgtccccggccaaggcacgccaaagccaaagcccatcccctgtcatcggagcagatcatcatcaagcgtacggcaccttggaccaggtgaaggcggctcttcagcgggtggggctcgagtcgtccaacctcatcatcggggtggatttcaccaggagcaaccagtggacagggaagcgctgcttcggcgggaggagcctgcaccacctcgccgccggcccgaacccgtacgaggaggccatcggcatcgtcggcgacacgctgtcggcctacgacgaggacaacgccatcccctgcttcggcttcggggacaccgccagtgtccacgcacgaccagggcgtgttcagcttctacggggacgggcggccgtgcgccggcatcccggaggccctgctgcgttaccgggagatcaccgccaccgttcagctctccgggccgacatctctggcgccgatcatcgaggctgcaatgggggtagtccaacgctccgggcatcaagtaccacatcctgctgataatcgctgatgggcaggttccgagaggttgcggtgctcatcgcgcgagctccctggacgaatcaagatcagagaacgacatggaggagaggactctccaggccctcattcaggccagccatttccctctgtccatcgtcctcgtcggggtcggggacggaccatgggacgacgatcagatgcggttccacgacgggccggcgccgattcgataacttccagtttgtagatttcaccaagatcatgtcggcggagatgtcccgcgccgagaagggggagcggttcgcgctcgaggcgctagagaagatcccgagccagtacgctgcgatcatcagccagcgtatcagtgatctggctgcgagggcgcctgcgaggacgcctcttcctcctccatcctgagcatccggttcaccgtcggtttcgctgcgcaggcaggttcatgatatggtcacattgttggaggatgaagttagccattttagttcccatcccctgtgtgtgcttgtacacttcagagcacctcaatttccagcccacatctcctgttcatttgtactcttttaataatagcatatatctttattgacagagttggctagtcttcatatatgttacagaagaaaatcatatattttgcctgtgtagtccactnaatcagcaaatata

SEQ ID NO: 3189 - DNA, 1770 bp, Triticum aestivum
  Clone ID: PAT_TA_3189
tcgcggcccgcggctcgcgcccggatgccgtcccgcggctcttcctgtcgctcgctgtcgcggcccgggcgcaggtgctgaactaccggcagatggtccgcaacagaatccagagcatggaggaggagtacgcgtcgaaggtggcgaagctgtgcttccaggaggcggacggagaagaggaggaagaagatcggggagctcaagacgctggagaactcgcacgaccactaccaccgcagttggagatcctggtggccatcaagcctggtccggccgcgtttgtcaccggcaacgaccgcgtaccaagcagcgagctcgtggagatgttcctcatgacacggtgccgcaacctcaactgcaagagcatgctgcctgtggacgattgcgagtgtaagatttgctccagcaacaaagggttctgtggcgcatgtatgtgcccggtgtgccacaagtttgactgtgctgcaaatacctgcagctgggtcggttgtgacgtttgcggccattggtgccatgctgcgtgcggtctggagaggaacttgatcagaccaggcccgacactcaaggggccgatagggacgactgagatgcagttccagtgtcttggttgcagccattcttctgagatgtttggatttgttaaggaggtgttcaattgctgcgcagagaactggaatgctgagacgctgatgaaagagctagatgttgtcaggaagatatttgctgctagtgatgattttgaggggaaggggcttcatgccaaggctgaagaggtcctcagcatgctttcaaagaaagttatctccctgccggatgcattgaacaacatgctgcaattcttcaaatatggcgttaccgactgctctgtcactggcagcaagtccaaaggcatattggcagcaaatcaggcgagccaatctacgattccccttctatctccgaccatcagtccacccaaatccttcaatttcaatgccagcacctccattctcgactcacagattgatgcgctcaagaccagcccaaagtccctctctattgaaccccgttttggctccagctcaaacccactggctattgaaccccgttttggcgccagctcgaagccgctgtccgttgattcccgtttcggcgccagcccgaagccgctctctatcgagccccatttcagcaccacctcaaaggacgacgaagcctccaccctcgagaccgtcgtcaagtgcaaggaagccgaagcaaaactgttccagaagctggctgacgatgcccggaaggaggtggagaactaccccctcgtggggcgcgccggagccctgtgcttggccgaggaggccgcgtcggaggtggcggggcggtgcgtccgggtggcgggggaggcgtccaggaacgggttgggggagctcccgccgctggcggactcgccctacgacggcctcaaggcgtgccggcgggcccggaccgagaatcccagggcccttgcttcgagcgggatggaggccacaaagaagatgtgggtgtagagaggaatcccggtaaaaaaacaaaaaaaaccaccacctgctgctcctgaatgcctgcagatcgccgttgttgtccattagagtgtaatggtttctaaaccaaagttgctgtgttccatctgtaatttgttcttttttactacccgttgttaactgttgttattataaagcggaggaggcctaaccttgcgccggcggatataacctgacagcattttcagttcaaaaaaacctcggccgcgaccacgct

SEQ ID NO: 3190 - DNA, 1094 bp, Triticum aestivum
  unsure (1)..(1094): unsure at all n locations
  Clone ID: PAT_TA_3190
cggcacgaggcggcccggcgcactgccttcgacgtgcagcgccactaaccaagcagagcactaaccagccaccttaactagatagctccatctcccaacaccggcggccagccatggcgctcgcgtctctccccaaggtggtgctcggctccatcgccttcgccgtcttctggatgatggcggtgttcccgtcggtgcccttcctgcccatcggccgcacggcgggctcgctgctctccgccgtgctcatgatcgtcttccacgtgatcagccccgacgacgcctacgcctccatcgacctccccatcctcggcctgctcttctccaccatggtcgtcggtggctacctcaagaacgccggcatgttcaagcacctcggcacgctcctcgcctggaagagccagggcggccgcgacctgctctgccgcgtctgcgtcgtcaccgcgctggcctcggcgctcttcaccaacgacacctgctgcgtcgtgctcaccgagttcgtgctcgagctcgccgccgagcggaacctcccggccaagcccttcctcctggccctcgcctccagcgccaacatcggctccagcgccacccccatcggcaacccgcagaacctggtcatcgccttcaacagcaagatctccttccccaggttcctcatcggcatcctgccggccatgctcgccggcatggccgtcaacatggtcatgctgctctgcatgtactggaaggacctcgagggtgtggcccccgacgcggccggcaagcagatgtcggtcgtcgaggagggcggccgctcgccgtccgtggcgtcgctcaagagcccgcacccgttcaacggcaccacggccgacgacggcaacgagtcgatgatggaggagaacatctcgaccaagcacccgtggttcatgcagtgcacggagcaccgacgcaagctgttcctcaagagcttcgcctacatcgtgacgctnggcatggtggtggcctacatggctgggctcaacatgtcgtggacggccatcaccaccgccatcgcgctggtcgtcgtcgacttccgggacgccgagccgtgcctcgtcaaggtctcctactcgctg

SEQ ID NO: 3191 - DNA, 393 bp, Triticum aestivum
  Clone ID: PAT_TA_3191
aagataaaatgctacagttacattggaccaaaccaagtctgtttctctaaatcaaaaaaggaacaaaaagaattgagctaaaagttaaaatcaggcctggagcttcacatgccgatcagcctaccatcggctgcaaagctaaattagaacatcacatttccccatggacataatttacaagcctttttacatcttaagttacagaagccaagggagtataaatccaagtagctctcaaaacattaacaacccattttagtgcctagtgttcatgcttgacacgccctttcagtatccctggaataggaggtgaggttcgtagcctaattccatttggccttgcaggttgtggtgatcgacgcccataaacatttgatgcacttgagcattcaa

SEQ ID NO: 3192 - DNA, 397 bp, Triticum aestivum
  Clone ID: PAT_TA_3192
cggagatcatcctttgcgtaaacgcggccacgacgaggaatggcgagattgaccgaacctgccgacggtgctccttgacgatatcgctggtcggcttctcctctacgacgtggccgagtacatccgcctccgtgctgcgtgcaaggagtggaggaactgcaccgatgatccacgcgcgggaggcggcctggactgccgcttccgcccccgacgctggatcatgctgtccaaccgcaccgagggcgacggccgtcgctttctcaacgactccaccggtgccagcgcatgtgtcgatctcccggagctctcccgccaccaccttgagaccagcaccgagggccttctgctcctgcgcggcaaggcgagccacgctgtgcgcctcttcaacctgctcacc

SEQ ID NO: 3193 - DNA, 951 bp, Triticum aestivum
  unsure (1)..(951): unsure at all n locations
  Clone ID: PAT_TA_3193
tcccccgggctgaggaagccggtcgccgccgccctctgcagctgccgcttaccaccgcgtgagcctcccgctggtgatctactgccgcgctgcgactcttcccctccccctctatgggtgtaggggtggcggccccggccgtccctgcggccttcgatctcaacaacgcggcggagatccaggacctggcgccggctgctctggggaccctggaggcggccagggctcccaatcttgttcttggccagccggcggaggaggaggaagcgccaccgccagtgctcaccgcttcgccgaggcgcagtccacgcatcaggcgcgcctacgacggggtgcgcgtgggatctgtcgagcgggctgctaagaggaaggcggtggcaacaggatccgactccagtttgggatcgtcccgccgctccggttcttcttggcgccgcaagaaagtcaagacagtggccgtgtcagaactcctcgagctaccacttctgaacacaccgtcaccgctcactcggggcaagctgaagcagatcgctcagtgttgcgacctcaacgccaatgccatcctggaacaagctaaggacagagccgtctccgtctcttcgggcgatgcctccaactctgccagtgcttctactggctctcctgcatgtgtcttcaactctttcaatggttagagctgacgtcttccttgtaggccttcgggcagtgctacttgtagtggtttggatcaagagtttacctgtgttagtgtactgcagttatctgttgttctgtctagtctttcgagtttcagtctgtcagagttagtgggtgttggtcgtctgtcagtctagagtctgtatgttgtttttccagcatctatgtcccaatgcttagcaccgctcccttttctttcanatcatgctgtatttgcttcctagcccctcggtcccggctatgtgttctttactg

SEQ ID NO: 3194 - DNA, 822 bp, Triticum aestivum
  Clone ID: PAT_TA_3194
attcggcacggcgcttggctacactctcacaatggctgccattaagcttgtgtcacttagcttggttgtgctactgagcattgggttagccagcgccactagggtagttagatacgccagctcaacggggacaggctcgggagtggggaatggtggtggcactgtgaacggcagcggtggagggactgggagtggcaatgggaatgcctacagtggtagtagtggagcccatgcaaatgcgggagggggcggtagcgggggtggtgcgtcgcaggatggtggcaccggacatggcgctgggtccggcgacggctcaagctctagctatacgagcgacggaagatatagttatggtggtgattcttatgcaggcggtaatggtgccggcagcggcggcggacaggcagcgggccctggttccagcggttacggagccggtggtggtgctggttctggctctagcgcggcaagtggtggctggtacccatatgcgaatgcgaatgctaatggtaacggtggaggcataggaactggtcagaacggcggcagcggtggcggcacgggaggtggcagcggtaatgctggtgcatacccttaagttatctctatttatgtgatagatctgaagatggagcccagaatttcatgttttttctttctttctgtttgcaccttgtggccccgttagtttgcggcgtttaagttcttgtatgctttttcatgtatactagtatggatgaatcaataaagggccccatcaacttgtgttaaaaaaaaaatgaaagaggagcttgatgacacgaggcctaagcttggcactag

SEQ ID NO: 3195 - DNA, 2673 bp, Triticum aestivum
  unsure (1)..(2673): unsure at all n locations
  Clone ID: PAT_TA_3195
agcgcgaccgaaaataccactcgcccctccaaactgatggtcggtcggagacagcttgtttgatagcggatccggtcatcctgttgccgccggccggcgaggtgatcgaggtggagaactcggagccgggctcgccggacgtcggcagccggagcagcggcagcggccggagctcgtcggagtactccgggtgggtctaccacctcggcgtcaactccatcggccacgagtactaacacctccgcttcctcgtcatccgcggcaagtgcgtcgccatgtacaagcgcgacccgcacgacaacccgggactcgaacctatccggagggtcaatgtgggtcacactcttgtggtggaggaggttggtcgcaaaaaggtcaatcacggggatgtttatgtcttgaggttgtacagtagattggatcaaacgaagaaaggagagattgcgtgtgcaactcctggtgaagctcaaaaatggactgaagcatttgagcaggctaaacaacaggctgagtatgacctgacaagaggggctaactggaacagattgcagagtgaaaacgagtttaatctcgatgggcatcgacctcgggtaagaagaggcttggggaaacttgtacgcattggcaaaggaccagaaatgctccttcggcagtcctccgatcttcaaagccatgaaagggttaacacaaactttggaggtgatactggagatgcacttgaagcacatgaatggagatttgttcgaacattaaatgatagtccaatctccgtagagattgcaaacgcaggccgggggaaggggatacttcgcgggtctattggcgtggttggtgcaaatcctgacagtgtgtttgaaatggttctcagtcgggataagcataagcgacacgagtgggatatgttgatttctgatttggagttggtggaaacaattgatgggtactgtgatgtggtttacgggacctatgagccaaaatatttaaactggtggaaatcaaagaaggattttgtcttctccagacaatggtttcgtggacatccgggggcatataacattttgcagagtcctgctagtcacaagcaaaaacctccaagacatgaatatgagcgtacacatatcaaccccacaacatgggaaataaagaggttaaacacatcagaatctactccgaagtgcattgttactcgcatggtggagatctccccatctttctgggacagatggaggagaaggacctcctcaaattttgagagaagtatcccttttgctctgctcagccaagtagcaggtctaagagaatactttgcagcaaatccagccatcacacctgattttccttcaacagtagtgaagtcaaaagtatctgaatccttgatcatccagagtgaacttgaatattcggaacctaatgatgagttctatgatgcacttgttagaggagaatcctttgaaggtgatagtgatgatgatgataatgatgatgatgatgttacaaccccgaaggctggaaaggtgaagttgaagaacgtatcatgggccattgcaggtttagctatgaagcgaactaaagcttcgcttgagaggagcgaattggttacaaattctattcccatagctattgacacgagccatttccatggcaccgttcgacaagcgaaaagtgaagatgacccaaattcttggagttcacctggtggagagaagtttatgataagagggaagacttacttgacagattacgccaagattgctggaggtgatcctcttctaaagcttattgcagttgattggttcaaggttaatgagcgctttgactcggttgccttgcacccaaaaagccttgttcagtctgaagctgcaaagaagattcccttcatactggttgtaaatttacaggttccagcaaaaccaaactataacttggttatgtactacgcagcagagaagccagtgaacaaagattctctcttgggtagattcattgatggaactgatgcatttcgagatgccagatttaagcttataccaagtattgttgagggttattggatggtaaagcgtgcagttgggacgagagcttgccttctggggaaagcagtgacatgcaattatcttcgacaggataactttctcgagatagatgttgacattggttcctcttctgttgcacggagcattattggcctagtcctgggatatgtgacaagtatcgttgtagatcttgctattctagttgaggcaaaggaagagaaagagctgcctgagtacattcttggcactgttcgtctaaaccgtgtaaatcctgaggctgctgtaccaatctaagttaattccatttcatcaccccttctatggcacggtagtagatctgcgcaattttctagcataatcttcagttctcggaggtgcacatttgtaagaaggaaaacatggtcactatgtaatgatcccaggtcgagagttgtatcacatcacatgtacatactagtacatacgtggtgcctatagtacacggaagaatactagaaatacttatattgacaggaagaagagtttattgcctgttggtccctatgacgcagagcaaatagacacggggaaaaggccggtttgtngaaaagnatttccaagaanttttccctttnaatattggccaaaataataattatcc

SEQ ID NO: 3196 - DNA, 792 bp, Triticum aestivum
  unsure (1)..(792): unsure at all n locations
  Clone ID: PAT_TA_3196
tttcgttcacgcgtccggaagacaatgcggttggctctcaaatcgacaggaaaaaagagggctgcacctgatgacgacgacgacgacgagattgagatggaccctgaaggccgtatgatcattcgcgaagaacgggaatggcgtaaaaagaaacccgtcgtctcgcatgaggaggaggctgatgacaagacctctgtcagaagccagtcggtgaagaggaggaaggtggccagcactggctggtcctacaccggccatgagtacaccagcaagaaggccggtggtgatctcaagaagaaagacaagatggagccgtatgcttactggcctttggatcgtaagctgctcaaccgcaggtcgngatcgcaagcagtccgcccggaagggcatggccagtgtcatgaagatggcgaaaaggtttgaggggaagagcgcttcgggtgccctcgcagccaagaggacacaaaaacacaagcagaagaagaacaagtgagtagacttgaggagacgaggctgtagggaatttttgtaactgtacagtgagggtttagctagcactagttgcgcttgtcgtggcgtatttatgctgctgccatttctctgggtttttcctgaaggaaaattttgactgcttctccgggctttttcttgacttaagtttcttgttcgcaagatataattttctgtatcttaggttttttgtacttccagattcagattgactgaacatgtgttgcaagtttttgattgattggtggaatgtaaaaatcttgcaattttgccaaaaaaaac

SEQ ID NO: 3197 - DNA, 1554 bp, Triticum aestivum
  Clone ID: PAT_TA_3197
taggactggtacttacgtcagatacagatcgtggtgggccgtatgcgctaggcgtgccgtggggccctctttgcggacaaagttcttatgagtgatattgtcttcatgcgagcatggatcaacgttgaagttcccacctactgtaatcttgtgaccacttctcttcaaccccgagatcagatgtggcaaggcatgagaaccagagacgtttccaaacaacgcctgtatatgcaatagaggatcgaaatggccggcaccgcatgctcaagtacacaccagagcatatgcattgctttgctatgttttgggggccactggctccaccaaaaagcggtgtactagcagtccagagtctttccagcaataaggtaccatttagaattactgcaactggttgggttcaggaattcaacaatactgcccgaattatgaagaagatcaagctcacaggcgcaccatgcaagatatttaagaaaactgccttaattaaaggggatgttcacaactgattttcacgaggctaggtttgaaggtgcagcaattcggacagtaagtggaatccgaggacaagttaagaaggcagcaaagatcgaaccaggagatgcgttaaggagaaaaggggaaattacggaaggcattgcaaggtgcacatttgaggacaaagttcttatgagtgacattgtcttcatgcgagcatgggtcaacgttgaagttcccacctactgtaatcttgtgaccacttctcttcaaccccgagatcagatgtggcaaggcatgagaaccactgctgagttgcggaaggcacacaacatacccattccacacaacaaagactcggtttacaagggtattgagcggaaagtgcggaagttcaacgccatagaggtccctagaaaactgcaacctttgcttccttttaaatcaaagccgaaggatagacctaagggcaagaaaggatcagctgtggacatgataccggagattatgaatattggcgagaagaagatacatggagctcttcaacagttgcatctgttaaagcatgaaaagacgaggaaggagaaaatcaagcgcgggctgcagaagaaagctcatgaggcgcagaaagccaagactgatgagataacgaggaagcggcagagggaagataggcgtgagagatacagggaagaagataagaaaaagaagcgcgcccgaaagtaggcgcggaagatacaaggggtctgtctctgcacgcgcgtttccatgacatagaagcaccagccagagcactgtctacccaagacatgttactccactggcacggctggcagcagacgactcatgaaacctctagtagcgatctagttggagatgcatgtgatattgctagtcacttcgcaaaaagttatgggcagtgacaccatgttcaccgataagcgtgtgcctccgtgaattttgtcacccttacgagtgactagctgggatcgtatgttgaattgtcaagttgagagagagaacagttggccaattttgttcttcaggttttgtaacggtggagctttgagagttgtt

SEQ ID NO: 3198 - DNA, 1013 bp, Triticum aestivum
  Clone ID: PAT_TA_3198
gcacgaggccgccccttgcccgccccggccccgaccccggccccgaccccgattcgctcctccgccgctgctccctcgtcgtccacctcgacgccgagctcgttcctccgcgggaaccactgccgagagcagctaaggaaaacctagaataggtggtgttatctggcttcgaattgctgtctagacatttcttgatcttcactcatcagaaacttaaagcatgagctcccatcgcgtgaagtggaatgaggacaatctgtatgagattgaatcaaacaagccagtgaggcagaagataaccgagcccaagacaccgtatcaccctatgatggatgaagatgggtcactatcaccaacacgccctttcgacaagtgtctagatgagactgttagtgctgaagctatattgactgctttaaatggtgtggcctcttcaagtaaaaatgattcaaaggatgatgagtgggcatcctcagatgatgatgcagatgccatggaacaggatggtgactcagaagctgacagatcatcagtgagtttcaaagagcatcgccgcaatcactacgatgaattccgcaaggtcaaggaactgatgcgcactggatccctggttgaagacgaggcccgtgcgaatgagcgagctgcaaacaacgtcgaggacaaaaccgcaggagagaaggcaacaggtgacaagagtgaatcgtcagcatcacctcaagtatgagccgcaaagtgaattctgtggtcgctaagcctagggaagttcaactaagcgggagcatgcagtttgcgcctgctctgtgtgtattgctggatccttgttttcataccagatcggatgattttctgtacgcaaagaacctgttcctctttcttattttgagatgttgcggtgcctaaaatggtggagaattctagttgaactagctacttcacgttcagtcaggaggctagaatttgcctgcgccgctttttataatactggaactgagttatatggacaacccttgagc

SEQ ID NO: 3199 - DNA, 509 bp, Triticum aestivum
  Clone ID: PAT_TA_3199
aatgagtagcatggatggcatcataaacacggtgtctgcaaacatccccatggcccttttttggggctactaaaacccaacggcaagatgatcatggttggtctcccagagaagcctatggagatctctccctttgctttggttgccacgaacaagaccctggccgggagcctcattggcggcatgagggacacccaggagatgcttgacctcgctgccaagcactgcgtgacggcggacatcgaagtgatcggccccgagtacgtgaacacggccatggagcgccttgccaaggctgatgtcaggtatcgatttgtcatcgacatcggcaacaccctcgacaagaccgccgccgccaccactgagtgactctacctctctgctcttgtcttgtccgcaatagcaagaaacaatctaaaattatttttgggtgtgaaagtgtaaaccctcgtgtacgcgatgccatatttatttcttctaataataaagcggctgtcgtttctggtcgt

SEQ ID NO: 3200 - DNA, 1427 bp, Triticum aestivum
  Clone ID: PAT_TA_3200
ccccctccggcgccgtggcagccaccacaacacaacggaaacgcaccaccgcaaccaaaacacccggggaatttccctaggaacttccggtccggccggccgtcacgccggcgcccacggcggcggcggcggagcagagccagcagcacacgaagaaggcggtgggcctggcggcgctcgacgcctccggccacctctccccgctcgccatcacccgaaggagcaccggagacgacgatgtcgtgataaagattctgtactgcgggatctgccactctgacctgcacagcatcaagaacgactggaagaacgccaagtaccccatgatacccgggcacgagagtccccggggggggccccggggtcggcaagaactggaccaagttcaaggccggcgaccggttcggggttgggtgcatggtgaactcctgccagtcctggcgaggctgcgacaagggcttccgagaaccactgcccgggcataatccccaccaccgcgacggcaccctcacctacggcggctactccagcatggtggtggtgcacgagcgcttcgtggtccggttcccggacgccatgccgctggacaagggcgcgcccctgctgtgcgccggcatcaccgtgtacacccccatgaagtaccacgggctgaacgctcccgggatgcacctcggcgtgctgggcctgggcgggctcggtcacgtcgccgtcaagttcggcaaggccttcgggatgaaggtgacggtgatcagctcatcgccggggaagaagcaggaggccctcgagaggctaggcgccgacggcttcgttgtcagcaagaacgccgacgagatgaaggctgcgatgagcaccatggatggcatcataaacacggtgtctgcaaacatccccatggcccctctcttcgggctactcaagcccaacggcaagatggatcatggtcggcctcccagagaagcctatcggagatccccccctttgctctggttgccaagaacaagaccctggccgggagcttcatcggcggcatgagggacacccaggagatgctggacctcgcggcgaagcatggcgtgacggcggacatcgaggtgattggcgccgcggccatggagcgccttgccaaggccgacgtcaggtatcgattcgtcatccgacatcgccaacacactcgacaaagccgccgccgccccgccgacaaccgagtgaccgccggatgtagctctcggcactgctcacggtcgacattggtctctggttctctgctattatcacatactttatctctcagcagtaacaatagacagtcctaaatttattgtcagtgtttgtattttgtgaacgaattctttacatgaaatctatcgcgcgacgaagtccgacgatggctcgcgacgccgccgccgcgcccgcgctaaaaaaaaaaa

SEQ ID NO: 3201 - DNA, 719 bp, Triticum aestivum
  Clone ID: PAT_TA_3201
gcggcgattcacaccgccttatcgcttctggagatcgctgcaagattgatatttggccgggtggcatgtcgtcgtcgatgtacccaaagcgccgttcggccgtgactgcgtgcagcatcaagctcccctcgggcctgactgcgtgcagcagcaagcgccctcgactcatagctgccgccgccatctcatatccatcttcgtgggcgtctcttcaggcagatttagttcgcctgatcgggtggagggtgttggcgagcgacttgagggactatgtccgcttccgcgccgtttgcccccactggcggtctagctccgtctgcccacgcggccgtggtgttgtcgacccgcgctttcacccgcgccggtggatgatgctgcccgagggccacggcctgtatcctggccacggcaggctacatgggtacatccgctttatcaacctctccactggcgccatcgtccgttgcctgctcccgcttttcagagatcactgcatcctcgactcggtcgatggtctcctcctcttgcaacgggacgaagacaccgccatccgcctcctccacccattcactggagacattgcagagctgccgccacttgcgaccctcatgcgtcttcctggagccaagaaaaatgttgaaatggtctggacgtatcttagaaacatcggtgccacgtctgtcagtgttagtgcagctggagtcatcacttgcatgatt

SEQ ID NO: 3202 - DNA, 1131 bp, Triticum aestivum
  Clone ID: PAT_TA_3202
gcctgcggtaccggtccggaatcccgggtcgacccacgcgtccgcgatccaccaccgccgccgcacagaccacaacatctcgagtagtttccagctcgccggaaagcagcaagcaagatggccggcaggaagggcggcgacaggaagaaggcggtgacccgctccgtgaaggccgggctccagttccccgtcggccgcatcgggcgctacctcaagaagggccgctacgcccagcgcgtcggctccggcgccccccgccacctcgccgccgcccccgtgtgcctcgcccccgtggcccgggcgcgcccccgcctcgcgcccgcgcgctaccgcttggcccgcagcgtcccgcgccgcccccgcctcgccgtcccccccgccccccaccgcggctggctgcgccccggccggtccggcccccccgcccgcgggcgcccctgccgcggcgccgtgctgtcaagtctactccgagcgaaagtttgcccggctcttgccggccggcggtggcggcacctacgggcgtcgtttcccttcttgaaggcgccgtcgtggagtttcttcgacacgcttcattctcggatctggttctttgggcgaaagcctagacccatctgggttgggcaacgacgtcgcccccgcggcgtttccccctttggggcgttgctttgaagaccgatgatccttctccacgcttcccttgggctggacatacacggcatcacgttggcaggtggccaaccgatgatgcgaggtgggtgtggtgttgtgatgtgtgtggtgacgacgatggtggcgagcagagctgggtcgcggcttgtccttctgatgtcgaaggtccggtgcgccaatggatgtgcctatgctgatttctggctgtgacagagaagtcggagctgcgggcggcagggccactgcggcaatgatgactccatgagggcggttttcagtggacggtgctctcccgatgttgcgttggactaggtcgatgcgaatcttgcaactttctcctgtgaaactcgtcagcaaaatcggagctgtcctgtcatcgacgctttggtcgactgtttggcgtttgtggccaagtcgtccacgaatgccccatgtggggtttgtaatacttggttttcgccc

SEQ ID NO: 3203 - DNA, 632 bp, Triticum aestivum
  unsure (1)..(632): unsure at all n locations
  Clone ID: PAT_TA_3203
tttcttggacccggcatggcctcacctgcaggttgtcttcgaactgttcttaagatttgttcagtctccagagacagatgctaagatggccaagagatatgttgatcagggtttcattctcaggctgctagatctcttcgactcagaggatcctagggaaagggagtatttgaagacaatacttcacaggatatatgggaagttcatggtgcaccgtccattcatcaggaaggcaattaacaatatattctacaggtttatatttgagacagaaaagcattatgggattgcagagctgttagagattctgggcagtataatcaatggttttgctttgccactcaaggaagagcataaatcgtttctagtccgcgcgctgattccactccacaaaccaaaatgcgttagcatgtaccatcagcaactgtcatactgtgtcaccaattccgttgagaaagatgcaagcttgctggataccgttataaggggtctacttaantatgggcaaccacaaatactcaaaggaggtgatgtttttgggcgagttagaggaantattggnantactcaatccagcaagattcccagagattatggtgccacttttcccgacagattgcccgctgtttaaa

SEQ ID NO: 3204 - DNA, 1233 bp, Triticum aestivum
  unsure (1)..(1233): unsure at all n locations
  Clone ID: PAT_TA_3204
aagagattngctgcggcagcttctgtaaagggagctctgcatgggcaaacccttacgaggtctggcctacgtcttgcaacccatggggaacttactagactatcgggtttagtggccaatttgatcacagctggccatggacgtgaagcagcatttgcagctgcagttctgggtgataatgccctcatggagaaagcatggcaagacacaggaatgctggctgaggccgttttacatgctcaagcccatggtcgtccatcattaaggagctcagtcataacatggaacaagatgctacaaaaggagctggatcacacaccaaccgtaaaaaccgatgctgcagcagcgttcttggcttctcttgaggacccgaagctcactagtttgggagaaactgagaaaaagccaccaattgaaatactgcctcctggaatgccgcctctatctgcacctcccatcattattaaaaaggctgctgcaaaacctgggcttcctaatgccgcacagaccccaactgcaggtgctcctatgaatcaaggcaccccaatggctcaaggtacccccatgaatcaaagccccccttggccccgaggccctcccctggcgcgccccgcccccatggctcaagcccctcctgctccggcacagagcaccgatgaggtaaagccatcagaggctacaacagctcctgacaatgttgaggctacagcagctacancaatgccgaagctactgcagcccctggtactgcggaagctacagaagctccggttccagacccaacaagtagcagtcctgacgctgctgatgctcccgccccagctcctgccccagcagctgattccagtggcactgatgcacttgctgttactcccagtgattctacaaatgatgcaccttcttccaaggaaccagagacacaggataaaccaccttcaacagaggcgtcgccatcacctccacccagtatttctgctgtataaaaatatttctgattcaagttctcatagcaagtgtgccattttttttatgtgtgctgattcctttgtcccactgcaattttttccattggtatagatattcgtcatatgtagtgctcaaaagacgacgagcagcatgtgagtagccatgtacatctgctgttctcgtcaggaagagaactataccgcgactgcagccgtagccaagccttttgtgattggcaaatcatgttgtttgggattgtccanatac

SEQ ID NO: 3205 - DNA, 732 bp, Triticum aestivum
  unsure (1)..(732): unsure at all n locations
  Clone ID: PAT_TA_3205
aggctgacgcgggctctgctcgctgatccgatgattcatgataactcgacggatcgcacggcnttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgcgctcgcgggccggcccagcttgcgcgcgccggcgcggccctggggccgcgtcggccgctccgccccccgccgcgcgcccgccccctccgcccgcccgccgccggcccccgccgccccctaggtcgccggggcgtggtccccgccgccgtccgcggcggcctcctgggggctcgggctggccagcaccggcggcgccttcgccctctgatctgcacggacggacggagcaagacggcttgcccgcttcaagagatcgtttgtagagcacttttaaatgtattctttgcgtaaaaattcgagtagggaaagaaagaaggaaggaagattgagatcatagtaagccctt

SEQ ID NO: 3206 - DNA, 965 bp, Triticum aestivum
  Clone ID: PAT_TA_3206
ccccccaccccgtgcggtcgcccctcctcccgtccttctgccgcttccccatctccctccccgtcaccggcggcggcgccctccttccctcccgctgcacccaaacctcccgcccgctcccaccttttcttccccctaggccccccctaggctttcgctccccgctccccactccccccgccctccactccgcccttgccgccaccagctccggtgcccgatcctgctgacctcgggcggccagcgtcgccccctggccggcaagtcccggccacgccggtgcgctccgtccggtgctgtccctggcgtggcgcctctgtgcccggcgcgatcccactgctttgcgtggtcgctacttcggcgctcataccctcacctcgctgcggtgctggccggaccacaacagtgatgttgttcagcatgtgcctggggtactaccctcctaccgtggtgaactcgaaccacctggagtcggagaactccatgttcagcatcatagaggtagagggcattatggtgactgcttaaggctgagaccgctgttttctgtgtggtggatgttaatggggtggagccgtgcctccccgcgcttgccctggtctccgcagtggtgcttcggcggcttccagaccctctcctcgatgtggtgatggtcacaccacagccgtgttgtggctgagcctctgctacggttagcaccttcctctggttgaaggcgctaaggtgttggagacgtgcatgtactagttgagcgttttatctgtagagtgctatactgtgattggtgtaatattatatggttatattgtgattggtggaatgtaataaacttgattggtacatcggtgatttggatgatatttgaatatatttaaaatgtgttcaaaaattgaagaaaacaactaaaccgagatgtcagaactaacggaaaaaaaagaagaactaaaactgggtgtccgatatat

SEQ ID NO: 3207 - DNA, 710 bp, Triticum aestivum
  Clone ID: PAT_TA_3207
aatgactagcaaatacacacaagaaatgcaaacgattgacgagcttctgaatgaaaggaatgtaatccatgcatcctataccaacaatccacctctaaaacggacttcaagcaggaataaatctaaatcttcaccttctttcaaatttgatgaagaaaaaaaccagaggaaagaaaagaaagtgaaggatcagcacatggagggctgcggaagtgaagatgatgactcgagtgaaaagaaaaccaaagagcggtccgcaaggaagagatggctaaacattcctttcaaagttgacaggagaaagccatgctgaccataatggtaagcgtacaagtgaaatacaaactattttcattttgactgccccagaagaactccttcgccgttacctctttccttagtgttgtctactatatttcctgcaaagattgggtgcaaccctgagttcatatgatgtatggctacgaggcacgagcactcgtagcttctaaggtcccctgctgccaccgtagtccagttccatattctttcgagtgtgataatgtcaattttgatttcattggctgtgtaatcagttgtaaatattagttatctcgtctctgttgcacattgtctctttccccgccttggactcctgatgtgtattaaccgaacaaatattcccgccctagaatcacttgtattacagggaaaaaaatataaaagggggg

SEQ ID NO: 3208 - DNA, 977 bp, Triticum aestivum
  Clone ID: PAT_TA_3208
cggacgcgtgggtaacctgctaccagtctctcgtctctccccctttctttctccgtggacacagcggcgacccgcaacagcgcccaaccacctgcggcgcgacctagccggcgagcggcggcaccacaggtccggcgaggggcggcgttcaggtcgtcaaccatggttttccttcaggaagagatgtcttggaacgtgctgatctcaccggaccagctgagccccaagggcctgctgctccgcaagtccatcatcgtgcgtcttctggaggacgtcaccaacaggaaggcctccaaggagcatggctactacattgctgtaaacgagctgaagacaatctctgaagggaaggttcgtgagctgaccggagacgttcttttcccggtcacattcacctgcatcacccagaggcctatgaagggggagatcttggtcggctccgtggagaagatcctcaagcacggtgtcttcctcaaatcggggccgattgaaagcatcttcctgtcggagaaatcgatgagcgactacaagtacatgggcggcgagaaccccatgttcatgaatgaccactcgaagctggagagggacaccgctgtgcgcttcaaggtcatggggttccgctggatggaggcagaccgccagttccagctccttgcgtcgctggctggtgatttcctcgggccgctgtgagctgctccggagatgctaaacctggcccctgctgtacattttgttatcctggtggtggtggatgaactttgctgttgtgatggccggtggcacatggttgccgtgacttttcgcagtgtcttgaactcatcagtgtagtgtgatgcaggctatagggtgtgatgacaatgggatttaactccatgtcttgaactcatcagtgtagtgtgaattatgacgagcctgcgtttgaacatttcacttttaacctggatgcatgtgtttgtggccttctactccctccgttc

SEQ ID NO: 3209 - DNA, 663 bp, Triticum aestivum
  Clone ID: PAT_TA_3209
cggacgcgtgggattcaggaaaacaatggccggagccaatccgagcaatgcaccgggagcaacaccatgagccgcgcgctcctttcccacatcctccaccgcccgcctctcctcgcgtcgaggagtggcgtccgaggaggagcgctgccttcccgcctccgcgctctccgcctcaactgcagcgcggctgaagccaccgcctcggccgatgaggcgcctgctcccccggtgaggaagaaaagagtagtttctggggtacagccaacaggaatggtgcaccttggaaattatattggcgctattaagaactgggttgcacttcaggatttgtatgagacattctttttcattgtggacctgcatgcgattactttgccatatgatgcaccagagctatctaaagctacaagaagcaccgctgcaatttatctagcatgcggcattgatagctccaaggcttctatttttgtacagtctcatgtccgtgcccatattgagctgatgtggctgctgagttcttcaactcctattggttggctgaataaaatgattcaattcaaagagaaatcacgcaaggcgggtaatgaaaatgttggagtggcacttttgacgtaccctgttctaatggcttctgacattcttctgtaccagtctgatttggta

SEQ ID NO: 3210 - DNA, 653 bp, Triticum aestivum
  unsure (1)..(653): unsure at all n locations
  Clone ID: PAT_TA_3210
gcacgagggtcaaccaaaactgcactatcggctcgagtccggtcgggtcaccgaaaggtgcgcctggaggaaacaagcgccttaataactctccaaggagtgttggaagcccaagacgtgggtctgctgagaagaacattcctgggctagaacatgtagacgaggcaaggaggaaggctatactgcgggagctgaggaagatgaaggccgcaggcaggtgaagctcccagagaggtatcgtttgaaccatttccgaaccttcagtgcaagtcaagttttcgatgctactcgacaagtttgaactctggattgcttcccagccagagaagatgactgacagccgaattgttgtgcctcatctgtttcaagttcatcagttgacaagcctgcttatcgtagccctgtttctctatagagcctcgaattcctgattgggtacacctggaatctgaagtacttcatccacaacaagggttaagctgggtgtaacagtattagcgtagcctgtagactctagtggacattaggactgttgttgccatgttcttgtacatcctgatgggtagccatgttgagagaacctgatgcgaaccgtggtgggttgtanctgtaaaangcgngaattnaanttgntcctcattaaaaaaaaaaaa

SEQ ID NO: 3211 - DNA, 503 bp, Triticum aestivum
  Clone ID: PAT_TA_3211
gcaaccgagagatacggaatctggttgagagagtcaggctactgatcttggaactggcaaaggccaacgtgaacgagaatggagctgagaatgcggccactcataacggtcttctgcgtgcgatcgtcaacggcgcccatggcgctggccatggtggcactgccggggacttcatcgttggcaactgtaagaccatatacttcgcagggcatgagaccacggcggtcaccgccatttggtgcctgatgttactggccaaacacccggaatggcaggagcgtgcccgcatcgaggcgctggaggtttgccatgggaggagcacgttggacgttgacgccctccaccgactgaaaattctgacgatggtgatccaagaaactctccgtctgtacccaccggcgtcgctgatgatgcgtgaagccctgacggacataaagatcggcgacctggatgtgccccgcggaacgatcgtccaggtgaccagatcgatgctgcacctggac

SEQ ID NO: 3212 - DNA, 425 bp, Triticum aestivum
  Clone ID: PAT_TA_3212
gccagaactaaagcgacaaattgaccatgatttgttgtgtgtaaatgctcatatcccattaagttcatgtgtataaatcaagtgggttgaagtgtgctgtgaatttcctaaagaattttacttgagatattatatgcatggtgtggattgttgagtttgcgggctccttcaggtattcaagggaaaaacataatatgtttaactaattttctatattgcttatttatgcatttgtgaccatagctttccactttagctcataaactggatggcaaaatagagtttgttttatagctgatgcttaatatgttttattgactggtgaatgctcaactttagcttataaactggatggcaaatgctaattctgatggggcttttgccacttattgatttatggttgtgtagacagctgatggcatgct

SEQ ID NO: 3213 - DNA, 729 bp, Triticum aestivum
  Clone ID: PAT_TA_3213
ttcgtagctcgacccaacaggaagctcaactgacccaagagatagctagctaccaaaccagcgatggtgctcctcgtccctggcgagtttgatcgagcggacggcctctcctcccctcggtgcgggtgggtgaacgggcccatcgtactcagcgccgggccggcgggcatcgtcgtggccgacatgctccgggagcagggcgtgcccttcgtcggcctagagcgcgacgactgcaactgcatcggctccctctggcagaggcgcgtttgcgaccgcgctccgactgcacctccaagcagttctgccaccgccgccagctttccgagcacctcgagatctgccccaccaagctcgacatggagcaggagctccgcggcgggagatcggcggcaccgtcgtgcgccccgccgtggccagctcctcgggggccggccggtcgctcgtcgtcgcggccgccgcgtgcgggacgtccctggccaggcatgctctggggacgctgtgatcgagatccacggcagcgagggccggcccggcgatcgagccgccaggcgtaaagcgcgtgctctgcaaaagcggatgcttccacctaatattccccactaagaagcttttgtctcggaaccagtactattactatatctgcattgtttagaatgttgagccatgaataatgtcgggtccctaagctgaataaaattctagctttctttgatttaaaaaaaaaaaaaa

SEQ ID NO: 3214 - DNA, 631 bp, Triticum aestivum
  Clone ID: PAT_TA_3214
gggtggtgctgctggagctgctgacggggcgcaagtcgctggacaggtcgagaccggtgagggagcagacgctgacggactgggccttcccgctgctggcgcacaggaagaaggtgctgggcatcgtcgaccccaggctcgccgccgacgactaccccgtcaaggccgtgcacaagacggccatgctcgcctaccactgcctcaagtccgcaaccccaaggccaggccgctcatgcgcgacatccgtcgccaccctctgagccccggcaagcagcagccgcagccgcagccggggcggggggggggggtgagcccggccaccgcctccgcgggccgcgtcggcgtcggggttcggtgatctgtctgacgtttcctctcgccgccgttcgttgctgctgttactgatgcttgtgcgaattgtattgtagcagctacacagctagtgacagtgctctcttggtctgcacactatgcaaagggtctttctctctctgcttcccacgaattcttcgggaatttcacaacttgcagaatcgagagactctcgcggatcaaaatgggcctaagaatttagagacagagaaatataatacttcctctgtaaattaatattagtggcctaccacgtctt

SEQ ID NO: 3215 - DNA, 510 bp, Triticum aestivum
  unsure (1)..(510): unsure at all n locations
  Clone ID: PAT_TA_3215
ccccgcccccgctccgccgcatctcccccgcttccccccctaaacccccgccgccgaccgcatagtcatccaggttccgggctccagctcagccgccacaccgccgcatctccaccgcttccccccctaaacccccgccgccgaccatggcgtcctcctccgctaaaccctactgctgctcctccctaaaccccgccccctccacccccctcgccaggcgcgctgccctctccgtcctccccgccgccaagccccgccgcttctcccatggcctcgccgccgtcgccgcgaaccctagggcctcccgctccgccgtactccgccccgtccgtgcgtgcctggcggcaccgcggccggccggagtacgtaccggaccgaactcgacgaccccaactacgttcgcaatcttcgaccaccacggctcccgcgaccggggcagcaatcccccggggggcaccatgaacaagcgcgggaaaagctcgtcgtcgngcggccaagttcgncccgcct

SEQ ID NO: 3216 - DNA, 1130 bp, Triticum aestivum
  Clone ID: PAT_TA_3216
ccaccccccccccatcgagcaacgatcaactgaggagtagagggagtgaccagcgacgatgccgggagccgtgaaggtgttcgggtcgccgacgtcgtcggaggtcgcccgcgtcctggcctgcctcttcgagaaggatgtcgagttccagctcatccgcgtcgactccttccgcggccccaaccgcatgccccagtacctcaagctgcagccgcacggcgaggcgctcaccttcgaggacggcaacgtcaccctcgtcgagtcgaggaagatcctgaggcacatcgccgacaagtacaagaggcaggggaacctggacctgatcgggacgggggcgctggagcgctcctccatcgagcagtggctgcagacggaggcgcagagtttcgacgtgcccagcgccgacatgatctacagcctcgcctacctgccacgcaccatgccgctcgacaggaggaatgacgccggcgccggcgccggcaggcagcagaagcagcagcgggacatgatgatgagcccgtcccacatgcagaaggtggaggagatgaagcagctgttcgagaagagcagcagggatctgagcaaggtgctggacatctacgaccagcggcttgaggaggcggagtacctcgccggcgacaagttcaccctcgccgacctctcccacatgcccaacgccgaccgcctcgcctccgacgagcgctccgcccgcctcatccagtcccgcaggaacgtgaggccgctggtgggccgacgtctcgagccgcgagtcctgggtgtacgtcaagagcctgcagcgcccgccgtccgccgaggcgccattctgatctccatgcacggtcgccgtccgtctcctcgcggcgcacggccgccgctccgcgagaaggtgtcgcccactgccccaccagatacactattatccgtggcatttccgttcccgcgcttcacagtttggattggtttctttgccctgtaatgtgttttcgttgtttctgaataatctcgtatgcgttgtgttcttcatcggcatgggtgtttcgcccttgccttcctgttgctacggtcgaaagatcatttaaatcgtgtaataataagtgtaataaaatgctttcccctgcaaaaaaaaaaaa

SEQ ID NO: 3217 - DNA, 1065 bp, Triticum aestivum
  Clone ID: PAT_TA_3217
acaccgaagctcacatttttcctcggcgcctccccggaacccgctcgacatctgctttcccctttgccattcgtgcgactcgtgagagcagctaagctaacccgagagcgatggacgccgtggagttgtcctggggcgcgcggtgcgccgggctggccttcttcgtcctgtccgtcctcgtggtggcgctcgccgcggtgctcctgctcgtgcgccggtggccgtggtgcagctgccatgtctgccggacgtacctcacgggctcctgggccaaggacttcaccaacctcggcgactggtacgcgcacctgctgcgcgagtcgcccacgggcaccgtccacatccacgtcctcggctgcaccgtcaccgccaacccggccaacgtcgagtacatgctcaagaccaacttcgaaaacttccccaagggcaagcgcttctccgcgctcctcggcgacctcctcggcggcggcatcttcaacgtcgacggcgacgcgtggcgccaccagcgcaagatggccagcctcgagctcggcagcgtcaccgtgcgctcctacgcctacaagatcgtcgcccatgaggtggagacccgcctcttgcccgtcctcaccgacgcagccgacaagggcaaggtggtcgacctccaggacgtgttccgccggttcgccttcgacaccatctgcaagatctccttcggcttggacccgggctgcctcgacctcgacatgcccatgtcggacctggcgaacgcgttcgacaccgtctcgcgcctctccgccatgcggggcgcggcggcttcgccgttggtgtggaagatgaagcggatgctcaacattgggtccgagagggagctcaagaaggccatcaagctcgtcgacgacctcgcgtcggcgatgattctacagcggcggaagctgggttttgaaaatagccatgacctcctctcccggttcatggcctcggacggagacgtgcatgccatggacgacaagtaccttcgcgacatcgtggtcagcttcctcctcgccgggcgtgacacggtggccttcgcgctgaccacgctctttc

SEQ ID NO: 3218 - DNA, 976 bp, Triticum aestivum
  unsure (1)..(976): unsure at all n locations
  Clone ID: PAT_TA_3218
ggtccagatcgcgaggccggcgcgcagcctggaggactcccctcctccgaccccggcgccgtcgtcacttcgtccctccccgcacaaggaaaaatcagaggcggatctcgatcgcccctaccagacagcactcttcgctcgcggggtaccatgcctttcgcaatcatctgagtagtagaatggcctcgaaagctataaggaggaggcctaccgagaaagaaagagagagacatatggaaacaacaatgccggaatctgtcacagcacctcttctaggaaatagtgcccaggggaataaatcggaggggtatgagcctataccggatttctgggatggaaaatcacgcgagtgccttcattgggtgcatattgtatctacttttattactcagtctgcaagaaagatagtaaatgctatttcggagtttggttcgttcctagcaaggttctttggttgctcccgtgctccccaaagttcacaaaatgcacagacaatgctaattcacctcagtccattacaggaggagagattaaaattcttgagacaaagattaaatgtgccatttgattgttccgctgtcaagcaccaggatgcactaaaagaactttggagattggcttatcctaaccggagaactcctcctcctggaaaccagttctatggaaggaaatggggctggcagaacccggacccaacaacagntttaaggccngggggatcaattccttggggaaacctaatatatttgcaagaattnaccagttcctttcatccggtattacacaagggaatggtgagagaactgaatgggaaacctttgcagtaaccggcgtaaaaactaaatgtaaccaaagcgggttacatcagaatagaggnggcaaaccaaatggttgccaacactganatacaaaggttcanaccttcgccacttcaagccagcctggctgggcgtcagtttacagtttgtcgatccct

SEQ ID NO: 3219 - DNA, 1222 bp, Triticum aestivum
  unsure (1)..(1222): unsure at all n locations
  Clone ID: PAT_TA_3219
gccgcgcggcgccgcctcccccccccccgccaggcgccgcgccaccagccgctccgcccagccgcagcgcgacgaggtgatccgccggaacggtctacgtctccgacatcgatcatcaggtcaccgaagagcaactggcagcactatttatcaacgtagggcaggttgtggactgccgcatgtgtggggatccaaattcagttcttcgttttgctttcatagagtttactgatgaggagggtgcaagggctgctctaaatctgtcaggaactgtgcttggatattatcctgtgagggttctgccatcaaaaactgcaattgcaccagtcaatccaacgttcctgcccaggtctgatgatgagcgtgagatgtgtgcaaggaccatctactgcacaaacatcgacaagaaggtctctcaggcagatgtgaaactgttcttcgagtcaatatgtggagaggtctatcggctgaggttgcttggggactaccagcataatactcgcattgcctttgtggagtttgttatggctgaaagtgctacagctgctctcaactgcagtggtgttatactgggttccctgccaataagggtgagtccatctaagactcccgttcgtccccgtgctcctcggccaatgatactagagttgtaggtacaggaggtgccaatggcactgcttatatatagagagatcgacatatgtgaaagagaaattaagatatgtcttttcttctaagttatccgctcgagtgtctttttattgtatcgccggtaagtatcaagactcgagcggaggaggggaaaggaaaaattagaaatggttggtcggtgtttaccttttgcacatagagcttcttagaagcgggcctgttgctcttgtccttgatgcagcaaggcgaaactcgtggacttttgtctttgttcagttgttggtgtcttgtttgctactacctggaaagttgcagcaagtcgtttacctgaaaaaaaaaaaaaaaaaaaaaaaaaaaaaaaaaaaaaaaaaaaaaaaaaaaaaaaaaaaaaaaaaannnnnggggggggccccngccccnanttccccntnnnggggggtattnnaaaaatnnggggccnnnttttaaanancnnngnnnnggaaaacccnnggntnncccnanttaaannccttnggaaaaaaaacccnttttnccnnggnggtanantnnaaaangggccccccccnaa

SEQ ID NO: 3220 - DNA, 1100 bp, Triticum aestivum
  Clone ID: PAT_TA_3220
tcagtgtgatctcgtgaaggtctcgtggctgccagacttctatgcgatcccgcctgaaattcagattgctggatcccacgcgtcccagcaagggaagatctatgggattgatgcagcttctggagctgccatcttagcactcgatgttcaaccaggagaccatgttcttgacctctgtgctgcaccaggtgcaaagctttgcatgcttgcagatatgcttggtagctcaggttctttgactggtgttgatgttgcaaagcaccgtcttgcagcctgtcgtacgatgttgcagaagtattctcttggagatcgtagtcggctctttgttgctgatgggacttcgttttccatattgcctgtgaactccaatctggggagcatggaagcttttgttggaattgaggataatggaagcatattctcagaatggacttcaaagagatcatggaaagacagacagaagtctaaaaaggcaaaagcagccggttcacctcatctaccatcaacttccgaacctgaactgatatactatggcaaagattcaggattaattggattgcaaaaacgttatgttcttcacccatcaactgatgctgctgcctgtacatctgggtatgataaggtcctagtggatgcagaatgtactcatgatggatcgataaaacacattcagaagtttgagttctggggatggaaaacattagaccgccgtgtactcaacgtagaaagaactggcaacctacttcatcttcagttagggcttctcacaaatggttttaaattattgaaaacaggcggatcacttgtctatagtacttgcagcttgactgttgcacaaaacgagaatgtggttcagcaattcctctcaaaacatccttcagcagagctgctaaagatcaatccagccgatagctggccctgcagaagcggcggcatccagaaaaccttgcggttcgatcccgcgacgtcacaaactagtggacttttcgtcgccaagttcgtcaagttgcgatgttctttatgagatgctcgcaacttcgtataagttaatttcatatgaaaccaggatgtcgcgagtcaaatttgctaggtttactcta

SEQ ID NO: 3221 - DNA, 3012 bp, Triticum aestivum
  unsure (1)..(3012): unsure at all n locations
  Clone ID: PAT_TA_3221
cccacgcgtccgcacaccaccacacaccatttcttcccccctttgcctctcgcctcgtctcccccgcagacctcctcagccggcctaccctccctccctcccgccgcctcctcctctaaaagcccgggtcaaactcccccggccagcgagggagacggcggagagagagggagaggggagaggctctcggatccgagctgctccctcccgcgcccgcccagatctcctgcgcagcccagcacccgacgccccggatctgcgcctgtcgcaaagatctacaagcgaccggccggcagcttgccgccgctggtggttggttcgttggtgaggaggaggattaggcggcggagatgtcgtccagcacgatccggaaggcgctgggcgccgtcaaggaccagaccagcatcgggctcgccaaggtcaccagcaacatcgcgccggagctcgacgtgctcatcgtcaagaccaccagccacgacgacgagccggccgaggagcgccacatccgcgagatcctccacctcacctncggatcccgcggacgcgtgggcgggtccttggccgtatgcaccacctgcagcagctgcttgacaggttccttgcctgccgccccacaggtggcgcgaagcagagcaggatggtgctggttgcactgtatcagatggcgagggagagcttccagctctacgccgatatctgcgaggtacttgcggtgctgctggacaggttcttggacatggaatatgctgattgtgtcaaggcctttgaggcatatgccagtgcggcaaagcagattgatgagctttgctcattttatgcttggtgtaaggacaccggggtagcgagatcatcggagtacccagaaggtgcagcgggtcactgataagttactggagacactggaggagtttatgagggaccgggcaaagcgccccaagagcccaccacaggagcctgagccggagcctgtcaaggaggaagagccagagccggacatgaacagcatcaaggcgcttcctgcaccagcggactacaaggagcctgaacctgagaaggtggaggaagaggtgaagccagagcccccgccgcagccccagggtgatctggatggatcttagagaagacactgtgagtgcagacgagcaaggtaataggcttgctctggccctcttccaaggaccacctgctgctggtggtagcaatgggtcatgggaggccttcccttccaatggtggcaacgaagtgacttctgcgtggcagaatcctgcggctgagcccggtaaggccgattgggaactcgcccttgtggagacggctagcaacttgtccaagcagaaggctgtaatgacaggtggtatggataatctgctactgaatggtatgtacgaccaaggtgttgtgcgtcagcatgtcaacgcacaggcgacaagtgggagctccagcagtgttgccctacctgcgcctggacagaagacacagatgctggctcttccagctccagacggttcgatgcagaacgttggtggagatcctttcgcggcatcccttacctttgcaccaccatcctatgtgcagatggctgagatggagaagaagcagcagttcttgacacaggagcagatgatgtggcagcagtaccaacgggacggcatgcaggggccgtcgagcttggccaagctcgatcggacctacaacaacggcttcggctcaaacccagccatgccatacgggatgccaaacgcgccaatggcgaatacagggtattactaccccacttactgagctattctttgttcaaatccttacagttgctgtgaattttgttctgtatttgtggtcttactcctcggggctgtgtccagcatcagttgttgtgtcccctgtctctggatcaaaccttttggtctcttatatatatgtaattctatttgtttggaaccaaaaaaaagagccacaagagtcctatacgggagtctgagcctgagccggtcaaggaggaagagccagagccggacatgaacagcatcaaggcgcttcctgcaccagaggactacaaggagcctgaacctgagaaggtggaggaagaggtgaagccagagcccccgccgcagccccagggtgatctggtggatcttagagaagacactgtgagtgcagatgagcaaggcaataggcttgctctggccctcttccaagggccacctgctgctggtggtagcaatgggtcatgggaggccttcccttccaatggtggcaacgaagtgacttctgcgtggcagaatcctgcggctgagcccggtaaggctgattgggaactcgcccttgtggagacggctagcaacttgtccaagcagaaggctgtaatgacaggtggtatggataatctgctactgaatggtatgtacgaccaaggtgttgtgcgtcagcatgtcaacgcacaggcgactagtgggagctccagcagtgttgccctacctgcgcctggacagaagacacagatgctggctcttccggcaccagacggttcgatgcagaacgttggtggggatccttttgcggcatcccttacctttgcaccaccatcctatgtgcagatggccgagatggagaagaagcagcagttcttgacacaggagcagatgatgtggcagcagtaccaacgggacggcatgcaggggccgtcgagcttggccaagctcgatcggacctacaacaatggcttcggcccaaacccagccatgccatacgggatgccaaacgcgccaatggcgaatacagggtattactaccccacttactgagctattctttgttcatccttacagttgctgtgaattttgttctgtatttgtgatcttactcctcggggctgtgtccagcatcagttgttgtgtcctctgtctctggatcaaaccttttggtctcttatatatatatgtaattctatttgtttggaaccaaatgcggcatctacgggttggttatagttgaatacanaanaaaagggggggc

SEQ ID NO: 3222 - DNA, 1423 bp, Triticum aestivum
  Clone ID: PAT_TA_3222
ccccgcctctccgccccactccctcccgggtcccccccccgaccactccgaccccccccccctatactcaacgccgtcgccccctccccccccgcaccccccgccgccccggcccggtggctccaccgactcccaggaccactcccaccacccccagggccgccagcccacgctgtgggccggcgggttcggcaagtgccccgacgcgccctgggactcgccggactcgacgtgcaccatgaggaaatcttcagcgaggacctgtcggcagaagtgccgcgggccggcttgcccgctggctccctccggctgctgctgtccgtggtgcaggcgtcggcccagaagcagagcctgccgggctcgggtccctgtatcaatcatgtgattgtcagccgcctttggcgcctggcacacatcagccgggaggttgggtccctcagcgtgtctgcgctcaacagcacctgcggtcctcgagacacagagcaacaactcgtcaatacttgccgacgactcggcgaccacatcctgcgcgaccccgccccgatctctcaagaccctggagcttccgaggagcgagatcagcgactgcatcgcgcccgcgccccggaggcggccggcaagagctgcgtagtccctggtggggctccggcgggcgatgcaccccatagacgtcgccggcaaggtgtgccagcacgacgaggcccgcgccatcgcgtgcagcatgccgaagctccggcacctggagatcgggtacatgctgatcgcgaccaacgccgtggtggagatcgcgtcccggtgccgcgacctcagcttcctggacctgcgcggctgctggggcgtggacgacaagctgctgcaggacaagtacccggggctcaaggtcctgggcccgcgcgtggacgactgctacgagaacagcttcctggaggagtgctccgacgactcggacgacgactccatctactcgtgggaggagttcatggacgacgaggactacttcgccgccgggagcgacgacgacgaggccctgtgggacgacggccacgccctcgaggggctggaggtgaggttctacggcggcgggttcggcgagggcgccttcgccggcttcgactggccggagtctccatgaaccaagccttcttcttcatcaataagctgtcaagagaagcgaagtttgcctgcctgcttgcttgcttgctcctgctgctgctgtcttgatagcatgtttcagctttgaagcatcttcttccgtgttcatgtgcttgtaattgtgtcaaattgtgtcgtctttagctgcttgcagatattggcctggatgttgagtgagcttgtctggaatgtaaaaaaacctgtggtgcttaaaacatagagcaacaaatcatcaatataaactgttgagaataaaaaaaaaaaaaaaaaa

SEQ ID NO: 3223 - DNA, 940 bp, Triticum aestivum
  Clone ID: PAT_TA_3223
ggcgtcgagcaccagctcaacgaccgcgtcatccgcggcgcccccatggaccgccactcccgcttctggaagggcgccgacgtcctcgtcttcaactcctacctctggtggatgaccggcgacaagatccagatcctgaggggtgccgacaacgacatgagcaaggacatcgtggagatgggggcggaggaggcctacaggctggtgctgcaccaggtggtgcggtggctggacggcaacgtggaccccaagaagtcccgggtcttcttcgtcacggcgtcgtccacgcacgccagcggccagctctggggcgacgaggcggagggcagcaactgccacggccagaccaagcccatcgccgacgcgtcctactggggcagcacgagcaaggcgatgctgcgggtgaccggcgaggtgctgggcgcgtccgcgacgggtgccggtgggcgtggtgaatgtcacgccagatgtccgagtacctgccgggacgcgcacacgcaggtgtaccgggagcagttgggcgccgtctgaccaaggagcagcgccgcgcacccacgagtctacagggacgcagtgggcgccgcccaccaacggagcagctcgccgactccaagagctacgccgactgcacccacttgtgcccccccggcgtgcccgacgcatggaatgacctgctctactggaatgctcttcttccccgccaacgaccaggcgctctgacgcgtcctcgtcgtcgctctaacatgcgtcgtacagtgtcgttgcgatcgtcgtgctgcgtcgtgtggacgccatggctataattcgttccctttttttggccaaaaaatgtggtcaacggtgtgttcccatgcttccctaaaaaaaaaaaaacccttaggcccttacatttggcccccaaatccatactagccatgcaagttgatgcaaaaaaaaaaaa

SEQ ID NO: 3224 - DNA, 1307 bp, Triticum aestivum
  Clone ID: PAT_TA_3224
taaaaatgaaccggtaaatgtcaatggctttgccatgaatgcgagctcacagaataatattagtgaccatgcaaagtcaacggtaccaaccgtagtacctggccaagtaaacgtatcaaaccgagggcctgatgcttcccggaacatcttctcagcatttccaccagctgtcagggagaaccagtgcattccgtctgctccagtggcccaatcttggatctcatttggtgcttcgtcagagagcaaaccaaccattgtcagtccgaattttaatgacggcaactctggctggaagatgccatttgcaaatgtccgaacttgtgatgaaacgaagataagtgctgttcctcagttctttagacaacctgttcaggttcctagagaaagtccaggtcaaaacaagggcttggtgatatttccacagttggtccagacagatttctcaagatcacagggccaatcacaatggcaagggttggttcctcacatgcaacagaagccaaacatggatatgctccgtccagacttgaacattgggtttccctctccaggttcaccaccagctcgacagtcttcgggcatcaatttggaagcacaacagccagatctcgccttgcagttataagcagggagtgtggataatgaacacgtgtgactacaagatcagatgtcagacacagaaacgtgaagcatctaaggacttgtggacccgggccacaaaattgagcaacagcagaaatgggacgtccatgaagtggatatgcacaatattagggatcacaggtcatgtcgtagatcgatcctcccctgtgcaagatatcagaatatggatggatgaacactgctcgaaatcatatcatatctaccggcccattttgtttggtacgggagttcagtaatccggcatttggagaaaggctgtggtgggatatatgttgatagcatgccctatgatccgaaagcccgcccgggctcttctgaccacacaatagcattctgcggtggaaatttttgcaccagaatttaggagacgtcctcagtagttagactgcgtggtcatccctatgttaatgcccatgtcacattgtatgtttgttgtaaatggttcagcattgaatagattgttagactagatcagccacctttactcccttaactgaatgaaattgcttccccttcaagttctgcgccaggaattgagttccatggtcaattcggttaggggtatcctgaatgaaagatgttagggcttgggtcacccgagctccacccaaacactgcattcctggcgcgagtcgcgttctctc

SEQ ID NO: 3225 - DNA, 653 bp, Triticum aestivum
  Clone ID: PAT_TA_3225
attcggcccgtccctgttttttttggggttgggttccatccttcttcagtcgttgtggttgttggtggttgccgccgccgtgagccgcgaggttgctgctctccccgacgcatctcctctccgtggtcgttgccgagcaggggtggctgctgggcgtcgtgtcgctagcagtgttggtacttctggttcaggatcctttaacccacaagttgtgccccgcggttgaggtaaatcctgaggacgacatgcatgggagtcttgggagtagcatcttcaccgttttcacttcacggaactcacacctattgtcctttaggaccgtgttttgagaacctagtatagttgtactttactacctgtggtggttcatcttgaattggagagataccctcttggtctgtatggcttagctaatttccccttaagactaacgctatcgcctaaagttaccgaggatgttctcggttatggtattgtagccttgtgctttacaccggtgctagttctttgcgtatatatatactatatgcttgccgagtctttgtactcatccttgttgtttatttgttttaggtaaatcctgaggacgacatgcatgggagtcttgggagtagcatcttcaccgttttcacttcacggaactcacacctatt

SEQ ID NO: 3226 - DNA, 3588 bp, Triticum aestivum
  unsure (1)..(3588): unsure at all n locations
  Clone ID: PAT_TA_3226
aacatatgttatgtgcacattncagggttgcagtcagctatgggatatgaaaagcagatttcaccatattaaatggattaagagctctttgaatcctgaggagtcactccagaaaattaaaagcctgaagcagatagatgatggaaacgattatgcatccaaagttgcaaggaacttgaccagtcagctgggtggttctgatgaacttgacggctattttgctgatatctcaaatagagagaatgccaatctttcctttgggcaaggtttctataaacgatcaaaatggcttgatgctagaaagtcctctgctgttttgtcgaaggatgcacaactaaggcgtttgatgcagaggaaggccgagaatagctaccggaagatggaagagtttgtcatcaatagattgagagaaatcatgaagagcagcagatttgatttcttcattccaaaggttgcaaaaattgaaggtaggttgaaaagtggatattatgctcggcatggctttagttctctcaagaacgatattcgatctatgtgccgtgatgcattgagatataaaggccgaagtgatttgggagatatgaagcaaattgttgtgtcctttatccagttagcaaagagactcggtaacccacgattgatttctgagcgtccgggagcagtagcccagaaggacaattctgacacgagtcaatattcttcagacgcaaaactaaaaaagaaacaaaataaaactacgggggaaagaaggggaggaaactgggctactgcctctgctggtgcagatgcttcatcccgtgccttcgaccgtgaaattaaaagaagcctctctaaattaaagaaaatggatgttgattctgggagtgagacatctgatgatgatgatggatactctgaaggtgatgaaactgagagtgaaactactgtttctgatacagagagtgaccttgactcaaattctgcagcatgggacttgaggggaaatagtatgaagttgtttgaatctggtgactctgtcggggatgatcgtggatggggtgctcgcatgacagcggccggccttgtccctcctgttactaggaagtacgaagtgattgagaagtaccttattgtagcagatgaggaggaagtacaacgaaaaatgcgggttgctttacctgatgactactctgagaagctgctctcgcagaagaatggtactgaaaatttggagattccagaggttaaggattatcaacgtagaaaggtacctggggatgaagttcttgagcaagaagtatacggcatagatccatacacacataatctcctgcgtgacattatgccagccgacgttggcttgtcatctgctgacaaacatacctttattgaggagctgcttctgaatactttgaataagcaggttcgggatttcactggttctggaaatactcctatggtttacccccttaaacctgtcatcgaagaaatccaaaagtctgcagaggagagtggtgatagacgaactgcaaagatgtgccttggaatgctgaaggccatgaggagccgccctgaacataactatgttgcttatagaaagggtcttggagttgtttgcaacaaaaagggtggatttggcatggatgactttgttattgagttcttcggggaggtttacccttcttggagatggtatgagaagcaagatggtattaaacatatacaaaacaacagtgaagatcaagctcctgagttttataacattatgttagaaagaccaaagggggaccgtgatggatatgacttggtttttgttgatgctatgcacaaggctaactatgcaagcagaatctgtcattcatgtaaccccaactgtgaagcaaaagtgactgctgtggatggtcaataccagattggagtctacactgttaggccgattgcagaaggcgaggaaatcacttttgattacaactctgtgactgagagtaaggaagagcatgaagcatcggtttgcctctgtggaagtcaagtatgccggggcagctatttaaatttttctggagagggagctttcgagaaggtgttattggaattccatggtgtgcttgatcgacacagtttgctgctacaggcttgcgaagcaaacactgtctcccaacaagacttgattgacttgggtagagctggtcttggtacctgtttgcttgctggtttgcctgggtggcttgttgcttacacggcccagctggtgcggtttatattcttcgagaggcagaaacttcctaatgagatctttaagcacaacatggaagagaaacgccagttttttacagatataaatatggattccgagaggaatgatgctgaggttcaggctgagggtgtattaaattctagattacagcatttaactcatacacttgataaggtaaggtatgttatgagatgtatattcggggaccccaagaatgccccccctcctctggtgaggcttaccgggagaagtctagtgtctgccatctggaaaggggaaggctcattagttgatgagctccttcagtcaattgaacatcatgttgacgaagatgtacttaccgatctcaaggacaaaattcggcttcatgatccatctgattctgaagacatcgagggagacatccgaaattctctgttatggttgcgtgatgagttgcgaactctttcatgcacatacaagtgccgtcatgacgctgctgctgatttgattcacatgtatgcttacacaaagtgtttcttcagagcccgagactacaagaccgtaaagtctccaccagttcatatcagtcctctcgatttaggtcccaaatatgctgataaactgggaccaggtttccaggagtacagcaagacgtacccagagaactattgcttagcacagcttatctattggtacagccagaatgcagaacccgaatctagactgacaagagctagaaagggttgtatgtcattaccagatgtgtcctctttctatgtaaagtctgtaaagccaactcaagagcgagtttatggcaccagaactgtgagattcatgctatcacggatggagaaacaggcccaacgtccatggccgaaggaccggatatgggtgttcaagagcgacccaagattctttggcactccaatgatggatgctgtgctgaataacaattctcctcttgataaggagatggtgcattggctaaagacaagatcgaacgttttcctagggtagtcaaaaggatcgtaggcagagggcattggtttttctcttaggagattttagtcaacgacattctttttttcctactcaccttacctacctaatcatgggacatagcttttagatggcaggttgtacagtcaccactccctacctacctacctacctagctgtagagatgtattcgattaataactgatagatcacagatcatcatcgattggatgtagcgtcttttcctgttgcatagaattgttcgcctgcttatgggctgatgatgtacttgtaaatgcaaaacagatgcaatcttaaattcagcaacgtgttacagcttgcggtgctgcaaaaaaaaaaaaaaaaaactcgag

SEQ ID NO: 3227 - DNA, 1387 bp, Triticum aestivum
  unsure (1)..(1387): unsure at all n locations
  Clone ID: PAT_TA_3227
cgcccacccagcgtcttctcttctcagcgagacagagctatcagacctcgtctttcacatcgcatccaaacgtacttgcaaagttcttccctaccgcaagcactacgcggcatcttcccacgtccactggaaatggaagctaccgacagcctcctcatggccaccgagctcaggctgggcctccccggcaccgacgacaagccacacaagatcacctcggtccgggccccgccggccactccccggcgctcgcagcgcaccctggccgccttccagacctccctcgcccatgcggccgccaggcccctccgcaccgacgccccctcccccgggaccctaccgccagccgcctcatggccaccgagctcaggctgggcctccccggcaccgacgacaagccacacaagatcacctcggtgatgtcgccgccggcgactcccagaggcaggaagccgcaccctggacgccttcgaggccaccgcctccgatgaggccgacaggtccgacgacgtcgagaccgcaccccccgtggccatggcccagggctacggggagctcccggtgaggtcgtaccggaagagctgcttccaggcggcggcgagcaagagcaaggcgaagaaagcagacgaggccagcagcaacaacacgccgtccgcaccggggccaggccggcgccctcgggcccgtcgtcgacgtgcccttcgacgggtcccccggcacatgcaaggacttgaggatcatcaagagatccgaagccacaggcctgggatccaaatgatgaagatttgagaagcaagatgatatcatggcctctctctctttttttctttttaaggtttatactttttcttcttcgtacgaggacaaggacggcgacctcatgcttgtcggagagtgcctctgagatctctcctgcagctcagccctttggttgaggaccatcaggaggcctttttagaagcacaaaggagatgtggagatttgggttaaactcccacatgtgttcgtgcgctcgctcctgttttttctttttacggtttatactttttgttcttcgatctgggttcgatcaccaagccaaaagggacgagcttggtgcatcaagagagcacacatggatgtgtgccctttgtttgggtccttgaagtaggccttcttagaagcacaaaggagatgtggagatttgggttaaactccccatgtgtttgttcaaacgaaacagttatattgatggtggatnactttccacaagcttgttttngcccgggggggccgccggttcccctgccccgacgggctgccggttccgctggccggccccgtctcaancataagtgtttgggaaaaaaaaagggggccggaccaatccccaaaangntctataccc

SEQ ID NO: 3228 - DNA, 2378 bp, Triticum aestivum
  Clone ID: PAT_TA_3228
gcataaccttcagctttgtgtatgtaccaagaaaaggaaggcttcagctttgaatgtgtgatgacttacagcttgggacacacagcgcaaaaaaacacattcaaatgcacaaaatggaaattcctgcacaaaccaccagcacctaattatgtacacccatacaattccccgggaggaaaaaggaaggaaaattttgctctccctatattttacatttacattacaaaggcggaggacgtcggtcgagctggaacctgctgtcagcgtatacggttggcagtattttttcgcgtcaaacgtcttcgagaagttgcttcaacaaaatgccaactcgtgatcttcgccctcccagtgccctacggggtattaggaagcatagtttggctggctccagttcccaagtttacagagcctagtcgttggagcgctgctgcgaggatattaacctccaactcatggggtgcgctgcatcttcacaaacctcccccgtaccaatgccatgtgcactgaggtgccaacctccgtccagtttacaatacatttacaccttttttctttaccactgccccgcctcgggtagcttggagacacggccatgtacaactgctccccttcgaatggcttggagacatagccatccatttcacatttcaagcactgctcatatgttgcctggataacatctgccgtcatggccaatatctggagttcgccacctccgaactttagcacattctgctggcgcttcgccgcgctctgtcccctcatttacatcccgttctggcattcttatccccttgatggcttcaaacccatccatttctggcatttgtatgtccatgaaacaagcatcaaaactgtgaggtggttttagcaatgcgattgctttcttcccactgtctgcacaaattacttctgcgccatacttcttgagagcaccagcagccactttaaggttcacaacgttatcgtcaaccacaatgatttgcctcttgtgaagaaggctacccaacgctgagttgccaacgactccattcttgccatgcaccttatctactccgcccaaagcccgccttagtgaggcctgaagcatacttgcacgaagcggcttcatgattacattcaagttatgctccctcgatatatttgaactgctcttgatagaattcgtagggttctccaaaagaaagagcttcggagggtctgactgatctttgctccgcagtttgctaagcaattgaggcattgaatgggattccttcagccaggtctccttgtcaactagcactagccttgtaactagtgatgcgcagttcatcttaggaataacttggtttacatcagtggtcaattccgttttgactccaagcctttgcaaatggtacttggtaaccttggcacgaaccggcttatgatcaactaccaatgcatttatccctttaaaccctggcgatttgttagcatttgcattggagcgtgctttcgtaagcactgcagtgaaggagaaaggagaaccaacattgggtaagcttacaatcccccaatctcccccttcatgagatgaaccaggcacttgctgatgcttaatccgatgcccgtgcccccatggatgcgggcaatggatggaccaacctgcatgaaaggcatgaatatccgggattgggcttcaggtgggatgccgacgccggtatcttcaacagatattatcaatcttattgtttcaggcaggataggagcaaagggcatctcagccgagtgtaaatccgtattgaaaagctggaagctctgccaactatgccttctgttagctaccttgtagccactcaaggtgttgtaggtgttgtttgtgttttgaaattctgtttccacctctaaacaactcatgacctcttcgacgacatgaactgtcaagtagatgtgtcctctttctgtaaattttatggagttccccatgagatttgtaatgatttgcctcattctacccggatcaccaataagtgtttgtggaacttgatcagagacatacactgccaactccagtcctttctcctgagcttttccacagaagagagacaagatgtcatcacagactagtctaagatcaaagggcactgcctcaagctcgagtttgccagattctatcttcgcctgatcaagaacctcatttataagggacactaaagcttttccactagcttgggctgttctaacatagtcttgctgcgttgtgtccagatcagtatccatgagcattcgcacgcgtgctaaaaccccattcattggagttctgatctcatgtgaaactgtagccaggaactgtgacttggcaacatctgcagcttccgcacacttcttgagcttcttcataatttgaagat

SEQ ID NO: 3229 - DNA, 641 bp, Triticum aestivum
  Clone ID: PAT_TA_3229
tcggcacgagtctagatgtattttagttctagatacattcatatccgagacaagtatttcaggcatatgggagtatatagtatctaagttatcttctttacatgttgtttactctattttttacttcccatgcactatggatttgagggtatatgcatatttatgttccggaggtaagtcatatgcagattttactactgaccatgatggtcgacttgctttttttccttttgctgaattccacaataatttcctctatacttccctttgtgtaagtgttccatgtaaactttaggtaagagtatatagtatggatgcatatatatgttattctaaaagttcaatctttcctatggtcgatggcagatcactgaacttgaatagtcctccatcaattatgatctttttgtggggaaataaattatgaacattacatgttctgtcaagacaggttatagttttgctgaacattctcatgctacttttgctcatgttatttgctcggcccactaaagagtatcctggtgtcacaggcttacttaaatttcacaaagataccagtgaacgactacctaggtgcacccaagatctgaaaacgtaattcaatttagacctacaaaatgctatcaattgatctattt

SEQ ID NO: 3230 - DNA, 309 bp, Triticum aestivum
  Clone ID: PAT_TA_3230
tggctgttgacgcgtgggtgctccttctgtccacatttactcaagctcaaacagagaaaaggttcaacaacgactacatgggtcttttgcacaagtaccaagtccagaagaggttcaacaacgacttctatggcatgcttggcaggtatcagcagcggccatacaaaaggatgatgtacggtgactactacaactggctaaggaactaccaagatcgcctaacctactagagagacagagagcttgggtaaagatggagctgttgaaaaaataatgacacacggcctacccttggcactggccgtatat

SEQ ID NO: 3231 - DNA, 1202 bp, Triticum aestivum
  Clone ID: PAT_TA_3231
ctggaagccgcctccctctcccctctgtcctccccctgcccgtcctcgacctcgccgccggccaccgatggagcggcgatccaccacccgcttctcgccatccgagattgcgaggatggagaagttggtttcatcagacagaaaagagcaagtcttggttgatagtttctgccagatgcttgtagaagaagttaatcgttctccatccacgactcggaagcagagctctacacgctacacaggttcggggatgcttcccttgtgttgctccctgcgtcatctcctagccctgcttcccggcctactacttctgaaggaccggcggtagccgcaggaccaagatgcgttaatttctgagataaaggctgcagctgctcatgaacaaagccaggtggcgcttgaccccaggagttcctccaggcggcctgcactcccttcagggcttcccgctgacacgaatctgcttcctgctgctatccgagcttgtgtcttactaacgggagcccctcgaatcttcggttgagactgccgcactcttgattgtttgttcttattgatgtactgtgtctagtagtaaaacacccgggagagtagttaagccccctctttggacacatagctgctgtaacggccatgaaggctgtccgtcggtaaccaattttggcacacacacgagaaagtcgaagcattgtaaaaggagatcttgtcctctgtttcaaggagagcaatgatgaagcactgcacttcgatgcacacgttctggatgtccagcggaaacagcatgatataaggggatgcagatgcctcttccatgttgaatatgatcatgatcagagccaggagatggtgaacctcaagagaatctcccggcgaccaagatacctttgacggcctctgctgccgtggatctgcttcctgctgctatccgagcttgtgtcgtactaacgggagccctcgaatcttagttgagaccgccgcactcttattgtttgttcttattgatgtaatgtgtctagtaaaacacccgggagagtagttaagccccctctttggcacatagctgctgtaacggctatgagtaggctccgtgatagccaatttttgcacacacacacgagaaagttggtgccaaagcgggcggagagccggattttaacggtgtgttggagcagattaccatgtcattatgtcagtgtttgcag

SEQ ID NO: 3232 - DNA, 542 bp, Triticum aestivum
  unsure (1)..(542): unsure at all n locations
  Clone ID: PAT_TA_3232
taacagagctcggtcgacaggcacagattcagctaggaggagagcaggagctaggtagccatggccgtcctgcgcgccctcacccgcgccctggaggacctggcccacgccctggtcgccgtcgtccgcgcccttgccgacctggccagccgcatgacccacgccagtgcccgcgccttgcccaacgccataagccgtgccatcggcgcctgatttgtataccctccggcggtacctctgcaccggatcgtcgctcttcgttagaggtactccaccgaaagagacgtgccttctcatcgttattgagacaatcgggcatgttgagtgtgatttaaagttatttttcttgtaataataatataataactcggccgacatccgaacgtttgggaccgcaggaagatgccgactgcacagaataatgcacttgccgacaactttttttcctttaaggtgaaccgccacctagcanttaatcaaatatcggggtcanatccgattgactaggaacaagaatnnggatncataanaaaaaaaaaaaa

SEQ ID NO: 3233 - DNA, 1019 bp, Triticum aestivum
  Clone ID: PAT_TA_3233
gcctccgtcggggtcctcgcggacacacgcgacccccgccggcgccgcgcacccgtgccgcggggggggtgtgggggtctgctcacccgcctccgcttggcgccggccatccggcgcgcgcccgcttctcggggccggcggcccccgttggggcgcctcggggccgggcttcgtcgccggcggccgccctcgccggtgcggtcctcgcggcgcggcgctcggcctccccgcgcgcggctcgtgctcgggcccccgcggcggccgctgccctcttccgctgcccctttcaggactgcgtcgtccttgccccaccgtgttcgccctggtcgccggcgccacgcgctcccctcaccctgcctgatgcaaccggtgactaccctacccggtcgccggcagactagacggcctgggcgcgggcggtaggcaccgccagcagccccgctctccaatctccgtcgacaccgtggtctaaatgaccccgcgccccacccgccttggaacgcccctccctggtcgatattatatggttcaagcataatcacggtgatatgattatatggagtagaagggaggaagttgtgtctcatcagcattgtgttctgcatctatataaagcacatccaagaatcactgtccaaggtctctctttcgattgatagcatcggtagcaggatataacatcaggttacaagcctttgtggtacaggaaggaccgaaggaggaagttggtgagatacagagggaagttgaattgggacgagggatagagatacaaccagcaaatgcgccgaggaacagtaaggtgctattttcttcaccagttaactccttcaagtatgcgttcttgtcatcagtacacacagcctcctattgcaggtctctaacactttcgcccaatggtccgatgcagacttatactgacattatcaagagaaagaatacgttgatgtagcatatttgcactgttcatgtacaactgaaagggactaaactctaattgtttttgcccttgccaactt

SEQ ID NO: 3234 - DNA, 1859 bp, Triticum aestivum
  Clone ID: PAT_TA_3234
gcacgggtcgccctcgccttccccttttccgctggtcccccgtgcgccctctccctcccctggttggtgtggtggctgctgcgcgcatcatcgtcagagcctccctccctcgcccaccaaccgcaccaccacaggagcgcgcgacgcagagatttgattcagggagaagagaatggcggcgccgtcgtccctcgcctcctcccacctctcccgcctcgccgccgccgcaccggccccgcagcaccaccaccagaaccaccagctccgcctcggctgctcccgccgccgcgcgcagcgcctcgtcgccatggccggatccggaaagttcttcgtcggaggcaactggaagtgcaatggaacaaaggaatccattagcaagcttgtctctgatttgaatgctgccacactcgaaagcgatgtacgatgttgtcggtagcaccgccattcatctatatcgaccattctcaaagagttcactaactggggacgtattgaggctgtctgctcaaaacacatgagattggaaaagggagaagctttcgctggaggagatcagacattgggctgccaatgggttattgttggtcactcgtgagagtcatggttactctcggtgaaggatgatcagtttattgggtaagaaggctgcatatgccttgagtcaaaatcttaagggttatggcatgcataggagaactgttggaagagagggaagctgggaaaacttttgatgtctgttttaagcagatgaaggcttttgcagataatattacagactggaaaaatgttgtgattgcgtacgagcctgtgtgggctattggaactggaaaggttgcttctccagagcaagctcaagaagttcatgccgctgtccgtgattggttaaaaaccaatgtatcagctgatgttgcttctaccgttagaattatctacggaggttccgtaaatgcagcaaactgtgctgagctagcaaagaaggaagatatcgatggcttccttgtcggcggtgcctcgttgaagggtccggactttgccaccatctgcaactcagtaacgtcgaagaaagttacagcctgatgtgagatcaccacctccatggtagaaataagtgatgagaaagagaggcagcctggccaccgcgtcgaaaaagcgtgagataggtgctccatgtgaaccgtgagtcgtgatctggttttgctgattcgtagaacgaagaaatacaaataatacgacgtggcgccattttgcttctcatggaatttctgtacgaaacgggagttttcttctttgtacgtgacaggaatgggagtggtcacactcacacctgaattcaagtgtgctcatgcttgtggaactgttgttctgttgtcggtctccaggaggggcatatacaagtcatactgcgcctgttgaatccactgaaatacaactcgtttgccaatctgattcttatgttgtcaacatcggctgcgccaaacatattgccaattggggtcctaggagtccggtgcttcagatacatgatagtgaaaacaccacaatcctcccagttattttgctgtggaacagtagggtagacaatgtcaaaattctcaaagtcgatacgagtacctcggccgcgacccccttactgatcccagattgttatgaaattttcaatcaatttatcatgaattcccagatgaaaatgatcctttgccccgtacaaagaatcaagaaatgcgaatgccctctccttcaagcaaacaaccaaggtaaaccagtgtttctcctgtccaataggaaagaataacagattacttctccacattgggaaagcacttagcgccagtaaatgcattgccccaatataagagaag

SEQ ID NO: 3235 - DNA, 495 bp, Triticum aestivum
  unsure (1)..(495): unsure at all n locations
  Clone ID: PAT_TA_3235
cgacccacgcgtccgaggaggacgacgccgatgacgacgacgagccagtctccgactccagcccagaagactaacgaagcagagcaaagccacgaaagcactccactgcacgcacctcagccaaaagtcaatccaaagaagaaaccttaggttctattctagtgaaatatttattctccgattatgtattagtcagtaatgataccactgttgcccctacggagtgtttttctggtaccatgactattgctggttgtccctaattattcttgaccttcaatcaataagaacacgaaacatggngaaaaaaaaaaaaaaaaaaaaaaaaaaaaaaaaaaaaaaaaaaaaaaaaaaaaaaaaaaaaaaaaaaaaaaaaaacgggaaacaaaaataaaaaaagaaacaagaaaaacaaaaaactaaaaatggggggggccctttttaaagaaccaaattttctggccggggcttggaatctcaataattttttttttt

SEQ ID NO: 3236 - DNA, 790 bp, Triticum aestivum
  Clone ID: PAT_TA_3236
agacgatgcggtggcggggttcactccgagattcaagaagctcagcgctgacgcgcaggtcgcacttcttctgtatcatggagtgccgtcgcgtcgctccgaggaggcgctcaggttgatcaacggggaggaggtgccgacgcttgataagggtcccttgccgggctccagaagcatgctcaccatcgatgtctatgaagatatcgtggtactttcttcgccgttgccgtcgccgtcggttgctgctgtcaccgagatggtcgtcgaccacgaccgcctggctgtctacatcatcaacgacgtgatgattccgagagagccagagattggattcccagccttgcttcttttctttgggctcctggcgttggcagcgctggtgctcgcgcaggtattattgatcttcggtgatgtctgagaagatcgtttcgtgtcaagattgcgctactacctatgttgggcgacaaggaccttagttcatgactgtttcatttacatcggctggtctaatgttaacaacttctacattatcctgctctgtttcatacttgtgtgcttaagaagtgagtgaggtgcaactgtgtgctcatgtcgtggtcggtagtgatcttgcattggattctctacttgtcatgtcctgctgtgattggtttcaagtaattccttttgtctcatctgtgtaatatcatggtggtcttagattattatgctggttgaagaagtgatgattatatgtgtgttgacctgattgatgtctgattgtatgtatatttcgagtaaattgcttagt

SEQ ID NO: 3237 - DNA, 1427 bp, Triticum aestivum
  Clone ID: PAT_TA_3237
tttctttgggctcctggcgttggcagcgctggtgctcgcgcaggtattattgatcttcggtgacgtctaagaagatcgtttcgtgtcaagatcgctactacctatgttgtggctccatatataagcgccaaggcccttagttcatgattgtttcatttacaccagctggcctaatgttaacccacgcgtccgcccaggcgtccgtccaccccctcggtgttcctgaccaccggccggcagctacctagcggttgcttcctcaaccctcgatcacgtcggagcgggcggagatcgggccgcggcgatgacggtgatcgacatcctgacgcgggtggacgccatctgccagaagtacgacaagtacgacgccgagaagctcaacggcgccaacgtcgccggcgaggaccccttcgcccgcctctacggctccgtcgacgcggagatctcgcagtgcgtcgagaaagcggaggcggcgaggcaggagaagaaccgggccacggtcgtcgcgctcaacgccgagatccgccgcgccaaggccaagctcctcgaggaggacctgcccaagctgcagcgcctcgcgctcaagaaggtcaaagggctcacaaaggaggaacttgcgacccgtagtgatctggttgccgccttacttgatagaattcaatcaataccggatggtagttctagtgcgacaaagaaaaatggaggttggggagcctcaggatcccgtcctggtggaggcgtcaagttcgactctacttctgatggaaactttgatgatgagtactttaaggggactgaagaatcaaataaatttcgtcaggaatatgagatgcgtagaatgaagcaggatgaaggtttggatgttatcggtgaagggctggcaactctgaagaacatggcgtcggatatgaatgaggaattggataggcaagttcccttgatggatgaaatggatgacaaggtggatagagccaatgcagatctgaagaataccaacgtgaggctaaagcagaccattcttcagatgagatccagtcgcaacttctgcgtcgacattatcctgctctgtatcatacttggtatcgctgcctacctttacaatgtgctcaagaagtgagtgaggtgcaacggcgtgctcatgtcgcggtcggtagtggtcttgcattggattctctacttgtcatgtcctgctgtgatgggtttcaaacgtgtgccacgagtaattcctttcatatcatctgtgtaatatcatggtgttgctagattattattatgcttgttgatgaagcagtgatgattatatgtgtgttgacctgatggatgtctgattgtatgtatattcgggagtaaattgcttagtaagagtacaaacatcattcttttgttctaaacctaaatttccctggggcctttctttgagttgcatt

SEQ ID NO: 3238 - DNA, 728 bp, Triticum aestivum
  unsure (1)..(728): unsure at all n locations
  Clone ID: PAT_TA_3238
attcggcacgagtcctcctccgccgcccaacaacagctcccggcaccaattcattctcttggcaaatcgtccagttcatcccaaattaccagctctcatccgcttctcttcctccaaatcgtcggcgtttcttgatcgacgagggcatggcgacgacggtggactggcgcagctataggcccgatcttccggcggcgatgtaccacatggtggacggcagagaccaggtaatgcacgcgttcgctccgccgacggcgcagggcgcggctccgaccatctcgttctccttcccctgccccggcgcggatcagagcgccggcctgcttcgtggcgccacctacctcactcccgcgcaaatcctccagctccagtcgcagctccaccacgtgcgccgggcgccgggcgcgcccatggcagcggtggggcagccgatgaagcggcacggcgtggcggcgctcccggtgcggccggcgaccaagctgtaccgcggcgtgcggcagcggcatatgggggaagtgggtcgcggagatccgcctgccccgcaaccgcacccgcctctggctcggcaccttcgacaccgccgacgaggccgcgctggcctacgacgccgccgccttccggctccgcggcgagtccgccaggctcaacttccccgagctcaggncgcggcggcgagcaccacggcccgccgctcgatgccgcgatcgacgccaagctccgctccatct

SEQ ID NO: 3239 - DNA, 1002 bp, Triticum aestivum
  unsure (1)..(1002): unsure at all n locations
  Clone ID: PAT_TA_3239
cacacagaatgtctgcttgcattgactgcgtcttcccgtttccgctccgtgcgcggtgtgtcgagcttcgggcgcttccgcgtctgcctcccctgggacgggtcttgcggctctcccccacgaaattcagcggagtggttgaggtgcctggccaaaggtgctgcttgtgtgatccatctttggaggagttcttggattcctggcattgtgctttcttggacccagagctccacaagatttgttgaaatagtttgccaatctagagggagagatatcctacttaattggtttctttggccttggcaatgccatgagcaaggggaacaccaagacctagatctttacagctttatagcttagggatcttgtcacttggtgcttcttggttctgatctgtggtgattggattggagacaaggagaaaacagagagggggttcaggtgactctcagttgtgtgaagatgaagtatatgcggacgcgtgggaaaccagatgtctttcagacagaggggaatatcaggtttgtggcaactgaactagcgacggatattgttatcactgttggagatgtcaagttttatcttcacaagttcccacttttgtccaagagttcccgcttgcaaacgttggttgcctccacagacgaggaaggcaacgatgaagtagacatttctgacatccccggtggaccttcagcatttgaaatctgtgcaaagttctgctatggtatgaccgtcacgctgaacgcgtacaacgtccttgcggcccgctgcgcggccgagtttctcgaaatgttcgagacgatcgacaaagggaacctcatctacaagattgatgtgttcctctcctcgagcatattccgcacctggaaggactccatcatcgtgctgcaaacaacaaagtnactncttccctggtcagagancctgaaggtgatccaaactgcgtggattccattgcggccaaggcttccatcgacccgtcggangtcaactgntcgt

SEQ ID NO: 3240 - DNA, 840 bp, Triticum aestivum
  Clone ID: PAT_TA_3240
cgtccgccacccaccacttccactccggcagagcgcacccggacggcggagaaaacaaaccatggcccctcccggtcccggccaactgctccccttgacccgctcgcttctgcctccctccgctccccccttcctctccggccgccgtcgcctgcctcctcccgcccgcgctcaaacctcgcgtccgcctccatggcagccccgccgcctcctgtgtcctgctcctcttcagccgctccgccctctggccgggaacaggacccgccccgttgctgcgcctcctggggcctccgccgccggtggaggcgaggcgcaggccctggcggcggagttcatgacgtctgagagggtgaaggtggcggcgatgctggggctggccctcgcgctctgcaacgccgaccgcgtcgtcatgtccgtggccatccgcgcgctctcccgggcgtacggatggaccccttccttcgccggcgtcgtgcagtcgtccttcctttgggggtatctgatatcacctataatcggtggagcgcttgttgactactatggcgggaagcgagtcatggcgtatggtgtggctttatggtccttcgctacattcctttccccttgggcggctgcgcgctcactttggtgtatcatctcaacgagaattctgctcggtcttgctactgaactggcattgccatgtatgaacaatatggctggctttcagcttggacgtaccatccgatctcttgcttccccgatcgccatgtcacgctttggaactggaagacccattgtgatttttggtttgtttatatttctgtgggtgcctggaacatttgctgctataacgggaac

SEQ ID NO: 3241 - DNA, 1301 bp, Triticum aestivum
  Clone ID: PAT_TA_3241
ctgtgctgtgctgtgctgtgctgttcccctcagagattccatgtttccccaccttcccccgcttcctcctctgctgctccaggaattagaggcgccgaatagcggggacagggcgtggcagaggggggaggatcgagactatcccagcttcccaaaccccactccagacccgtgcttctagtcccgtgccggttgatttccggctgaaattctgcggaagatgagctccgagtccagggagctgctcggaattgaccccaacgagctccgcttcgccttcgagttaaagaagcagatctcgtgttcactgcatctaacaaacaggacagaccaatacatcgccttcaaggttaagacaacgagcccaaagaagtactgtgtccggccaaacaacggcattgtggcaccgcgatccacattccgacgttctcgtaaccatgcaagcacagcgggaggcgccgccggatatgcaatgcagggacaagttccttgtgcagagtgccgtggtcagccaggacatcgcaccaaaggatatcaacggagacatgttcaccaaagaatcgggcaatgtggtggacgaggtgaagctgcaggttatttatccccccccgtccccacccccttccggggttgggggggctgatcggccgtggcggggcagttggagttatcaagagacagcaaagagaacttgcagaaccagaaacattaccgtctgaccccttggctttaattttgaagttgatgaaggaggagaagaactttgctgttcaagagaacaataagcttcgagaggaactgcgtctcttaagacgggaaatcagcaggcagaacgtcggtttctcgctacttttcgtgctcgtggccgctattctgggcgtcctcctaggcttcttcatgaggagatgagcttctgtaaccatgcaggccgtttcagttctctgtcaagacctgaataccatacgtgctctcggtcttgttagccttatgtacaacccatggcctcttatctttggatctgatgcctcttgtaatttttttaattcatattagctgctatagtcactcaataagtcgcctgtcgccctaagctcccggtatttgtgccagcttgttagtggccctacggtttagcctattcgattaggtaaatattatggctaattatttgcatcttttggcacctgtaaacagaatagtgccttcggtactatggctttgcagtaatatatactccctctgtaaagaaatataagagtgtttagatcactaaagaaatataagattgtttactaaaaaaa

SEQ ID NO: 3242 - DNA, 581 bp, Triticum aestivum
  unsure (1)..(581): unsure at all n locations
  Clone ID: PAT_TA_3242
acgagttcatgaccaggggcagcctagagaagcttctcttttttanatacgcggcgtcgttgcaatggtcaanacggnttaagatngccctcggcgccgccaaagggttggcgttcctccatgaggccgagaacccggtcatctaccgggacttcaagacctccaacatcctgctagactcggattacaaagcgaagctatcggatttcgggctagccaaagatggaccagaggaagacgagacgcacgtctccacccgggtcatgggcacgcagggctacgccgcaccggagtacatcatgacagggcatctgacggccaagagcgacgtgtacggtttcggcgtggtgctgctggagctgctcaccgggcgcaagtcggtggacaagagccggccgccgcgggagcagaacctggtggactgggcgcgcccctacctcaacgactcccggcgcctggaccgcgtcatggaccccaacctcgcggggcagtatgccggcgggggccgcgcagagggccgccgccctggcctacaagtgcgtcagccccaaccccaagtcccgcccgcacatgtccgccgt

SEQ ID NO: 3243 - DNA, 539 bp, Triticum aestivum
  Clone ID: PAT_TA_3243
cagcaatccgcccaactcttgtaaggccccggagtacatgccggaggacctggcgcggcactcggcgtggctgggcggcgcgatcctggccaaggtggtcttcccccagaaccagcacgtcaccaagggcgattacgacgagacgggcccgtccatcgtccacaagaagtgcttctgaccgactgtcaaccagcctgtgactcgagtaaagggctggatgacacaccgtacgcgtacgtgttggcaactgataaatgatgcgtgtaggggccagcggcactggtactggactggtgtggtgcccttcctcctctgatgctgggcgcctctgagagccattcatggcctctggctctgcctctggtttggatgtgtcattgttgctagcttggctagctagatgataactagctagctattcagattgccgtaggatcggatctaagattgccgtcttctttttattaggagtgctagcccattgtacctgtgccgtaccattggaaatttgttcgcgggaggtgcatcgcgttgttctc

SEQ ID NO: 3244 - DNA, 1625 bp, Triticum aestivum
  Clone ID: PAT_TA_3244
ttcgtaacccgcctctcgccggtcgccgcttgccagtcacacactccctccgctccgtggtcctcccgctctgtcccgctaaatcatacaaaacccctccacccctttcccccgatgcacaaaaatttcaaaaatcctctcccctcgccgcaaacccaagcgctcaaccctccccgcgccgacgccgcggagccggagcctcccgcccgcacgcgccgcaggccatggaggcggtggtcgtcgacgcggggtcgaagctgctgaaggccggcatggccctgcccgaccagggcccgggggtggtgatgccctcgaagatgaacacggaggtggaggagagcgaggtggccgacggcgcggcggcggtggtggaggaggtggtgcagccggtggtgcgcggcttcgtcaaggactgggacgccatggaggacctgctcacctacgtcctctacaggaacatcggctgggagatgggggacgagggccagatcctcttcacccagccgctcttcacgcccaaggctctccgggagcaattagtgcaacttatgttcgaaaaattcaacgtatcaggattttatgattatgaataggctgtactttctcttcatgctctgggcgcctctgagggccatacatggcctcttgctcatctgatggtttgtatttctcctttttgctagcttggcgtgctagatgataagtagctagctattcagattgccgtctatcttctttttattaggagtgctagcccattgtacctgtgtcgtaccattgcaaatttgttcgcgggagtgcatcgcgttgctctctctcgctcaagcatgctacacagaagatcagttagcctttgaagctatagcgagtacatgccagccagaaactcacactcttccagatggacaggttataacaattgaaaaagagcgctatatagttggtgaagctttgtttcaaccaagtatcttgggcttagaagattatggtattgtccaccagctaattactagtgtttcaaacgtcgcatcggagtaccaaaagcaagtgctcgagaacactatgctatgtggtggcactgtatctatgactggtttcgaggacaggtttcagagagaagcgaatctgtcggcttcggcgatccgcccgactcttgtgaaggccccggagtacatgccggaggacctggcgcggcactcggcgtggctgggcggcgcgatcctggccaaggtggtcttcccccagaaccagcacgtgaccaagggcgactacgacgagacgggcccgtccatcgtccacaagaagtgcttctgaccgactgagaaccagcactttactcgagtcacaggatgctcgtgcgtcacaccgtacgcgtacgtgttggcaactgataaatgatgtgtgtaggcccttcctcctctgatgctgggcgcctgagagccattcatggcctctggctctgcctctggtttggatgtgtcattgctgctagcttggctagctagattatggagtagctagctagctattcagattgccgtctattttttactaggagtgctagcccattgtacctgtgtcgtaccagatgaaatttgttcgcgggatgtgcatcgcgctgctct

SEQ ID NO: 3245 - DNA, 388 bp, Triticum aestivum
  Clone ID: PAT_TA_3245
atcacatctcgcggtatcaccatctgagagccagcctacagcatcgatttgccatggtcttcatcttcatcctctgctctcaaatatgtccgagaagccgcggatgacgggcagaacgccatgctgaaaagcctcaagctcgtagggcaaccaagcatctttggcagatattacaacatctcctgaactcatctgtattttttcatgtaaacttctatgctggagagtgatggttacttgttggttaaactactagtgtttgtatgttcatttcccttccctttgcgttgttgagcacttgagcgtatgaagactactgttggtacttagtagtgatacttgttttcagtcaattcaagaaccctgtttctcgtcaaaaaaaaaaaaa

SEQ ID NO: 3246 - DNA, 894 bp, Triticum aestivum
  Clone ID: PAT_TA_3246
tcgcggccgcgtcgaccgaagtcaggcaaagttggcagtggggttcttaacgttggtttaccggcatatgtaatccttaatgcactccttcgatctgcaaaatctaactctaatggcctaatcttgagtgatggcactgagattacatctgataataggcctaaaagcactctctttgactggttcttcgaccctcttatgatcatcaaggaacaaattaaagccgagaatttcacagaagaagaggaagaatacctcaaaatgcgagtcctgatggttggtgagcccagtaacctcaagggcactcttcctcatgtgccatcactgaatgagcggaaaaaagcagaaatcgacgcatttgctcgaagattgcaaggaatcacaaagtcgatatcgagatatcctacatccaagcgccgtttcgatgttcttgtgaagtctctcttgtcggagctcgagaggacgatgggtggcagcttgcctgccaatggatcccaagcgttaaggttgagaggcggtattgcccgaatgcttagccagaaatccgttgggaagacggcaaacatcacggatgaagatccagaagcgcaagtaacaaggaaggctcgcaccccgtgatagccgagtctttggctgtgtattgtgtacgtagttgacaagctagtgagagaccagctctgtaaaaatgtgtaaaagagaaacagctatgagctagtatgaacgttcttaggtgtagcttgagttgttgcaagttttgttgtgtaatttgctgctattggtttttgcagactacatttatgagaaatcttgcaaggtctcgctactatgttaacgtttgaactaccacaagacatgtgataagcaatccaaactactaaaaaaaaaaaaaaaaaa

SEQ ID NO: 3247 - DNA, 546 bp, Triticum aestivum
  Clone ID: PAT_TA_3247
cccacgcgtccgtgttatgttctgtagcataatatggaatgctatactgctagtgctacggtccaaagatgacttgtctttgacatcataagttgtgttgcctagcggtggagtgcaattacaagaagcttcattgtgtctatcaagtgggttttgagtgctcgtgactggcgtatacatgtatgtagaacaaaatgtccagcaacagtggcggtggtgcgaaggagaagggtccccgaattgctacgccgcttgtgccacctcccttagtccagaattctatgcctactgcttcagatggccctaccactgatctgagattagcacaacagtcctggcctggacatgtagtcctgcgtccatgcacatcttggcctcctcatgtgaatcctgcgtatccacaacaaaatggggaagcagtggcggatgtggtggcagccgatgttcttcctgtgattaatagctgcaatgagaagatgttgccggaagtaaatatgctatttgatgacgagaatgatgcttatgagttctacaatatttatgcgg

SEQ ID NO: 3248 - DNA, 694 bp, Triticum aestivum
  Clone ID: PAT_TA_3248
cccactcgtccgcggacgcgtgggcacacacacacacacacacacacgcactcagagagagagagagagagagagagagagagagagagagagagagagagagagagagagagagagagagagagagaggagaagaagagggagaggaagaagatgggtcagagtccccttttgcggctgccggtggaggagcaggttcagggagtggtagcgaccaacggcagcaacaggaaggaacagcttaccaagtctacaaaagctacaaacaaatactacaaaaactcaagcaaggacgatctagttttgagggcgacactagactcaatcactagaatgggataaaatcgtgatctagtgacaaaaagaacttacaattacgggcgactgcgccaatgtaaccttctatacacttatggtttggaagatgatgaacctacccagattgtaatttataattttgtcaagaaaaagtcgcgcccggccttgtacttataagcttttggcttattaatgatttatacagaaatattgcgtactagttgaatttatgtacttcaaatgtatttatttattgtccttagacaaataattcgtatctccctctgttttttttagaaaaacctcttcgagtgaggatatgtggtacccacaattttcataagaagattattctgaatgtatatatttaagttct

SEQ ID NO: 3249 - DNA, 832 bp, Triticum aestivum
  unsure (1)..(832): unsure at all n locations
  Clone ID: PAT_TA_3249
ctcgtgccgaattcggcacgagcggaggtagaggaggagatggagttcctgtacgagtgcgccgccaccgccgccgtcgcggacgtggcggccgcgctcgcgggcaccgccgggctccaggctgggcggacgcgtgggtttgttgcggttgcagagaggtgcccgagcggcgagctggagagggctctgtcggaggccgaagcctacgcctccaaggtacaagtacgtcataacaaattcgtgtcccctcgtgctctaagggaacatatcaagaatattgaaaaggcagctgctaatgctctaccagacacttcggaggccttgtgtccgcaacatccaaaatcagatgaaaagcgtgacagcatacaactttggtgggctggaaaagagctagctatgcataagaagctatctgactatattggtgttaatgacaaaacaaagattgtcatcaggctaagcctcccaacgagcctttagtgtggtcctgtccgtcattgatatttcctagtactccctctgtatcaaaatacagaacgtcttttgatactccctttgtatcaaaaaagagtatccaataacgtcttatattttgatacagtggcagttgggaagtttcctttgattcgtatatgcaggtcagcaagttaagcacatgttagtgtttttcaatttcgtnaaaaaacnaacagggacantcttaactnnantttcaaanggcaccatttccaccaggttaaancatcccnntttaccacgangnttcatggtcaagtcaaggtattcngggataanctcaatgntaaaaattgntaggntcaaaaaaaaaaaa

SEQ ID NO: 3250 - DNA, 628 bp, Triticum aestivum
  Clone ID: PAT_TA_3250
cgcctcttccccttgcccccctcgtcttccgccggaactagggttttagcggtcctcgcccgtccggccggcgccccccgccccctccccccggggtccatcaccatcagccatggacgacacggccgagctgcagcggttcatcgagcaagagaaggagaagatgatggtgagcgagatgatcggcaaggtgacgagcgagtgctgggacaagtgcatcacaggcgcccccgggagcaagctgagctctggcgagaccagctgcctgagcaactgcgcgcagaggttcgtcgacatgagcgagatgatacgcgaagcgtttcggcgcgcactagaacaggaccaccacacatgcacgcgtgcagttgcttcctggccttctgagctacgtgtctttcggtgcgagcggattttggtgtggcgttgaaagatgcataggtaaggtaggttcggtgggggtttaactgaacgccgaagaccgaagtatgcctgtcgttgtcgtcgtgcttggtagtaattctcgcactctgggttgaactttggaccctgcttccaggagcaagcaagaagtttggcctgttttaacacgccaagattttgttccaaaaaaaaaaaaaaaaaaaaactc

SEQ ID NO: 3251 - DNA, 609 bp, Triticum aestivum
  Clone ID: PAT_TA_3251
gagtgaccgacgctggttcacgccttccatgcgttactactgagggagggagagcgcatgcatcgcgtgagtaacccggagatgaggatgccccggagatccgcctccctcttcgccctcgccttcttcgccctgctgctctccacttccctggcagggagacagcggccgagcttcattgtagatcgggaggagtctcttggtcagcaaggagaggcccaggacgaagcagctatggcacagcgtgtgcactcccggatgccggaggatgtcaccactaatgaccagtgactctagcacccaagccccaaccccgtcaagccccacttcaagctcatacccaactgatcactgaacacaccctaactgataattgatatgatccatctatatatctacgtccatgtgaatgtatatgtagatatcgatattgatcgaggtattttaaaatagtttggctaatatgataactgatatttgtaagttcttgtgtgacgtgaggtgagtacgtacgtgacaaagaacttagtggcctgacctatttatacactatacttcgagtatatacacatattgtgaaaaaaaaaaaaaaaaaaatccaaggggggg

SEQ ID NO: 3252 - DNA, 591 bp, Triticum aestivum
  unsure (1)..(591): unsure at all n locations
  Clone ID: PAT_TA_3252
tgctccagagcccaggcaataggggcatccagtgcacctgaaccactagctacctagctagctacatcggcaagtcggcagagctcgtgatcaatgggggtcaagctcacgctcccgccggcggcactgatctcccaggtggccaagctgagctccctcctcgccctcctcctcctcgcgctgctgctgcccgtcttcctcagggtcgcctacggctacctcctcttcaacggcatcgtcctcgcgctcggcatccaggccttcgtcggcggcggcggcgcttccatcgccgacgacgaagaccggcacgggtctccgagtgccggtcaggccgtcgaggcctcgccgttccagagggctggagctgaatcagtccgtcccgacgaacgggcggcggttctgggtgatcttgtcgtggtgcctgcctttgtggcgagtaatatattcgagctgaagacaagacaaaggaggtggtgctgaaggtgctgaaaaagtgccgtcgacggcgagcatcttcttcctcagctcgctgaacggcggccagcaagccggcgaagangaaaaggcacgccnnnaggaggnnngnngann

SEQ ID NO: 3253 - DNA, 872 bp, Triticum aestivum
  unsure (1)..(872): unsure at all n locations
  Clone ID: PAT_TA_3253
cattagcacctattgttagctgttggttggccaaagcatccattctgcatggctttttgcaaattacagtggttgctatggctgtttcatcccaagtatttccttacagcaccggagcaccaaaacgagttgtgcttcaacacacctttgtcacagatgctagtaacattgtgtgngtcaaactatgggggctctgtggttgatgctaattcgttggagtttgttttcaacaacgcatctgaggcagcaaaatggctaaaagataactcagagttatccttaaaagaaaaatatcgatctgatagaagcacgtgggtggcattatatcctgtccctttcttgttctctggaagtttgaagtttcctgcacagactgaagagattagaaagcaccaccagcattttccccagctagttgttcagaagacatcaagtaacaattggaaccgacggatgcatctacagctctcacttggttcattatcggaggtttggaccacttcgctcaatattactggcccattatcgaattggacttttgctgacaacacacttccagctccttaaactgtgacaggaggaccaccatcatatatctgccgacttactggacagacaaatgagaattggtctttctggttaaaaggnaaantcttctgaaccgctgagaagtcgatgtggctgtactcgaccaagtttcntgttgatagtgncaaagaactgangagcctctttccaagttgggcaagatatgacagtcttcaccaaaattttctcaacttaacaattgtaaactctgtataaatgtaaanctgngttnnttaagnggggggaanttaanaagttcccntgtttccgggggcaaggatgtt

SEQ ID NO: 3254 - DNA, 633 bp, Triticum aestivum
  Clone ID: PAT_TA_3254
gctgcatctcctagcactagcaggccccgtcgccgccgccgcctgtcctcgccgaggagaaggcgtcaggtcgatctccgcgaggacttcctctctcgttctcccttgcatctggaccagcagcttgaactggagtgagctgatggaagctgaaagaagccagcttagtccaatcgacccaagaagagctcggtttccttgttgcatagtgtggactcccatacccttcatcacatggctgatgccatttatcggtcacattggcatttgcagagaagatggtgtaatcttggactttgccggtccaaatttcgtgtcagttgacaactttgcctttggagctgttacacgctacatccaattaaatggtgatgagtgctataaacttcttgacaccggcgcagagacgacatgggatggtgctctgaggaaaggcgtgcaggagtttcagaacaggaactacaacctgttcacctgcaactgccactccttcgttgccaacaacctgaaccggctcttctacgccggccacgacaagtggaacgtggtgagcctggccgcggtgatgttccttcggggccgctgggtgagcgcgggggccgtggtgaagaccctggcgccattcgttgtggt

SEQ ID NO: 3255 - DNA, 613 bp, Triticum aestivum
  Clone ID: PAT_TA_3255
cggacgcgtggggctttgtcctgagtgacatgtttcagaacctgcgcagtgaggacaggggagctcttctccatgaaggtgctggacactcagttgtatctgcttttgtcgagataatttttgataattcagacaaccgtattccagttgataaagaagaggtacgcttgcgaaggacagttgcttcaaagaaggatgaatactacttggatgggaaacatgtcagtaaaactgaagtcatgaatctgctggagagcgctggtttctctcgatctaatccatactatgttgtccagcaaggaaagattgcatcccttactctaatgaaagattctgaacgactggatcttctcaaagagattggtggtacgcgtgtttatgaagatagacgtcgggagagcttgaaaataatgcaagaaacagccaataaaaggaagcagattgatcaagttgtccgctacctggaggagagactgagagaacttgatgaagagaaggaggaactaaagaagtaccagcagctggacaaacagagaagatcacttgaatatactatattggaccatgaactaaatgatgctagaaatgaattagcttcgatggatgataatcg

SEQ ID NO: 3256 - DNA, 481 bp, Triticum aestivum
  Clone ID: PAT_TA_3256
tcgacccacgccccaaccccgacccagccggaaaggccagccaaaccctccccagtccccattccccacccccctccgagctcgccatggcgccggtggatccgcactcctacaccgacggcgcgcacccggtgaccgcccacgccgcgctcgccttctacctcgacttcgccgcctccaccatccacgcctccgcgctcgtcaccctctcggcgccgcacaccggggacctgctcctcgacacgcgcgccctcgccgtccactccgccgccaccgcccccgcccccgacgcggcccccttccccatccccttctccctcgccgccgacgccgacccggtcctgggcaccgcgctcacgctcgccctgccccccgacactgcctccttcctcctcaccttctccacctccccgggcgcctccgcgctgcagtggctcgccccgccgcagaccgcctcgggcctccccttcgtcttctccca

SEQ ID NO: 3257 - DNA, 1478 bp, Triticum aestivum
  Clone ID: PAT_TA_3257
cccccccgcggtcccccccgcccccaggcaaggaaggcggaaggcccaacatttgaccagtttgaaggacagtggtgctggttcttaccatctcggcgtgctccatttgctaagactttatggctgagggcatggcaatggcccgcgctggatcattggtttcaaagcttgagtccaagatatgctatcatagggatgctgccctcgagtacatggaaatcaaggctgttgttggtgaagtcatggaagaaaaggagatgctccagcaggattatcgtgcactgaaagatgaacttgaggaggcaaagaaaacgattgtggaagtaaacaaggagcttgcagcaggaagcgaggagacctctctcagtaaaaaggagctggagcttgtaaagaagaagcttcaagactgggaagctaagcaaaatctacctgagctactgaattgctctgcttctgagcatgtccagcctagtaatagtaaggggcagaaaagatcaatgaggcaccaggaagtgccttctcaaggtcctctgggaattgatgctcacaagcctgacctggcagaagagcgtcctgggagcatgctggtaaacaaccccattgttggccaaacctcagttgttccaccaagcacagatgatgacgtggtggccctgcgtgaacatctgatcaagcaattccttgaaatcgataaatacggcgggcggatcatcgggataaaggaaatgggcaaactgaatgtgaaggcgttcgagattgcttgcgctgagaagttccgtacaacaaaagccgctgatgcgtctagtaagctgtactcactgtggcagcagcggatcactgacgtaagctggaatcccttcaacatggtcacggtcgagggcaatcatcaggaggttctgaatgtcaatgatgataagctgcaagaactgaagaaggaatggggagaaggcccctacaaagctgtcatcaatgcgctgatggagatgaaagagtacaactgcctaggcgacaggagcaccgtctatgagctatggaactaccgggcggaccggaaagccaccctaacggagtgtactgagtacatggccgatcgtgtgcaagaactcacagtggtcaagcgcaggaagactcgcaggaattagtgatggctcctgcaagatgctctagcaaggaaaagaggttgccagaccccccttagtagtagttaagcagcaaaactgttgtgagtgtgctttgagtaattcttaacctggctgtagcaagaggggggaaactatgagagcaagcccttttcgtattttttttttttgcgcggaaagcccttttcatattgttggaccaagttacatctatctaatacaatgcccgttttaccttatgctcacctctatctaaaacaatgctactctgatatttgaaattcctgcattcggatttcaaaacacagagcaagtgtgcttgcatgtttaagttgtcaa

SEQ ID NO: 3258 - DNA, 1339 bp, Triticum aestivum
  unsure (1)..(1339): unsure at all n locations
  Clone ID: PAT_TA_3258
tgttagggactgctcttcccaaatcggaggggactcctgtccggccccgtccagtccgccagttgtccaggcacccggacgttgcgggccggccgtctcgccggggcaccaccccccggtgtggcctgacgctatttggccaaggcgcccggggcaccacccgccggcccggggcctgcgcgtggcctcgggttcttctcttgtttctttttagatgccggaatgaatctattgatgtgtcatgatgatagtacatatatagatatatatatgcaacaacatcgtaggattattatgatctctctagctagaattcctagtggtgtacacactacacacacataattacatacaactcattttgcaatcggactgaggagcgctttttttgtttttttcaggaacaaaattattctaatccacagacagatcaacatatatcatgcatgtaacaaccagaataaagagggaggagaaccggagaggaatatagagctgtatgtgcagatgctataagacgaaggcacctagggcaggagagtgctggctgtgtgccacgcattgcctcttgaacaactcctgctccgccggcgcagctctccccctcttctctccggcgatgtcgacgccaaacagcctcacgacacggacttgttctccattagctgcctccgccacaggcggagacgccgttgcagcgccgccgtcagcggggcagctcgccatcgtcttgttcttcttgcagtcgatgaagaactgcttcttttgaccgtacgccgagcacgagaacacgatggaatcgccggcaccgaggcccttctcccggacgaagcggctccaacccttggtgagcacgtagctctggctgctgttccagtacgagtaccggaagcgccacaccttcccttggccgtcctcgaagttgagcagcacgccttgcncggtggtcgtcgtcgtgtgaggagtgcgcttcagagggaagtgcttctcggcgtgatgcttcggcactacgaggcgattgagcttgccgacatcgctaggggtcacggccttctcgaaaaggggctcccgcgcccacgacggcgtcggctgcgcgcgcgcccccatgccacggccgcgccgcaggccctggcggagttcatcgggcgtaggtctgcttccggagcatgtccagtatctcagccttggagtgcgccgccaggaaggcgagctccgcctccacggtcgcgcacgggaagttgaaggcggcgtggcggccgcggtacctgagcgaggctacgtcgtaggctcgcgccgccgagtcctggtctgggaacgtgccgagccagacgcgagcgtg

SEQ ID NO: 3259 - DNA, 795 bp, Triticum aestivum
  Clone ID: PAT_TA_3259
tgtctgttggcgccaaaccgggcggggtcatcgtggagagccgtggagctcatcttcctgtacttgggatgtaacattgagctaaggtctgagggtacgtagctgcctgcctgttggtgaaataaatggccagcttgtgttcttgtgagcagaagaaagaatgctagctgctcatctcatctggcttgcttcaagtcatggtattcagttattttttggaaaatgatattccatgtgcctgcttactggagcacacggcgtcgatcatggccaaattaatgcagtgaagttccaagatgtcatcatcaccagagacagaaggagaggagcagcattcactgcactctacaccatgcatcgagcagctcaagatgctcttcaaatgatgagcgcttcttcgccatcgactgtaggatcttctttgtaccagacttgggtagcactgtctgtcgatcgcctctgggaagatgacccgggtgatagatgtgtatggaatggatgaatgggtagagataacccattgcaatccaatttctccatcaggccttcatcatccagtgaagtttctcattcataaaaaggcaaggagaagatgattgatgttcaccacatattagcatggttttaaatagcggtctatgccaaatagcggcagaccgcaaaatcagctatagcgggctatttgtacatgagaccatttagcggcaccctgctgaaaaggctatagccggcggctatttaaaactatgcatattagacatgctatgtatattatcattgtcaacaccattcttt

SEQ ID NO: 3260 - DNA, 1111 bp, Triticum aestivum
  Clone ID: PAT_TA_3260
cccacgcgtccgcggacgcgtgggggctcggcgcacgcagtcacacactagcagtagcagacaggggcagtggaaagagaggagtgagaagcagaagaacaagaacagcaaggaaggcccggaggagagagatagagggtgaaaggaagaagagaagttgagtgagtgcgcaaggatctggtgagggatctcatcatgcagaactcaaaaaccagtaggaatggctcttcagatgctccgcagaggacgtctccagcaactccgcggtcgtctcgtgtggctaaaactggagggaatgaaactgactccgcagggatcacaccgacaagaacacctacagagaggagcccaaaggtcattgagcgccgttcaccacggagcccagttacggagaagaagcgcccaagtaggctaactgagctggagtctaaggtcaaccagctccaagatgagctgaagaagaccaaggaacagctgagcgcatcagaggcacgaaggcgccaagcacagcaggaggccgatgaagcaaagaagcaggggcaggatgcatcgtcgaagctggaggagtcgcagtgccagcttgtcgagctctcagcagcagaggaatcccgtctccaggagctgcgcaagatccagcaggagcgtgaccgcacctggcaggccgagcttgaggcattgcagaaacagcagtcggtggatgccgctgcactcagctcggccttgtctgagatccagaggctgaagttgcagctggaggcgacggtgcaatccgatacagcccgtgccaagcaatgtgagcatgcggactctgagctcgaggggctgaagcaggagatggagctcaggcttgcaacgattgaagccctgaaagtaaatgtcagtgaaagtgacaaggctgcagctgatgcgaatgccatggcaactgaggccaagctgcagcttgagaccgcaaaggccaccattgacacactcctagctgagggtgtccggttgcaggaatgcctgaggtcaaaggacatagaactcagtgagtctaaagctcgggtagcatcgcttgaggaagatctgaagaaagcgcaggctgcaggtaatgaaattctgaatgaggcac

SEQ ID NO: 3261 - DNA, 608 bp, Triticum aestivum
  Clone ID: PAT_TA_3261
ccggttactccgccatcgccgacaccaattacaccacctattacaccggttactccgccatcgccgacaccaattacaccaccaacgccaccatcccctgtggccccggccccagtcccagcgacgccaccgccatcgtcatcaacgggcaagtgccccatcgacacgctgaaactgttggggtgcgtggacgcactcaacgggctggtgcacgcactaatcggcagcagtgccagcgacaaatgttgcccgctgttatccggtgtggctgacctcgacgcagccctatgcctctgcaccaccatcaagctcaaggcgctcaacatcaacctcgtgctgcccatcgccatcgaggtgctcgtcaaccaatgtggcaagacagtgcccgacgacttccagtgccctagttaagctccatcaagtactatagtgctataagtatcacctgcatctgcatgcaatacagcctttaaatctcttgggagtcacttatgtaataatatctacatgcatgtgcagctctaactacttgtgatgtggagctttggaacatgcatgcattttgttagtgtaattgtctatcaaatagtaaccgtgtaacgttttat

SEQ ID NO: 3262 - DNA, 270 bp, Triticum aestivum
  Clone ID: PAT_TA_3262
gcgagcactcggtgacgagccctatcgccgtcacttggccgacgagcaaggttgcagagatgtgaatgtgatcgccgttgggtgtgtactagtacatagtacgtgcgattatgcgagaatttatctcatttgctgtaagtttcacttcctgtggttgaatcagttaatcaagattcttactttttgatttcaaaaggaagactagtattcaagtcaatacaactaccacattggtaaataaaaaattatcaatgcagataatttattttt

SEQ ID NO: 3263 - DNA, 2097 bp, Triticum aestivum
  unsure (1)..(2097): unsure at all n locations
  Clone ID: PAT_TA_3263
ggcaagtgcgtctcaggcccgtcgttcaacggctccgcgctgtgcaacaacaagctcgtcggcgccaagttcttccagcgggggcaggaggctctacgtggccgtgtgctcggtgcggactccaagtcgccgctagacacaaacggccatggcacccacacctcctccaccgccggtggctctgctggctacggcgccggctttcgactatgccagagggaaagccgtcggcatggccccgggcgcgcgcattgccgtctacaccgcgccgaagcgtgcggggaggaagggcgccagttctgacatcctagccgcgtttgatgaggccatcgcggacaatgtcgacgttctctcggtctccctcggcgccgtcggcatggccccgaacttctacagcgataagaccgccgtgggcgcgttccgcgccgtcagcaagggcatcgtcgtctccgcctcggcgggaaactccggccccaaagagtccaccgcattcaacgtcgcgccatggttcttgacggtcggcgcgtccacactcaaccgccaattcccgggctccaaagtgtgcgagaagggaaagttgaacgctaccaaggtcgcggggaagattgttctatgtgaatcgggtgtaaatgcccgagcagcgaaaccatatgccgtcaagctcgccggtggcgccggagcgatcctcgcgagcacaaaatcattcggcgagcagtccatcaccagcccgcatgtccaccccgccacggctgtgtcatttgtcgacgccgagaagatcttcaagtacatacgcgtgcaaacatcccctaccgcgacgatcgtcttccgcggcaccgtggtcggcccgacgcctccatcccctagaatggcgtccttctcgagccgcgggccaaacttccgcgcgccggagatcttcaagccggacgtgaccgcgcccggcgtggacatcctcgccgcttggacaggcgccaactcacccacggagctcgagagcgacacgaggcgggtgaagtccaacaacataccgcgcacatgtccaccccgccaatgcggtgtcatttgccgccgccgagaagatcaggaagtacatgcgcgcgcaaacgtcccctaccgctacgatcttcttccgcggcaccagtggtcggaccgccgcctccttctcctagaatggcggccttctcgagccgcggcccgaacttccgcgcgccggagatcttcaagccggacgtgacggcgcccggcgtggacatcctcgccgcttggacaggcgccaactcgcccacactgctcgacagcgacacgaggcgcgtgaagtacaacatcatatcgggcacctccattccgtgcccccacgtgagcggcatcgccgcgctgctaccgcaggcaacgcccaagtggggcccggcggcgctcgagcccgccctcatgacccccgcggcccccgggcgcgcccaacgcgcggcagcgacgccgcggctgcgtagcacggcgaagatcccccgcccccgccggcctgcgcgcctcggccccccccgcgcccgcggccctgcacctcggcgcggcgcccgcacgggtgcctgctcacccttccgctgcgcgcccgcctactccgctcacggagaagcacacgttcgggtcgatcgagtggagcgacggcgagcactcggtgacgagccctatcgccatcacctggccgacgagcaaggttgcagagatgtgaatgtgatcgccgtcgggtgtctacgcctacacgggaccagcgacgatgccgaagtttcgactacgtgccgggcctatcactccccgcctgacggtctgctcgtcacggtgcgccccgagacgctgcggttcagtgcgacgcagaagacgcaaggatatgccgtcaccttcgcacgggaaatcggcgggagcgtcacggggaagtacacctttggctcgattgagtggagcgacggcgagcacacggtgacaagccccatcgccatcacttggccgacgagccaggttgtggagatgtgaatgcgatcagtgtagtgtgagagtttatgtcatttgttgtaagtttcagttcatgngggcatcagtaatcaagacgtc

SEQ ID NO: 3264 - DNA, 894 bp, Triticum aestivum
  unsure (1)..(894): unsure at all n locations
  Clone ID: PAT_TA_3264
gcgctcatcagccggctgctccaccactcgcttgtgcaccgtgttcttggcatcccattccaccaaatccacatatngccgaacaactgaagggaagccgtatctggagaatggccctccggccttcagaaacttcaatttcaacacgtcgcatcagggtgactacgtcggcatagcagcggagctgctttgccttgttggccttgatattgtgtgtatctctaagcctcagggagaaaccaccgtggaattccttaagaatttctcttcgtacctcacagaccatgagtggaactgcattggtcgcgctgccggttccattgagatgttatcagagttctacaggtactggtgtctcaaagaagcatttgttaaagctgtaggcgctggggttggatttgggctgcatcgcttggaattccaccatgttgaatggagtaacatctctgtctacattgacgggatagagtctaggaaatggaggttctgccttttcaagcttgatgaaatgcatttggcgtccatagcgaaagggcatccggaggatgctacacacagcttcaagacaacattgtctgatgtggttgttgaggacgaagaattttatgctgcactagagataccagatgaaactttcacgctacagacagcggagcaacttacacaattctagtcttagctgggtagatttcttacatagtgcagtaacatatgactccaggattatctcaagacgatgaaacgccatccgcttattgatttctcagttgcataccacttcacgaatgaatcaagcgatgaaatatatacttgaaggtgtcaaataagtagataatcaagcgatgacatatacatgaagaacgtgtcaggatttgataaaaaaaaccttgaaac

SEQ ID NO: 3265 - DNA, 924 bp, Triticum aestivum
  unsure (1)..(924): unsure at all n locations
  Clone ID: PAT_TA_3265
cggtggctgctgccgtggaggcgagtccggtggaggtggaggaggggaggagcaagacggtggctgctgcggtggaggcgagtccggctccggtggagaaggggaggagcaagacggcggctgctgaggtggaggcgggtccggcggaggtggaggaggggaggagcaagacggtggtgctggtcgccgtggacgacagcgacgcaagctaccgcgcgctcgagtgggccgtgcggcacgtggcggcgacggccggcatggccggcgccggagcggtggagctcgttgtcctccacgccaagccgcccacttccctcgccgtcaacatgggcggccccggcgtgcccggcgacgtggtggggttagtggaggaggacctgcgcaagaaggccgagggcgtcgtcggcaaggcgcgcagcctctgcgccgccaactcggtggaggctgtggtggacgtggtggacggggagccgaagcacgtcctgtgcgacgccgtcgagaagcaccacgccgatctgctcgtcgtcggcagccagggctacggcgccatcaggagggcattgcttgggagcgtgagcgactactgcgcccaccacgccgactgctctgtggtgattgtcaagcagcccgggtccaagaactgatcgccatttccggtgttggatcgatcgtgcccagttccagtgttgggattgtgctatttgcgtgcctacacaatgtatccctgcctaattatttctgctccaaccagttgtattctctcttttatttactctgcataatactagcagtcaagctttgtaaactttgattaaatttatattaaaagtgatctaaatgatcttatattatttacagagggagtacaattaccantcagcacaataaatcatcgttgaaatnattcacattaaaaaaaaaaaa

SEQ ID NO: 3266 - DNA, 632 bp, Triticum aestivum
  Clone ID: PAT_TA_3266
cgacccacgcgtccgaaatatgcacgtccgccaaacttgccatcggagggccttgatgaaatgatggcatccgaatttgtggaatggttcgagattgcttgcaaagaagatcccaattctgatgaggacttgtggaatttagctaatgggatgcagctctagagcctattcctatagctcctatgatgtgaatggctttcgctttagatcagagatatctgagaaaaaacgtagaaggttgaaaacggtgaacacaggggtttgtttgtcatccttcatctcagagactgaacaacttgagtactatggtgtcattgaggaaattatcaaagtatccttcacagctggtagaaaaattgagatggtactcttcaaatgccgttggtttgaccccatcaagggtgtgaagccaaatgcaaaattaggtttggtggagataaagtggtcttcaaggctaagtaattttgaaccatttgccatggctcaccaagctacgcaagcttattacttgcattacgcatcctccaggagagatcttcgtgattggagggttgtttacactattcagccaagtaccagcttgagtaactttgatgactgcgcaaatgacccatctactacagatgaatatt

SEQ ID NO: 3267 - DNA, 933 bp, Triticum aestivum
  Clone ID: PAT_TA_3267
gaggcgtattccccatggcaacggcatcgaggctcctgcgggccgcccggcacgcatcgctcgcatctcgcgccgctgcgtcagcggcatcgaggctgctgcgggccgcccggaacgcatcgctcgcatctcgccccgctgcgtcagccgcatctcgcgccgctgcgatggccgcgtgcggcaccgtcgcggcagccgcatctcgcgccgctgcgatggcctctcgctcagagcgtgcggccgcagccgtcgcccatttagcctcggacgtcctccagagccgcccaattcgcggcgatgcctcaaggcacgaagccccatggccgtgacgctcctcgcttttgcctcgccgagtacctatccagcgccaattacaagcgcttgccagatgatgttaagaccccgacggacaaggaccttgagtcggacgaagccctatgggccttgtatgagcgctggtgcaaggctcataacaaggaacgtgaccatgcggacatggctcgccggttcaaaatattcaagatcaatgcagatgatgtgcaccattggaacacttatcttcctccagatccagtggaagcagccattcaccgtgagaaaagagaagaggcaaagttacttcgttcaaaaggccaagacgtctcatactttgatgtgtggcatctgccatcggaattaggtccattcgccgatggcggagacccatttattgccgaaagcaatatgcgcttgttgaaggaaatcgaagatgctgaaggtgttaaagcagagtagtagtttgcttagggaaatcccagaccctgaatgagatgaactcatctcaccaaatcactccactgtaataagttatgctttgctgttccatgtgtactaagttatgcttccatgtgtgctaagttatgcttcagtgtactagctaacaaaaaaaaaaaa

SEQ ID NO: 3268 - DNA, 905 bp, Triticum aestivum
  unsure (1)..(905): unsure at all n locations
  Clone ID: PAT_TA_3268
cttatactgtatagattttacaacctgatatgatcagcggagaataaaacagtgcaagtgcctgccagtagcaccatgatcaactttgcatactagtagctgctatacacatacatatttcaccgtgagtagttattctaggcatagaagctgaacacatcttcaacagttattctaaacacatattttgatgtgtaacctgttaatgaagtattggttgattgtgattccaagcatagatctcttggcgttactacttgttactgcaagcatgttgtgttgacatactgcatttcgatctgaatatgttggcaagagtgtctaaattaatttagtatatatgcacgtttcatcttantctcttantatggttggatgtgtgcttcagggggataaactgctatctatgctccttattggctctgaagttttatgtctgtccagtgtgtaaggagctctaatttctctttctagcgcctaaattatgccatgtgtactagggggagctagatgtatgatgtacgacaacgggaatgggacctggtgaggaaaggaacctactgggtcaaccagatcgagtcccttctctacatgttggttttgctcccttgcacagcagtaaatgcctctacaaacatgatactatatacatgcatgtcatagtcagcagttagcgttggcaatgaagtgaaccatgagattacattttgctttgtcttgttgataatgccatatgtcttgcaatcagacttcatttctgtttgttatggtaatattttcatagtgctatagaacatctagtaacaagaatatgaaattgtaaatatcaaaaaattcttgtcttgtgcggtctaagtccaaggaaagtaaaaaaaattctcttatacaaaaaaaaaaaaaaaaaa

SEQ ID NO: 3269 - DNA, 674 bp, Triticum aestivum
  Clone ID: PAT_TA_3269
cccctgcagcgtggctgcagcctggttatgattactgttaatgttgctactactgctgacaatgctgctgctgcttctcctcactgtctccacttccttgaacaatgcgccgtcatgcttcttttgcctcccgctgctccagaaagctaggccgcagatcagaaccaccacagtcaatatcaccaccttcctcttatagattcggaatctcatgataggggctcagcctctgtgcgagtggagagaagtttgcaggcgagctgaggagcaattgcaggtgatatgatgtgctcggctcaagaagcgggcccggagaggaagaagtcgtgccggggctaattattggcaaaacgagctcttgttgtaaacattgatccaactggaatgtcactaatggcgaatcaatattccataaggcatgatggttgctcagaggcaggagaagagcaacgaatacgatcctataaaagataaaacataaataaacagtcttgattatattctgggtattaaagccacaatcagaacaaatatatgctttgtatcttttcttgccttcttcattaccaactgcttccgcggccacattaagagaacttgtggtaagataagaagatattttattcgttctgctgacttgctggatgtcgggaaatattctgcatttgataaga

SEQ ID NO: 3270 - DNA, 885 bp, Triticum aestivum
  Clone ID: PAT_TA_3270
ctcgtgccgaattcggcacgagaaaaaatcgtcgtctcccgctccactccgcctcgccgaggatgtcttccgccgccggagccggagccggagagcactcgtcttcatcccgacctgggaagcagagagaggaaggtgccgacgatagcaaccgcaaggtggacgatgagggagatctgagcctggaactctatggcgccgaggcggggtgggtggaggcgcggaccagctgcccgcacctccctgccatgcccgccgccagcgccgacgaactcgcgcgcgtgcccgcgcctgattcccactgctctagatgtcatcacccttctgaaaactggttatgcttgatctgcaaggatgtgctgtgtagtcgttttatcaacaaacacatgctgtgccattatcaagaaacgggccattgtattgccctgagcttcagtgatctgtcagtttggtgttttgcctgtgactcctacctagacgctcaatccattttagaactgcgcccagtttatgaagttgcacatctgttgaaatttggagaaaggcccccttttcgatcacttgaagtactggatttgagcagtggacaaaatggaggttcatcttcaagttcctaatgtgtgatcctctgtcagtgagtttttttgtcatgatgacagtagcccattgtgtgagatggaccttgctaagcaccagcacaaatataagtcagctaatggtcatgttcctcattactcctgccgaagtacctgttaggcgtgaagcaaactgataattgtaaaagtctgtttacctttggacatgataaaggcattaaaattgccttgatgttgacatccagaaaagtattcaattgcgaatatatttttctccagtgactgatgt

SEQ ID NO: 3271 - DNA, 1215 bp, Triticum aestivum
  Clone ID: PAT_TA_3271
gctcaatagtctgcactgcacacgcacaaacacagtcggttgcgatcgagagcatggctgccgctagtgcaagtgcgggccgcgccggcatgaacgctagtagtgctctgtgcgtcgtcctgctagtcgtcatggcggccggcggggcgtcggcgcagctgtcgacggggttctactcgagctcgtgcccgggcgcgctgggcacagtcgcgtcggtggtgcagtcggccgtggcgaaggagccgcgcatgggcgcgtccatcctccgccttttcttccacgactgcttcgtccagggctgcgacgggtcgctgctcctggacgacacggcgagcttccagggggagaagacggcgatgcccaacaacgggtcggtgcgagggttcgaggtcatcgacgccatcaaggtggccgtcgagaatatctgccccggcgtcgtctcctgcgccgacgtgctcgccatcgccgccagggacagcgtcgtcgccctgggcgggccgaactgggcagtgaaggtcgggcggagggactccacgacggcgagcttcagcggcgccaacaacaacatccccccgccgacgtcggggctcgccaacctcacgtcgctcttcgcagcgcagggactctcccagaaggacatggtcgcgctctccggatctcacaccataggccaagctcgctgcacaaactttcgagcacacatctacaacgagacagacatcgacagcggcttcgccgggacccgccaatcgggctgccctcccaactccggctccggcgacaacaacctagcaccgctggacctccagaccccgaccgcctttgagaataactactacaagaacctggttgccgaagaaggggctcctgcactccgaccaggaggtcttcaacggcggggccaccgaccccctggtccagtactatgtcagcagccagagcgctttcttcgcagacttcgtggcaggcatgatcaagatgggagatatctcgccgctcacaaggaacaatggagagatcaggaagaactgtaggaagagtaactaaaataactattacgatcaaggtgatacaacgtatgtactgagagatccacgttttgttgaaagtttgtggttccacctcgtttttttatttttttgtgcttccacaatttgtgaaattaatatgtactcagtgatatgtccggtcattggataattccacaatatatga

SEQ ID NO: 3272 - DNA, 554 bp, Triticum aestivum
  unsure (1)..(554): unsure at all n locations
  Clone ID: PAT_TA_3272
tatgtgacatatgtaagatcatatttgcggctttgctgttgttgagctgcgtaaattttcttcaagtccaacccagtctggtcgccacttcatttacatgatcttgttcttgtgagggattattttttatggatctgagcccccattgttcttgctgttgtttcccactcctgtaattaacctttactaagtactgttaggtcttcagcataacactgaatatttaagctaataaggataccattagatgaccgaccctgtaattaactttattcagtttatgaacatatatgtacactacagagcataaaaatgggaaaatacaaatatgattggtggttggttcaccacctaaaaatttgatctaccaattgtgtctcagtgatttctacttgagctaagaccacgccaataattttggaacggagggagtacttattgtggtgtgaattgatggntgataaaatacatgaaggtaaatcgacgtggtttgataaatttgtncaagatatanacggcttccggttgggaaactataaccattctccactnag

SEQ ID NO: 3273 - DNA, 1208 bp, Triticum aestivum
  Clone ID: PAT_TA_3273
ctttcgcacacacaagaatttttattgcctagagttgtgccactgctgcattcatagcgtactgctggctgctgctcctgctcttggcggccttcttctcgccggctgggccttcttcgtgccaccacggcgacctccgtccggcccggcggtcccccgccacgcgctgcagtggtgcggccgtgctctcgtgcggcctggcgcgttccctcttgctgtgtcggtgggcgcgtcttcggcggggtgggtaggggcggcgccgcgacgcggcgactcgccgcgggccggcgcttgggcggccccggcccggcgtcgttgggcccccccgcatggcttgcggggctcgcccctcccaacaagaaaaagctcgccaccaccaaacagagggttatcgtgcccttgcacctttggtatttgtgaccgtcggcgatttttttagttggcgaactacacaaaagtttgagacggctcaaagggcttgacatagctcgtcgttcacgaggcatgtgttttactatcatgccattgtatgtgaagcgtaatagaagaacactcgacgaacaaccaaatacaatatctgggagcaacaacactgtcagatctgggagcaccaacgttgtttctgggaatgacaacactgtcatatccgggaataacaacaatgtgggctgggagcaacaacactgtcataaccgggaacgacaataccgtaactggtagcaaccatgttgtatctggggacaaacatatcgtgactgacaataacaatgccgtatccgggaacaacaataatgtatccgggagcttccataccgtatccgggagccccaatactgtatctgggaccaacaacactgtgtctgggagcaaccatgtcgtatctgggagcaacaaggtcgtgggagtggaatgaatggtaagtgaattgtttgcatctgatgtaacggagcttctgttgttgtccaagttcagtgtatcccacaaccacttgggtggggtcaatagtgtcatgtaacttccattcatgtatttagcatcttattacaaatttagaaaccttttactactttaaataaaatttcccgaaattgccttgcatacacgctccaaatatcaacgggcggcttgcagctgatgtagaccaagtgcatttgcttttgaataaatttgtgttgtggaaaaaaaaaaaaaaaaaaaaaaaaaaaaaa

SEQ ID NO: 3274 - DNA, 663 bp, Triticum aestivum
  Clone ID: PAT_TA_3274
attattaattaaactgaccgattaaatcggcattcatacacaatgcctggaatgggcccaaaatgtgccaatattccatatgtttttttaaattacaatattccacaagttgaacagagaaagatactacaagtggcacgcaggccaagatatcggttgtgatctagaaaagtaggcatgataaacagtgtacacatgtttaataaaagaaaaagggaaatagataacgggagatgaatatattgaaagttttttttttgcaaaaaaggaaatatactcactccttatatgcgacaatcgttgtgtagcaaatggtttaaggcgtgactggtacgcaattactcagaatattaatgttttctctttttgttggacattgcttatctcctttgattactaagccttttaatatctttgattttttacttcctgttttgatgtcagcttcacgttagcttctcaagtgaaacacaaacacgaggtgcatcattgtgcttctaacctcagggtatttcttttctttcttgaagtattagcgaatttccactctttgtgtcaagaatatggtccttggtactttaatttacttctaatattgttatgctacctgcaacattatttaaatagtaaatttattttgagttaaaaaaaaaaaaaaaaaaa

SEQ ID NO: 3275 - DNA, 1100 bp, Triticum aestivum
  unsure (1)..(1100): unsure at all n locations
  Clone ID: PAT_TA_3275
actgcggccagactgcattgatgcatgcatgccgacatggacactgggaggtggttcanatgcttctgctcttcagatgcaatgttaccagggcggattacttgagtggtcgaacggcattgcactttgcagcacacgacggacttgttcggtgtgtaaggctgttacttgccgacttcatcccaagtgggcccttggaggatactgcctcttcggtggcagatggcggtgattctcagatgaatagcggcagcagtcctacttcttcactgggactcaagtttaatgaacctgctcgtgtgaggtacatcaacaaacctgctgatggcggtgttaccgctcttcacatggcagctttgaatggtcatttcgattgcatgcaattgttgattgagttaggtgcaaatgtctcagctgtcacatttccctacggaactacatcaaatttgataggagctggcagtactcctttgcattatgcagccggtgggggcagtctggaatgttgccaggtacttctttcaaaaggtgctagcaggttgacactcaactgcaatgggtggcttcccatggatgttgctaggatatttggacgccgttgcttggagccattactttctccaaattcacacacgattattccagcaattcagccatccagttatcttgccttgccactgatgagcatacttaatatagccagagaatttgggttgcaacacaccgtatcctcggtggatgagagtgacctttgtgcagtttgcctggaacggtcttgctctgtagctgctgaaggctgtggtcacgagttctgcatcaaatgcgctctctatctttgctcaaccagcaacgtccgtgtggagttcacaggcccagctgggtcaatcccatgccctctctgcaggaatggaataatgtcattcactaagctaccgagcacaccgacagaagggctcaaatcaagctcagcactcacattctgcaatccatgcattttgaatacccgttctgtggactccccagcaactgtctgtaaagctgaaatcaggcgcaaccgtgtggcagctctctcttccgagttagtctgtccactgacctgc

SEQ ID NO: 3276 - DNA, 418 bp, Triticum aestivum
  Clone ID: PAT_TA_3276
ccggacgcgtgggagctcacgcatctctccctcagctccggcaagcaacaccagctctcctctcccctcgcttccctgctgcaatgtcgaccgacgtggccgccgatgtcccggcccctgaggtggaggtgaccgccgaccccgtcgtggagaccacggccgaggccgccgccggcgacgcgaagccggccaaggagaccaaggccaaggcggccaaggccaagaagccctccgccccgaggaagccccgcgctacccccgcccacccgacctacgccgagatggtttcggaggccatcaccgccctgaaggagcggacggggtcgatccagtactccatcgccaagttcggtgaggacaagcacaaggcgcaccttccaccggaacttttcgaagatcctgtctgtgcagtttaaga

SEQ ID NO: 3277 - DNA, 858 bp, Triticum aestivum
  unsure (1)..(858): unsure at all n locations
  Clone ID: PAT_TA_3277
accggtccggaattcccgcccggccccgcccccgccctcacgccggcgcagatcctcgatctgatccctccatgcccgccgccagcgacggcgacggagcctcccccgcgtcgacggagctggccgcgccggggaaggaggagctggagccccctacacctgccgaggagaccccaacccctaggaagacgcgcctgccgcgcgcctgcaacagcaagccgaggctccctcccccgccgccgctagaacggccgcgtcgccgagctgcagcgggtgccgccgcggacgagacgccgcaatgccgcgtggtgacgccgcttgtgtcggagcccgaagcgcccgcggagctggcacggtggcggctccgctgtatgtgggagctcggctccgtactcaacttcctccacgtgttccgcgctttgctcaatatcacggtggagctcacggcagaggatatcgaggcggcacttatcacacctaacggtactctatacgatattcacatgccgctgctaaagtcaattcccccaataacccgcatggcgatggggcgcggaacctgggtaacccgtcctatgtagaaaaactaagggattgggtggcattgggttgcagaaggggatctaccaaatagttgcatcacaatggagctgaaattggaatggacaaggagcttgaaccatcgaccgtttactgatcttgaaagcgatatgtngacatacgtgtcgagcaagatgatatacgcanctacattgacactaacgtaaangtggttatacnttccnacttccgnaaagaacaattggggaaatcccttggaacccaaatgggncaaannatcaatcctgggcataattt

SEQ ID NO: 3278 - DNA, 679 bp, Triticum aestivum
  Clone ID: PAT_TA_3278
gctggacctcctcgtccccgcctccggcggcctctacggcacccccagccttgacctgcgcatcgaggccttcgtgacgagcgagagcgagccccgcaccggcaacgacacgcacaagcggccttgtcaacaggtctggttcaagccgtggccgtcggacgcacccgtctccccggcgctgggaaccaacggctggctctggctcggcgccgtcgtgtcctcgtcgttcgccgcgttcctcctgctcgtcgccgtgctacagcggttctacatctacccggttgaccgagacagctaccacgtgtacccgtgggcggccagaacgatgctgaacctgctgttcctcggcgtcagcgtcgccggtgtcaccggtgcggcgttcctgtggagtaagcggaggagcgccagggtgtggacttaacccttgtgcgctcgttttttcagtcttagcagagaataacagctgagtaggtcattgacagctgagtagataagtttgttaggatagtttttttcctagaactagtccaactcccgcacgaactggatcgtgggatggcgcggtcattgtggttcgtcgtgggcgtttttctcgggccgttggtggcctcgttcctttgctgtaacagaataagagaggatgcagaaactgagaaaagttgcaggttgaacgcaacgc

SEQ ID NO: 3279 - DNA, 2189 bp, Triticum aestivum
  Clone ID: PAT_TA_3279
ccttacccacgtttcctcttcacctgcgtctccatcccggcctcctcgcccacaccgcatctccgcatccccccccgcgctgcgcctccgcaccgtcgtcgacgccgacccgagatcccctcctcgccccccgatttgcacggacggacgcacagcccgagccacatgccggtgggagcgggcctgcgcgggtgatctgtctccccccgtcgacagcacgctcgtgcggaggggagccgccacgcacactccagcggggacatcggtgctgtcgcaaaagcgccggtccacccgccccgtccttgggtagtaggcgcaccggcggcggaggcctcggcagctgcggcccggctcgagggctcccttccgtacttcaccacggcgtcctggctcgcagatgtgtccaccggtctgggcctttcgctgaaggtgaaggagcggctcgccaatactgggggcgcgtcgcgcgttggtcgcggaggctgccgcccagcgcgtcaaagccggaagatcggggagcaaccgattcaatctgttgtcgtgctcggtgcccccatattttagtcggttcgcgggccagtgcctccagttgaggtttgcccgactgtagtgcaagctaagtgcaggttgcgtgctgggatttgtcattacaagttaaatgtggacgggcagaggaggcatgacgaggggcaacctactataacgggagagtatggggtggtaaacactttgtacttgacaagggaatttgaccacataaatactgtactgagccccactacacctgggagcaggatggatgtggacaatgatagttttcaacgaatgggttcgttgtcggatggtgcccttcaggaaggttctccaagaatttcagaggctgctatacagatctctaggtgtcgtgttgctgagtatctgaatgcgcatacaggctatgacctactaccagattctggaaaggtcattgctctggacattaatttacctgtgaagcaatctttccatattctccatgaacaggggattcctgtggctcctctgtgggattcattcaggggtcagtttgttggccttctgagcccactggattttatacttatattgagagagctggaaacgcatggctcaaacctgacagaggaacagcttgaaacacacactatatctgcgtggaaagaggctaagcggcaaacttatggaagaaatgatggacaacttagatcaaatcagcatctagtgcatgccaccccttatgaatccttgaggggtattgccatgaaaatactcgaaactggcatttctacagtaccaatcatctattcatcgtcatcagatggatcgtttccgcagctgttgcatcttgcatccctttcaggaattttgaaatgtatctgtagatacttcaagaactccactggtagtttgccgattctaaaccaaccagtatgctcaattccgctgggtacatgggttccaaaaattggtgaaccaaatggtcatccattggctatgttgcggcctaatacatctcttagctctgcccttaacttgttggttcaagctggagttagttcaatacccattgtggatgataatgactcgctgatcgacacatactccagaagtgacatcacagctctagcaaaagacaaggtctacacccatattcgcctagatgagatgaccattcatcaggccttgcagcttgggcaagacgcgaattcaccttttggacttttcaacggtcaaagatgccagatgtgtcttcggtctgaccctttgctgaaggttatggagaggttggctaatcctggggtgcgtcgcgtgttcatcgtggaggctggcagcaagcgagtggaaggcgtaatatcgctgagcgacatattcaagttgctgctgagctagcgagagccctgttttcgttggttcccgggcaagtggtgccagaagagctagcatgcaagaaagagattgtggagccaacatggagttctctctctggcttgctcttggacaagagtagcaaaacagattgtaaagtttttttttcctttcgttgtgccaacccaaccctcaccgtccgtctgtccgtctgtcgtaaccgaaactacctggtgacttttttctctttaaattttattggattgattccgctgcttggcgagattagtctccaaggagccaga

SEQ ID NO: 3280 - DNA, 877 bp, Triticum aestivum
  Clone ID: PAT_TA_3280
tccgcaaaggggaaagggaggcggcggcggcggctgagagatctcccatcggcggcggcgcgcgcgagggtttctttctttgctgttagcgcatcacaaggaaaatggcaagcagagcaggtggcgatggcagagaacccataaatgaacaaatagtcgaaaatatttgtgccaacatgcgctgtgaaaagacccaactctacacaaagatcacgaagctgaaattggaagtcatggagaacgcccttgtgtttgccccaatagggccctgggccccaaaaagccgttgcaccagaataattggcggggcctggtttgaggggaccatcagggaaggtcttgcccgccgtgcaccgcaacaaggagggccttgaagaaggtcgtcccccgcatgaaggaggctctggagaggaagaagcaagagatcaccgagtttgagctctagtacaagatcaggatcaggaagggcgacaacagcgccaatgaagaaggcagcatgaaggaagcctctgcccggggtgttcttgttcgcccggcgggctagtagagcatgatggcagggcgaggagacttgcatggttccttgtcgacgccagatttcttgctaccggatacccgcctgacagtggttgtgtgtttcgggctgcagtttatcatgcagtactgttgaattctcgagtctacgcatttgaaattagggttgaccgtggctctggacgctatccgtaaacttcgcactgtgcgctgtcaggactcgcgtgccttttgtctcccttcgtggtgttgcgttcctgttttgtctccgttgtgtggttgcgcgtcagatcttttctggcggttgatgacatgtttcgattcaagatgagtttcaaaaaaa

SEQ ID NO: 3281 - DNA, 685 bp, Triticum aestivum
  Clone ID: PAT_TA_3281
aggccctgagtaccaggcagcaggcccgggcaggtgcccttgcgactcgcgcctctctgcccgcccctggcgcccctcttcttcttcttcctcctcttcctccggtggagtcccgcgaaatgctccgggttcccgtcagtggctcaagaaatccctcccgggtttaagggagcagaaagggaaaattgtcctggggttaggtaaaagaagaaggacatggctgacattgaagctggcggcaagccagccactgagtctgacactgcaacattgatcccaaacagtgggaacttagaaggttcaagcagggccacaaagacctgcaggttcaaagacgacgacgagcttgtcgagatcacgctcgatgtgcaacgcgattcagcgtcggtccaagccgtcaggccggtggccgcggaggctgcggtggccgccgcgaggaagcgatacgacagaagcaagagcaccgctgcggtggcgctcaagggcctgcagtttgtgaccgccaaagtcggctccgacggctgggccgccgtggagaagcggttcaaccacctgcaggttgatggcgtcctgctccgttccagatttgggaaatgcattgggatggacgggtccgacgagtttgcggtgcagatgttcgatgcgttggcgaggaagagagggatcgtcaaggaggtgctgacca

SEQ ID NO: 3282 - DNA, 958 bp, Triticum aestivum
  Clone ID: PAT_TA_3282
cgacgtggtcgtcatgcctaagacaaaagcggccaggagaaacaggtcggcacggggctcatcttttcgccgaccccagccatgcggcgcatactgctcgcggcgctcggcatccatttcttccagcaggcgacgggctccgactccgtcgtgctctacagcccacgcgtgttccagagcgcgggcatcaccggcgacaaccacctgctcggggccacatgcgccatgggggtcatgaagacgctcttcatcctggtggccacgttccagctcgaccgcgtcggccggcggccgctgctgctgaccagcacggccggcatgctcgcctgtctcatcggcctcgggacgggcctcaccgtcgtgggtcggcacccggacgccaaggtcccgtgggccatcggcctgtgcatcgtgtccatcttggcctacgtgtccttcttctccatcggcctcgggcccctcaccagcgtgtacacctcggaggtcttcccactgcgggtgcgcgcgctgggcttcgcgctcggcacgtcatgcaaccgcgtcaccagcgccgcggtctccatgtccttcctgtccttgtccaaggccatcaccatcggcggcagcttcttcctgtacgccggcatcgcggcgataggatggattttcttcttcaccttcattccggagacgcgtggcctgccgctcgaggagatagggaagcttttcggcatgacggacacggccgtcgaagcccaagacaccgccacgaaagacaaggcgaaagtaggggagatgaactagtgagctagacgtcaaccaactgttaccgatgtactaccatagagatgtatctgatcaacgtggcaatataagtgtcacggactcttggtgctcattgatggattgtttggataaaatttcaagagaattgtttcaaggttggatcaatccgcgtgcccgttgccgcgcgagaaaa

SEQ ID NO: 3283 - DNA, 1476 bp, Triticum aestivum
  Clone ID: PAT_TA_3283
tttaaaacccgccctcccttccccacacgcctcgcctttggaagcgctcttgaaggaagcctcgagacccccgctctccatctctctgtccccatacgcctcgcctcttgagcgcgctcttgaaggaaggctcgacacctctgccttctgctctcctcggctctgcatccgtgagagctgttgcattgctgcagctcgcgagcgcccgggtcgttagtagttctttcaccacagcccggatcatggagttcgacgagcgctgcctcaaggtccaggaccccaaatttgattgcctcctctttgacctggacgacactctgtacccgctgagctcggggatctcatcacacgtcaagactaacattgaagcttacatggttgagaagctgggtattgaggagagcaagatcgaaaaccttggcaacctgctgtacaagaactatggcaccacgatggcgggcctcagggcaattggctacaacttcgactacgatgagtaccacagctttgtccatggaagactgccctacgacaacatcaagcccgaccccgttctcaagcagattctcaagaacatgcgcatgcgcaagctcattttcaccaacggtgacatgatccatgccgtgagagccctcaagagggctgggcctggaggacctgcttcgacggggatcatctgcttcgagaccctgaaccccgccgtgcctgctgacgccgtgcgaccaggcgccggcagatcttcgacatcgccggccacttcgccggggttaggcagcgccgaacgacctggcccaggacccccgtcctatgcaagcccaacgtcggcgccatggaggcggccctcaggatcgccaacgtcaacccttacaaggcgattttcttcgacgacagcgtgcgcaacattcaggctggcaagcgaatcggcctccacacagtgctggttggcacgtcacagcgggtgaagggcgcggatcacgcgctggagagcatccacaacatccgggaggcgctgccggagctgtgggaggaggccgagaagacggaggacgtgctctactcggaccgcgtggcgatcgagacctcggtgaccgcgtagacgccgctggctctcggtgcaccttcagtctgataccccaagcgcaacccgattcgaccccagcctgccggacagatgatcttcacgtggaatgctcttcagcattggccgggaaaccagtacagtatccatcacgaggagaggagggggagttcagaaagtcaggaattaatgcagcatgcgcaccatgccgggccggtcctaatatatgtatatgtatgtgtcgatcagatctttgcttgtaaattactactactagtaaggaggaataataaaaagaaaaacggggttacttgtacgcgacttattcgtatttagccggagcaatattcctaggaagccgaagcaataaatccaggacttgccctactcggcaccag

SEQ ID NO: 3284 - DNA, 711 bp, Triticum aestivum
  Clone ID: PAT_TA_3284
ccacgcgtccggaggaagaagaggacctgcaggcgcagaaggaggaccttcattggagcacagagattttgtatggcgacattgtgtgggcacggctcggtaagcggcaaccagcgtggccgggagttgtcgtcgacccagctcggcaggctgctgccgatgcaatgccaccccagccgcgtggtggtgctgtgctttgtgtgatgctgtttggctggcgtgcagagttcagtgacgagaagaagtatgtctgggtgaggcaaggagggatttttccttttgtggactacattgaccaatttcaagggcaaacagatttgagcagtctcaaacctggtgacttccagagggcactagaagaggcctttttggccgaccaggggttctctgaagtgccaatggatgacagcacagcagggcagcctgttgtctgtcaatcttgtccagacgaattagaagaagtgactggctcgggcgagctggagtgccaggcacagattaagcattatacaagtgaattgcagtgtgaaagttgtggaaattgcttcccaaacaaagagtcaaacaagttggtttatgtgatggagcaacttgcttgcaaacactgtgctaggatcttgagatcaaaagagtactgtgggatatgcttgaaaagttggcaacataaatgtgaccgaagatgggtttgctgtcatggttgtgaaagttgga

SEQ ID NO: 3285 - DNA, 502 bp, Triticum aestivum
  Clone ID: PAT_TA_3285
cggacacaaccgagcgcgcgctccacttcgacgaggcggcggcggcgggcgcgctggaggtgacgccggtggcggtggcgtatccggcgccgcaccgccccccggagaaaaaagcgagggtggatgtggtggacgtggatgattcggagccggagtcgggtgctgtcgggaggcaggggttggtggcggtcggctccggggtgcgggtgccgggggaggtggtcattgaggtgctccggcggcttgccccgagggcagtcgcggcgtccgcggccgtcagccgcgggtggcgtgactgcgcgaggcgggtctggcggggggccgaggagctccgcctccgcgctgccggcgttagcaccatcgggacgctgctgccgcggtgccccgcgctgtccaggctcgtggtccgcatggaaagtgatgttgatgccacaatgcttgcatgccttgcattttcctgcccaaacatgccatctctggagataagcatggctgatagtgc

SEQ ID NO: 3286 - DNA, 540 bp, Triticum aestivum
  Clone ID: PAT_TA_3286
tagttgttggcgtgctggacgatgcgcaggcacgggtcaccaatgctttttatgatccatggaacgtgcccttctatccatagctgaatctgaaggatacatgaagtatgagtgctggtaactgataatgtatttatttggttattcaaagctactccctccgtaaccaaattcggagggagtatgcaacactctttgttcaattactacttatctaagaatttcattctacaatactttttttaaattcactcaaattaatgttgcatcagtttctagacttcaaggtataacactctacagtggacttgtgaaatctgagatttagtgtttaggatattatgatttccaaaaatcttgaatgtaaatcagcaaatgtgtgatgtgcatacaaaaaagttgctagaattttgatatttgaattgagattcacacatgtcttactattagcttccccttgaataattatttcaagtcagcagctatatggaattgagggttcactgtttcaaaaaaaaaataaaaaaaaaaaaaaaaaaa

SEQ ID NO: 3287 - DNA, 769 bp, Triticum aestivum
  unsure (1)..(769): unsure at all n locations
  Clone ID: PAT_TA_3287
cggacgcgtgggggactcgcgcaccacacttccaccagccatctccagtcctcgctgtcgctgcctacaggaaggagcacacgcgctcgctcgcagccccccgctcctgctcgcttcccgcgtcgctgccgtcggctgagcggcccccgacgagggacgagggtggaggagaggcgtcgccggacggagctgcgaggtgtttgtaggattgcgtgcgtaggcgagctttcgaagcttgggcatagccatcgccatggccaccggggtggcaccggctccgctcccgcacgtcaaggtccgcggcgggggcatcggcttcaccaagagcgtcgacttcgccaaggtcctctccgttcccggtgcgctgaggacggcgtcctcgagaggcagggcgctcgtggtgtggagctcaagtacagagtctgataccatggagctcgagccggcctccgaaggaagcccacttcttgttcccaggcagaagtactgcgaatctatccaccaaacaaggaggagaaaaacacggactgtgatggtcgggaacgtggcacttggcagtgatcaccccatgaggattcagtctacgacctcctcncaaggtgttncaaaacgngaaaaaggnanagaatacaaaaaaggcgttntttnttaaaaaacccccaggtaaaagaaatnttcctgttnaaataaaaacntttcaaaaaaanaaaanctttngggcnatttanttngccccaananttaaaanggcnagggtttaaaaaagggn

SEQ ID NO: 3288 - DNA, 1350 bp, Triticum aestivum
  Clone ID: PAT_TA_3288
gctcctgtggcccccgcagcgaatccgtatcccggaatctccacttaaactccacgagacgaaaccaaaccaagccgtgacaccggagcagcccagccccaaaccccccttttcggccggccgcgacctcttcctccacaaaaatcctccccggaattccgccgagtccccggtagccggccgccgatcggtcgattcgcggggggcgggatgagcttccaggacctggaggccgggaacggcgtccgtgggacgccgcggaggaacggccgggcggcgggggccggcgccggctcgtcgcaggccgtcgcgtcgggcgtcttccagatcaacacggcggtggcaaccttccagcgcctcgtcaacacgctcggcacccccaaggacacgcccgacctccgcgataggatacacaagacacgagcacacataacacaactggtgaaggatacatcggagaagcttaagcaagctagtgaggcggatcatcgtcttgaagccacccctaccaaaaagattgctgatgcgaagctagcaaaggatttccaagcagtcctaaaagagtttcagaaagctcaacgattagcagtagagagagaagctgcatatgctccttttattactcaagcaggtctaccacagagctataactcaaccgagatgaataacggtgctgataagttggctgagcagcgcactcagcttctagaatcaagaagacaagagttagtcttcttggataatgagattgtgttcaacgaggccatcattgaggaaagggaccagggaatacaggagattcaacaccaaatcactgaagtaaatgagatcttcaaagatcttgctgtgctagttcatgatcaaggagcaatgatcgatgacattgacactcatatcgacaattctgttgctgcgactgcacaagcaaaaggccagctttcaaaagctgctaaaacccagaagtcgaactcttctctgatatgcctgttgatggttattttcggggtggtgttgctcatagtgataatagtccttgcagcctagcaatttggatggcacattgtgctccaaaatctgctcatgcttagcgctcaaattgcttcataattttattttgctgtgcagtcagtcaggaatatatccaggtctcctcctggaggttgtgctatggtggtgtatgtggtgatggtgtgtgtgtctggaatgcatggtttacataagtaatcgagtatactcgcttcgtttgaaaaactctagtgctttgtttcttatgtgctcgccttgttagcatctgtgatgtagtatatctctgagtgagtggcgtgagaacgcgaaggttatttaattttt

SEQ ID NO: 3289 - DNA, 1145 bp, Triticum aestivum
  Clone ID: PAT_TA_3289
gaattcggcacgagccggggtggagcgcatagggctcttctcgtgcccgctctcctgctcgcggctctgctagcttgcagcggcggcggcgtccatggcgccgggttcaacaggtacagcttccccaaggggttcatcttcggcaccggctcctccgccattcagtatgagggagctgtgaatctgcggggcaagaatatctgggacaccttcgctcgcaccccaggtaaaatagccgacggcagcaacccggatacggcaaacgacttctatcatcgctacaaggacgatctgaagctgataaccgacatgaatatggacaccttccggttctcccttgcgtggagcaggatccttccaaacggaaccatagccggaggaatcaacaaagcaggggtcgatttctacaacagcctcatcgacgaggttttggctagagggctgacgcctttcgtcaccatcttccacttcgacaccccccaggtcctcgaggacaaatacggaggcttcttgagcgaaaagatcataaaggactacgtggagtacgcggagctgtgcttcaagctgttcggcgaccgggtgaagttctggaccaccttcaacgagcccatgatcttctgcgccttcggctacggcagcggcagcacggccccgggccgctgctcgccgtacgtgtccaaggcctgcggcgccggggactcctccacggagccctacatcgccggccacaacctcctcatcgcgcacgccgaggccgtgcgcctgtaccgcaccaggtaccagccggcgcagcggggccaggtcggcatcgtgcaggtgtcccactggttcatcccctacgacgccgcctccgacgccgaccggcacgccgtgaagcgcagcctggacttcatgctcggctggttcatgcacccggtggcgttcggggagtacccggcgacgatgcgccggctggtcggccgccggctgccggagtttaccaaggagcagtccgacatgctcaaggggtcctacgacttcctcggcctcaactattacacgagcaactatgcgcaggccgccgcgcgcgcgcccgaccggcgccagccgtcgtacggcaccgaccaccgggtcaaccagaccggctaccgcaacggcgtccccat

SEQ ID NO: 3290 - DNA, 466 bp, Triticum aestivum
  Clone ID: PAT_TA_3290
tgaagaagcaaagcctgcagtaccaaataataaggccgtggagaaagccttggcagggacagcagatttcctcatcgacctcgaggacaagagatccatccaggttcctggaatcccagcacgctggtgggcctggcgatcgtgacgttcgcgggggtgtgctattcgctgttcgcgccggcgttcaacctggcgaccaacgaccagtggcacacgctgcgcgacggcgtgccgcacctggtggtctacaccgcctacttctacttctgcctctcctcgctggccgtcggcgtggcgctcaacgtctggtgcctctaccgccccgtggcccgcgtgccgcggtccacgctccgggcgtacgtcgcccacggggaggggagggggctggcgctgctcgcggggctggtgtccgggctgggcaacgcgttcacgttcatggcccggctggcggccgggtacgcggcgg

SEQ ID NO: 3291 - DNA, 394 bp, Triticum aestivum
  Clone ID: PAT_TA_3291
cccacgcgtacgtccacgcgtccgcccacgcgtccgcctccttcttcctcccccaccccccgccccccgaccctggatccaaatcccgaccctccccagaaccggaaccgaggcaagcaaaagcttggcgcaattattggccggagataggtagagaagcgaggcagctcgctcgcggtgaggcgagatcatgaagcgcgagtaccaggacgccggcgggagcggtggcgggggcggcatgggctcgtctgaggacaagatgatggtgtcggcggcggcgggggagggggaggaggtggactagctgctggcggcgctcgggtacaaggtgcgggccttcgacatggcggacgtggggcagaagctggagcaagtggagatggccatggggatg

SEQ ID NO: 3292 - DNA, 1163 bp, Triticum aestivum
  unsure (1)..(1163): unsure at all n locations
  Clone ID: PAT_TA_3292
cctgacgcagtggctcagggagaaagggttcgatgaggaggccatcgggcgcatgtcgaagcggtgcaggaacctgccgaacctcgacgctggcgaggcctccggggtctgggactacctcctcaacgacgtcaagatcgagcagcggaagctgcggtacgtggtgaccaagtgccccaaggtgctcaccatgtccgtcaatgacaagctcgtccccacggtccagtgcctcaccacgctgcaggccaagcccggggagatcgcgcaggccatcgtcaagttcccgccgatactgttccacagcgtggaggagaagctctgccctctcctcgccttcttccagacgctggccatctccgagaagcagctcgccaagctgctcatggtcaacccgcgcctcatcagctacagcatccaggccaagttctcccagacggtcgacttcctcgtcggccttggcatcaacagggaggtcatgatcggcaagatcctgaccaaggagccatacatcatgggatacagcatcgataaaaggctgcgccctactgccgagttcctcaagtccgcagtcgggttgcaggggtcatatctccagagggtcatcatgaatttccctagcatactgtcacgagacgtcgacaagactctgcggcccaatttggtgttcctgcagagcgctggattcagcaaggatcagatcatgaaattggtggctggataccctcctgttctcatcaagagtatcaagcattgcttggagccaagggtgaagttcctggttgaagaaatggggcgggacaagggcgaggtggtagattacccccaattctttcaccatggtctcaagaggagcctggagtaccgtcacaagatactcaagcagatgaattcaaggtgcagtctcagtgagatgctcgactgtaatcagaagaagtttgccatgaaatttggtttgatcccagtagcttagggcctggtcttcttgtctcttcagttcccatgtagcatgttttatattcaggtgaatgttttatttttgtaccattggccgtgttgtttcttgaacattttgggcattgagaatccaagcattttgctttaactagatgtttacaaaaaaaaaagagaaacaaaataaccaattcgccctatagtgnntcgta

SEQ ID NO: 3293 - DNA, 2029 bp, Triticum aestivum
  Clone ID: PAT_TA_3293
cgacggaggaagcgcgggcagattagatgcgcgagcaaagcacaaaataatccatccatcgcatcccaaagggaaggcaagggatagagaaagaaaaagtccccactgcccgcccgagccgtcaaaatccaatctttgacgggggacgcctcgccctcccctactgttctcccctccggtttgttttgttcgcggctccgcgataattattattgtcaggcagggaggcagcccctggttggtggttgctgctaatcaggctgccgccgctgcctaatccgcgaatccccgcgtgattctcgtcccagtttggtcggcttctttctttctttctttctttctttctttcttggaggttccttggattcatccgttcatcgggcgggcgtgcgggctcgatcgggatgggcgggggctgctgctgctgggttgggctcgcgtccaattccccaccaccacaactagtacgcttcttttttattgttccaggagtgggatttgcctttgcgctgtgagagagagggagctatttccgcgattctcattagggctcctccctcttcgtcttcgtcttctcccccacgctttactctttcgttatcctcctttgcgcccccccgaatccaatcctcccccctccgccgctccccgtccggatccggggcgctcgttctcgatttcgcccgcccgcacccgattcggccgccgcaatccgccccctgggttccatgaagtgacgccccccggaggtgaatttctgggtcttgctgagagtttttgcttgcggccatgtcgcaaatccagagcttgtcacggagctgcgtgctactcgcggtgctctgcggcaagcacgccgataagcagcagcagcgtgcgccgccgggcaggtcggggccggaggcgaagcggctgcggccgtcctatccgtttcctgagctcagctccgcggggaggttggaggtgcacacgctggtcaatccaacgccggagcagttcctcgaggcgcagcggctggtgcaacccaacttcttctacatccaaggccagcagctggaagatgaggagattggttcgctcgtctggggggatgccgacatgtctgacccgcagtcgtttgtctgtctcatcagcccgccgttcccaacgattgtttatctggaggttcctattggcgaaaaacttgcccaagcggttcactcaaagcgtattccatatgtaatatactggagaaattcattttcatcttatgcgagcatcccattttcgcaatgcattgttgtcggtggttcaaagttcggtgagccatacatgggattcctttcagcttgctcatgcatcctttcgactatactgtgtaagaaacaaccatgttcaaagtgttaaactcggccctcgtctgcttggggatgcgtccaaaggtaaatgtagtcactcccgagaatgaaatggctgaggaagaaggttcttcttctgaagtgtccccagctataaaaatatatgatgatgacatcaacatgaaatttcttctctgcggagtaccaagtgcgctggactcttgtttgctgggctcattagaagatggtctgaatgctcttctaaatatcgaaattcgtgggagtaaacttcagaaccgaatcagtgcttctccaccgcctcttgaagcagcgtctgtaccacgtggaatggttacaatgcgttgtgatatgacaacttgcagttcttctcatgtgtcacttcttgtttctgggagtgcacaaacttgttttgatgaccagcttctagaaagccacataaaaaatgaactcatcgagaagagccagctagtccgtgctctaccgaacagcgaggataagctctcatcgaccgagcctttcacttctatgttcacagcttgtggtgcttctacctttgaagtctggatgacccttcctaagtgggcagcacaggttttgaagcatctatcaccagaaatttcatacaggagcctagttgcacttggagttggctgcgtaaatgctactcctgttgc

SEQ ID NO: 3294 - DNA, 1184 bp, Triticum aestivum
  unsure (1)..(1184): unsure at all n locations
  Clone ID: PAT_TA_3294
ggaattcggcacgaggttgagctcgtgtggggctgccccggcggcgtattcggagatacgacggatgagctcgtgctggtggttgcgccggtgacgtacccggaaaccgcggcggactggcggaggagctgctcctggagctcgagcgcggcgctcccaagctctcgtgctcgggcggctccggcgaagcgcgctctggtgaagaggagcggcgggaaggagatgggggcgatgcgttcgatgacgggggtcgccccctgctactgcccggctgttggcgcggctccggcgactcacagggaggccacagcgaggagatgcgcgagcggggagagcgcggaggcgactctagcggagaggagcagcggggaggcgactctagcagagaggagcagcggggaggcgatggggccgtgattcggtcgatgacggggggcaccccctgctactgccccggttgctgccgcggctacgtgagcgctgcggtccgggctgggccatgttggccgtcgaccgatgccggacttgggctgctccgccgccacacccgcagcaggacttggtctgctccaccaccacgcccgcaacctggtagacgacgtggccgacgccgacacaccggcgagtttctggtgcggttgtagatggaagagagcaagtgaattctgatgcgactgtgagttcgacggcgagaagtgactgtgcaggaggcttggtgcctagcagctctctcttcatgctgctatctacaacgacccgggtactccccggtaggccccggtgggcggggcgtgcgggctggggcggcttcctcccgatcggcggccttcgggcgatccccctcgcgttgcctgcgacttgttccccccggggggcccccgctccgagcggcgccgccagaccgggggctggaaaggcaactactcgtgggcttgagggccctccatgccacggtaggactccgttctgggttgccttgtcgcgtgcggccccggtgggccggttgtcgcaggggcggggtggcctgacgcctgtcgctccgtcttgcggcgtttctccgtgcccctggcggttgttgcttggcttagagagcggcgcgcgggccttcctctggatgtgtacatgtggcctagtctaggatttggganctgtgcagaatttgntcgggtgtgtctagggcacnt

SEQ ID NO: 3295 - DNA, 1056 bp, Triticum aestivum
  unsure (1)..(1056): unsure at all n locations
  Clone ID: PAT_TA_3295
gtcggcacgagggagcatcctctcctcctaccctcgcacgcgctagggttcctgcgctgccgccacacgggagcttgtcgaccagcccagcgtcctccggatcgccgccgcccccctcctcctccccgccgccccgcacctgctccccgccgtcccccccccgcaccccgtctcgacgggtacaattccatggatgcgactgccgaccagtacacgagtggggctgccgttctcctaccggtaatcagctgctccagtgccaccgcatatatactccgatgagtatccttgatatcttccctccacattgcatctaatgacacactaacacattgcatctgatgacacacttccaactgggatatacaattacatacaccgtgaaatttgaaacttcccttgagagatgctaaagtactatttatttgaccggcttggtgtacattgaccctgaatgttatgaattattatttggcatcggattcagcaacgaccaatgctggtgcctcctcatctggagtggcatctgatgtgccggcgatgaatactccagccaacaggaattcgtggtggatgatatgaatgtcggggaggtgatgggcacgaagtatgacgaggaacttgtgaaggctgtgggcatggagaagaatgggagaatctaagtgggaggctgacattggcggtgttgaaggctatatgagtgaatctacagttctgtaatcatcaaatacacgcagtagtgatggtacaattgcatggttgtgactgccgaccatgatggcattgggcaaggggtcattagatggcattcactgaattattgatttaacaccccccctaatctatgcttgcccatgtagatcatcttcacgattgtccgggaagctctatcatcttaaatgattctccttcaaaagttcttcataaaatgatgagatcctgaaacatataatcacaatgaaagatagcataatgtgatgtcattaaaatgaggatatctcaagaagagactccccctgacacctgcaagtccctaagtcttcgcataccaattnc

SEQ ID NO: 3296 - DNA, 2002 bp, Triticum aestivum
  Clone ID: PAT_TA_3296
gaggactgaggaaggaagacgaattcgactcggagttttggacttgcccattcggctcggagttttggacttggccatttggcccaatcttgccgtccggcgatttttctttggatttctttggtgaaaccctcggcggatggtcgcttgggagccaagcatttgattcgatcttaagtggtccaggcgattggaggagctgctggctgctgctgttcccggggagtggattttcttgaggtgcagtgaatctgtcctgctgtcataggtttaaaaaaaacaattcaaattgcctggccttggatcaagtccattttcctatagagattgccatctgtcttaagtcaaagcagctatatttctggcaaacacaacgagctagtttcatatgcagcgttcagttgatggctgctcatcctgttgaatcagaagcaagcagtgaaacagacaatcaccctttactgatagaccacatggaaaatactgctcatcttgagattgcaattgagagcccaagggatgatgttgcttcatcgtcaaccgctcgtcgggaggataatgatggcttggatcgattgcctcacatctcagaaagttcttcggagacaactactgcatctaactctcaaagtgctcctctagcaagaagagatgctaatcgtgctcgtcgtcggcaaagtccgttgaattctagttgctggatctccattgagcttgttgtaacagttagccagattatagcggccatttgtgttctgtcattgtcaaggaaggaacgtccgcattctccattatttgagtgggtcattggttatacggtaggttgtgttgctactcttcctcttctctactggcgctatctccatcgcaaccgcccaacaactgggcaagaaccagcaagtcagaacttccctccgaacagcatacctgagtccaattctcacacaacaaattcggcccctggcatgtctgaagctggttttgtaactgacacaaatggagtctcgcaaaacaacgtgcttaccagaaatctcagggcccaagcttatgccgatcacttcaggatggcccttgactgtttcttcgccgtgtggtttgttgtggggaatgtgtgggtatttggtggacattcctctgcccatgacgctcccaacttatacaggttgtgtatagccttcctcacatttagctgcatcggctatgctatgcctttcattctgtgcgcattgatatgttgctgcctgccctgcataatctccctaatgagctttcgtgaagatctaaaccaaaacaaaggtgctactgcagaagcaatcaatgccttgagaacatacaagttcaaaacgaagaagtcccgtaacggcgaggggattgaagtcggcggcggagttgttgctgctggaacagacaaggagcggattgtttctgctgaagatgctatttgctgtatctgcctagcaagatactcgaacaatgatgatctccgagagcttccttgcacccacttcttccacaaagaatgcgtagacaaatggctcaagataaacgcactgtgccccctctgcaaagctgagatagacagtggcccgacaactgctcctgccattggctttgggcgtcgccacagtgacaacagggtaggaaatgacatcgaatcgcagctgtaactctgcattatccattgagggtgcaacatgtccctgatgtggcttcgacagagcaatttgtaaattataaaatgaaatagttgacacaatgtacgggcccccttatattatcgaaccggctcttcacggtctgattagtgtctcattgtcaaaatatgttccgaagatggtaattcaggttaccggacatgaattacgagcctttgttggttactgatggcaatcctcccggttttagcagactggctagagatggttaatagccatttgtttttcctttgtctaaataccagatgctgatcagagcccataatagacagaagaagtttgctaac

SEQ ID NO: 3297 - DNA, 541 bp, Triticum aestivum
  Clone ID: PAT_TA_3297
tcgccggcgatggcagaggagtcgtgggaggagggtcgggggttggacttcctcgtgagcctgggcccggacatctccgccaccgtcttcagcctgctcgacgaccccgccgacctcgcgcgcgccaccgccgtctcccgctcctggcgccgattcgttcttgcaaaccagttcagcaagatcctgtgcctgtgggtttacccggaggtttccaacttcacgcgtgttgagctgagcagcatcagcagtgcacaccgaaatgctgggtcaagtgcttttgctgggctggagaagctcgggagggatcacagggtgtatatgcatcttagccatgatcttctctcgccgtatgaccccaaggattgcatcagttgctgcgtacgtgcgtccagcactgatcatttgcctgaagaggccatagaaaatacccttgaacatgatgaggagtggagaccgtcttattggtcgagcggtggccagaaagatcctgctgtgccagaatgcctgatatatagccttcagtcagagctgtgtctcgttg

SEQ ID NO: 3298 - DNA, 602 bp, Triticum aestivum
  Clone ID: PAT_TA_3298
cgtccgcccacgcgtccgcattgagagaagcagcagcacgagcagcacatgtcacaaagggccagcgtcccacactcctcctgcatagccttcgccctccattcccacctcctcgtgtcctctgagatgtgccccagctcctactgggaatagaatagcctcgcccaaatccgacaccttttttttgtttttgtttcctctcttctttagattttgtttctagatctttgggggtctcgaattcgtccgtctgcgagggggaagatgggcgtcaagggattcgtcgagggcggcatcgcctccatcgtcgccggctgctccacccacccgctcgacctcatcaaggtccggatgcagctgcagggggagtcgtccgcggcggcggcggccgtcccgcagcccgcgctccgcccggcgctcgccttccaggccggggcgcacaccgtgacgctcccgcacgcgccgacgccggtgccgaagcccggccccataggcatctgcacgcagatcctgcgcgccgagggcgccgccggcctcttctccgggatctcggccaccatgctgcgccagacgctctactccaccacgcggatggggctcta

SEQ ID NO: 3299 - DNA, 1643 bp, Triticum aestivum
  Clone ID: PAT_TA_3299
tcacccggcccgcgccgcacctgggagaagcagcagcacgagcagcacatgtcacaaacggccagcggcccagcccccgacgcaatgggccacgcccgccactctcaccttggcctggcgtccgacatccgtccccgcttccactcgccctccaatagcctcgcccagtgccctcagcaatatgctcgagctcctcgccccaattccatagcttttgcctcttgagtttcctctctggtttatttttcctttcttgattggggggggtttccaaatcgttcctgccctagggggcatcgccggggtcgatgccggcgggaagagctggccgcccgcggtttccacgggcgcgacgccgcctgcatcgtcgagtcctcctccactccggcgcccgcccaggacgccgcgcccaggcagctgctcggcggccgcgccggggcgcgcgccgtgacgccagcgcgcgcgccgacgccggggtcgacccccgggagcctgggcccctcaccctgacgcccccgcccgcgcccgcgcccggtgcccatgctcgggcagattggcatatgcagacgggccctgcgcgccgctggcgcaggcgggctgggctccgcgatctccgcaacgatgctgtgacccacgctcgactgcaccacgcggatggggctctacgacatcctcaagaagcgctggacccaggagaacggcggcgtgctgccgctgcacctcaagatcgccgccggcctcatcgccggcggcgccggcgccgccgtcggcaacccggccgacctggccatggtgcggatgcaggccgacggccgcctcccgctcgccgaccgccggaactaccgcagcgtcggcgacgccatcgcccggatgacgcgcgacgagggcgtgcgcagcctctggcgcggctccgcgctcaccgtcaaccgcgccatgatcgtcaccgcctcgcagctggccacctacgaccaggccaaggaggccatcctggcccgccgcggcccggccgccgacgggctgggcacgcacgtggccgccagcttcgccgcgggcatcgtggccgccgccgcgtccaaccccgtcgacgtggtcaagaccagggtgatgaacatgaaggtggcccccggcgcgcccccgccgtacgccggggccctggactgcgcgctcaagacggtgcggtcggagggcgtgatggcgctctacaaggggttcatccccacggtgtcgcgccaggggcccttcaccgtcgtgctcttcgtcaccctggagcaggtgcgcaaggttttcaaggacgccgagttctaatgcagtgcagaccaccgccgcgcggcgccatggatccatgatgatgatgacgacaagaagccgccattgatgccgctgctgctaagaataactagtagtaccgctggagagattcctccagttcctgcctcccgttttattcggatggatttgatcgattttgaatgaaattctcatttttatccccgattcacaatgttcaagtccgccggcttcttcaacaagttgagggatgaactcttcgagtatcagcaggagatcgaggaggaggtggaggagggcccctagggtctcctgcgcccccacttcgagaaaccatcccctaatcatgttttttg

SEQ ID NO: 3300 - DNA, 949 bp, Triticum aestivum
  unsure (1)..(949): unsure at all n locations
  Clone ID: PAT_TA_3300
tcctctctagggttccaagtcgaaaagccccaaaatcgcctcgagtcggaagctagggttccaaatcgatcgaaaatcaccaaatcgcttagaccgagaaatggcgactgccggcgtggaagatctgttcgagggtctggctgtgtcagggacaatgccggtgcgttgcggtcggaagaacaagaaggggtcttcttcgagtgcgcgttcgcaggaggtggaggtggcggaggtgccgatgccgtcgcgtcgtggtggagagaagggatttcccaaggcagcaccgccgcgtcgtggtggcgacaagggatcgtcgcgtcgtggtaaagagaagcgatttcccaagggcggttcgcaggaggatgcagtgatcaagaccgggcgtctcgatcggaaaaaggggttcaggaaggccggttcggaggaggaggagaagaagaagaggatgcctgaagagatggtgaacgacatcctgtcctgggaaaagcctccccgcttcacaatgttcaagtccgccggcttcttcaacaaattgagggatgaactcttcgagtatcagcaggagatcaaggaggaggtggaggagaagggctacgctgagctccccgccgacttcaaggaatataccaaggaagctgacattaaggcttacagaaaggcataccttaaggtgtttggcactgaaccgccgcctgagctctgctctctctgatctggatctgaggaggtctcttattttactgtctatctacccctagtagtgataactggataactgaagtactatagtttgcactctgttactcaatctgaggtctttgttgttttaccatctatctatctatgcactgcaatatctatgcactgccgccaacctctaaaattaccatctatcgtatctttttcagtcatcaaanaaaaaaaaaaaaaaaaaaaaaaaaaanagggg

SEQ ID NO: 3301 - DNA, 610 bp, Triticum aestivum
  unsure (1)..(610): unsure at all n locations
  Clone ID: PAT_TA_3301
cgatggccgcatcctgctcgttccgtaccatcgtccgagctccgccgcctccgcggggcctcgccggggccaggagatcagtccgctgctgcagcagcgccgctcccgcaggcgcctccacatccaagctcgtcctggaggtgaaagagaggctcgaaagggagcatccgggcctcccgacgggcaggagcggcagggatgacgacgagatgatcctctggttcttgaaggacaggaagttcgccgtcgacgaagccgtctccaagctggccaaggccatcaaatggcgtcaggatttccgcttgtcagaactatcagaagaatcagtgaaagggttgtaccaaactggcaaggcatatgtgcatgattcttttgacatcaacggcaggcctgtgttagtagtagtggcagccaaacatttcccttctaaacaagacccacttgaaaacgagaagctatgtgcctttttggtcgaaaaggctctacgtaaacttcccatgggaacagataatatacttggaattttcgatcttcgaggcttcngtgtagaaaatggtgatctccaattcttaaagtttttgattgatgtgttctactattactatcccaa

SEQ ID NO: 3302 - DNA, 518 bp, Triticum aestivum
  unsure (1)..(518): unsure at all n locations
  Clone ID: PAT_TA_3302
cacgagggccggagttgccaggggtcgggactggtgacctacttcaggaagaaagggaaggagaccatctgcacgtgtgtgccatgcgctggcattggctatgtntcggaaaattacataccgagagggagctgaaaatctggatgagttagacaatgggagaccaccctaatttgttggtgctgtctgtttggtggcggtaattttattaactggtgctgcgtggggtgtgcttactacatgtgattcttttcactacacaacttctatttcaggcacggtacaggacaggatgccattctttaagcattgtaaacttttcttttctgtctagttattgtacacactcctattcttcaattacagatgtatgatcaaaattcacaaagaaggaaagaataaaaatataaagagattgcttggaccagttctcagaaaacctttcggcatgtattgccccaccgagcagcttggatgagatccctgctttgcaaataaaaaaaaaaaaaaaaaaaaaa

SEQ ID NO: 3303 - DNA, 1266 bp, Triticum aestivum
  unsure (1)..(1266): unsure at all n locations
  Clone ID: PAT_TA_3303
gaaccagttttctatatttgtatcacgagacagtgggaataaaaaatactcatcggtattggctcctggacaccatgaaggcttaaagaaaagtagtgactctggaatttcatcatgggattggaacctgagtggtcaacactctacctaccatgcattgtttcctagggcctggactatttacgatggcgagccagatccagaccttaaaatctcatgccgccagatatcaccattcattcctcatgattacaaggatagcagtcttccggcatctgtgtttgtgtacactctggtgaataccgggagagaccgtgcaaaagtgagcctgttgatgacatgggcgaattccattggaggtttttctcatcattcaggaggccacttcaatgaaccattcattggggatgacggagtgtcaggagtgcttttgcatcacaaaacagcaaaggataatcctccagttactttctctattgctgcctgcgaaactcagaatgtgagcgtgacagtcttgcctgtttttggtctttctggagagaaccatgcttcggcgaaggaaatgtgggataccatgtcaaaggatggccacttcaatcgggaaaatttcaatgctggttgtagtatgccttcttcttcagggngagacactttgtggccgcttggtctncggcatcgacttggggtggaagccgcatggtaggtgtactgtggcatttgctttggcttggtcctcacctaaagtgaagtttcagggggcctgcacagggaacaggagatacaccgaattttatggaacttctgaaagatcatcatctattcatttggtacatgatgccttaacaaaatatagactttgggaagaagagatcgagaaatggcaagaccccatactcaaggatgaaaaactcccagaatggtacaagttcaccctttttaacgagctttattttctggtagctgggggaactgtttggacagatggtcaacctccagcgtttagtgaatcaagtcctgcttaccaacataaacattcanagaagggcactaaatcagaatcagttaaagtaaccatgtcaanccagcagcagagcaatctcgatggaatactcctaagggtgaanaccaagcttcaattaacagcantcatggatacagtcctgaacaaccagngactagttgaggacngatcctatttcttccaggtggcctgaaattcggaattctgtncngaggatggatacacagtgacacttgattcttcnt

SEQ ID NO: 3304 - DNA, 1356 bp, Triticum aestivum
  Clone ID: PAT_TA_3304
cgacctcgtccgctccatcacggcctccgccggtgctaccgtcaacatcagcgagatggtggccgcgctcagcaacgacgtcatctcgcaggcagttttcggtggcaagttcccgcagcaggaagagtacctccgcgcgttggacgaggtgttccggctgctgggtggcttttgcctcgtcgacctcttcccgtcatcacgcgggatcacggtggctgagcaatggcgagcgccacatgaagaggagctgtgctcgcatccatcagataatcgctgagattatcaaggggcgcaaagagtcgctggatcccggcaacggtgccaccgacgacgaggatctccttgacgtgctgctcaggctgcaggaggaggcctcgttggcattccctctaacgactgacaccatcggcgccgtcttgtttgacatgtttgcagccggcacagaaagcacatcgaccgttttggagtggactatgtcggaactggtgattcacccggaagctatggctaaggcacaacaagaggttcggcaggtcctaggtgaaaaaagggctataattactaacagagaccttggagaactccactacctacggatggttatcaaagaagttcttaggttgcatccaccaggcccattagtcccccgccgggctagagaggactgtaaaatgatgggatacaacattctcaaaggcaccaatggtgtatgttaatgtgttcggaatttctagagatccaacatactggaagaaccctgaaagagtttaagcccgagagatttgaaaacaacaggcatagattacaatgggacatactttgaatacaccccctttgggtctgggcgacggctgtgcccaggaatgttgttcagcacgtcggaccttggacatcgtattggccaacctattgtatcacttcaactggatacttcctgatggagcttcacttgacatgtccgagaaatttggcctgacggtaaacaaaaggtatgacctgaagctcagagccgttccacacatgtggaactatgaagttcagtcggagtgatgcagaagttatggtatttatctatatgtcaatcctatgatgacgcatcttcagcttcaacatttgcactctactacattgtagctttctgctttagaataagagaagttccgttgagaacattgtcgtatatgtagtactatattgtttgagagctttcaaaacatgattgtaataattctagataagattgtggacttctaagagtttttttaatttgcatcaagaattagcctcatcttttacacggtcatgcacatatacatggctccttgatccgaacacataaatataaatgtgaaagtg

SEQ ID NO: 3305 - DNA, 766 bp, Triticum aestivum
  unsure (1)..(766): unsure at all n locations
  Clone ID: PAT_TA_3305
gcggcgagggtcgaagcgtccagcgcgaggaagaaggctctcaccacgcccaggagcaagaccgtgcggccgaggcaggagcccttcctcagcgtgaagcaccagaaggggccggtcgcggcgccggcggcggagnatcaaggggacggtggtgaaggcgctgtttatgagcacgcccgggaaggagacgccggcgaagagccaggctcctcccgtggccgaggtctgctcgaagatgaagaagctcaacctggcgtgccgggaggtgcctagcaggtacctgtcgcagctgcccacgccgaagatcgccaagaagtgcgaggagacggcggcggtggtgaagagcgcgaagagagtacaggagccaaggaatgggaagaagaagatgatcttgggctgttcggcgaaatgcgccaatgctgaaacagacaaagagaaccgaagtggccgtgagaacatcaacgcggacgagaactcgtgtaaacgaactgcaaggcgcaattgggggcaagaacccaaggaggtggtgcagggatcacgggttgaggtggtggagccattgcagcccgacattcatggcgacgacaaggagaatgcgccatgcggtgatcagctcgccgagcaagccttgaatcgggaggatgaagaagatgaaaacagcaagcagtcggagaacagtgagaatgctcctcaaaaggtgcttaaaaggcagaacaaggtagtgaatgcagagcagggaggaaagctcaagaaaaataccatccta

SEQ ID NO: 3306 - DNA, 528 bp, Triticum aestivum
  unsure (1)..(528): unsure at all n locations
  Clone ID: PAT_TA_3306
accacttggatctgaaagcacgagcaagcaagcaaagggaggtgcaatggagcacgggtacccctgcaacagcaatagcagcagcagcaacaaggagaagaggcctccgctcaagagaggccagctcaagctgcacatcgccaggaccctgggcagcctcgtggcgccggccgccaagagcggcttcagcttcaggaggtgatggcttgaccggccgcgacaagcaagcaagcaccttctcgaccaatctagctaggagcatggtgtgattctggtggttgatgtgtacagtgtagggattgtgcaggttgaaaaggagttgttttanttaggtgtgcttctaatttgtgtccagtttccccccttccacggttccacctagcccctgttcgctttgaggtttgctgatgagatctcgcttccttgatcgacaatttttacgttgtccacgagtgagggcatgtacggagattgcagatccatgctttttcaaaatgcactgtagcttctaatgggaattacagttct

SEQ ID NO: 3307 - DNA, 1046 bp, Triticum aestivum
  Clone ID: PAT_TA_3307
ttctgcctgttaaaaagccttccggtccaatcccgtcgcaactcgccccccgagctcccccttctctcgtcgacgcggcgagtctgctttgcgcccatccgaggcggaggccaacagatcaaggatacactacagcatactttgaagagttgtcctgtgccaaatcaagaaagaaggcaccttttgcctggaatcatggcaccatcagcatccactggtcagaaagtcaacctgaaggggtacaagaccctaccccatgctattcagctggtaacgatgatgtcggggacgtcttcagcttcaacattgacgattggggaccagaacaagaagttcaaggtgagccgtgctttgacgtggatggtggttatctgcataccggctactttcattgccgtcacagcaggttcggcctacaggatgtataacaaacccatctgggccgccggcttcccatcgaggctgccagttgtcttgatgttgggagcctacctggcagtggtgaacctggcgctggggtacttgaccctctacttgccacaggcacccttcgctgtgtggaaagctctggatgatgttggtctcaggttgattggccttgccgttatcttaatctctggccctgttttgttgtctgcccaggcgtggctgcacatcatctgggcttgccttcttggcgtcctcattgctgccatccttgccttctgtgtctgtcttgctcggacgtacagcaagtagcctcttgctaccatggcttagatgccgccttttaggcccgtacgtgcagtacgggcctgtcctcgtaaactagctagcggcttagatgccgccttagacccgtacgggcagtagcggcttagatgccttcttagacccgtatatggggcagtacgggtctgtctttgtgaactatactagctgtcgtttgctagtaggataataatgtcgtctcttcaaggtgaagtcactctgtaaacagtctgctgctcgtgtgttattatttattattattattgtcttttttgttacctttagcaaaaaaaaaa

SEQ ID NO: 3308 - DNA, 1083 bp, Triticum aestivum
  Clone ID: PAT_TA_3308
tgctgcttcaccgcctatgccaatgaccgtcggcggctgggtggggactttcccaccttttagttacattgctcctgttcctggactatcagctcccgcgcggcatcatcctatggacatcaagccaggaacttctgctggattacagcatcctgcattgcctccactgccagtacgcccgaagcgctgcgctacacattggtacatcgcacagcagatccaataccaccagcgaattacgaagatgaactctttctggcccacaacagcggctgccgccgctgccgccgccgccgccgccacaagatctgcaccattctttggtccaagaggaccattcaacatgggcgtcgttccacctgcagaggctgcctcccttctcgcgaacccaatgcaggggagctaccctgttcgggcacacgccccgctgcaagaaactaaggctccttcaatggtgccttctcctttccaggggagcctctccaaggataaagcgtcatccagcagtgccagtgttgctgaatcaaaccaaaggaagcaacctccagctcttgaagcgcagcagtcctctcccatgccaccaaacatgatgcaagcgccaacattcatctttccattcaaccaacatgctgcagcagtagcagctgcaactgccgctgccaatcgaatgggagatacaaaatcttctggcaccagcagtgcgatgccgtcatctgccactgcccacgcttcagcagcacaccctggtgcaccggccatgaacttgagctttgccaacatgcagccgggtgatgcccagttcttggccatcttacagaacggctacccattccagctcgctgctgctcatgctggaggagctccatcatatcgaggcatggcaccaccaggcgcaggtgtaccgtatttcaacgggcatgtctactctccccacatgttgaacccatcacagcagcaaggtacgcagcaacaaaatcatcagaaaaacccatgccaagcttgtctggttcctctcagaagcatcagccacaacaatcacaagggttgctgggatatgcaccaaatgctaatgctgctgctgcc

SEQ ID NO: 3309 - DNA, 273 bp, Triticum aestivum
  unsure (1)..(273): unsure at all n locations
  Clone ID: PAT_TA_3309
tttttttttttttttttttttttgaaaaatctatgtttcctttaccacaaacatgacacacttgctgtgataacaaaacataaattaactgtgtatatatgcacatgacgaaccaatggtgcaaagggtcggaagcctcacaacgaccactcctgaataagcaccaactaatggatgaggatactatctgtgtttcagcatatgtcatggtatgactgcaagttgttcccagcaggttttccaatctgcagacaagctatggagtgntttgag

SEQ ID NO: 3310 - DNA, 2836 bp, Triticum aestivum
  Clone ID: PAT_TA_3310
cgttcgtctaaaaaagaagatgttggtgggaaaacttatcaagacaaccttggagatgaatttagggttggggcccaagagttgggtcttatttgttaatggaactaaaaaggttcctgctacattagatgactacaggaagcttgttgttccagtaattgaggagtattttagtacaggagatgtggaactgtcagtttccgagctaaggagtcttggatccgatcagtttcacaattactttgtgaagaagctcatatccatggcaatggaccaccatgataaagaaaaagaaatggcgtcaattctgctgtctgccttgtatgctgatctattggactcctccaagatgagtgaaggttttatgatgcttctagagtcaacagaagatctatctgtggatataccagacgctattgatgtcttggctgtttttgtggcacgtgccattgttgatgaaatactgcctcctgtttttctcactcgagctagagcattgcttccagaatcttcaaaaggcattgaagttctgcaggttgctgagaagagttacttgtcagctcctcaccatgcagagttagttgaacgcaagtggggtgggagcacacactttactgttgaagaggcgaaaaagaggatccaggatattctgagggagtacattgagagtggagatacagatgaagcctttaggtgcataagggagctgggccttccattcttccaccatgaggttgtgaaacgtgctctcatccttggtatggagaatctgtcgtcacagccattaatcctgaagttgttgaaggaatcaacgacgggttgtttgatcagttctaatcaagtgtcgaagggtttttctcgggttgcggacagtgttgatgacctgagccttgatgttccttcagccaaaacactttttgacaagctgctttccacagccatatctgaagggtggcttgatgcttcattctgtaaatctgctgcccctggtgaagatatgtggaatgcaagcagtgaaaaggtgaagcattttaaagaagagtctggtcacataattcaggagtatttcctctcagatgacgtcccggaactcattagaagccttcaagagctttctgcccctgaatacaacgccattttccttaagaagctcatcacgcttgctatggacaggaagaacagggagaaggagatggcttctgtacttctttcttcactcagcttggaactattttccacaggtgatatcatgaagggattcataatgctcctgcagtcagcagaagacaccgccctcgacattgtggatgctcctagtgaactcgccctcttcctggccagggcagtgatcgatgaagtcttgcttccactgaatttggatgacatcagtagcaagctgcgcccaaacagcagtggtagtcaaactgtccagatggccagctctctgcttgcggcccgccattccggtgagaggatactgcgctgctggggtgggggcactggctgggctgtggaagatgcaaaggacaagatctccaagctccttgaggagtacaacacaggcggcgacctgaaggaagcctgccagtgcatccgcgaccttgggatgcccttcttcaaccatgaagtggtgaagaaagcgctggtgatggcgatggagaagcagaatgaagctagcatcttggctctgctgcaggagtgctccagcgaggggctgattaccatcaaccagatgaccaacggcttcgcccgcgtcaaggaaggcctcgacgatctgaccctcgacatcccgaacgcgcaggagaagttcagaggctatgtggagctcgcgacagagcgcggctggctgctaccttccttcgcctccctgccctgagctcttccccaacagacggctgagcttgaagaaatatacctctgtatatcgtacacccatgctgtctttaccaccataccgaacttcttctcctgttctagtctttactgagccgaaatggtatggtataccggagtgtgatagggttgttggtgtattggtctgtgagttggagagtttaaggaataacaccatttgacctcaggactcaaaacggattcgctcgcgtcgaaggaaggcctggacgatctgaccctcgacatccccaacgcgcaggagaagttcagaggctatgtggagctcgcgacagagcgcggctggctgctatcttccttcgcctccctgccctagagctcttcttccccagatggctaaacttggaagaaatacctctgtatatcttacacccatgctgtcttttcgaccatccggacgtgcaggtgtagttcgtcgtttatgtggagctcgcgtaagagcgacgggggtgtgaaccttcctttgcctccctgccctgagattttccccgacagacggatgagcttgaataaatatacctctgtatatgttacacccatgctgtttttaccaccataccgaacttcctttcctcctgttcctagtcttttttgagccgaaatggtatggtataccggagtgtgatagggttgttggtgtattggtctgtgacttggagagtttaaggaataacgccatttggcttcaggactagtggagttgtttttaaattgctgtccatggctttctgcttttgaagttccttgttgtggacgtgtagtaataggagtatgtttttgtggccttagagcaactacacccgtatgtcccgcaaatatgtctgggggtgtctgcagacatcggccggtcaccagcatagggatagtttattatacaagatgtcatcggaccatcaaaaattgacatgttttaaatactatagct

SEQ ID NO: 3311 - DNA, 808 bp, Triticum aestivum
  unsure (1)..(808): unsure at all n locations
  Clone ID: PAT_TA_3311
gcccctttcccccccgcgctcgcctggctcccccgccgcaaacccccccctcgtcggagatgcccctctcgtcgccttcgccttcgccgtcgctctttctctctcccactcctttcctgcgctgtccccccagactcccgggcctccttgctgcagccccacgatatctccggcccctccgatacgcccgcttctcgcccccggattctcggcccgccggagggcccgcggccggtcttgggccgccgcctctccgggatgggtgctgctcggcgccccggccccgcccctgcgccggacccccggccgcgcgcgggccccaccggtcctggcctcccacgacaccgcgccccgccacgcccgggggtcccgcctcgtcgacgccggcggtggcgggctgagcccccccgcgctcctcgcgcctgtcgggctggcggcccccggggtgcccaaggctgtcggctgctcccctgggggtggggttggcctgccggcgaccgcccccccggccgccggcctcgacttgccggggtagggcagcaggtaaccccagcctgcccccggtcctcctcttgggggcgggatttcagcatatacctcttcggggtccaacctttggaggtttattnananantttatngnaccaanaatttgngccnggtcccaaanntnggngggggggaaaacccntttttaagggcacnttggccaancttttnngggnagaaannaaaancngccnncttggaaannnttttngggggnttnaanntngnnnnggnnnnncntncntggggnggntnntan

SEQ ID NO: 3312 - DNA, 2227 bp, Triticum aestivum
  unsure (1)..(2227): unsure at all n locations
  Clone ID: PAT_TA_3312
ccccgcggtgccggccccgtttgcgcccccggccaccagcccccctttccctgcgatccgaccacatgcgcgcgttcgtggaggcgccggggagggtgctgctggacacgttcccgtcccagtaccagagtgccgtagtccttgccatcttggacctcctgtcgacgcgctcgtcggatggggagtatatgggcacgcacgaagagccgtcgttcgaaacaggatgggccggcccggcacacgtttgggaacgtctgggcggcgccgggcgtgggcccggggccgttcggccaggaggatcgtgatcccgatccgcatcacccggcacggctccagcatggctgccttatgtgcgggtcaggccgtccgaccctgatacatacggacgagatgatggtgagggacaagggtgtctccaacagcaacgcgacttcagcgggactgagtatgtgtgcgaagactgaacttagcgtcaatatcggcatgtactagtctagtaagacaaaggtgggtataattgcattgggacatcagtgtgaccgaaaatgctaataaaatggcacgaggatactttttcctctcatgacagttgaggaggccgtggctaacaagaagctcttcatgctggactaccatgacttgttgctgccatacgtcctcaaggtccgcaagctcgagggcaccaccttgtacggctcgcgcgcgctcttcttcctcaccgccgacggcacgctccggcccatcgccatcgagctcaccaggcccaagtccaagcgcaagccgcagtggcgccaggtcttcacgcctggatgcgacggcagcgtcacggggtcctggctgtggcagctcgccaaggcccatgtcctggctcacgacgccggcgtccaccagctcgtcagccactggctgaggacgcacgcctgcaccgagccctacatcatcgccgccaaccggcagctcagccagatgcaccccgtctaccgcctgctgcacccgcacttccgcttcaccatggagatcaacgcgcaggcgcgcgcgatgctcatcaacgccgacgggatcatcgagggctccttcgcgcccggggagtactccattgagctcagctccgtggcttacgaccagcagtggcggttcgacatggaggccctgccggaagacctcatccggaggggcatggcggtcaggaaggagaatggcgagctggagctggccatagaggactacccctacgccaacgacggcctgctcatctgggacgccatcaaggagtgggcgttgacctacgtggagcactactacccgtgcaccgcggacatcgtcgatgacgaggagctccaggcttggtggaccgaggtgcgcaccaaaggccacgccgacaagcaggaccggccggcgtggcccgagctgcacagccatgagaacctggcgcgggccctggcgaccatcatgtgggtcacgtcggcgcatcacgccgccgtcaacttcgggcagtaccccatggccgggtacatccccaaccgcccgaccatggcccggaggaacatgccgaccgagatgggtggcgacgacatgcgcgcgttcgtggaggcgccggagaaggtgctgctggacacgttcccgtcccagtaccagagtgccatagtccttgccatcttggacctcctgtcgacgcactcgtcggatgaggagtacatgggcacgcacgaagagccgtcatggaaacaggatggggtgatcaggcaggcatttgacaagttcaaggagaggactagggacatcgtggagcaggtggacgagtggaacaacgaccccgaccggaaaaaccggcacggcgccggcatggtgccgtatgtgctgctcaggccatcggacggtgatcctacggacgagaagatggtgatggagatgggaatccccaacagcatctccatttgagatgacttgtgtgtgtgtgtgtgtggctgaactagccgtaaataagcgtgtcttctagtctcttggctgtgtcaacggaaatgctaataaaaggacatgaggatacattattgcacgagggaaaaaaaaacttcctagagtcacaagatatctnatagaaaaaagtcttttctacggcacatcaaattatctattgctaggctgttcatcattgtaatccaatggtgaagatatcacaatgccacctcaaaaaaagggggggcccggtacccaattcgccctatagtgn

SEQ ID NO: 3313 - DNA, 422 bp, Triticum aestivum
  Clone ID: PAT_TA_3313
aggcttatatgttgaagatttctgctggaaacgagttcattattttgcccctagacttgtagacggcagtgttggcgaagacagctatggagaggaaactgtatatggtgaagaattgggagccagaagagcaaagccgatagcagggccgagcagaagatgtcgccaatgttgttgggtcatgggagaacaccaagtagaaggcggtccttgacgtgaagctctgaatgccagaggtctcgactctgaatctggaccttgcctagttgccttttttgtgttagctagatcagtactagtgctcagtagtacgacaagtagcagtactgatcagtacgacttacacaatactagtactgatcactactatttttaatgttaaaagtaacatccataactgtatttatgagtcatactgacaa

SEQ ID NO: 3314 - DNA, 865 bp, Triticum aestivum
  Clone ID: PAT_TA_3314
aacatggtgctctttcaagtctctccttctcgccgctgtggctaccaccagcgtgctcgccgctcccttcgacttcctcactgagcgtgacgatggcaacgcaactgctcttgagaagcgtcagtccactcccagctccgagggctacaacaacgggtacttctactcgtggtggactgatggcggtggttccgctcagtacggggtgggagagggcagcaggtactccgtgacctggaggaacaccggcaacttcgtcggtggcaagggatggaaccctggaaccggccgcacgatcaactacggcggatctttccagcctcagggtaacggttaccttgccgtctacgggtggacccgcaacccgcttgtggagtactacgtgatcgagtcttacggcacctacaaccccagcagcggatcccagcgcaagggcagcttcacgactgacggcggtacctacgacgtttccacctccacccgtaccaaccagccctccatcgatggaacaaggacctttcagcagtactggtctgtccgcacgcagaagcgcgtcggaggcagcgtcaacatgcaaaaccacttcaacgcctgggctcgttacggcatgaacttgggccagcactactaccagattgtcgccactgagggttaccagtcttctggcagctcggacatctatgtgcagacttcctaagtcaggatgggtcgcggataatcggatgagcagtcggtgtgcaagaacagacaatggcggcgcttcggttgctgtccgaattagactgtagatacgggcgatgcgggtcgttcgaactagtccgtaatgtgtcaatctaatcgctcgttcaaaaaaaaaaaaaaaaaa

SEQ ID NO: 3315 - DNA, 592 bp, Triticum aestivum
  unsure (1)..(592): unsure at all n locations
  Clone ID: PAT_TA_3315
ctttgccggcctggggttcctgtcgtggtacctcgccgggaagatcaccgtcttcgaccgacgagggcacgtcgccaagctgtgcgtcgtcatcctgcctctcctgctcgccgccgtcatcgccatctcgcgggtagatgactactggcaccattggcaggacgtcttcgcgggcgccatccttgctattgtgtgcttgctgaatttgatgtaacaaacaaccataatccacccaatggccgcaggtttctggcctcatgcccacttcagggacatcagcgagagggaagaggagagccagaggcggcgcgctactgaaatgagcaacagtggctcaaccgcaattgtccctcggcaaggtgagacgggggcaaacacgagccgaacgttggacgcgatggagtccggtacgtaggacagggcgatggccccatgtaacatgcatgtatgatagcaaaaaaaaagtaacatgcatgtattgtggcctgtggatagatccattgtcacctaccctaagccttggagatctcagctttcgaattcaaaaatgtagggttggaagtgtcacnaatatctctgtatatatagtact

SEQ ID NO: 3316 - DNA, 501 bp, Triticum aestivum
  Clone ID: PAT_TA_3316
gtcgccgctagtgactcgctaaagtcgcgtttcaccaagcttaagtttatcgtgacagataagctttatcttgttttggttggagccgctttaaaatctggaaagatgcagcttcttatcgtctgtgctttgttctacgtactctttctgagggcaccatcttttatgcgaagaatggcgagggttgctgcaccacctgccggagggaatgagtcagagtgatggttatttttgttggtgctctgtattggtggaactttatttgtgaaccttcttctgtaccttaggtgctacttggtctgcatgtgtgagacttcatttgtgaaccttctatgtaccttagttgctacttggtctgcatgtggactttatttgtgaaccttctctgtaccttagtcgctacttggtctgcatgtgtgagactttatatgtgaagcttctctgtacttagttgctacttggtctgcatgtgtgagactttataaaaaaaaaaaaaaaaaa

SEQ ID NO: 3317 - DNA, 1009 bp, Triticum aestivum
  unsure (1)..(1009): unsure at all n locations
  Clone ID: PAT_TA_3317
ccccaaccatggnattccactgccgacttcaagggcaagcgccctctcttccagcctgatgacatgtctgccgccgccgctgcagtggcggtgccggatgaggcggaggcggaggcgaagccctcgtcttcttcggaggaggtaaaggagccggagccggggacagagaagcaggaggagaaacccgccctggtgctggtggccgaggacggcgtggaggtgcgcatcgcggagcccgcggcgcggatgtcgcagatgctccgccacatgatggaggacggctgcgctgacggccgcatcccaaccgccaacatccactccgacatcctcgagatggtcgttgagtactgcgagaagcacgggccgtactacgaccccgaggcctctgagcgcgaccggtatcccttcccgcccttccccatcgagctcacccctaccgtctcctccatcaagcccgtcacctacgtcgacccggacccccacggtctcaaggactgggacagcgatttcatctccctcgacaactccaccctcttcgagatcatcctggccgcaaactacctgaacattgaggatctgctggacctgggcacctcggctgtggctgacaagatgagggggaaaaagccagaggagatccgcgaaatctttgagatcgagaacgactacacaccagagcaggaggcggaagtcaggaaggagaacgcatgggcctttgaggactaaaagatgtcggttgatcttgcttctgtctatgctgctattcttggtttcatgtacaagtccttacctccagttctgttccaagtagtctgatagatagatagatgaatgagtcggtgaaaacagaaaaccgagatgcaccatatgggttagttaatcatcgtatacaggagagttttggtgtgaattgtggatgcgtggatggatggtttcgaaatggttgaatcggcagaaccttaatggcaacctgtgttcaattaagttatactattcgccaaaaaaaaaa

SEQ ID NO: 3318 - DNA, 655 bp, Triticum aestivum
  Clone ID: PAT_TA_3318
gggggccccactggccgccttctccttggagcagtccaaggtaggatatgttcatttgtatatcctgggtagagagactcttcctccgtcttcatcatttggtggtagtgtaaattcattttccttctctaatacaggctcaacgttttgttgttacattaggtagctatttgagtcttgagtgtgctgttgtagcctcatttatgtaatgtgtcaagcaggtgtatttaaaacaagtttttcagagatgtgggcgtatatatatatggatgtgtttgcggctacgcctcagggctgtaaggcccgggggtcgcagcgggtggagcctctccgggggcttgggtttgcgcctgggcctgcttctccgggttttccagtaacaagccgcctttctcctttggaacagtcccaaggtaggatatgctccattgtgtatccttgggtagagagattcttcctccgtcttcatcatttggtggtagtgtaaattcattttccttctaatacgggctcaacgttttgttgttacattaggtagctatttgagccttgagtgtgctgttgtagcctcatttatgcaatgtgtcaaggggtgtatttgaaacaagtttttcagagatgtggtatatacgtatatgtttttgttaaaaaaaaa

SEQ ID NO: 3319 - DNA, 1046 bp, Triticum aestivum
  Clone ID: PAT_TA_3319
accacaatggtaactgggcctggggctcattggacatccaaaagagccatggagaatcccacattggccaagacaaccacaaacatggaaccatgtcaaacatggtgttcttagaagaggccctcaaaccaggatcaactataccttgttacatccaaccatcggctaccttaggagctcctttgttacggcgtgatgtcgccgactctatccctatgtccacggggaacttcatcaaaattctgacaatgtttgcaccagcgtccaacgacatggctaccaaaatatggtcgacgctggatgattgcgagcacccgcgcgctatcaagggtgagacgaaggcatgtgtcagctctgtggagtcaatggtggagtttgctgcatccgtgctcggggttagtacctacaacctcgcggccttctcctcaccggacgtgcccgtggatggcgtcatgacagggagggggtacaaagtggcggctgtaacgagggtcagagaggcgggggacaccatgacttgccatcgcgggagtttcccattcgctatgttcatgtgccacgcggtgaatcccaccagagtgtactcggtgacgctggagggggaggacgttgatgctgacggcgcggggcagaggatggaggtgcttgccgtgtgccacctggacacatcagacttccacccagctaagatgccgttgcacgtcaagcctggagatgctccactctgccacttcatctccagggacagcattctctgggcgcctgctacgcccgcttctgctcacgctgctgcttagctacatgtataggtacataaataagaacagtgtgtacctatgtaaggcgtatgcatgcatgtccagagcagtcatgcatgcctcctgcgtgtggctacgtacctacacgtatgtgctctgaataattatttgtgtagtgtgcttgatgtggtgtacggtcgtgtgagcgagtatcttacatatatatagtgtgtaccgatgtataggtgtatgcatgtatgtccaccgcactcttgcatgcctctctga

SEQ ID NO: 3320 - DNA, 1146 bp, Triticum aestivum
  unsure (1)..(1146): unsure at all n locations
  Clone ID: PAT_TA_3320
tcccgtcgtcgccccccccacgccgcggcgaactgacccaccacccccaaaccctcgccgccgatggagcagccgccgtcctcgccgccgccccccgcggcggccacggccacggctgcgcctacacccgctcccgctccctcttccgctcccattatcctctcggactcgcctcccgcggccgcggcgggggagcccgcgctgaccgccgcacagaaggcgctccgctccaagccggcgcgcgcccccgaggaccccgacaagaagaataagaagctcaaggatgtggagatcagttttccaattgtttatgggaccatttcgttttggcttggcaaaaaagcaagcgagtacaactctcacaaatggaccgtgtacatccgttctgcaacaaatgaggatctgagtgtcatagttaagcgtgtggtgtttcagcttcacccaagtttcactaatccaacaagagttgtagagcaaccgccttttgagttgtccgaatctggatggggggagtttgagattgcaataaccctttattttcacagtgatgtctgcgagaagcgcttggacttgtttcatcagcttaagctgtatccggaagaggatgccggacctcaatcaacaaaaaaacctgttgtagtggaaacatatgatgaagttgtcttccctgagcctactgaggccttcttcctgagagtccaaaatcatcctgctgctactgtgcccaggctacctcctggtatgacattgtcttctccaggccctatggaacttatgccacatgataagaagcgttttgacacgaaggatcattctttgagccagtggttctcgaacttctctgaagctgatgaactattaaaactggcggctgctcgtcaagcaggtgcaggctcacatcgctaagctgagaaaggcagctaagtatgatagagggaatgccccagcaattcaagaagtcaatcccctgggncctggtcaacanttttggggcattggctaatgggaacnggtaanctgctngttaaggaggatgctgaaancctgacaacaactcgctaaaanatntgatgaaangtgtcctcaaatgacgtcctaagctcccaaattgatgnttaatgctgggcaattgtgcataaagcgcaa

SEQ ID NO: 3321 - DNA, 508 bp, Triticum aestivum
  Clone ID: PAT_TA_3321
gacccacgcgtccgggaaattgttcagtttgcttgcactcgctttaaggccgagtatccaatttttgacaaggttgatgtcaatggtgacaatgttgcacctgtctacaagtttctgaagtccagaaaaggcagtctcttcggggacaacatcaaatggaacttctccaagttcttggttgacaaggaggggcatgttgtggatcgctacgcgccaaccacctcccccctcagcatcgagaaggacatcaagaagctgctcgcgagttcttaaaccttgttgctgcatcaactagatgcattggtgcatcgcctgaagctttcagtataatgttgtaataaaggctgtgcagtccaatctcgtagttgtatatgacatgtaatggatttcgtggaatgtgttacttctgctgcagagatatcccctcttatctgtgtttttgttgtggttgtgagactcctgttcccgaggaacaagtttggaatgtgatgcacacctgttgttcgtc

SEQ ID NO: 3322 - DNA, 1051 bp, Triticum aestivum
  Clone ID: PAT_TA_3322
cccacgcgtccgcccacgcgtccgccgaagcaggcatcctctgcgcgcaccaacgcggccacacaccctcgatctccgctataaagcccggtctccggtccccgatgccttctcgccccgccccgctcgtccaccgcctccgcctgctgaggagcgccgtcgtctgctcttcctccgcgctgctgccgtgcagccgcccgcgcctcgccatccccttcgcgcagccgccgctccgcggccccgccttcgccgccgcctcgtcgccgttgctccgctcggtcggcgccagattctcgctgttcagcagcatggccgccgccgcctcctctgcctcctccatccacgacttcaccgtcaaggatgcaagtggaaaagatgtcgacctgagcacctacaaggggaaggttctcctcattgtcaatgttgcatcccagtgtggcttgaccaattccaactacacggaactcgctcagttgtatgagaagtacaaggaccagggttttgagatccttgctttcccatgcaaccagtttggtgggcaggagcctggcactaacgaggaaattgttcagtttgcttgaactcgctttaagggcgaatatccaattttagacaaggttgatgtcaatggttgacaatgttgcacctgtctacaagttcctgaactccaggagacaacatcaaatgggacttctcaaagttctgggattgacaaggaggggcatgttgtggggtcgctatgcgccaaccacctcccccctcaacatccagaagcatatcaagaagctgctcgccagttattaagccgtgctgcagcatcaactacattcttgggggcaccacctgaagcttcagtataatgttgtaataaaggccgtgcagtccgatctcgtagtggtatacgacatgtactggatttcgtggagcgtcttacttctgctgcagggatatcccctctatctgtgcttttgttgcggttgcgagattcctattcctcaggaacaagtttgaaatgtgatgcatacatcctgttcgccccattcggcacgag

SEQ ID NO: 3323 - DNA, 618 bp, Triticum aestivum
  unsure (1)..(618): unsure at all n locations
  Clone ID: PAT_TA_3323
naattattgaacttgctctcgtgttcctttggcgcatggttctattttgatacggtatcaaaaccgcatccttattcactgaaggtggccacagcagcccccacacgcgatgaagaaccaatggcggccntccttgcgcaaaatcacatcttagcagcatgtcaggataaatcaagtctcggccgtccacgaggtcaaaagggcttttttttattctctcattaagctcctatgtgctacatggtttacctgccctttcgagatttgcctctagatttctccttcttttcaatttttttttgcccgatacccaagagctgcagcatcagcaatacccgaagaacaatgcttatagagtgccatcaatttcctccactccggcgatcctctgggctgggcggccatgtatgctagttcgcgtcttatttcctccaattccgtgagtgataaagatggctttgctgaaggtactgccttggatccaccaaacatatccaaggctgaattcagtgcaggtgcagactgagcttccaaagcaggaaaattaaacaacttcctcacagtgggtcgacgcataacaataacatatacaagtgtgaacaagtttgccgtgatcca

SEQ ID NO: 3324 - DNA, 731 bp, Triticum aestivum
  Clone ID: PAT_TA_3324
cgctccacgccgacaacgcccgtgacctcgaggcctcccactcccggatctccaagcgcatcaagatgcagacgcagagctgcgtgcagatggcggaggaggcggagaaggagcataagaagatgatcgacaactactcccagcaagccgacgagatcaaggcatcggacaagaagttgatgacagaggtgcagtcgtcttcgtctcgtgtgtgcaaggtgaccctccctgagatggcaaagtctgtggccagagctatcgacggcttgcgcagtcgctacaacatcccagctacaacagcttagcatacagtttctgctacatctctgacttggtacatgcccttctccagatcaacctggctgctgaattcctggactcatggcagcagaaaactcgcgcatttgtcaataactactgttacacttcttgctacagtctcttcgtcagctacgtcaaaactcgttacgttcagtccaatatatggggctcgtaagctatgtcaaaacttctgttggtacctagggttggatcatgctatgaacattctttacaccttgtattatatgaattgtcgtcagttggtcgattaatccattggatatcggaagtttgctgaaaaaaaaaagccaggtcttagcatctctctttcttcctcgtttctttcttggtggtttacatgcgctcttcactcagaaattggttgctgtgacccgagataactttttcag

SEQ ID NO: 3325 - DNA, 691 bp, Triticum aestivum
  unsure (1)..(691): unsure at all n locations
  Clone ID: PAT_TA_3325
gcacgaggcaagggtgttgggcatttggctggcattttacacgactttctggagagacccaacgatgttgttgatggcactacggatggtatgctgtatactctttcccgtgaagagttgttagaattgtttgtaaccgtgagcagccaactttcacttctatggaatgcattcttgaaatttcataggacaaataaaactaagatactggattacttgcgggacatttgggccgttgacaggaaagcagaatggtcaatctggactaatcactctaaaatcgagattccacaccgctatttgcggagtatgagtgatgacccacctcaccgccaacactccctcctgagagtttctggttcaaggaagtttcatgaagatcctgtacaaaattctgcttcacgggctgagctacacaggaagagcatagcccaaatgaagatcaacacganggtctgttcaagatatgcatatatatgctgatccttcgcgtgtacctgttgtccttatagaacaacatgtcatggnttgttccacaacatggttcaaacaaggatttggcatcaagttcttcagaacagaaggatactattgtgctacctaaactacaaggagagtctttggcgctgaaaaatatcaatggtaaaaaaagtggacgcgtactacgagctgtcatctttgtgcatggatt

SEQ ID NO: 3326 - DNA, 1221 bp, Triticum aestivum
  Clone ID: PAT_TA_3326
ccgcgggtatctcccgtcgctggtcctgtcccccttcccgccgccccctccgccgccgccccttgccggcggagcccgtagaaccccgagtcctctctagtgcttagaccccttctcgtcagaaccctcatggcgctcctcctgcggcgaggtgccgcagtcgccgcccgcaccctgcgcgccgccgccgcctcctcagcttccacctccgttccaccgcctaccgaccgccggatccctggcggccgcaagaaacctgcccaccacgcagtttttcctccttgagatccggaggggcttcgcgaaagggaagaaatcgaagaatgatagtcgaagtgataccgttgaagctgctcctgatatcgggccgactgtcaaatcggccgcgactgcacaaatggacactgccgtcgttgcgctgtcgcgagagctgagtaaacttcggacagggagagcttctcctggcatgcttgaccacatcatggtggaaactggggatgttaaagttggattgagtcgtattgctgttgtttctgtcctagattcgcataccctatcagtgatgccctatgatcctaatacaatgaagtctattgagaatgcaatcgcttcatctccattgggcatcaatccaacacctgacggcagtaggattattgcagctgtacctccattgacgaaagagactatgcaggcaatgtgtaaggttgttactaaatctgctgaggatttcaagcaaagtattagaagagcacgccaaaaggcacttgatacaataaagaaatcttcatctagcatgccaaaggatgatataaagcgactcgagaaagaagtcgaagaattgaccaagaagttcatcaagtcggcagatgatatgtgcaaggccaaggagaaggaaatctctggaagctgagcctgtccatctagctgatgttccttccttcgtttaccttacacaacttcgatgccagtgatgttgagccactgaggtgccgcagccatatcaacgattaatagttttatttcttgtggcattgttagcaattcaaaacaatgtgatagccaggacaagctggcaggtttggtgatgcaacttggattatgctgtaggagccacgaattgatactttgagaatgaaagctggtttattgtgagtctgtgaccagcatggcttctcctgttcagctgtagactatgtccattatggctaaattctttcc

SEQ ID NO: 3327 - DNA, 1562 bp, Triticum aestivum
  unsure (1)..(1562): unsure at all n locations
  Clone ID: PAT_TA_3327
cgggccagccctcgcgcctctctcccctccgccccgctgccgcccgccctcctccccgccccgccccgtccccccccccgcgccccgccccgccgcagctgctgcagcccccgcccggcgcccatgcggcgcggcccgccgccagccatcctccccgtcccgcgccttctccttcccatcgcccctccctgccgcagaagcagcagtccccgcccgtcgcccaagagccgaagcccgccaccaagcagccgccccctctcctcttcctcccacctcacatatctctctccatccaaaccctagccccgcaccggccttcctgccctgccgccgtcatctccttcgcccggttggccgccccgcaccgcacgaggtgggatgcgaggaggcaggcgagtgggtgcaggggagcaggcaggaaggagcagcggagatgcgcggaagagcaggatagctacacgacagagctgaacgggacctcaggcggaaccgcggaactgcgtggttgtgccgggagcgcgggcggataactagagacgacgtcgagggcttcctcggcggaccgaacctccagtccgggtcctaccccccccgcgccgccctgtagctcgctcacgcgccggcacgccgacgccatagaggatgctgctccacccctgctccggtccgtgcccccgacgccatggaggacgcccctccacccctgctctagcctgaaggtactccacacctgctccatcttagttttggtcaaaactgatggttgaatgccccggctgcagcgagccgttgcttccccattttattctgtgttgtggtgtatgccgtgccgcaccatggtctctgttttgtcaatcttctgtaatcatttatgctgtgggagtaagttttaaacaaaattcagtagagttctgaaccattgcatcagtaagtcctatacaaattcagttgagttgtaaacaagttactagatcattaagttctgaaccattgcaaattctgaatttttcctgccacggcggccccccctcctcttccaagtctagcccatcgatgacgcgccgtctcctgcaagcccctcgcctcctcctcgactggcggcagcgccgaccccgatgaggagcccatcctgcccctcctccaggaactagcagatagcttggtgctcccgcaagcaatttgggattctgtcttgatcacaagaatccatcagaattcaatacccgatagtcatgctgacatgatggatctggacgaaccatttgatcccatatttagctgacctatgggcaacccatttggtattttggacccaaattttgttgagagagccgctgctggtttctttggtcagggacctcaggttacacatcgcagggttgtgcggtacatacctatcacactaataatcctcaaactgggaggtctggttaatggagggtattatcanctcatgccactgtccatgtcctctttttagttaacttcaacttcnanacccaattttttgtancaagggctggcttaatggggtngcccttgataaaaatttccggtaaaaa

SEQ ID NO: 3328 - DNA, 1023 bp, Triticum aestivum
  unsure (1)..(1023): unsure at all n locations
  Clone ID: PAT_TA_3328
catattctcatcgatgcaaatgcactctggaaggcatgatttgctcctttctgactgtagagaatgtgggattctggctgtaagataaatcccccactggcagaagagatcctttgtatggaaaaacaccacagacgtataaattttttctgcctggattctgaaaatgaccaaggacaagcaactcaagcgaatgattgcttcagtcgatcctgccctgttattcttctgaaacatgctaaagaaaggtggtccattatcgtgcctttgagctgggtaaagcctttttggctctttctagtatctcatggtgcacacgcgattggcttaagagagagacggtggattgcatcacagttaaagataccatgcttcccttatgattacccagacagcaaagcatattcatcatttatgacagaagaggctgctgtttttgataaagcagctgagtaccgccctgctgccaagagacctccaagagttcctgtacctccttcatggcatcatatcatggctagtttaaataaagaagatggcacggtgagatgtcttgaagtagatgacttaaagccttctgatacggtgttacctgagtgtttctcattaaattccaactgtggagattctggatcatcaccgacaactgtcgttgcttcattccaactctttgtgccaagaaccattcaaacgttgagacattatgtgaaagaacttgatatgatgtctttgagttcctcatccgaagatgggaaatccatattgatgaacccaaattggcttctggtggcacgttaaagacgcatctcctgtaaatggattataccttgtaaggtcctgatcgagtgtcaaggaagttcnttgaaaatggccgtanttgtgcacattttacaagtctacagctggaaacagttagaggagataggacatgtcaaaaaatggaatcaactccgatccatacagtctattcattcngggncaagatgcacaaacgaanatnnatgcgnagcttccanggttcta

SEQ ID NO: 3329 - DNA, 1379 bp, Triticum aestivum
  Clone ID: PAT_TA_3329
actagccagagcagagcagagcagagtccggtagccagatcgaacgccccaccctctctccctccctccctcgcccccttccgatcgagcccgtcgccatggcgccgccccgcgtccacctgctcctcgccctcgccttgtgcctcgcgttcgcgcgcgcggacgcggccgtgagggagctcagggtcgggtactacgcgcagacgtgcccccgcgcggaggagatcgtgcggcgcgtcatggcccgcgcgctcgcgcgcgaggcccgcagcgtcgcctccgtcatgcgcctccagttccacgactgcttcgtcaacggatgcgacgggtcggtgctgatggacgcgacgccgacgatggcgggggagaaggaggcgctctccaacatcaactccctccgctccttcgaggtcgtggacgaggtcaagagcgccctggaggagcagtgccccggcgtcgtctcctgcgccgacatcatcatcatggccgcccgcgacgccgtcgtgctgactggtggacccaactgggacgtgaggctcgggcgggaggacagtctgacggcgagccaggaggactcggacaacatcatgccgagcccgcgcgccaacgcgagcgcgctcatccgcctcttcgccggctacaagctcaccgtcaccgacctcgtcgcgctctccggctcgcactccgtcggcgaggcccgctgcttctccatcgtcttccgcctctacaaccagtcgggctccggccgccccgacccccacatggacccggcctaccgccaggcgctcgacgcgctctgccccctcaccggcgaccagaacgtcaccggcggcctggacgccaccccggtcgtcttcgacaaccagtacttcaaggacctggtccacctccgcggcttcctcaactccgaccagacgctcttctccgacaacgaggggacccggcgggtggtgacgcagttcagccagaaccaggacgccttcttcagggccttcatcgaggggatggtcaagctgggcgagctccagaaccccaggaagggggagatccggcgcaactgccgcgtcgccaacggcgggcggccgccgctggagaagcaggtcgcgccgttccgggtgctggatttctgaacctggttctacggtaggcctgtaggtgtctcatgggagctctggtgtcggagcgatcgatatgcttgacataggtttggtcgtgtcgcagttctgtgcctacccaagaatggtttcaggtctggctactgcttattgctaattgttgaggaataatagagaaatcgatgcctctggtacgttgatagccatgggctgcattaaggtttgcttctttgtcgattctccaaagattctcgtgccgaattc

SEQ ID NO: 3330 - DNA, 491 bp, Triticum aestivum
  Clone ID: PAT_TA_3330
actgcatcttcgttcctttcttgtgcttcgatctgctcgcgagctacccgagtccatgcctcagttggaagagattgtctcgacggccggcggggcaggctcgccgccgccgccgctgtggtttctcgtcttcctcgccctcggcctccacgccgtcgttgtatccgccgcgaccttcctcgcgtggctgtaccgcgcattcctccggcgggggcaggacctgggcctgcgctacggcgcgtgggcggtggtcaccggcgccaccgacggcatcggccgcgcgctggcgctcgagctcgcccgcagggggctccacctcgtcctcgtcggccggaaccccgccaagctgtcccgcgtcagcaaggaggcccaggaggcggcgccgtcctgcatggtcaagagcgtggtgttcgacctcgccggtgacgcgacggagctgtcgctgggcgcggcgagggtggccgccgccgtgaaggggctcgacgtgggcc

SEQ ID NO: 3331 - DNA, 1159 bp, Triticum aestivum
  Clone ID: PAT_TA_3331
gccgtccgccgcctgcagcactccagctcctgcgggggcctgcccggggccccgtccccgagggccgggtggatcctctccacgagctgcagcgcaagaaaccaatggacaaattcagagtgtggcttgattctacacacaggcttggttcgggattatctccctgatgacgcccctgaagtgcttgtcagcatcatgccaggtacctcttgctctgacgagttgccccccgctcttcctcgatgcgggccgcggggcccgtcggcggtctgcgaggctggcttctagcagcatcgtctgaactcggttgccccggccagtgtccagtctcgctgtccattttagtgtgtttgtgtttctagctggctctcctgttgcggtggtttcttggggcgctcagtgcgcaggtctgcttgttggttcgaagtcttctgctctctcccctggcttcgggacggcacaaattgtgggaagtcctcaatgcatcacaatgtgggaagctgtaaatgatggcaaacatctcaacatgtctgtcactatgccctctgttggaagtgggctcggtctcgggtgggacccacttggcgtcacagtcggcatgcctggacctgctcggcgtgaaagggccccacgacctttcgctagaaccgcccgcgaggcacctggcccccgtggttgcaggcggggttctcgccggccagttgtccctcttatccgctcgcgccgctggccagctcctcaagagccacatgtagtacaacagatccagcagagacatgtgcaaggcggcatctctaagttcttgattgactccacgagctgcagctcaagaaacttaattctgcatacagggtgtttctggcgtcgttcttcgcgtgctgccgctgctggcatcgtcgacggacggccccgggcggcaccggagaagctaacctttttagcctgtttgtgttcataaggctttgtggttggttgggttggttaccttggcgcgcaaagtgtggggatctttttgtagcatcgaagtgtagagatctctctccttgcttcaggaagccagccttgtagtggtatctgtttcacctttaaaaaaaaaaaaaaaaaaaaaaactagtcgaacaatttcggaccttggtgacgtgattgtagaaaaaaaaaa

SEQ ID NO: 3332 - DNA, 697 bp, Triticum aestivum
  Clone ID: PAT_TA_3332
tagccctcctcgcgtccgcctcggggtgcctcgcggccgcgggggccggcgagcgggaagggtggctggacgaccccgcggtgctcctctcgctcgggccccgcgcgcgcgacctcgccgtggccagcgccgcgaggtccgtgctggggatcgtcccagtcgcgggcggcggcggggtcaccgtgaagcccgcgctggggccagacgacggccggatctccgccgtggagtgggtcccgctcgacgcggagggagcgcaaggggaggagggaatggccctcgtggtgggcaccgacgccgggtggctcctcttctactcgctcgccggcgatctcctgcataagcagagtatatatcctgcgaagatactgaagcttaacttcagtgagagaaaggaaaatgcttgggaagattcaggttcagatgagctttccgtggtttttcccggtgttattgcacgttgtgatggtgctgaccttcagatcatgcttcaaaaatcatttcaagaagttaaatcgcgcatgtggaaagataagtttgaacaggaagatggtgaggacacgagttctttcgaaaagatacctcttcagattttggaacgtaagcaagttcagcccttgtgtttgatgcggcaattgtttgggctaatgccacccccccggttagctcttcagtcgagtcagcgccactactgtgc

SEQ ID NO: 3333 - DNA, 602 bp, Triticum aestivum
  unsure (1)..(602): unsure at all n locations
  Clone ID: PAT_TA_3333
aaagcgtggcgctagcatgtgccctcgccggcggcccagccgcgttcaaggacgtcttcgtcgacagccgccacgacccgccgttgcccctgccgaagaaagaccacagcggtggcgacggcgacggcgacgccctcacgagcaacccgatgacggggcagcgcctgtaccagggcacctgggtgatggaagggtggatcccggggatcgtccagattcaaaacggcggcggcttcacgccacgtcgtggcgatgtcatcctcgccagcccgcccaagtgtggcaccacgtggctcaaggcgctcgccttcgccaccatggcacgcggggcgcacccgcccgccgcccccgaccacccgctcctccgccacacgccgcacgactgcgtcccgttcatggaggtgatcgtgtccggcgggtgggggagcaagctggacgcgctgccgtcgccgaggctcttgtccacgcacatgccctactctactctgcccgcccccgtccccgaggatccagtctgctggagcgcctacggctgcaggctcccaggggtcatgggactcgccatctggctcttcctatttnagcancngggggattnnntg

SEQ ID NO: 3334 - DNA, 625 bp, Triticum aestivum
  Clone ID: PAT_TA_3334
gcgggccactccctcctccttcggtcagccctctcgcctccctcccagcagggcccctcgtcccatcgcggtctctgctggcggccgcgcccttccatgtcgcagccttctcatccctatcctctccgtccgcccactcgccgtctgtcctccgcagcatccgggggcgcccgtggggccggccacgccgtccgatgcgccgcggccaaggaggccatcctgtacgcgctggagcacgatgagatgttcaactcggaagaggtgatccagtgggagagcggcaagacgatcaactccatcgccgccgcgcagggcatccgcatccgccgccggtgccgcccccggtgcccctcggagggctccggccccggccccgccgcgccccccagcatccccgggcggaccgtgtgggacaaggagctggaggtgtcgcagaggaaggccaagaagcctctgaagagtgtcgtggagtccagcgagcacgcgccgccggccagggatttcatcggcgctctcacggcagcccaccgtcgcaacggcgtgcctgccctgatcgccgaggttaagaaggcgtcgcccagcgggggcgtgctaagggagaacttcaacccggttgagatcgcgc

SEQ ID NO: 3335 - DNA, 628 bp, Triticum aestivum
  Clone ID: PAT_TA_3335
agttgagcaaagcactgcagaagacaaacattctcataaaggatattttaaaaaagaaaccatgctcggatgtttcagagtgccagctgcccggccggtcgtcccgggtcccccccgcctccgcgtttttcaagaattttcttgaggaagattcattgaaatcaagtttgcaggtcctggaaaaggaatatgtgaatggacttgatacaaagggagaactagatgcacggatgtttgctaatgatgaggacagtttgcttggcagtggaagtctgtcaggaggtgcccttaaattgccgggcacaaagagaaagtatgacgatgttatggcctcacctaccaaatcaacagcaagtcgagccccaatgtctcctccacgtttctgtccgtcacctaatggaaatagcttctgcaactcaaagatggctcctttcaccccagtgagcacagccatgacaactgccaagtggcttcgaagtgcaatatcgcctctcccttccaaaccttctggggagttgctgcgcttcttctctgcatgtgataaggatgtaacagatgacatcacatgcagagctgccattatacttggagccatattcacaggcagttcttttggtgagcgtatgtg

SEQ ID NO: 3336 - DNA, 822 bp, Triticum aestivum
  Clone ID: PAT_TA_3336
ccctatccacccgccgcgccccgtccacatcccgtcccgacccttcctggtggtcgcatcgccctcgcctagcctcgccttctccccccagcccagccgcgccgctcccccttccccctcccgccccctgcccttccctacccttcctccccccgcccccaagggcctcctcggggttggcaggctcctgccggccgccccaccaaccctcagggaaaccgccactcgcggcccgggcaacccgcgtcgggacacctcgccccactcgcctcgcgtttctcgcgtcgttttctgttcgtcgatttgatttttgggcgaatttcgctttcacggtcggcggattccggcgggctcccgatccgcggccgggggctgggtctcggcccccgcccgcggcgtagtatttcgctcgcaaggggcccgccccggggcatcggcgctgcttcgggtcctcgcggtgtgctcgctgtttgttcccgtcctgtcgcggtcgcgatctcgggggcgatggccgacgacgggcgcggccgctgccgcggcttcttccggggcgccggcgtcggcatctgcgaggccatcgagaaggccatcctcgtcgccgccgcccgcgagccgcaggagttcctgcgccgccgcgaccgcatagccgagcgcctcttcaacgcgctcctcgcccgcccctcctgccacggctgcaccgccagcaccggctccgtcccccccgccacgcccgccgtcgcggaggacaagggcagcgtgcgccgcgtccccgagaaggagtccaaggtcgatagcagcagcctcggcgcgcccgggggtggg

SEQ ID NO: 3337 - DNA, 703 bp, Triticum aestivum
  Clone ID: PAT_TA_3337
ttcggcacgaggaacccgactctgccgaactgtactgtcggtcgccgcctccgcccgcgcgcgcacatggcgacgggggaggacgactcggggatttaagtaagcgagaatacgcggagagccacgcttcctcctcctcgtcgtcgtcctccgccccgtccctcgttgtcagccgccgtacatcggcacatgtcctcctgccgcggcagctgactagctagctcagccgagagtgggggagggccaagggggcagggcagcggccatgagctggaggagagggggagggggaggggacggggccgtggccaggcggtgggtgctcctgctctgtgccgggagcttctccctcggcctgctcttcacctccgggatgtggacattgccagaggcaaccgaggttgccaagccaaacgaaagaagagggaaagaagccgagctcgccgccatagactgtgattctactaaggtcgggcagaagcaggatttcagagatacgctgcaggccttggacactcacaacgctgtacagacactggacaagacgatagcgaatttggagacagagctttcggctgcgaggacgctgcaggagtcattcctcaatggctccccggtttcgcaggagtacaaggcctccgagtcgaccggaaggcggaaatacctcatggtcatcggcatcaacacggctttcagtagccgt

SEQ ID NO: 3338 - DNA, 744 bp, Triticum aestivum
  Clone ID: PAT_TA_3338
cgcgcctccccccccgcctccttctccccctgcttctcactcacttcggcatgaggtgcgagatggaggcgcaggatgactgcggaaagtggcgccaaatcccggcgttcggcgactggaacatgtgggaggagatgcccgtgacccagtacttcgagcccgccgccaccgccctcgccgcggcgcacgccggcgacctcgtcgtcgtccccctcttcgccccccaccccgccgcctacccctactccgtcgacaagtgcgtcgtccgagtgaagaagggggagcaggacgacaagccgaacgccaaaccccggtgccggtgctgtggccgggaggaggaagaaggggggcagcaggcccccccgccagcggagccgccggcaagggaagaaggagcagcagcagaggaggaagaagcccaaggccaagcgggcggcggcggcggcggcggtggacgaggacctctacaagatctcccccaacgtcatctgcaaggtgcagaagaagaagttgctgaggaacctgctgggagggtgcctgggcctcaactgcatcgcctgaatcaaacaattatatccgagacttcttatccagagttccagagtttggtgttattaggaaaactaagatcggtcgagttgtgtttgtgtatgtacatcgtctactgctgctcctgctacgataatatatggaagtaatggaaaccaattgctgctcagaataacgccctccgcactcagtcac

SEQ ID NO: 3339 - DNA, 2526 bp, Triticum aestivum
  Clone ID: PAT_TA_3339
gatgcgggtgcccgttgcgaaatttcctcttcttccccggtgccctagctccaggctgccgccttgccctggcatcgcatacgcctcacacccctgagcccccaaccccatatttgtcacgctcgtcgccgcctccaaccttatcgcggcaccgcggccctgccgtatcccccagccgtgtccgccgacgagaccgccgccatcttcgtcattagttttgaagactaatggattatgataactctagaagacacaatcaaagtacgtccaaagataggactcatttcaagtcagatgatggaaagatgatacggctaaactacaggcaggatggcgaacatatgtcctctcacccatctgaaaccgtctacaggatactaagctgaagcaaaacgatcggcgctttcttggggaaacatgggcatgtcgtgaaaactctaggccagctgacaaacgcacagataatccacgctgaggctagtcattgagaacacgatagtgtacaaaatatatctggtctataaaaaaacactggcctagcttgctaaaatttcttatttacttatgccttttacccccttttgaccgatatacatcttctgacagcttttgtaaggactcaatactctttgtccacagataacgtgctgagtggaggacgttcctatgtgaactcggccatatgccgtccgctagctgttctagtagaggctttcagcaattaggcctctcaagaactgggaatagtaatatgcaacaattaggcgtcaccagagctggaaattccaaggctcatgatttcaccgacgctgccgggcagatgcatggacgtgaggagtatcaaagagcggcagatgttacggggtattccagtagctctgttgagctgaggattccaaatagttctctggaatctattgttggagctggtggtgtcaatctagcagagatccgccagatctctggtgcaagaatgaagttacttgaagcccgtcccggttcttcggaatccatcatggagatccaaggtatgccggaccaagtgagagtggcacagagccttctgcaaggcttcattggtgccaacagccagagcgtgcagccatcccagtcttctcgcgacgtccattatccaaggtggaactaaaccctagaggcttgtggtgaagagcaacggaacaccgtgcaaactccaggtcgattgccatgctgccacattaactaggttgagcggtgtaacttagatcatgtttgttgacaaaaataatctgggctttggttatttccaaggatgtactgccaaacgtgcttgttttattagtctttttacccccttttgagtgaaatacatctgatgacaagagttgcgaaaactctgtactcattgtacacacggaacctggatggttgaagctgttgttatatgcaatgctatttatgaacttcaaaccaacaaatggaagacctgccaacgacacaccatatggaaaacctgccaacaacacaccatatgggagacctgccaacgatgcaccatatggcagaccaaacaataaaccccatgattcagtagattacttctctaaaagaagagagtatcctagtggaagtccatttgctagcgacgctccaccatctgcttcttatgatagatatgcagcatctgctcgcttgcctactagagaaatgcccttgcctgttagtcctggtgctgattacatgtcgcatcgttcttatcatgaccatatgcctactgatagctattctagtagaggcattcagcaattaggcctctcaagaactgggaatagtaatatgcaacaattaggcgtcaccagagctggaaattccaatgcttatgattacaccgaggctctcgggcaggcgcctggtcccctggtttgccaatggcccgcacctcttactgggcattcgagtcccgctgctgtgctgtggattccaaatagttctctggaatctattgttggagctggtggtgtcaatctagcagagatccgccagatctctggtgcaagaatgaagttgcttgaagcccgccctggttctttggaatccatcatggagatccaaggtatgccggaccaagtgagagtggcgcagagccttctgcaaggcttcattggtgccaacagccagagcgtgcagccatcccagtcttctcgcgacgtccattacccaaggtggaactaaaccctagaggcttgttgtgaagaacaacggaacaccgtgcaaactccaggtcgattgccatgctgccacattaactaggttgagcggtgtaacttagatcatgtttgttgacaaaaataatctgggctttggttatttccaaggatgtactgctaaaagtgcttgttttcttagtctttttaccccccttttgagtgaaatacatctaatgacaagagttgcaaaaactctgtagtcattgtacacatggaacccggatggttgaagctgtttttatatgcaatgctacttgtgaacttcaacaccgtcacatac

SEQ ID NO: 3340 - DNA, 1079 bp, Triticum aestivum
  Clone ID: PAT_TA_3340
aggttgctatcatccatattaagagctcatttacaagcttatgatcctattctctcaatgtccttaagatacttaataagcattcacaaagtattctgctcgtgccaaggagtttcatcacctatatctgatctaactgagcggctactcttcgaggaccgtgatccgcctgcagttacccaggaatgttcaagtaagaagcaccaccatttgacgaggttgatgttcaagccctagcacatgcggttgagttgacaagacaaggcgctatcgacagcttgaagtttgcaaaaggagatttgtatcaagcatttcagaacgaactgtgccgaatgaagatggacctgtcacttctggataaacttgtacatgagtactgtatatacaggggaattgttcaaggctgttctcatgcccttcctggaactgctgacatgcaatgcagtcaaaacattgatgttagtttcataaataatcaaggagccaacaatgaagcacagcttgattgtgaatcggctggccaagcaggatggcggttgttgcaccagtgatattacccatcatgattcctggtcgaagagattacgcagggttagaagcagtacatcagggcagggaaggcgaaagagatggagaggtcgagcagatgatcttaattatgcttttgagactccagttgatgcaaatcgtgataccttgtctcctgcctttgacatggacgaagatgttgtaataggagaacatgactctgtgttagatactggtttgtctgatactaggaatatgcaagatcagaagtatgaggttattttagagatgagggacctcacacgcaaaggaatggcttccaaagttgtggatgaaataaacagcatagatcctgatttcttttcgcaaaaccctattcttctgtttcagctaaaacaggttgaatttcttaagctagtagctggcggtgatcatgtagctgctctcaaggttgcatctgcgcacctgggacctcttgctgccagtaaccaagctttactgaagcctttgaaggaaactttggcaacactgattcaactcaatgaggatgt

SEQ ID NO: 3341 - DNA, 605 bp, Triticum aestivum
  unsure (1)..(605): unsure at all n locations
  Clone ID: PAT_TA_3341
gggtcgcccggcgacagnagcaccgccccaacatcggatctgggcgcggccacctcccactgcgccgtccccagccacctcgcactgcgccgcccccccagatccgcgctcgttgggtgccgccggcccgctctcttctccggctgttgggaggaggggcgaggcctcccgtattgccacccccccctggcgagctccctccccgaccggatgcgccgtctcccctccgctcctttcttccaccttgccggacgaggttgcggccgtgagcgagcgcgtcggcgacgcatttggtggcgcaccaccgtggcctccctcccggcgtcgagcacgctagcatcgcctcaccactgcaaggggagatggcctaggcggggacgggtgtgaataagaacaaggaaaggaggatgtgcatctcattctcgcctcgaggacgccgatggcccgcgagacgccggccctggcgagccaccacggcgcgtcggcctggaacatgagctccacggcgtccctgaagaccgcgatgttgtccacctcatccacctcgaccctcctggccccgccgccggcgccactgccattggactcgggtgccatggccgcga

SEQ ID NO: 3342 - DNA, 595 bp, Triticum aestivum
  Clone ID: PAT_TA_3342
tgcccaacgagcaaccacaccaccggccgaaatggggcagtccaagccagtcctggtcctcctcctgctcgccgtctccactgcggcgagcagcggcaaaccgctgctcactaagatcaccaaaggcggcgcggcgacggccctgtacacggcgccgctcagcgccggccgcccgctggtcctcgacctctccgccccggccatcacgacgccgtgcagcgggcagacgacgaccgtcacgctctcggccaactctaccgacggcagcaacccgctatccctggtctccttggctgccactgccacctgcgcggcggcaccgtccggtgccgtcggcgtcgcggggctcgcgcgctccagcgcctcgttcccggctcaggtggcgagcacgcaaaaggtggccaactcgttcgctctctgccttccaagcgacggcaggaccgggttcaccggcaacggcgtgggtgcggccatcttcggcggcggcccgttctttctcgcgcccccagcggaccggccgtccatcacgacgctcctctccgacggggttccgctgcgccagcccttcgccggtaaccccggctacttcgtctca

SEQ ID NO: 3343 - DNA, 593 bp, Triticum aestivum
  Clone ID: PAT_TA_3343
gcacgagggtgaagacgacgacggtaggagctcgccccaccaccaccccccgcccggcgactcaaatcccaacccctcttcactcgaccgccgccccagctcgagccccacctcgaattcccctgctgccgccgctgccgctgtttccccttctccccacctggtatggccgcgtgatctggccagggtttggatgaaggaacggaagccggcggccccctctgcgttggcccggatcctcgccacctgcgcgtcccaggcaaaagattatgggagatgcatagcagcaaaggtccctgagattgaacataatatgtgttctaaggagtttctagcactcagagcatgcatgcaaactgcggtcaagaataaggcttgaagttcaaggcgtctgtagtttggtgtgaaccacctttcagtgtgatcagtgtgctctcagatgcaaggaggtttgagcagccctggtgcgctctctcatgcttatgtacaacatcctccgctacggtgtgacattccagatattaaggggctattctatgatgatgcgaataagtttcttgtagccccaacagctgatcggatattatactgga

SEQ ID NO: 3344 - DNA, 830 bp, Triticum aestivum
  Clone ID: PAT_TA_3344
acaactttgggatagataactcgaacaacagattcctcctttgcggtagactctggtggttcgagacccatcagaggctcggcccgcgccatttacgaacctgatgatgccagtcttccagttgcatcatactatgttacgaactcaacgagatggggcgttagcaacatcgggagattcatggactcgtctaatgggagttatataatatacacttctcgccggtttaccaacacacttgattctgaactatttcagacagccagaatgtcaccctcttcattgagatacttcggcattgggctcaagaatggcatgtacagcgttgtacttcaatttgcagagatttttttcccagatgaccagacatggaaaagcgtgggaaagaggattttcaatatatatatccagggagatcttaaagaaacagatttcgatataaagaaacaaacaaatggaaaatcttatactgctgttcaaagacagtacactgttgaagtaacgaataatttcattgatattcatctcttttgggctggaaagggcacttgttgcattcctgaccaagggttctatgggccatcgatatcagcattaagcgtatcttcttatggtactgttacttgtgctatcaattagttacataaatcatatgacaacagtccactttctattatcttactcctactgtagatagcaacggtgaaggggatcctggttcacagagaaacagcactagcagtagaacaggtttggttgttggagttgtagtctgtgttgcgattttaggatttctagcactcgctggggccattgtttggaggcagaaa

SEQ ID NO: 3345 - DNA, 1375 bp, Triticum aestivum
  unsure (1)..(1375): unsure at all n locations
  Clone ID: PAT_TA_3345
cggacgcgtgggcggacgcgtgggttctcattgacaggtttctcaagaggaagatgtttgaggatgcagtggacttgttccggtttgcaatgggggggacggagaagccatcggctcaggattttgtcttcttattgaagaagcttgttgtgagggatgatatggatctgaagctggtgatgagtgttgtgcggatctatcagaaggctgggaatgaggtgaagtcttccgtgtttgatgctgttatcaagtcgctgagaagcgtagaaaggcttggtgagagtggcagggtgttgaaggccatggaggacggtggttttgcaccagacagcactgtgcatggaaaagctgttcttgcaatgtgtgatgctgggaatctggaaacagcgcacaaacatttggctcgtgtggaaaaatcagggcataagttggatccacctgtatggtctgctttggttcagaagtattcccttggtgatgatgttgatatggcagtttcatgcttccccgaaatgctggaaagaagaagtggcaatcaggttggtagcgctcttgaggtgcttgtgtatgggctgtgccggaagaaagaagcaaaggaagcgttcaaagttctgaaggacctggtgttggaaaaggatgtggttccttggcaaagtacctacaagtatttgatccacaagttgatccgccaagggcatcttaaagaagcatttgatgtgctaggtttaatgaaaagtaatggatttccgccttatatcaatccatttatcacacacattttgaaatctggtactgtggatgatgccctgggtctgctaaacgcaatgtcttcagaggagttcccatcaagaacagtttacatgcgcttgtttcaaggtctgttcaaagaggggaggcatgaaattgcccagcagctgctctcggtatctcctggaagtgtccaaaaccacgcagatgttctcgacctcttctataagatgaagattgaagaacctacagcagcgttgtagactattcttatgttgaatcgaattgctgatgcttgtatttcaattggcattttgtattcccccttggctttgtaactggcctttgagccagaatcagaagttggatggcagaaaacttctttgctgaaatgcctacttgtcctctaaaaaataaataccattcttttttcctctctgccatggaatttcttttttctgtttgtgccacatatttatatgcttcatgtagcaatagccatctcgcaatagtgctaatttaaatgattggcatcagtgtaccagtttcctgtagttcttcttaatgcactgctcatttggtgttcaaaaaaaanananaaaaaaanccangggggcccgtaccaatc

SEQ ID NO: 3346 - DNA, 2063 bp, Triticum aestivum
  Clone ID: PAT_TA_3346
ccggtagttcacgacgccgcctttcttgccggcttcccgtctgctgctgccgcacgcggtgtgagcctgggcgtggtggcgcccggctggggggtgccggcgggggtgcccccggggggccggggccgatgggttctgccctcgccgccccccggactttgactcatggtggcggccctgctttcttttcgtggcaactggctcccctgttccgggtgaggggtcttgtattcccctcgcgggattccactgagggctgctgtttggtggcgggttccccggctgtgggagcttgtggcttgcgtgctgctggccagcgccgccgtttggtccccgggcatgatgcgtggctagaagatgcattcgatagagctgctcaactatatttgtcttactaccggtctattcccaaaagtttggaacgtgccacggctcacaaacttatggtagccatgttgaaccatgatgaaaggtttgtagaaccatcaccacattcattggagaagttgactcttcaatcagttaaagaagctgtcatgaaccagtttgtgggtagcaacatggaggtcagtgtagttggtgatttcacagaagaagaggtagaagcttgtgttcttgattatcttgggactgtaagcgctgcaaaatcttcaaacaaagaggaacatattgagaagatttccttcctgccatccccatcggatctgcatttccagcaagtatacataaaggatacagatgagagagcttgtgcatacattgcaggcccggcacctaaccgatgggggtttgctactgaaggaaaagatctcttcaatgacattcgaagttccagtgcagatgcagaaatctctgcaccggctaactcggggaagacacatattaacgttcgcaaccatcctcttttctttggcatcactttgagtttgctggctgaaattataaattccaggctatttacaacagtgcgagattcaatgggattaacctacgatgtttctttcgaattaaatctttttgacaaactggatcttggttggtatgtgatcgcggtaacttcaactccgagcaaggtccataaggctgttgatgcgtgcaaaggtgttctcagaggtttacatcacaacaaaattgttgaaagggagctggatcgggcaaagaggacactgctgatgaaacatgaggcagagacaaaaacaaatgcctattggcttggtttgctagcccatctgcagtctgcatccgtgccgagaaaggatatatcctgtatcaaggaattgacgacattgtatgaaagtgccacaattgaggacttgtatcttgcatatgagcacttgaaagttgacgattcatctttatttgcctgcatcgggattgctggtgctgaatctggtgaagaagtgaacgatgatgagcctgagttggggcttcctggtatggttcccatgggaggccggggtctatctactatgaccagaccaaccacatgatttctacacattttcacgccccaactttctcaaggtatcaagtatcaacctagctcctgaagaggggatctgtattgccatgtggagactagactgatggcagtcgtttgctagcgggtaatgtccacccgctggttcattggatcaggccgatagttattcaatgcacattgcaacagaaagctttggttgttgcattttgtcagagaaacattgagttgatttggtggcaagggccttgaaatgaaaggtttacttgccaggccatgtccacatgtatagtgtgaacgatttgattcttgcaggttcctcggttgttgtaacttgtaactaggattcttcaggtcattgcagaagatataggatgacagtagagaatcaatcactcataagatattgtgtgcaacggctaagtagcacaggtcattgtaacacaataacggtgaaataataaatagcgtaggcttgtaagtttttgctaccgttgtttcttgtcacagttgtaatacttgaggtatttataatgagaaagatacgcagttttggctaaaaaaaaaaaaaaaaaaaaaaaaa

SEQ ID NO: 3347 - DNA, 494 bp, Triticum aestivum
  Clone ID: PAT_TA_3347
aaacaaaagttgccaaacactccattgctcctctctcactgtacctgttagatcctcatgcaaagcaatcaggcagcaaagtttttggtgactctcgcactaggtgacattttccagcatgaagcccttgcaagagcaagcgactccgtatctgcctgtcgtgctcttgtaagcctacttgaggaccagcccacggatgatatgacaatggttgctatttgtgcactccagagcttagtgatgcacagcagaacaaacaggcgtgctgttgcggaggctggaggcattttggttgtacaggagttgcttctgtctccaaatgtagatattgcaggacaggctgctctgctaatcaagcatcttttttcaaatcatacacttcaagaatatgtatctaatgagctcatccgttctctcactgctgccctagaaagagagctgctctctacatcatctatcaatgaagttattttgaggaccatatatgtgatatt

SEQ ID NO: 3348 - DNA, 608 bp, Triticum aestivum
  Clone ID: PAT_TA_3348
tttggcttcatggtcaccttctgtagccttatcatcggccatgggatctgtgaatttcaagattgattctggaacttcaatgtcctgcccgcacatttcaggcgtggccgctcttctcaaatcaatgcatcctaattggagcccggctgcagtaaaatcggcaatggtcacaacagccaatgtccgtgacgagtatgggggcgggagggtgtctgaagcagcgccctacaagcaggcgaatcccttcgactatggaggtggccctgtggatccaaatagggctgcacaccctggtctcgtgtacgacatgagaccatctgattacgtgcgcttcctttgctccctgggctacaacaactcagccatcgcctccatggttcagcagcacacaccctgtcaacattcgccaaaatcgcagctgaacctgaacgtcccatccattaccattcctgaactgaggggcaaactgtcggtgtcgagaacggtcaccaatgtcggcccggtcacgtccaagtacagagcccgtgtggaagcacctccaggggtgaacgtcaccgtgaacccctcgctcctgaccttcaactcgacagtcaacaggttaacattca

SEQ ID NO: 3349 - DNA, 300 bp, Triticum aestivum
  Clone ID: PAT_TA_3349
gttccttgtgatgctccgtggcccttgtgatgctaaacttgcatcactaggttactttcctgcccccctttgatgaaagggccaagaaatgaataaagtggcgttgggagcaggcgacaacgcttagcttttaactgtgtgcctgcggggccactgggggggcctagtactccacgaatgaaacgcacctgttttacaccgtctgtttggatcagtataaccatttggttgtgtttgtactactatcttaaaactgagcgtttgcttctttttacaaaccataacttctggtggccatgt

SEQ ID NO: 3350 - DNA, 505 bp, Triticum aestivum
  Clone ID: PAT_TA_3350
cggacgcgtggggaagcagagggccatgctggagaacatatgagggcgtgcgtcggcctggcgcccgagaacaacatgatcctggagtacaagtgaggagcagggcccaagctcgcggggacgagagcgaccgtacgtacgtagcaagtggcgaggggcgacgggagggcaggaggaagaagaaggcgagatcggctgtggaattatttggcggcttgtcttcggtttcctttgcgattctttctttccctggttaagtttaccccggtagtgtgtgtgtgtccttgcgagactatttcggctctctgtctggcctctgcgacttggtagcttctcatgggctccatggtgttggatgatgtggagggaggagggtgcgtgttagctaagttagtccactccctctgttcgtgttttgtaagctaattagtagtatctgtactactagtatatggaacttccaatcggttcaaaaagaaaaaaaaaaaaaaaaaaataatgaaaa

SEQ ID NO: 3351 - DNA, 1125 bp, Triticum aestivum
  Clone ID: PAT_TA_3351
actgcacgatcaacttgactgaattctgcacacagcttgttcaaaccacatttgttgtctgaataactgacagttttttctagctaccacaatactgctattatatactgtatcacacatagcataaatatcataccttataagactcttaagttcaaccctggtgtctgaatgactgactttgtataaccgacacaacgaactgttcgaacggggtgtttgtttccacttaattctgcctgccgtgagcagccagattttcagcggccttggcggcgcgggtgagagcctcggacaccatcatagctcccgcggagaagtagctgctggtcacgatggtgttcataaccttgactgctgttcttccggtggcggtggcgacagtcttggtcgtctcggtaacatggtatgtctcgtccactgatctgattgcgccaacaccagcgctgactctatccgtcaggccgagcctcctgctcagctctgcagcctttgctgccgcagacccagatagctggtgggactcgtcgaaagctctagccctggacaatgcatccttgctcagtatgtatccccttgacagcattgtcttcacgacgtcctgagccactgtcaatgcttcctgtggagtggcgtagaactggcatgaaaggtagtccctatttcgggcttaatgacacgatggagaacctcttggcgtctgtggacaagaacgaggcagagatatccccatcaacactgtatgccattgcctgtgtcatggagggcgtcccgttcatcaacgggagccctcagaacacctttgtgcctgggctgattgatcttgctattaagaacagctgcctgattggtggcgatgatttcaagagtggccagaccaagatgaaatccgtcttggtcgacttccttgttggtgctggaatcaagcccacctcaattgtcagctacaaccatcttgggaataacgacgggatgaacctatccgcaccgcagacattccgttccaaggagatctccaagagcaatgtggtggatgacatggtctcgagcaatgctatcctcaccgagccgcctcaccgcccacttccgtgccaccgcccgccatggaggacctctcctcaccgc

SEQ ID NO: 3352 - DNA, 3592 bp, Triticum aestivum
  Clone ID: PAT_TA_3352
cccacgcgcacaattcactccagcccccctaccaccgcactcgaaaacctctctctctctcactccaagagtctccaggaaagagagagagggagagatcgatcttgcgttgccaagatgttcatcgagagcttccgcgtggagagcccgaacgtgcggtacggcgcgggggagatcgagtcggagtaccgctacgacaccacggagctggtgcacgagagccacgacggcgcctccaagtgggtcgtccgccccaagtccgtcaactaccacttcaagaccaacaccaccgtccccaagctcggggtgatgctcgtggggtggggcggcaacaatggctccacactcatggctggggtcatcgccaacagggaggggatctcatgggcgacaaaggacaaggtgcagcaagccaactactttgggtccctcacccaggcctccaccatcagggtcgggagctacaacggagaggagatctatgcacccttcaagagcctcctgcccatggtaaacccagatgaccttgtgtttgggggctgggatattagcagcatgaacctggctgatgctatgaccagggccaaggtgctggacattgacctgcagaagcagctcaggccctacatggagtccatcgtgccgctccccggcatctatgacccggacttcatcgctgccaaccagggctcccgggctaacaatgtcatcaagggcacaaagaaagagcagatggagcagattatcaaagacataagggagttcaaggagaagaacaaggtggacaaggtagtggtgctttggacggcaaacactgaaaggtacagcaacgtctctgttgggcttaatgacacgatggagaacctcttggcgtctgtggacaagaacgaggcagagatatctccgtcaacactgtatgccattgcctgcgtcatggagggtgtgccattcatcaacgggagccctcagaacacctttgtgcctgggctgatcgatcttgctattaagaacaactgcctgattggtggcgatgatttcaagagtggccagaccaagatgaaatctgtcttggtggatttccttgttggtgctggaatcaagcccacctcaattgtcagctacaaccatctggggaacaacgatgggatgaacctatccgcaccgcagacattccgttccaaggagatctccaagagcaacgtggtggatgacatggtctcgagcaatgctatcctctacgagcctggggagcatcctgaccacgtcgtcgtgatcaagtatgtgccatacgttggagacagcaagagggccatggacgagtacacctcggagatcttcatggggggcaagagcaccatcgtgctgcacaacacctgcgaggactcgctcctcgccgcacccatcatccttgacctggtgctcctggccgagctcagcaccaggattcagctgaaagccgagggagaggacaagttcccctcccgtccggctccccccctccgctgccaccccactcgaaaacctctctcttcctccctccccctagcctccacgcaaagagacctcgctctacatcgttgctacactgtccagctgttcatagagaggattagattctgcacacagcttgttccaaaccgacatgtgttgtctggatgactgaccgttttttctagctaccgacgatactgttattatataactgtatcataacatagcacgataaactatcatacgttaacggcacttctttaagttcaaccctcggccgtctggaataagctagacttttggtataaccgacacaacgaaacttgttccgaacggggtgtttatttcgacttaatgctgcctagccgttgagcagccagatttccaggcggccttggccggcgcgggtgagacgcctaagcagaaccatccataggctgcccgcaggagaagtagcctggactggtacacgatggtgttcagaatccttgcaactgtctagttacttgccacgtggacgggtggcgacggatcttggtccgtcttccggtaacagtgggtatgtcctcatccatctggatcctgctggcgccaacaccagcactgactctgtcggtcaggccgagcctccggctcagctccgcagcctttgctgccgcagacccagatagctggtgggactcgtcgaaagctctagccctggacaatgcgtccttgctcagtatgtatccccttgacagcattgtcttcacgacgtcctgagccactgtcaatgcttcctgtggagtggcgttgaactggcatgattggtagtccctatattcaatttcctcctccacctgccaagttggcctgtcccagaaattacaaggctcatcaggctgtccccaaccgagatatgcacaccggcctgggtccacaatggtagccccactcagcaatactgcagtttccaaggcatagggttccttgaaagtcacataagcagttgaaccatatcctcctgatttgatgaggtctactatgcgacaataggtccagagaatgagaagaactcatggagatcattctcagatgcgctgcttgaccaggttagtgacttgcactgtgtaccttgttccccacgttattcgtaacctaccgtctccccctgcctgccgcagcgcccagagctataagcaccgcatcaccctacccctcctcctcgatctccgctcgcaacagctatccaagggatcattcttgagcactgcgttcgtgaacaaggctgtgccatacgatggccgccagcacgagggcaagggacggccacaccttggagacctcaagaggcggctagacgaccacagtgcgccgatactcctgggaggatagggtaccctcgtgacggatcactcctgcgatggttctctccgcccagctccgaacatcctttccccggtggtcctggccgagcgacgagctcgactccttccagccggtcgccgcaaacctgagctacctcacctacgcaccgcttgttcctcttctcaccccggtcagtgaacgccctcccgaatccgcgggccacgctggagaacgtcatccgggggtgcgtcggcggggcgcccgagagcaaaatgatcggggaggccaagggcggagcagggagaacaccatgagggaggagaacgaccgtgcgtccggggccaaggtcgcggggccgcgggaggccggacggatgtagaaggtggcgggggccgacgggagggcaggaggaagaagaaggcgagatcggctgtgcaattatttggcggcttgtctttagtttcctttgcgatttctttccctcgtttaggtttaccctgtagtgtgtgtgtgtgtccttgcgagactatttcggctctctgtctggtctctgcgacttggtagcttctcatgggctccatggtgttggatgatgtggagggaggagggttcgtgttagctaagttagtccactccctctgttcgtgttttgtaagttaattagtagtatgtgtgctactagtatatggaactttaaatcggttcacaggcgacttaaaatcggtgcacttgccaaaaaaaaaaaagagagaag

SEQ ID NO: 3353 - DNA, 754 bp, Triticum aestivum
  Clone ID: PAT_TA_3353
ccaggttgaggggagcagtgacgaccctgtccctgatgatggtgtagagtatgatacctcggttcagagctctagggataatgttcatctttatgatttccatattgtctacagcttttcttacaaagttccggtgctatactttcgaggtcttcagtctggtgggcagcttctaactttagatgagataaaaaaggatcttccttctcattcgcttcagctgttaaatgaatcaaagtggacatttattactcgagaggagcatccccacctaagtaggccatggttcaccctgcatccatgtggaaccagtgactggatgaagttgcttcttcataaaccgggagataaggatcgatctctgcaatacttgtcagcatggttatctgtggccggtcaggcagtaggattgaaaatcccacttaagctttattgcagttcataggttcactcttctccagtatgtagtatgtactattttggtgagtaaaatgggaagtgtccacctcttattttgctttgtatatgttcaaacattctcttggtaatttgaccattttgcagtgcaataactaattttattgcatatgcacgaatggcgcagttgcacatactgcagcatagttgcagctttaacatgatgatttgtccttgggcatgtaattgattattattcttacatcctttcgtttcccagatttgtttaaagctacttgcttgaaagaatcaaaaaaaaaaaaaaaaaaaaaaaaaa

SEQ ID NO: 3354 - DNA, 706 bp, Triticum aestivum
  Clone ID: PAT_TA_3354
aaagctgtcagacagcttatcagcatgataagcagtgataatcgtcacgtggttgagcaagcatgccttgctctttcgtcactagcgtcagatatttcatcagcaatgcagctgacgacccgcgcgtccgtgaagcctatagaagctgtactgaaatcatttgatgatgaagaattaatatcagtgttgcaagtcgtggtcacgttaacttttgtttctgatcacgttgctcaaaagatgttgagaaaagatgtgctcaagtcactgaaagcactttgtgcacacaagaactctgaggtgcaacgcttatctctatttgcagttggcaatttggctttctgcttggagactcgtcgcaccctcattcactctgagagcttacgtgacctcttaattcgctctactttttcacaagagaagcgtgtcagcaaggcagctgctcgtgctctcgcaattctaggggagaacgagaacttgcgtcgcgcaataagagggagaccagttgcaaagaagggtctgcgcattctttcaatggatggtggtggcatgaagggccttgcaactgtccaaatgctaaaacagatagagcaaggaactgggaagcacatacatgaaatgtttgacctcatatgtggtacatcaacaggtggcatgcttgcgatggctcttggaatcaagcagatgagtttggatcagtgtgaagaga

SEQ ID NO: 3355 - DNA, 522 bp, Triticum aestivum
  unsure (1)..(522): unsure at all n locations
  Clone ID: PAT_TA_3355
tcgccgcctctcgttccagcgcgatacagcgggggcgctcggcgaggcgaggccgcggcgggggatggcgaaggccggcgggggcctgatctgggcgacggcggaggacctggcgcggaaccggccggtggtgctgtccatgtaccggcagatcctgcgggcgctcaactcgccggcgctgccgctgggccacgcggcgcggctggccaagaaggccgagtgccgcgccatcttcatcttcggcgcccgaggagaggtcgctgcacaacatccaggacctcctcgacgccgcgcgccacaccctcggcctcctcaaccgcggccgcctcccctagaggggaaggaaggcgcctagccctaacctcctcgcgggtacctcgtctcttccctgtttactttagcctatgctcaagtcgattgtaatgtatacggcattaatctggtgccattttgttcaattgaaacaatctgctgcctattcgctaatctatgtatgcactgcaantcataancatgttgcga

SEQ ID NO: 3356 - DNA, 1129 bp, Triticum aestivum
  Clone ID: PAT_TA_3356
cccacgcgtcccacactccccactctcccacgccacgccgactagcctcctccgttcccctcctctcttcttgcttgctcggacctcggcgagagagcgagagcgaaagctcccttctgctgctgcaatggcggttcctctggtgctcgtgctcttggtcgccatgttcaccggctcagatgcgatgtactgcgtgtgcaagtcggacgcgaacccggcggcgatgcagaaggccatcgactacgcgtgcggcaagggcgccgactgcacccagatcacctccagcgggccctgcttccagccctcctccgtcgtcgcccactgctcctacgcctgcaacagctactaccagaagaacgccggcatgggcgccacctgcgacttcatgggcgtcgccaccctcgtcgccgccgaccccagcgccggatcctgcaagtaccccgccagcgctagcggcgtaggcaccggagcaggcaccggcggcatgggcaccggcggcacagggatgggcaccggcggcatgggcaccggcacaggcagcaccgggacaggcacgggcgtcagcaccggcggcatggggagcatgaccccgccgggcgcgaccagcaccgggatgccggggagccccttcggcggcggcgcgtacggcccgtcgggcatgaaccaggactacaacgcagccgccgtcggtcgccgcgtggcctccgccgggctcctcgtggcggcagccgcgccgctcctcctccacctcatctgatgcggtggtgaccactggctggccgcgcgtcggcaatgcgggtgcggcgccggattcggtgggcgccccgccgcttttgtgcccgctcgctcgcctgcatttccggcgtcgttttgatggttcgatcggacgtactggtagcgtagtgtgtgtgtgtctgtccatgagtactagcactcttattaagctgaccaccccatgtggtgtctgtaccggtgcgggtcgtggtagagttgatgagatctggtaggggattctttcttccttctcgtagcggtgacggtgttccgagacatataattatgtgttgtcgttccaacctcgtctgtttgcatgccgcttttgtgctgctagctcatgatccccgcgtct

SEQ ID NO: 3357 - DNA, 1186 bp, Triticum aestivum
  Clone ID: PAT_TA_3357
cgtccgcccacgcggccgcccactcgcccacgcccactgccacgccgactagcttcctccgttcccctcctttgcttgcccggacctcggcgaggcgtcggcgagagagctcgacctcaagctcccttccgctgctgcaatggcggcccctctggtgctcatcctcttggtcgccatgttcaccggctcagatgcgatgtactgcgtgtgcaagtcggacgcgaacccggtggcgatgcagaaggccatcgactacgcgtgcggcaagggcgccgactgcacccagatcacctccagcgggccctgcttccagccctcctccgtcgtcgcccactgctcctacgcctgcaacagctactaccagaagaacgccggcatgggcgccacctgcgacttcatgggcgtcgccaccctcaccggcgccgaccccagcgccggatcctgcaagtaccccgccagcgcaagcggcgtaggcaccggagcaggcaccggcggcatgggaaccggcggcacagggacaggtaccggcggcatgggaaccggtacaggaaccagcaccggagcgggcacgggcgtcggcaccggcaccagcaccggcggcatggggagcatgaccccgccgggcgcgaccagcaccgggatgccgggaagccccttcggcggcggcgcgtacggcccatccatgaaccaggactacagcgcagccgttggtcggtccgccgcgtggccgccgcggggcctcctctttggcggcagccgcagccgctcctcctccagtgccggtgatgccgctggggggccactggtgggcgggcggaaaggcgcgtctgcgatcccggccggtccgatgcatttccggcgtcgctttgatggttcgatcggacgtactggtagcgtagtgtgtgtgtgtctgtccatgagtactagcactcttattaagctgaccaccccatgtggtgtctgtaccggtgcgggtcgtggtagagttgatgagatctggtaggggattctttcttccttctcgtagcgctgacggtgttccgagacatataattatgtgttgtcgttcttcttccttctcgtagcggtgacggtgttccgagacatataattatgtgttgtcgttccaacctcgtctgtttcaaaaacgcttttgtgctgctagctcaaaaaaaaaaaaaaaaaa

SEQ ID NO: 3358 - DNA, 400 bp, Triticum aestivum
  Clone ID: PAT_TA_3358
aggctataatgggtgctggggatctgaatattcaaacagaagatggaaatattggcatgccaagtaatgtctgttgtgtcattgtggagtacctttctggatgtgcattgaaaataattctgataaagaacaggagaaagaagttatcttgtaaagttgtggtccagatatctgttgaccttgccagagggaatggccctcctatgccctgctcctctcgcattggcgcaaagtcgcctcctcccccacctccgtctccatgtgtgcaacaacgaccccgggaggagctcgagccgcagcgatggtccatggtgccgtcaccgtcatctttggcaagagaagcgtgggctgcagagacggccggattcgtccgaccctcgcgctgccgtccgtccaccct

SEQ ID NO: 3359 - DNA, 620 bp, Triticum aestivum
  Clone ID: PAT_TA_3359
aggaattcggcacgaggctcaaagcaacgagcgagccagcactttctgctcagatcacccgatgggttccaggtcctgctcctacgtcttcttgctcggcctttgctccctgctgctagtggtgctttcaggccagcgcacgctagctcgagacactcccgtgtccacagcaacggccttggctccatttgttcatgcgcctgccaagggcgacgccggcggccaccgtgctgatgtggataagcctcgagtatcggatgagaagccaacaataaccggaataatctggaggcccgtgcctaagatccactgcccgtccatcttttgcggtaccaaggctgccactgccactgcccctgcggcaacggcacatccatgacaagaagaagatagagtggtggttcgcaatgtaatcatatgcatgttttcctaccctggttttagtaatttagatatatatgtatgtgttccacgagtgttgcagcgtgcctgcaaaggcctctcgatggatactagtagtgctatggtagcacggtcgggttgtagtttcattcattgtatctgtcgatcatgcaattggttgctgtctctcggtccttttttggttgttaaaaaaaaaa

SEQ ID NO: 3360 - DNA, 509 bp, Triticum aestivum
  unsure (1)..(509): unsure at all n locations
  Clone ID: PAT_TA_3360
tggcgcgacgtcgcgcagtcccacgacgccgccgccagcgtgctccgcgccgacctgcagcgggtgctcgacgcgcaggcggtccgcggcggcggagacggccaggaccaggacgacgccgagtcgtgctgctggggggagaaccaggcgcccgtctgcgcggaggaggaggaggccgaggtgggcacgccggccccgacgggagtcggaaggtgcaaggggtgcggcgacggcgcggtcgtcgtgctgctgctgccgtgccggcacctctgcgtgtgcgcgccntgcgcggcctcggcgcangcgtgcccgtcgtgcggatgcgccaagaacggcagcgtctgcntcaacttttcgtgatgatgccgggggaatagttttagagtatgctcgacttttctttcttagctttattttcttcatctttcttttttgttccccttcttttgttcaatttaactttttgctnaaactgttggatcagttgttcaacacnaccaaanaaacag

SEQ ID NO: 3361 - DNA, 724 bp, Triticum aestivum
  unsure (1)..(724): unsure at all n locations
  Clone ID: PAT_TA_3361
ccacgcgtccgaatttgatcatttggnnnaaacttatacagctcaccttcattccattagtcagatattgccctcgagaacgttgggatgaatgggtgctgttgttgttggaatatttatttttctactgtgaagatatctttcgttatgcgtggctcagtcttatacacgagggccgagctaaagtaccagctttctttggtgatctatatggaccagaagaaaaactcaagaaatcagtagcgccgcttctgattaagttcactcgttctgtatcttctttgctcaaggtcttagcatcagaagaacttaatagcggccttccggatttgaattgtccaaagtctgacttgaaatccatatcttccagctctcttatggggtatcttttacttcacaattgctttgggaggtttagtatgtacttgtttgggtgtttggtggattatcaatcagctaaggaagcactacccttttttcatgcattgatccgccttgccgttgctactgatgatgagagactaaaacagtttattctgaatgaaatgcttccaactcttgtccggtttgatgataggaggcccccaagtggaatctcacggttaaaatcggagtcaaattcaggcatagaagtgagttctatgaaggatattgtttgcctttgtcaggaaatatacaacgtttacttacaaaatcaggttactatgacgaatggcgaaatggc

SEQ ID NO: 3362 - DNA, 774 bp, Triticum aestivum
  unsure (1)..(774): unsure at all n locations
  Clone ID: PAT_TA_3362
gcacgaggcaacgacccttgaaactaaagtagccatgggtagtactggtagcccctcggtagccgctctaccaacaagcggcctgctacccccgatacgcacgccaaggtcagcgccggccgaatggaagacggacgacgattccgcggtggcggcagcggaggaggagccagtgacccctagtgcaagactcttcgaagctatatacatcgtggttatggtcggccttggctcgcccgtcaacctagccatcttcagcgccggcatcgcagcccaacttgctcgttacccacgcttccgtagcattcaagtgacagacgggtgcaagagcccgcggtgggcgtgcacggaggtgaacgtcgacgaccacatgatcgtcccgacgctggaccccgccgccgtggaggctgacccggaccgggccgtggaggactacgtggcctcgctgcaggcactccccatggattgctcccgcccgctctgggagttccacttcctcgacttcccgacctcagaggcncacctccaccgtggtgttccgcgtccaccactccctcggtgacgggatgtcgctgatcacgctcctcctggcgtctgcccgcagcgccgcggacccgacacgcctgccggccatgccggagcagccggcgcgcacgggcgccatctacgagccgcggcaccggcagccgctgccctcgggcgccctggcggcgttcgtcgcatgggtttggccgtatcttgcgcttgcatggaacaccgtggtggacgtcatct

SEQ ID NO: 3363 - DNA, 551 bp, Triticum aestivum
  unsure (1)..(551): unsure at all n locations
  Clone ID: PAT_TA_3363
ccactccatgaaccacagcgtttcggcgcctgaggcggcggtggtgcccgacgcggcggtggcgccggtggtgagccgggggagggagcgggaggcgcggctgatgcggtacagggagaagcgcaagagccggcggttcgagaagaccatccggtacgcgtcccgcaaggcgtacgccgagacgcggccccgcgtcaagggccggttcgccaagcgcacgggcacggcggacgccgacggcctggaggagcacgaggagatgtactcctcagccgcggccgccgtcgccgcgctcatggcgccaggccccgaccacgactacggcgttgacggcgtggtgccgaccttggtgtgatcgatcggtcgccggcgcgcccttccgggctgtaattttgttgcatgcatgcatgcacgcacagcttcctctagcatttgatcaaccaattgtatatgcatgattacccggagcgatcagactccgatcaacccctgtacatatatatatcatcacagctggtatctgatcacctatcacttaaanaaaaanaaan

SEQ ID NO: 3364 - DNA, 1665 bp, Triticum aestivum
  Clone ID: PAT_TA_3364
gccccacggctctttcacccccagaaaccttcagcaagaacggcagcggcgcgcgcgctcacaggacttctccaggcgccgtcctcctccgcggccaagtgccgtccgacggcgacgagccggggagcggcacgagccgtgttcgccgtccgcgcctcggcggcttcggcggccatccaggacgccgtgctcatgcgcttgcgtgaggaccggcccctcaagggcatttcggggctgcagcgccgccacagggccagtgtggcgtctgtcggccccgctgcggctctgcgccgggtcgccccacgtcggggtatggctgtgagcggggtggccatacggccggggcgccggcacgctgacctcccgacatcgcgggtgttctgctgttgcatcccccccgaacatcccttcctggacggcggccgccagcccgacacctagacgcacgtgagcccccatgcttcggatggccccactcctcggcctagccgtacgtggactcgatagggcagccagcgggtcaagtgccccttgcccgccgtcccccccgcctcgttcacactgccccgcccccaccgcgactgcggcgtgcgtagacgtggggaccgcctggcggagatcgccggcgcactcggcgcggcatgcggggcggtgagtttgtttcatgcgtgcccgcgcgtactgcaacggctagaacttggtcaccaaccactggcaccttcaccattacgcgcacgcgaccggcactgcccgcgccagtgcccacttcagttaccgcaacaaaggcagttacgggcaggccgcccagcatgcggtggggtcgttgccttctccgcgctcaagcaggtccgtcgtgatcgggcaccggatggtgagcgcatggcaaggggcggtggggttcgggggctacggtaggaaggtggcctgcagggcctgtgcaaaaattcaccattaagtattactattccacgcgggcgcgacccgactttcatgcggcgcagacgcggtgaagtcggaaaggattgaggcgattgcgtcccaggaggtttgctcgtttcctctagcctagcctaagacccaattcagaggacatggacggacgcagctaagttaaccaagtcgttgcatgctttccattttactaatttactatattacttccattgcactgttctgggctcgcgtgatggcaaataaggctagggcaatgtaacgtgtttgctggaacagcttagttctagtttcggatccacaggatactgatctccaagggaggtgctacccatgttgatatagcatgtgaccaggacttggtaaagcttgcgctggagcttactaaccttccgatatgtgtatcgtctgtggatccttcagcattccaatctgcggtagaggctggcgcgcaaatgattgagattggaaactacgactccttttacgacgcaggcatcgaattctcttctgagcaaatactgaacctgacaagggagacaaggaagatgcttccagacatcacgttgtcagtaacagttcctcacactctgagcctcccagatcagatgagacttgcagagctacttgaagaggaaggtgccgatatcatccagactgaaggagggaagtgttctagtccgacaaagcctgcggtgcttggcctaattgaaa

SEQ ID NO: 3365 - DNA, 370 bp, Triticum aestivum
  Clone ID: PAT_TA_3365
ggaagcccaggccaaatccaaagcgacaacagaaaagctcgagctcttgcttgggtggtcgagcgagcagaccccgatcccagcagtagcaccaggaggaggaagatgtcgtcggtgttcagcggcgatgagaccgcccccttcttcggctttctcggcgccgccgcggcactcgtcttctcatgtatgggggcggcctacgggacggccaagagcggcgtcggcgtggcgtccatgggagtcatgcgcccggagctcgtcatgaagtccatcgtgcccgttgtcatggctggagtgctcggtatctacgggcttattatcgccgtcatcatcagtaccgggatcaaccccaaggccaagccctactacc

SEQ ID NO: 3366 - DNA, 609 bp, Triticum aestivum
  unsure (1)..(609): unsure at all n locations
  Clone ID: PAT_TA_3366
acctaccgccgaatcgcctcctctgcgccgctgcgctcccccctctggtggccccgccaagcgccatccctctttgccgcccgcgccatgtcagggtccgccggtagccccccgtacgccgccgagcttgcagccgccaagaaggccgtcgcccttgccgcccgcctatgccagactgtacaacaggaaattctgcaatcagatattcagtccaaggcggataaaagtcctgtgacagtagctgactatggatctcaagtattggtaagtctcgtgttaaatatggaagtaacttctggttcattttctatggtggccgaagaggactcagaagacttgagaaaggatagtgctgaagaaattctggaacatattactgatcttgtaaatgaaactctcgctgaggatggttcatacaacattactttatctaaggaaggtatcctctctgcaattgatactgggaagtctgaaggaggtccatctggccgacattgggttctggatccaattgggtttcttgagaggaggccaatatgcaatcccactggcactgcttgatgaggagcaaagtgttttngggcgtgttggggatgaccaaatcttact

SEQ ID NO: 3367 - DNA, 700 bp, Triticum aestivum
  unsure (1)..(700): unsure at all n locations
  Clone ID: PAT_TA_3367
cntantgaagcatgttacatganccgacttctgtntgcgccggccccggggcgcggctcttcccggttgtctggccgatgcggtcgctgcgcgcgtcatccacgacagacggcaaggctgcacgtccccttcccaagctcacgctcttccgccagttctacgtcgttgtgattggatacttgtacttcacaaggatcattgtctacgcgctcaagacaatcaccaactacaagtacagatgggtgagtgtcgcggcagaggaggtggccaccatggcattctacatgttcatgttctacatgttcaagccggctgagaggaaccagtactttgctctggatgacgatgaggaggaggctgcggagatggctctccgtgaggaggagttcgagctctagagtgttgctgcgaggggatacaggatacatgatgacaggaaatgcagccctacctgttcaatttctcctccttgtgatgttgatcatactatacagatgcaggatttaacttatatttgtctatgtactgtggtaaatcttcacttctgcttatttcttttagcttcaaatgttgccggtgagaccaggggtaatttggattgcttgtgttgcaaactaggcgaattcaatcactgctgtcattttgccaaagcctaaagttgcggcgtccccacccaatatagtcccttgattccccttnn

SEQ ID NO: 3368 - DNA, 2068 bp, Triticum aestivum
  Clone ID: PAT_TA_3368
cgccgtccgccggccgattcgactcctcccgcgaagcgccgtccatcttcgccgcccgtgccatgtcgcgccccgccggcaatccctcgtacgccgccgagctcggcgcggccaagaaggccgtcgccctcgccgcccgtctatgccagacggtgcagcgggaaatcgtgcagtcagacattcaatctaaggcggacaagactcctgtgaccgtagctgattatggatctcaagtattggtaagtcttgtgttaaataaggaaataacttctggctccttttctatggtggccgaggaggactcagaagacttgagaaaggatggcgctgaggaaattctggagcgcattactgatcttgtaaacaaaactctcgccgaggatggttcatacaacatttcattatccaaggaagctatcctctctgcaattgataccgggaagtccgagggaggtccatctggccgacattgggttctggatccaattgatgggactaaaggtttcgtgagaggaggccaatatgcaatcgcactggcactgcttgatgagggcaaagttgttttgggcgtgctgggatgtccaaatcttcctttgacatcaataagcaacctcaatggtagctcatcaggagatcaaacaggggccctcttttcagctacaattggttgtggtgctgaagtacagtcattagagggctctccaccacaaaagattagtgtttgtaccattgacaatccagccaatgcctcgttctttgaatcctatgaaggagcacacacgatgcatgattttactggctctgtagcggagaaacttggtgtccaagctcctccagtcagaatagatagccaagcaaaatatggtgctctggcccgtggcgatggtgccatttactggcgttttccacacgagggttacagggaaacgatatgggatcatgcagccggctcaattgtcgtcacagaagctggaggtgtagttaaagatgcctcaggaaacgatctcgatttctcgaaaggcagatttcttgatcgtgacacaggcatcattgctacaaataagcagttgatgccatcactgctgaagtctgtccaggaggccatcaaggagaaaagccaggccccttccccattgtagaagcttttttggtttgaaccttccctgttgtagttggattgatccaaaacaatgatcgcaatgccacaccttattcacactgtttatgtgtaaatgacctttttgttgggacaaatgcaatccttgttgtatcacatttgtacatctaaggagtggtgacagccatgtcttaaataaaagaggcatctgcctgcagttatcgcggccctagacccccaacgtctggccaatacgcgcacctccacgacccggccccctccccccctccccccaaccagatctcgccgcgatggcgcccgccgatgccgcgcgccgcctgctcctcctcctcgcggtggccggggccgtcctccgcccggccgcggcggagatcaagcaggagtccttcaaggacgactcccgcgggaccatcctcttcgagaagttcggcttctcgcaccgcgggtccgtctccatcgcgctcaccggcgccaaggccgtctccaagctcgccaagccggaccccgcgcagcttggcttcttcctcctctccgacgaggccctcttcgaggccatctacgagcagccgccgcccacggatctgaaccccaaccccgaccccaacacgggctgcgtcctcgccagccgctacgtcatcccgctcttcaccttcgccgacctcgacgccagcggcaactacaacaagaccttccccgtctcccaccccgacgagtacagcctcttcttcgccaactgcgcgcccgagaccgccgtcaccatggaggtacgcaccgacatgtacaacaccaaccccgacggcaccaaggactacctctccgtcggccaggcccccgtcccgacgatctacgccttcttcgcgctcggctacgtcgccttcctggccggctggctctacctcaccctctaccacaaccgcctctcggcgcacc

SEQ ID NO: 3369 - DNA, 1445 bp, Triticum aestivum
  Clone ID: PAT_TA_3369
gccggccggttcgggttggatcatctattttccaacgccccggacgcgatcgtggaagcccaaaccaaatcccaaagcgacaacagaaaagctcgagctcttgcttgggtggacgagcgagcagaccccgatcccagcctccaccacacgcaaactggggagaccctctgttcctctccctaccaaccagcttccttagcgacgaggccacccaggagctccacaggcaaagaagcgcgacccggcagcaaaggaggagcaagaagagcaagatgtcgtcggtgttcaggcggcgatgagaccgcgccccttcttcggcttcctcggcgccgccgccgccctcgtcttctcatgcatgggggccggacctacgggacggccaagagcggcgtcggggtggccgtccatgggacgtcatgcgggccggagctcgtcatgaagtccatccgtgcccggtcgtcatggcggggagtggctcggaatctagcgggcctcagccatcatcccgtcatcatcagcacccgggaactgcaaaccccaaggccaaggccctacttcccttcttcagtatcggctagcgctcacctcctcatccggggctcgccgtgtgtggccttcgcggggcctccgcctgccgggcatggcacattcggcattgtcggtggatgctgggtagtcatgggctaatgcgcaacaaccaaagctgttccagtgggcatgatccttatcctcattttggcgcagaagcaccttgccctttacggtctcagtctgtcggcatcatcctctccgtcccggtgccctggccagttccccgtgacggattagggcgcctcctgctctacccattctgcaatttgccacacaggctaacattcttggagaagcttatcgaattgatgacttctgaatttttgatgtattaaggagatatttgtagatttttaaggaaggtgacacttcacagtaccgtttccattctttttgggttgtggtgggcgtttgctgtttcgttgcagaggattttggggtaggctggattgctgctccctgggtaattatgggttttaatcctacttggtggtgaataaaaacacggattgtagctaaataataaatttatgattatattatattctacagtttcatgatgtagcctgctagtcgtgccctcttgttttatattattcagacagcaaactgagctctagaggttatcatgtctagttttcattcttctgtttggtggagaaaaaaacatctgtagccaagggagctttgcccttgatgtaccattctttttccgtcaggatgctgggtgggggttgatgcttatttatgcacagttatttaccttttgggtctggctggacggtgtaatctggtgaataagcgagaacttgcaatgcaattgagttttgtccaaacaaaaaaaaacccccccc

SEQ ID NO: 3370 - DNA, 2088 bp, Triticum aestivum
  Clone ID: PAT_TA_3370
gtcgacccacgcgtccggaaaaacagcgagacggagataaggtttgggccagcccacccagctacaagaattcggcccgagcccccaccaagctcacagctcgcctctcctccctaccctacctcgccggcgtcgccaccccccgccgcccccatgctccacccagtgcaccgcctccctgccaccccttcccgcccggccgtccacccgcacgtatcccccgcgccgccctcccttcgtctccggcgagtggccgggacgaggccgacgacgcctgtggtatgctgctccggtttcgtgggttcgctgcctgtagcgaatcaggggagcgaattcgaacctcgatccagatcgatctatgggggtcggggttccgtggccatcgatccgagattcatggcatcgaaaaatagtaccagaggcagaggtaaacacctagcatcacctagtgctagcttaaatcatgcaccatcaccaagatttcgccatcggaggggttcacggtttatcgttcgagctgaatcagatttctattccgtacttggcgtgtcgagaaatgctagtaaatctgaaatcaagagtgcctatcggaaacttgctcggagctatcaccctgacgtgaacaaagagcctggcgctgaacaaaagtttaaggatatcagcaatgcttatgaggttttgtctgatgatgagaagcgagcgatctatgataaatatggagaagctggtctgaagggttctggcatgggaacgggagattactcaaacccatttgatctctttgagtcactattcgaaggatttggtggaatgggtggaatgggcgggggccgtgctgctcgtaacaggccaatgcagggtgatgacgagagctacaatctggttctcaacttcaaggaagcagtgtttggtgtagagaaagagattgagataactaggctggaaggctgtaatacttgcgacggaagtggcgccaagcctggcacaaagccaaccacgtgtaaaacttgtggtggtcagggccaggtggtctcctccacaagaacaccacttggaatattccagcaggtatccacatgcaatacttgcggtggcactggtgaattctccaccccttgcaaaacctgtgggggcgatggccgtgtgcgcaagacaaagaggatcagtctgaaggttcccgcaggagtggattctggaagcaggttgagggtccgttctgagggtaatgctggtcggagaggaggcccgccaggagacctttatgtctttattgatgttctctcggattcagttcttaaacagagatgggacaaacattctctacacatgcaaggtttcctatattgatgcaattcttgggacaactgtcaaggtccccactgttgatggggtggttgacctgaaaatccccccggggacccagccgggtacaactctggtgatgtccaagaaaggtgttccacttcttggtaaatcaaatgctcgcggagaccagctggtgcgtgtccaggttgagattccaaagcgtctaagcagcgacgagagaaagctgatcgaagagcttgcaaacctcaacaaggctgagccggcaaacagtaggagatgataactgaatcaggcttggttggtttggtgcttgtgcgataggcaattttgatgcaaattgcagcgacaaagtgacagttggagttgttactgtaggaactctgctcattctgcacgcagtgtcatggaggaaaactgttgagagataaagccatgtctgtatcttcattttaagcttacagaaaggtaggtcaccgcaaatcaccaaatggatggtgaactttttgcaatagcctgtcgtatgctttagccaagcttattagcctatttttgatgacatatgattcttgtatctttgaaagtattaggggcattattactgcgcaaaggttttcaatatttgttgcagaagtgctgcaacattttatgagcattttgtaagctgtaacacgaacatgtggcattttggtggcactgcggattcggattccattaagtagtcctttgcagctaaaaacgagctatacagccccccggcgtcgt

SEQ ID NO: 3371 - DNA, 769 bp, Triticum aestivum
  unsure (1)..(769): unsure at all n locations
  Clone ID: PAT_TA_3371
tagcgtggtcgcggccgaggtacgtcgacgacgacatcggagacggcttctcgttcagcggggggaagtatgcggaagccgaaggcccgagtaagtcggacgagtggttcgctcagggcagaatggtgaaagctcatgcattatatgggaacaaagaaaaggcaaaagatcccttttttgggctcaccatgggttcaggatcacaatcttccggtgatgttttcaattggttttgtgcggaagcggggagctcttctaatcctacggtccttctaattcatgggtttccatctcaggcatactcttaccgaaatgtgctacctgtaccggagttctgcgacccctccggtccttctaatccatgggtttccatctcaaggcatactcttaccgaaatgtgctacctgtactatcagacaagtatcgttccattgcttttgactggcttggttttgggattctcaagacaagcctcaacctaaatatggttttgactatactctggatgaatatacttcaaccctgggaatcgttaatcgatgctgttgctcctggataagctctccaatgttgtcaagggtacttcgctccaaattgtagcaaatatgctaacgacacaagacaagttgacaacttatacnggtaaccacgtaatgcaacatgaagtcaccacctgatgttagactctgtggcaatattccagtcctaaactaggnaagctgcagaaggcanatataagngaatnacgntnaaggaactgcaagganng

SEQ ID NO: 3372 - DNA, 1425 bp, Triticum aestivum
  Clone ID: PAT_TA_3372
tctccatatgtaggctgtttagttatgaggagctgaaacttgctacatcaaacttctcaccagatatgttgattgggaagggaggaactagccacgtttacaaggcacagttatatgatggcaccttgtatgctgcaaagattctgaaaccttcagttgatgcacttcaggagtttattacggagattgagactgtaaccaacttgcaaaatgagaatattgtctcactaaggggattcagctttgacatcgcctgcccgcggccggggtacgattacatgcaccagggaagcttagacaaagcgcttcatggcaagtgtgagtatagccttagctgggaaaagagaaataagatagcaattcacattgcaaaggcgcttgaatttctgcatcatggtggtgtcaccgagtctgtgattcacggagatgttaaatctgcaaacatcctcctctcagaggattttgaggcccagctgtgtgattttgggttggcaaagaaagtttcagcttcaacccctcacctaacatgcactgacatcacaggaacttttgggtacatggcacctgaatatttttcgcacgggaaggtgaacaagaaaatcgatgtgtacgcttttggggttgtgctgctggagataatttcagggagaaaacccattataacaggatgtgcgaagggccaggaaagcctggttggatgggcaaggccactactttcaagtggggagatcaagcagctggtggattcggctctgggcaacgactactgactgtgacgagatggagaggatgacgctcgccgcctcgctgtgcacgaggacgtcttctgattccagacctgaaatgccgctagtgctgaagctgctggagggggacgatgagacagtccaatgggcgaggtcgcagatgtgcgcaggctccgacgtgccggacgaggaggcgatgaccccggcgctccaaacatgcagtcccacctgaacctggcgctgctgggcgtggatgaggaggaggacacgctgtcgcggtgcagcacggagcggaccgccgacacctcggcggacggcgggtactggagccggtcctcgagcttcgactaggcgatccagccagccgtctgtggtctctgtacagttcctgacgattggttgtggcatctggactggggagattctttggtgggtgcttggcttggcttgctcatgtaggaaggattcttgagtgggtgcttggcttgggttgctctgctcgtgtgtgtgtgcaaggcgagagatgtctgatgctgttgttgatgctaattgaattgaattaggagttgcttttgtagttttgtagtagcagttgtagatctatctaacctttgctggccttgggtgcaacattctacgattatgaggaatgaatgtaggtttcatggtgcatcaggat

SEQ ID NO: 3373 - DNA, 1062 bp, Triticum aestivum
  unsure (1)..(1062): unsure at all n locations
  Clone ID: PAT_TA_3373
cgcaaggncgagccacanagagccgcaccgaaattgcgtcccgtcgtgcaaagggagcggggggttgggagcgggacaaatctccctcgtcaccacctccaccaccaccgtccaccgccacccccctctcgccccctccagtctcgcccctcgcgtgggagggacgccgtgtcctcctgcccccaccgcgccgcgaggggaaaccctagcggctgcagatctccgggcaggcgccccgatccgggcggcccgcgctccgattcggccctcccggcgcctcaaatggcggcggacggggcggacagcgaccttgaggagcaactcaaggatgtcggcgcccgcctgcaggaggcgcccgacgactccgacggcctgctcaagctcctctaacgatgtcgagaaatatctgttgagagtgggagcaatcacctgcaagcaaagcacattttgctgctgttcgcccagcaatggatgccctgatcaagaatgaacttttgactcaccctaacgccgaggtcaaacttgctatagcatcttgtatatctgaggttacaagaatcactgcacccgaggctccgtatgatgacaatattatgagggatttgttttccataattgtggggacttttcagaatttagatgatatcgagagcccgtcctttgcgaggaggatttcaattcttgagactgtggcaaaggtccggtcgtgcgtggtcatgttagaccttgagttggatgatctgattctgcagatgtttaaccattttttcacaactgtgacatcaaaccaaccagaaattgtcatatcatctatggtaacaacaatgaaacttgtaatagatgagagtgaagaaatacagacagcgcttgcatcgtatcttcttcaaaaggctagaaatgaggagagggaaacgtctccagcatcttttgaacttgcagagaaggtgatcagctcatgtgaagatgggaagctaaaaccaatattcctgcagttacttcaagttcaaggcaatcccttggatgaatacagcaaaattgtcacgctggtttgtgaaggtgata

SEQ ID NO: 3374 - DNA, 542 bp, Triticum aestivum
  Clone ID: PAT_TA_3374
cagccctcgaggggggactcaagcatttggaggaaacgaagccgccgccgccgccgccgctcactcaacgcgtcgccgcccaactcctcctcaagacgctgccgcccgccgcctcgacgccggtgtacccctccggcatactggacgtctccccgtcgccagcagcctgggttcttgttggggtggacaagttgcctccatcttgggatccaattgtcacgcctaagttcgtgactacaggtgaactgtggcaagcaagatggccctctcatcagttttcaggagagtaaacatcaaagaactgatctcaaatgttccagtgtacactagctcaacagagacatctggaggaatgagcttggtgtttaggcgttgggccacaaaaaaagactgctgggtcaacgaaaaatggccgcgactctaaccccaagtatctgggtgttaagaaatttggtggagagaaagtggaaccaggaaacatcatcgtacgacaaagaggaacccgcttccatcctgggaactatgttggcatggggaaggat

SEQ ID NO: 3375 - DNA, 1032 bp, Triticum aestivum
  Clone ID: PAT_TA_3375
attccagcctctggcggacccgacgccgccgcccccgccgccgctcactcaacccgccgccgcccccctccccctcgccaccctgccccccgccacctcgatgccggtgtacccctccggcatactggacggccccccgtcgttacccgcgtgggttcttgctggggtggatatgttgccgccctctttgcatccatttgtcacgccaatggtcaggcataagttgcgtgaactgtggccagcaagttaggcctttcggcgagtaaacaggagagtaaacatcaaagaactgacctcaaatgttccaggtgtacactggctcaacagagacatctggtaggaatgagcttggtggtcaagcgttaggccacaaaaaatgactgctgggttcaacgaaaaatggacgcgaatctaaccccaattcagaagggttgttaagagatttgggggcagagaaaggtggaaccaaggaaacggaattccggtacaccaatgaatgaacccgcttctgtcctgggaactaggctggcctgttcaagcatcacactcaactctcgccgaaggaagggtaggtgcggttgtagggtgatgtgctgagttgctggaaaccgatttgtgtagagcttgtaggtgggcactcccaccaccctgtttacgccaatggtacttcttctgcgcctgacttggagctgcggtagtgttgatgtgagaatgagctgcagtgacaagttgcatgtaatttaaagtgtctgtttctgcagatttgctgcggacgtggatacctgttaattttttgaacttgttgtgctgataatcgttttttgcgctaggaatgattgcgaataagtaactttcagtgtgatttctgatgtcattttaagtatacattctgcacgagacattgaaggtcacttgtgtaatgtgtttgttcgtatgctgctgcttttctctgaaactgtatgagtgttgtagctgaaaccttggttgctagtattctcttgttcatatattcttctgagtaaaaaaaaaaaa

SEQ ID NO: 3376 - DNA, 2004 bp, Triticum aestivum
  Clone ID: PAT_TA_3376
ccacgcgtccgcggactcggggcttctcctgctcgtcgtcgtcgtcgtcgtcgtcttctcctctcgtctgcctgcgcggcccgaccaatagaccgaccgggagagtggaagcagcagccgccgcggctatcgggctatggagggagcggccgggagggagagggacccactcctccgctccgagatccacggcttcatcacctacgcagacttgaacttcgagaagctgaaagcagaggccgcgtcgcgctggttccggccgaatgagatctacgcggtcctggccaaccacgagaggttcaaggtccatgcacagcccatcgacaagcccgtgagtggtactattgttctatatgatcgcaaagttgtccggaacttccggaaggatggccataattggaagaaaaagaaggatggcaaaactgtccaagaagcccatgaaaaattaaagattggtaatgaagagagggttcatgtctattatgctcgaggtgaggataatccaaatttctttagaaggtgctactggctgcttgacaaagaggctgaacggattgttcttgtgcattatcgtcaaacatctgaggaaaatgccatagcacatccgagcacagaagccgaagccgaagcgcctacaatgaatgtgattcaatattatacttctccgatttcagcaaattcagcctcagttcataccgagatatcgttctcccctctggcaccagaggaaattaattcacatggtggcagtgcattttctagtgatactggtggctctagtctggaagagttctgggttcatctattggagtcatctatgaaaaaggatactgcttgtggcgcatccgtggcatttagtcagcagattaaatgcggaacaaagaattctggaaatgacaccgtcgccgcggccgaggtacatgcgaaccacgctggagctctggaacatcaagtagaccaatctcaataccctttaacatcagatctcgattctcagtcacagcaatttgcaacttctttgcggaaaactccagtggatggtgacattcctaatgatgtgcctgctagagagaacagtcttggactgtggaagtacttggatgatgacagtccttgtctaggggataatatagtgagcaatggaaaaatcttcaacatcactgatttctccccagaatgggcttgttccacagagcataccaagatcttggtgatcggggattactatgagcaatacaagcatctggctggttccaatatttacggtatctttggtgataactgtgttgccgcaaacatggtccaaactggtgtttaccgtttcatggttggaccacatacagctggacgagtggatttttatttgactttggatgggaaaacaccaatctctgaggttttgaattttgagtatcgtagtgtgcctggaagttcattgcatagtgagttgaagccgcttgaagatgagtacacaaagtcaaagcttcaaatgcagatgagactagctcgtttgctgtttgtgacaaacaagaaaaagatagcaccaaagcttctcgtggaaggcagcaaagtttctaatctcatacggacatcacgggagaaggaatggatggatctatggaaaattgctggcgattctgaaggcacatctgttcatgctactgaagacttgcttgaattagttttacggaatagattgcaagaatggcttctggaaagagtaattggaggccataaatcaactggccgtgatgatctaggacaaggacctatccatctgtgttctttcctaggctatacttgggctatccgcttgttttctgtgtccggattctccttggatttccgtgattcttctggttggactgctttacactgggctgcataccacggaagggaaaaaatggttgctgctctgttatctgctggagcaaatccaagcttggttacggatcctactgcagtgtcccctggtggatgcactcctgctgatctggcagcaag

SEQ ID NO: 3377 - DNA, 1072 bp, Triticum aestivum
  unsure (1)..(1072): unsure at all n locations
  Clone ID: PAT_TA_3377
ttgctttctgatagctgtgttccacttcattcatttgactacgtcttcaattacctgatgggaacaaatattagtttcattgattgtttccaagatcctgggtccacatggaaatggaaggtattctcttggagatgcttcctgaaataagaggagaagagactccagaaaggggtgcccagtggggtccgcaatccacgccgaaagacatgctttgctggattcccgggcggacaaccttttactacaagaagttcnaagctatattgcnaagccagcaagatgggcgcaactgtattgcctgatcagcattacttgccaaccctatccaatatggtagattccaaggtgggatagctaattggtcggttacacatgtggattggtctgaggggaaatggcatccaaggtcgtacgcagttgctgatgtcagctatgatctactaaagaatataacagccgttgatgagaccatccatgtaacaagtgatgacaagaaactcgtgacacagaagccatgtttgtggaacggatcaaagagtccatgctatctttttgctaggaaattttaccccgaaactctcgacagcttactgaagatattcaccagctacacgtctgtttgacttcaacctgattctttgcacctcaacacatggttcaagtacatgagcatgtctcctctcttcatgtaaaaattgtgaagtcaatcgatacttagatctgggcctcgagcgacgggttgctgttgcagcgaccaccgcaaacctgcggttcagtccatgggtggtagggatgcggcgatattgatagcgatgatactgccctcagttgtaatctattgtgctttctgtatgtttcctttaagtccttcgcctctctctccctctccctccttaatctctgtcctagcctcattagttcctggctcttggagttggagatcatatttttgtcaatatgctgttattatatgatccattcttttgtagacacaaaaaggaaatgattgagaagtaccacatacaagaaaaaaaaaaaatacacgtgcgccggtgacgagttctttccn

SEQ ID NO: 3378 - DNA, 1190 bp, Triticum aestivum
  Clone ID: PAT_TA_3378
gggtcagccacgccgccttcgactgctctccccctagccctcgccccatcgccccgccgccgccgccgccaccggcgacggcgaccccgatgggcgccaccgcctccgtcctctctctccccgtggccgcctccttccctggcgcggccaccgctatcgcgggcgccgccgggtgcttcgccctcggctacttcctcgccctcgcccgcctccccatccacgccgccgccgcccccgactccggcgaagacgattccgaggaagactcggacgaagatgatgacgaaaattccggccgcgcttggccggcgaagcgagccgccgggcggaagcggaccgggctcaggctgctgttctggtcccggaacgtggtgaccaagtccgactccgccagggaagccgagagggcgcaggcccagaccgcctccgcccccctggagatcgagaacctcgccaagataatagaggatttcaagatggtgcttgtggtgagaaacgacctgaagatgggaaaggggaaaatcgctgcgcaatgcagccatgcaacactgggcttgtttaaaaaactccagcagagagcaccaaagtcattacgaagatgggagaggtgtggccaagtcaaggtggttgtgaaagtagaaagcgaggaagatatgctggttttacaagggagagcaaaatctatgaatctgccaactcacattaccattgatgctggaaggacacagattgcacctaattccagaacagtcatggctattcttgggccggctgacatggttgacgatgtcactggtggtctgaagctcttataacatgacttcaacattctcaaacataggagttaaaagagcaatgctggaatttgcaatctactgtatgatacttccactggtctcctgctgaagaatgaaccttggatttgttggtttacttgatatcgttcttccaggatttgtttggaaggaggttttgtccactcttacttgtatcgacgactgctatctctggagacctctgatttaagtaaattttcactggatttgaggcagagtagttaatgaaccgttctccatgtgtaggatacaaatctgaaaaggataaatgcggtgtttcccttccatgaactttgtgaactccttcaaaacaaaaaagaaaaggaaaaataaaaactatctgaactctcttgt

SEQ ID NO: 3379 - DNA, 564 bp, Triticum aestivum
  Clone ID: PAT_TA_3379
gaattcggcacgaggccacctccgcgtccgtgctcacccttccccgcctctccatctcgccaacaatgccagcgcgggcgtcgccaaccacgacgatgacgaggaggaccaggcctctccgcgcggcgtgcacctacacgctccaggaagggccagtcccgccgctcccaccgcctgccctgcggcctcgacctcgaggtcatagcccagcaaccgccttctccgcccccgaccccgggaaggagcgagcggccgccgctggtgttcgtgcacgggagcttccacgcggcctggtgctgggcggagcgctggctgcccttcttctcgcgcgccggattcccctgcttcgccctcagcctccgcgcacagggtgaaagcagcattccatctgacacagtggctggcacgcttgagacacatactggcgatattgctgatttcatccgaaaggaggtccctgtcccacccatactaattggacattcatttggaggcttgattgtgcagcaatatatatcatgcctacaaggttcagaaccttttcatccaaagctttctggcgct

SEQ ID NO: 3380 - DNA, 670 bp, Triticum aestivum
  Clone ID: PAT_TA_3380
ttcccgggtcgacccacgcgtccggggcattagttgaaacttaatccccctcgcctgtggcgctggtgtgaggtcctggtttgagaagacaattgcgtttgaaggcgtgaactccattgccggcgatggagttcctgatgcaaacaattagcagtgcccggatccagattccccttgatcttgattgaagaggtggagccccgatgggtctggcgccgtacgtcgcgagagttgcagcccagcctgcggaccaagacccgggcggagccgcaagtgagcgcagatctgggagcgagaaaacggtcgggcggatacgcgcgagtcctcaccacaggcatctgaactctccagtgccaagaagaacccgcaggcacctggctgggctaagaggtgcgggcgtgcggccgccgcccctgcctggatgctccgccccggcggcgcgtgcccggtgagccccgtctggggtgcgctccccgttctggcttcgcactgccttcggtcagtccaaccacaggagacagttagaacaatttgggtcctttaccatagttttgggttatgatagaataattagtacttgtataagtgtgttattactggaaggtagaactgagtgaggctgggtgcagcgactaatttagcaaatattgtgtagtgtgaatgggctgag

SEQ ID NO: 3381 - DNA, 772 bp, Triticum aestivum
  Clone ID: PAT_TA_3381
agaacaaaacaaggggagctctttggtttcaatgggtttgatcagcggaggggtgttcttcaagatcttggcgttcctctgcttcatcacattatctcaaggaagaaaccattccgccacaccggatctccctcccctccggaaggcaagcagtttctccaaaatccagcatgaagcatatgactacatcattgtcggcgggggcacggccggatgcccattggcagcaacgctgtcgaaaaagtacaaggtgctgttgcttgagagaggtggatctccatatggcaaccgcaacatctcataccttgagaaacttccacatttgcttgaccgatgaatcgaagaattccccatctcagggattcatctccactgatggtgtcatcaattcccgagcaaaggttctaggtggtggaacatgtataaatgccggcttctacagccgagccaaccgaagatttgtgaaggatgcaggatgggatgaagagttggtgaatcagtcctacccctgggtcgaagagaggattgtttattggccaaagattgcaccttggcaagctgcccttcgtgatgggctgcttgaagcaggggtatcgccttacaatggatatacctatgaccatctctttggaacccaagttgggggaaccatctttgatgaggcagggtaccggcacactgctgctgacctcctagcttctgcaaatcctgacaacctcagagtgctgcttcatgctcgtgtgaaccaagtaattttcaaaacgagacatgg

SEQ ID NO: 3382 - DNA, 718 bp, Triticum aestivum
  unsure (1)..(718): unsure at all n locations
  Clone ID: PAT_TA_3382
agacactttcaatcaacgtgtcccgttttcctttgctcctgtagtccaccgtacctagaaactagatttttatttgcaaaatcagctcaccgtacctagaacaatcagttcggtccatctcctgattttgaaaatatgaattgtgttctgccaaaattgatgctctgtagttcaccatgtatatatgtcatcagtccagatatgcgctcacatcagttccatcgtatgcgttcccacccacttggccggtgcacctcctggcagactcctttcaagtacgacctttggcccggctctggtgcccgccgcctctaccttcatgccagcgtcgaggggacaagtaggaagtattgttgtttccctattgttaaggtcagtatgttattccgttttcagtacgtaaacaaacacacagggatatttataagagcaaaaattacaaatggaaatctantaagttcaanctacatattttacaacaattgaaatacaaatattagatcagttcaatgaaagaaaaatatcacttcgaaaatatatatgcaggaggttgggagcaaaaaaaatcataattttgctcagttcaaagattggaagcaaaaaaattgtagctagtggttttgatgtgtcaaaagatgaaacatttgctactaaaattaagtttgcatcagagatatagccattttcttctaaatatttttgtgtgtatgcttgtaac

SEQ ID NO: 3383 - DNA, 1490 bp, Triticum aestivum
  unsure (1)..(1490): unsure at all n locations
  Clone ID: PAT_TA_3383
tttttttttttacgcgtccgcagtcgcatcacatgcaccgccccagttaaaacgcggggagagagcgggtgacggccgtgccactcgtgttgacccaccccaccccaccccaccccccgcccctgcccccgcaccccacgtcaaaaccaaggcggcggcagcggggcgggagagcggggagcaccgaccgacaccggccgacagcgcgggctgcatgcggagctgaggcgaggcgaggcgaggcggggagagatccggcgcgggtgccaccgccggccggccgcgggagatctggttggtggcgccgcccggataagggagaggcggcgaggggagagcagccgggggagaccgaagcgagaggagatctctctcgtccctcttctcgctcgatggagaccgggggtagcaagcgggaaggagactgccccgggcaggaaaggaagaagaaagtgcgcaggagaagcactggtcctgattcggttgctgaaaccatcaagaagtggaaggaggaaaaccagaagctccagcaagagaatggatcccggaaagcaccggccaagggttccaagaaagggtgcatggcagggaaaggaggtccagagaattcaaactgcgcttaccgcggtgtgaggcagaggacgtgggggaaatgggttgctgagatccgtgagcccaaccgtggcaatcggctgtggcttggttcattccctaccgcagtcgaagctgcacgtgcatatgatgatgcggcaagggcaatgtatggcgccaaagcacgtgtcaacttctcagagcagtccccggatgccaactctggttgcacgctggcacctccattgccgatgtctaatggggcaaccgctgcgtcacatccttctgatgggaaggatgaatcggagtctcctccttctcttatctcaaatgcgccgacagctgcgctgcatcggtctgatgctaaggatgagtctgagtctgcagggaccgtggcacgtaaggtgaaaaaagaagtgagcaatgatttgagaagtacccatgaggagcacaagaccctggaagtatcccaaccaaaagggaaggctttacataaagaagcgaacgtaagttatgattacttcaacgtcgaggaagttcttgacatgataattgtggaattgagtgctgatgtaaaaatggaagcacatgaagagtaccaagatggtgatgatgggtttagtcttttctcatattagggttttagctatgagggttgtagtcatgcggagcaatagggataactttcattctagctgctaggaaatacttcaaattatctgcaacccgaagctttgtagtcacttatggttttcatcttactggagagaatagctttataccataagtcaacgggtacaagaagttgtcctgtgcgttgagttcatgtactatggtaaaagttgagtccatatttaatgagcttactctgttgaaaaaaaaaaaaaaaaaanactcga

SEQ ID NO: 3384 - DNA, 607 bp, Triticum aestivum
  Clone ID: PAT_TA_3384
gcctctatacccaggtgggggacgggaacgccgaccacgggtgctgggagcggccggaggacatggacacgccgaggactctgtacaagatcaccgcggactcgcccggatctgaggccgccggcgaggcggctgcggcgcttgcagcggcctacctagtgctcaaggaagacggtgacaaggcgttcgcctcgcggctcctggccgcgtccaaatcgctctttgagttggccaataattacaggggatccttccagtcgtcctgccccttctactgctcctactccggctttcaggatgagctgctctgggcctcggcgtggctctaccgggcgaccaaggacggcaagtacctcgacttcctgcgccagaaccagggctccagcaacccggtcaacgagttcagctgggacaacaagcaggttggagcccagatgctcgcaacacaggagtatttgaaaggaaggagagagctagacaggtacaaggccaacctggactccttcgtctgcgccctcatgcctgacagcggcaatacgcagatacgtacaactcgtggagggcttctcttcacacgcgattcggtgaacatgcagtacaccaccac

SEQ ID NO: 3385 - DNA, 673 bp, Triticum aestivum
  unsure (1)..(673): unsure at all n locations
  Clone ID: PAT_TA_3385
gggagctgcaattccctcgttgcactggatttgtcgcacaacgacatcacgggaccgattccaagcaccctggggaacctcaccagtcttcaggctgttgatctctcccagaacaggctgaatgggaccctgccggtggagctttctaatctgcccagcttgcacatctttgacgtctcccacaacttgctatcaggaaatctccccaacagccgtttcttcgacaatatccccgactacttcctatcagacaattccggcctatgcagctcccggaagaacaattcctgcggtgcggtcatgccgaagccgattgtactcaaccccnnnaattcctcatcaaaccccttgtcgcaatccacaccaagctcccctagcagcaagcaccacaagaaaatcatactgagcgtctccaccctcattgccattgcgggcggtgctgccattgccttcggagtgatcactgtgactgtgctcaaccgacgtgtccgttctgccgcctcccacccaaagcctgctattgcactatctgatgattaccttagccgatccccggagaatgatgctagctctgggaagcttgtcatgtttggcaaaggcagcccagagttcagcacttgttggcatgccttgttgaaccaagactgtgagcttgggcgaagaggctttggtg

SEQ ID NO: 3386 - DNA, 683 bp, Triticum aestivum
  Clone ID: PAT_TA_3386
ccacgcgggcactcgtctgacagggcctccgcctgtggaagcggattggaggcggtcgccgacggagggccggcgacggcggccgaggcgacgccgacgccggcgggcggggtgcgggtggagagggtgagggcaaggtccgccgtcacccggtccttcgctccgtatccgctcacgctcccccccccgccgtcgggcgccccctcctcccccggcgcggtgtcgctgtccccctgcgccttcggccccgtccccgtctccgcgtctcagttcacctgtggggtcccagacgctggcgggggcccgagtgcgggctcgtcgcaggcatccccctcggttcacgcggcggggggtgctctccggcccgggcacggtcgggggccggcgcttggcggcgatgccctccctgccgtcctcccaggtcccctagcctgcggctccaccgcgcgctgagcccgtacgcgagtgtgccacagttcggggggttccaccgcgggcagtgttgcctggtccactagccgccggctcgaccgcgcgataataccggacgccagcgcctcccggagctggggattcaaacttggtcattgtaaattggtttacaagtggccggtatgagagtggagaaaaatgggacttcaacttctacaagagtgttaaccacattcttttggaagagtatc

SEQ ID NO: 3387 - DNA, 1039 bp, Triticum aestivum
  unsure (1)..(1039): unsure at all n locations
  Clone ID: PAT_TA_3387
gcacgaggtcttcttcttcctcctcctcaccgctcctccgaccatcttcccggacagcggggagcagggagtgatggcgcggcagtgggcggctgcgaccctgctgtgcctggccgtcttggcggcggcgtccgtgctggcggccgccgtggagggcgcggtcacctacgaccggaaggcggtgctcatcagcggccagaggaggatcctcttctccggatccatacattacccccggagcaccccagagatgtgggaagggctgattcagaaggcgaaagacggaggcttggacgtgatccagacctacgtcttctggaacgggcacgaaccaacccccggaaactacaacttcgaagggaggtacgatttggtcaggttcattaagacggcccagaaggccgggctgttcgtgcatctccgcatcggtccctacatttgcggggagtggaatttcggcggctttccggtctggctgaagtatgttccgggcatcagcttcaggaccgacaacgagcctttcaaggcggcaatgcaggggttcaccgagaagattgtgggcatgatgaagagtgaggagctctttgcttcccaaggtggccctattatcctttctcagattgagaatgagtatgggccagaagagaaagagtttggggctgctggcaagtcatacagtgactgggcggcaaagatggccgtgggattggacaccggtgtgccgtgggtgatgtgcaagcaggaagatgcaccagatccagtgataaacgcatgcaatggtttctactgtgatgcatttacaccgaactcgccttccaagcctacgatgtggactgaagcttggactggttggtttaccgaatttggtgggaccatccgtanacgaccangttgaagatctttcatttgctgttgctcgctttgtgcagaatgggtgggctcctttttatcaaccacnacattgtatcattggtgggacaaattttgggngcaccggctgggaggnncccttcatcaccacaaagcctatgnttatgnt

SEQ ID NO: 3388 - DNA, 787 bp, Triticum aestivum
  Clone ID: PAT_TA_3388
ctcggcaagggccgccgcaagtttcgccagttccaactgccaggacccatcgacaagggcagcgacgcatcccactcgggacattgctgtgctcggttcttccatcaactatgtcgtaatggagtactttgcccgtggttggaaggccactgtatggagcatcagcactaattccctccctggggagggttggggcatccgttaccatcttgattcctctaatttacaaggtcttgaaggtgaaccagctacagctccttatattggcctacccaagctgagcctccaagacgatggcactgttttctttctcaaacaggttgactaccgcgacccacaccaaccggcatgggtgcttgctgttgacatgagaaacaaaactgtccagaaagtggccaagtttattccctctggtttgtacgtcgactatgaaacaagcaggatttccaaatatctcaaagttgctccaggtacaaagcaaataacgaaaagacctgggacgccattgctgaaatcccctagcaagaaacatactggagacacagatgaccctatgacggcgattgatgtgtgttagagaggttgcagacctgaaaacaatgtgtccggctatatccatggacggggtattagagtattatcttatggctcactgctaaatgtctggactgtcctttgtttatttattttattttaggattatgtacactccaagttactatgtactatctattttattaatcatgtgaaatctattacaaagctttctaaaaaaaaaaaaaaaaaa

SEQ ID NO: 3389 - DNA, 1346 bp, Triticum aestivum
  Clone ID: PAT_TA_3389
gagggcttgatgggaggaataggtgatcttcgtcaagttgaagccaagtatcctgctctgcttttcaagcagcagcttacagctttccttgagaaaatctatggcatgataagagacaacttgaagaaggaaatatccccattacttggtctttgcatccaggcgccgagaacatctcgtgctagtctaattaaaggatctcgttctcaagcgaatgccttggcccaacaaaccctgattgcccattggcagagcattgtgaaaattctaacgaactacttgaatgttctgaaagccaattatgtcccttcattcttaatcagcaaggtgttcactcaaatcttctcgtttattaatgtccagctgttcaacagtctgctcctccgacgggagtgctgttcgtttagcaacggagaatatgtcaaagctggattggctgagttagagcagtggtgcatttatgccactgaagagtatgcaggttcttcctgggaagagttgaagcatattaggcaggccgttggattccttgtaattcatcaaaagccaaagaaaacattgaaagaaatcaccaacgatttgtgccctgtccttagcatacaacagctataccgaatcagtacaatgtattgggatgacaaatatggcacccacactgtttcgtcagaggtcatctcaagtatgagaataatgatgacagaagactcgaacaatgcagtgagcagttctttcttgttggatgacgattcaagcattccattctcggtggatgacatctcaaagtcaatgacagaaatcgaggtaacggacgttgatatgccacctttgatccgggagaattctggatttactttcctacaccaaagaaaggactaagcgggtggtcctttcgcttgcgacttccacattcctttccccactcgatctgtgcacaaatcatgtatatactcgtggcttttctttctaccaaatcaaatctagtctggtcaggttatttggtagatctgtttgatattttttgttaggtcctcggtttgatcgattggttatttcttcagtttggctcccctttttgttgggaggtcaaatttatattgcaatgccaggggtcggatgcccttggtcaggatgccgagctgctattggaaaagctcgtcgtccttttatcgtccctttagcgtctggaaaggttttccacggctactagtcagtcatttgtgtcgttcatttcaatcttcgacatgttgtaaattgcaacgaagatcatagttacaaggaattgcacactgatgactgatatttttggtgtaccctgaatctagatgtttatcgtctgtttgtacaaa

SEQ ID NO: 3390 - DNA, 972 bp, Triticum aestivum
  Clone ID: PAT_TA_3390
cgcccaacctcccgcaccaacaccggccatcctcaccgcctccggccgccatcgctccactccatctaaaacagaagaaacgacagaaatcgtggtcgccggagtggagtctgctgccgaacaaaactgcaaaccgtgcagtggagtcgaggattctggggagcggagggctctaaaaccctaacccccttcggatccacgccgcgccggtccatggaggtggacccgtcgccgtccccgtccccgccgccgccgccaatgtcgacgccgggctacttcgacccggagtcctcccgcctccgggaggagtaccgccgctacagaaagagactatcttcttcaaacgactccccaatgttggggacctcattctccagattctcggaagcaagggcattgcatgatggaagcagcatacctaggcggcccaatgctggtctactacttgaagaagtcaagcaggaggctgctgattattccgacattgatggcttgaatggaccgaaactgctggatggtggttcaggtaggaaggcggcaagatcaacgttgaatctagtcaagctggaggacgatatgccacgagaaggagaaacaacttttacagcgtttgcatcccttcttgattcagcaatacaaggattgatgcccttcccagacgtgattttacaatttgagaggacatgtagaaacgcttcagagtcactaaggtatgctgccataggaaaggttcggatggtggaggataaacttatgcagcaaaaagcacaactattactggatgaagctgcttcttggtcacttctttggtacctctatgggaaagcaaatgaagagcttcctgaaggactattcatgtcaccaactacatcccatcaggaggcttgccgctatgttgcaacagatcttacagcacaattgtgtctgcggattgtactttggcttgaaggacttgcttctgaaagtcttgat

SEQ ID NO: 3391 - DNA, 431 bp, Triticum aestivum
  Clone ID: PAT_TA_3391
cccacgcgtccgcggacgcgtgggccgcgagctacccctaaaaaaaaacccaccgcacatcactcccctctctccccgcgcagcgaaccctagcgctctcaccctctcagccccgcacaccactcctccttctggatccaccgccgccgccctctggatctcgaagcgccgctactccctccctccagatcgagagagagctcgccgccgtcctcctgctctcgcccctgcccttccctccccttaaccccgaggcggcaacgcagacggccatcgacctcgcccacctaaccctagcaagaggagagcggccatggatccgtcgaagctgagcgagctgcactccttcgtggaggagtgcaagaaggacccggcgctcctcgccgaccccgccctcgacgccaacctcccaccgtgggggtggggaagac

SEQ ID NO: 3392 - DNA, 622 bp, Triticum aestivum
  Clone ID: PAT_TA_3392
tccgtcgtcacctactcgctctcccgcctctccgagttcctctcgccgatccgcaccgtccgcctcacccgcgaccgcgccaccgacgccgccgccatcaggcgcctgctcgccgggggcgacctcgtcgtctgccccgaggggacgacgtgccgggagcccttcctgctgcgcttctcgtcgctcttcgcggagctcagcgacgacatcgtgcccgtggcgacggagtgccggatgagcatgttccacggcaccacggccaggggctggaaggggatggaccccttctacctgttcatgaatccgcggccgcagtacacggtgacgttcctcgacaggctgccggcggagcacacctgcggcggcggcgggaggtcgagccacgaggtggcgaaccacgtgcagaggctcatcgcctcggcgctctccttcgagtgcaccggcttcaccaggaaggacaagtacctcgcgctcgccggcaacgacggcgtcgtcgggccgagcaagggcacgtgaacgcgattgcctggccggacaatgatttgttgatccattgatcgtatatttgtacataacaaatcattgataaacagatatttttatttcgattaaaaaaaaaaaa

SEQ ID NO: 3393 - DNA, 417 bp, Triticum aestivum
  unsure (1)..(417): unsure at all n locations
  Clone ID: PAT_TA_3393
ccaccaccttcccccaacatcaatcgcaaacccccgcaagtgccacgtcgcagatgccgcattagctccgaaaatccaaaaccattcctccccacccacccccacctcgctccccccggcggcgacggcggccatgacgaccggatccaacgccgaccactacggcccgccctcctacccgcagcgccgcccgcactacgggggcgccccgccctcctacggctcctcggcctccttccgcggctgctgctgctgcatcttcatgctccgtcatcttcctcgccctcctcggccctcgccgtcgccgctcgtcgtcgtcctcgccgtcaagccccgcgagccccagttcgacctcgaccaggtcgccgtccagtacctcctcggtggccccgccctncccggtcgncttcgccngaa

SEQ ID NO: 3394 - DNA, 820 bp, Triticum aestivum
  Clone ID: PAT_TA_3394
ttttttttttttagtacacatcaaacatttcttttatagtgtgtaacacttcaaacatacctaactgtcgttgcatgggagtatcagaaagaagagagaaaagcctaccaccaacatatcgcaacgcctgtgaagcacaacaacatgaacactcggaacgttgtcaaggcggctccaacgcggctaaaacgatgcccacggtgccgcctctgagagctaccaccacaaggccaacaacggaacaaaacccacaggctacacacatatcatgaaatacactaaaatgtacaacatcacgagttcgctctgcgagggtcgctggtcggaccggagtttggaggcacaagcatccaggcaccagtgtgcgccgtctccttcaccagggagtcttgtcgcctggacctgcaaggatgatattgcaatcaatggcgaaccgccgcgccagcatgatggcggtgttccgctctctcgctgtttcaaaggcaacggcgaagctgaggtcactccggggccgccaaaacattgcctgtgaggctgcttccccaccacctcgaacaccacatagctgcatcgatgaggaatagaattctttggcaactactgtctttccttttgaaagtctcatccgcaatctcccaacattgagaacatgaacagcctctttcggctgatcaattccattcaactgaagcacaacaacattgaattcagtttcaggttttcttacgagtgtctctacataatccaccagtccagcatcagggtctactagcccagctgtctttgctattgcagtttcacccccaaaattgatttcagc

SEQ ID NO: 3395 - DNA, 1115 bp, Triticum aestivum
  unsure (1)..(1115): unsure at all n locations
  Clone ID: PAT_TA_3395
cgtccgccattgactaacaggtgcaacgatgcgccgaggaccggaccatcctcatcaccacgtacgagggcacgcacaaccacccgctcccgccggcggccatggccatggcgtccaccacgtcggccgctgcgtccatgctgctctccggctccatgcccagcgccgacggcgcggggctcatgagctccaacttcctcgcgcgcaccgtgctgccgtgctcgtccagcatggccaccatctcggcgtccgcgccgttcccgacggtcacgctcgacctcacccacgcgccgtccggagcgcccaacgccatgccgctaaacgtcgcccgaccgcatgcaccagggcagttccatgttccgatgcccggcggtgggatggccccggctgagaccggcggcccgaacctgaccgtcagcgcagcggcggctgcgatcaccgcggacccgaacttcaccgtggcgctcgcggcggccatctcgtcgatcatggccggccagcacgccgccggcaacagcaacgcgaacaacagcaataataacaccagtaacaacaacgtgacgacgaccagtaacaacacgacgagcaacaacaccaacagcgagactcaatgaacggcttcgtcaagttcggaaagagttgagaaaccagatagctaggttgcaagttatacacggatggtgttccattcttctttggtcaggattagcttctcgagacgtttctttggttttgataccaagcattatatacgatcaccctttttctttcgtgattttgcggcggcaaaaaaacaaagttgtattagttcattccttccccttagttctttttcatcgcccgcagctgttgatatttcactgtaataattataactacagtaataagtaaaataatggcgcctcagagatatatctatgctagtcaaagcagaagaanannaaaaaaaaaaaaaaaaaaaaaaaaaaaaaaaaaaaaaaaaaaaaaaaaaaaaaaacaaaaaaaaaaaaaaaaaaaaaaaaaanaaaaaaaaaaccccaaaaaaaaaaaaaaaggggccttaggggcctcaggggggcggcttaagggaacccccccccctaaaagtgtttttt

SEQ ID NO: 3396 - DNA, 853 bp, Triticum aestivum
  Clone ID: PAT_TA_3396
cagtctcctccctctttcggtctctacgacacgtttctttctctctccctctccctctccctctcccctcggctagcaaggcgtctctctcttctccagggaggctctcgatttgcatggacaagggccacctcggtggcggcggaggaggaggaggactgctcgccctggacgcctcgccgcggcagctcggcttcttgaacttgctatcgccggcgccgttccacaggagcatggaggcggacgacggcggtggcggtggcggcggcggcagggggaggaggtccatcgaggttgacttcttctccgacgagaagaagaacatgaagaagagccgggcatcggccggtgccgacgcggaggaccacaaggatcaggcctccgccgccggactcgccatcaagaaggaggacctcaccattaacctccttcccgggaacaacacgaggagcgaccggtccatggtggtcgacgacgacggggcgtcccgggccgaccaagacaggaacggcaggaacaccggcgagctggcggtgatacaggccgagctgagccgcatgaacgaggagaaccagcggctgcgagggatgttgacccaggtcaacaacagctaccatgcgctgcagatgcatctcgtcgcgctcatgcagcaaaggacccagatgcctccggtccagccgcaacaacctccgacccacgaggatggcaagaacgagagtgccatcgtgccgaggcagttcctgggtctgggcccgtcgggagccagcgctgacgtggcggaagagccctccaactcgtccacggagctcgggagcccgcggcggtcgtcgtccaacggaaaacgagaccctga

SEQ ID NO: 3397 - DNA, 1199 bp, Triticum aestivum
  Clone ID: PAT_TA_3397
tgggatggccccggccttcgcgatgccgccgcacatgctgtacaaccagtccaagttctctgggatgcagatgtcctccgactcggtggacgccgggcagttcgcgcagcataggccgccctggccgcgctcgggccccacgctacgtctcttcctctccccctctccctccccctctccctcccccctcccctcgcaaggcgcctctctctcctccagggccgcgcccgatttgcatggacaagggccacctcggtggcggcggaggaggacgaggactgctcgccgtggacgcctcgccgcgcgagctcgcctccctgaacctgctatcaccggcgccgttccccaggcgccaggaggcggacgacggcggcggcggcggcggcggcgcggggcggaggtccgtcgaggttgagtcctgcccccacgccgagaccgacagcaaggaggggggcgcatcggccggcggacgcgcggaggaccgcggggctcagccctcgccatcccgtcgcgcatgcccgaccaacaagcccacggctaaccgctacacgggtaccagcacccgcagcacccggggcagcgccctcagccacgaccaccgatcaccccgccaggccagctgtccgacaccgtcagcgcagcggcggctgcgatcaccgcggacccgaacttcaccgtggccctcgccgcggccatctcgtcgatcatggccggccagcacgccgccggcaacagcaacgcgaacaacagcaacaacaacaccagtaacaacaatgtgacgacgaccagtaacaacacgacgagcaacaacaccaacagcgagacccaatgaacggcctggtcaagttcggaaaagagttgagaaaccagatagctaggttgcaagttatacacggatggtgttccattcttctttggtcaggattagcttctcgagacgtttctttggttttgataccaagcatgatatacgatcaccctttttctttcgtgattttgcggcggcaaaaaaaaagttgtattagttcattccttccccttagttcttttctccatcgcccgcagctgttgatatttcactgtaataattataactatagtaataagtaaaataatggcccctcggagatatttctatgctagtcaaagcagaagaaatgcgggggtaaagaacaatgacagctcaccggatgctcatc

SEQ ID NO: 3398 - DNA, 1181 bp, Triticum aestivum
  Clone ID: PAT_TA_3398
gcctgaaccctagctagctccgccgccccctctcccctctcctcgccccctcctcgccgcgtagcccctcccaactccggtcctccgccgtttcgctcgttcttccgggagagctgcagcgaggacgaagtatgtcgtccctgcgggaactcgattccgcggcgggctcacaaggcagcgcgcccagccggagtcgcggaagaagtacgggcttctggagaagcacaaggaccatatcctccgcgccagggcctaccagcgcaaggaggatttcatcaggaatctgaaggagaaggcatcgttcaagaacccagatgagttctatttcaagatgatgaacagtaaaaccgtggatggaatccataggcccaagcctgaagcaaataataagtacaccgaagaggaacgtatgctgttgaagcataaagacatgggatacatctttcaggccgttcaaagtgaaagaaagaaagttgaacgattgagctcaacccttcacgcagtggatgacaagcgttcaaacaagcacatttactttgcggaagacagagaagaagccaaagaaatacgatctaggataggtgaaagcagcagcgcacctcaatttggcaacatcccttctcgtataaagaggaaaacagcttcctcctacaaggagttagaaagcaggaaagaaagggttaagaatcttgagaaattgtatgcggacatggccttgcaaaaagaactgaagaaacctggacgcaaaaggaagctccgtgaagaagagattttaaattcagcatcacagcctgtttacaagtggcgtgcgcaaaggaagcgatgataggaatggcgaaagctggacaattgggaacagacaagctggtgcttgaagagtttcacttccctgtgacattgcccttgcccttacacaaccccatccattactttcagatacctttataacctttgcctggtgatatttgtggatcctatgccggagaccatgtactgctattagtctattaccatatgttaatttctcgaaatgttaagatatcagagtcaccatgtaggaacaattttaaaatcatgcctatattgtgatcaagttatttgtgatagaatttcagtcctggcagctgattaacttgcattctacgattagaaagcagagccaaattatcagagttgcctcg

SEQ ID NO: 3399 - DNA, 886 bp, Triticum aestivum
  unsure (1)..(886): unsure at all n locations
  Clone ID: PAT_TA_3399
gggaacgtgtcgtcttcgtcggggattccatgagccgcacgcagtgggagtccttcatctgcatgctcatgcccggggtggaggatcccaagaccgtctacgaggtgaatgggaacgagatcagcaagaccatacggttcctgggtgtgaggtttgcgtccttcgacctcaccgtggaattcttccggtccgtgttccttgtcgagcagcgccctgcgcccaggcatgcgcccaagagggtcaaatcgactctgaggctggacaagatggataatatcagtcggaaatgggtgaatgccgatgttctgattttcaacaccgggcactggtggactcccaccaaattgtttaatacgggttgctattttcaggctggacgtgctctcaaactaggtacaaccattgatgctgctttcaggatggcactgcagacttgggcttcttgggtggaaaaaagagttgatctaaaccgaacacatgtgttcttccgcacatatgagccatctcattggagtgacttgaaccaaacgatatgtgaagttacagaaaagccttcacctgaggcaaaaggaaatgacaagagtgagcttggggatatacttggtgatgttgtggcgagcatgaatgttccaattactgttctaaatgtaactttgatgggtgccttcagaacagatgctcatgttgggcgcttgggagttatcctcccactatacttgattgcagtcactgggtgtctccctgggagttccaagatgcttgggaatgaactaagtattttcatacctttttacaaatgggtggcgaaagatggcaaggtgactgaccctttttcgnctttgcccgtacgtacatccatctccgntttgtcagctatagaagacaa

SEQ ID NO: 3400 - DNA, 720 bp, Triticum aestivum
  Clone ID: PAT_TA_3400
ggcacggggccagcgccgtctggaattttccggggcggcgctagggtttcggatggagcccgaggaggcggaggccgtgctggagaccatctgggacctccacgacaaggtcagcgacgccatacacgccctctcgcgcgcccatttcctccgcgccgtgcgtcgccgcgccgggggcaaggccccgggcgtcgtccacatcaagggggtccccgcggacggcgacgaggcggccgacctgaacgcggtggccgaggaggcgaggagcctccacgctatccgcgccgcgctcgaggacctcgaggaccaattcgagtgctttctcgctgtttgttcacagcaacaagcagaacgagatattgcattagcaaggttgcaacaaagtcacatcatgcttaccataagattaaaagagcaccatgggaataatcacaaagtcatagatgaggcgttggatttcgtccacaatgtctaccatgatttctggtcttttctgtcagtaaacaatcctgagaaatcaagagctcattctggcgctaacagcaccaaggagacgggagatggttcagatttcttaggttggatggtttcttccagtcttgatgttgtcaggaacagtttcaatatgaaaaatattggtggttttctagggaacactgcagtgcttgctgttggcatgattacaatgttgcagctccatttgtcgtcttctggagaaca

SEQ ID NO: 3401 - DNA, 859 bp, Triticum aestivum
  Clone ID: PAT_TA_3401
taccagtccaggtggcggcggtggccggcgagaagcgcgcggcggcgctcacgtccgggtccatctacgtggtgagcgccgggacgagcgactacgtgcagaactactacgtgaacgccatgctggccgccgcctacacccccgaccagttcgccgacgcgctcatgcagccattcacggccttcgtcgagaggctgtacgggctgggagccgcggcggatcggggtgacgtcgctgccgcccatggggtgcctgccggcgtccgtcaccctcttcggcggcggcggcgggggtgcggctgcgtggagcggctcaacaacgactccctcaccttcaacgccaagctgcaggcggcgtcggacgcggccaagaagcgccactcggacctcaagctcgtcgtcttcgacatctacaacccgctcctcaacctcgtcgccgaccccatgagcgccgggttcttcgagtctcggcgcgcgtgctgtgggacggggaccatcgagacgtcggtgctgtgccaccagggggcgccggggacgtgcgccaacgccaccggctacgtcttctgggacggcttccaccccaccgacgccgccaacaaggtgctcgccgacgcgctgctcctccagggactccagctcatctcctagctagctgctcagtccttcctcgccgctccaatggcgctctgacaccgcaccgaccgtcttgtgcatgtctgtccgtttacctcctggcttttcttgcttgtcatctctactaccggatcatctctcctgctgttttgtttgctttcaactactactgtgtttccgtgcttttgtgtgatgtgaatgtgatccgtaatgtgataaaaaaaaaa

SEQ ID NO: 3402 - DNA, 1564 bp, Triticum aestivum
  Clone ID: PAT_TA_3402
gcgttccttctcctcccttccccaatcccccactcggcaccgcggggaccgaacccagtcgccatctcgccgccggtgaagtcgccatggccgaccacgccgcagacgaggaggagccgcccgtcctgctcgaccgcgcggcgcgtgccacccgaggaaagaggataaccaagctcgtcgaggaggaggtcgagcttgatgaggccttctggggccaagaagccctcaaggaggacgaggaggatgataactatcaggaagagcaggatgctggtgatgtattcgacagtgatttcgatgaagatgaacctcaacctgatgatgacccagagaaggaagtaagtgagaggttacctattaagaagaggctattttttcctgggaagaccatgaaaaaaatgaaagccaagaagaagaagaagaagaataaggtcatcaaactagaggatgatgaaggtatagatgacaagaatcctgataagactacttcatccaaacaatcagatgttcctgatgaatgggagtctgagaaaacgatcaggaaatcaaccagaacatctgtcattgtgagacaagctgaacgagaagcaatacgtgctgaaaagcaagctactgctaagccaattaagaagagaaaagagggagaagaaaaacgtatgacacaagaagagatgctcttggaagcagctgaaactgagattatgaacatgagaaatcttgaacgtgtactggcaagagaggaggaggtgaagaaaaaaagctgttgttcagaaagctgtctatgagggtcctacacttcgatttcactcgagagatggggaatcacgtctggaattcattaatggggcatcatttgggtctgaactttgtacgacttcaactccttatccggagaaatctgtttgcgttgtaacaggacttcctgccaaataccgtgatccaaagacaggattaccttatgcgacaatggcagcgtttaagatcatccgggagagtttcctgaaagaggagccggataagaagaggcccaacatgtcaaatatgggagaactctttgaatcagtagccggcgaacattctacgcctaagaagaaaagaatcgagtcaagatcgccaatatcaggagacctaaggcacggcggacgcttcagacgaatacctgctcttgatgtcatggacgaggactgacaagagatcttctctgacagtgtggttgcatacgatgccatgtgttagcatgaggacttgccagagatctctggcggcgtggttgcatacgatgccatgttagcattagaaacagtagagtgacacactatgttcctgatgccgccgcttgtgcaatggcatgttgtaaacgaactgctgtcagttggtggcttcttgtgttaggtgtgctggaatggtggtcctagggattgttcaacatagcctcagcattgcaccctgacatctagtcacgttccgtgtcattttgacatggaacttggttttcactcacaataatttgttgtgccatgtggttttgttggcggaaaaaaaaaaaaaaaaaaaaaaaaaaaaa

SEQ ID NO: 3403 - DNA, 654 bp, Triticum aestivum
  unsure (1)..(654): unsure at all n locations
  Clone ID: PAT_TA_3403
gtcaccgcccgctgccttcccacctcctcctcgccgtccaccgccgcctcctcctcctccgccgccgttccaagccgctgcctcctcctcctcgaccacctcctcccctccatctgcctctagcgccgccagcccgcccacccgctcgcctgccactcctgtcagccgctgcgaggaggagaccatgaagctcgacgtgaacgccctccgctacctctccaaggatgacttccgcgtcctcaccgcctgcgagatgggcatgcgcaaccacgagatcgtgcccgcggagctcgtcgaccgcatcgccggattgatgcatggaggcacatataaaatgctgcggaatctgggtcagatcaaacgggtgcaccatgacgccaataaaaatttggggtatcctggcaccttgcttcggttggcccccaactccgtgttgggaaaggatcaaatatatttcaggtcccacggaggatggaaaatgttggcatgaactcaaaagttgggtaggnacttttagggcgtcaatcaaacgggcattactcacggagggcttaacnggtgtcctacacaatncggctaaagaattgctttanaaaggttaggaacaaggttccggtcaaacgggtggacgcgcgggtgtattnattgccggnt

SEQ ID NO: 3404 - DNA, 879 bp, Triticum aestivum
  Clone ID: PAT_TA_3404
ctacgcggcccgctgtggattcgggatgccagagcgccggctctgggtggtggtccgacggatccgcctcatactttgaggacggtcggtcgtggtcgctgttggtggaggggaggccggcggcgtccggtgtcacctctctgcaacgttgatgagtgtctcttgccttcctgtagcggtgaactcacccggcaatctactccctggtcgtggctccggtggtttggactttgttcatggacggggcgaaatctccgcacggcttgccgatgctggcagcgacgacgcctgtgggtgccgtttccttcttggggcgctgccatggccctgatcatgtccctcctcgagctccgggggaaacccttgttccggcccttcggaacaggcgacggcggcgtcacggcgtcgttaccttcatgaaggcgccgccttggctgctcgcggagtcctcggagctagagtttggagcgtcttgcttttggtgtgggttgccccttgggacatgggcctctagggcgctatgtatgccatcgcggcgcatcctgcgcgtcttcttcttcaggcccggctaggttctgccatccaccagccgactcttctaggcactagtggtgggaggtacgttgatctagttagttctgtagttgtcagtgtggcttggatgttgcttgcaacggtagtgacgcggcctgtttgctcggtgccccatcttctttgctttcttggctagggatagggcaaggcaagttctctcattctcgtctgtagtaggtgtggttctaatcccagggattagcgtggtgtgtttttgccttttggcattgtactcaaactgtggatggtctcttcccctttcttctatcaatatatgatacgcat

SEQ ID NO: 3405 - DNA, 1018 bp, Triticum aestivum
  Clone ID: PAT_TA_3405
gcacgaggcttccgttttggtgcctttgagtcaatgcggcacgagggaacaatctcatttgaagcttgctgggctttcatcatcggaaaataaggaccctgtactttcttgtcaatctagttctgataagcatcttgactggagctcagagctgcaaagttgtcgtgtggcttctcctttgaatgacatatggcattcttctgtggccactgataaaccccatgccactgctaacacatcacatatttctttgtggaatgataaagaaattaaccctactttgacaagtgatggtagaacttctggcaccatgctgcataccaggttatcttcaactgacaatgcttctaccacgttgaatggacgtcaagaggggctaggacctatgcatacacctggtatggtttctgaacattctggtatgcgaaaccaccagcatagagcactggatgcagcaagaaatgataacataggcagttttggcaacgctgcaagtggaaataaagacgagggcagcataatttctgatatattgtctttggagtttgatccatgggatgagtcgtattcaactgcgaacaattttgttaagatgcttaatgaatctgaaaagaacgatgcacttttcaacgcaccttcctggaaatccaaagggcaccagtaatgagtctagattttcgtttgctagaacaggataaccaacggaacttccaagattcatctttcagaaattgtggcactgatcagaattttagcttgctatcccagaattctcatggcaacagctatcagaatggtgttgcattccaatcgccggaggaagatttttcaaagagtaatcctcttgctatgtcagatatagcaactgctgggtcttccaggtctaaaatatctgcacctcctggattcgcggcacccgctagagtcccacctcctggattttcatctcaggacgggttgaatcccccacctggattttcttcaggattctcatctcaggatatgttgaatcaccctc

SEQ ID NO: 3406 - DNA, 1583 bp, Triticum aestivum
  Clone ID: PAT_TA_3406
gatgactcagctccaagccacgccgctcagaaccctctcagctccaagccacgccgctcagaaccctagccctctcccgccggcggggcgccggcgcggcggcgcggccgatggcgggctccgtgcggtgctccgccgcggccaggagctacagcattacgctcctccccggcgacggcatcggccccgaggtcgtcgccgtcgccaaggacgtcctctccgtcgccggctccaaggaaggcgtggagctccggttccaggagatgctgatgggcggcgcggcgctggacgcggccggcgtgccgctccccgacgagacgctcgcggcggcgcgggcctcggacgccatcctcctcggcgcgattggagggtataagtgggataacaatgagaagcatctcaagcccgagaccgggctgctcaacatccgtgccgggctcggcgtgtttgccaatctgcggccagccaccgtgttaccgcagttagtagatgcatctactttgaagaaagaggtagctgaaggagttgacatcatggttgttagagagcttactggagggatctacttcggcaaacctaggggttttggaaccaatgacaagggagaggaaactggcttcaacactgaaatatattcagttgctgagatcgatcgtattgcccgtgttgcatttgaggttgctcgcaagagaggagggaaactatgctcggtggacaaggcgaatgtgcttgaggcatctatgctttggaggaaacgggtaactgcaatagcttccgaattccctgacgttgagctctcacacatgtacgttgataacgctgcaatgcagcttgttaggaatcctaaacagtttgacacgattgtgacaaacaatatttttggtgacatattatcggacgaagcatcaatgatcacaggaagcattggaatgctgccatctgccagtgttggtgaatcgggaccgggtctttttgaacccattcatggctctgctcctgacattgctggccaggacaaggcaaacccgttagctacaattcttagtgcggcgatgctattgaaatatggccttggtgtagaaagtgctgcaaagagaatcgaagccgcggttacagagacactggacaatgggttccgaactggggacatatattctcctgggacgacattggttggatgcaagcgaatgggagaggaagtcctgaaggctctggagtcgcagaagtaaacagcaaaccgatagccatgagtacggagggttgaagaagcctgcaacatgggatggtcgaaagcgcaccgggatctgatctgaccttaccccgccaaagatcgtcgatcttgcccctggattgtgtgattttgtttttatgtttgcctgcttccgcccttgtagttgggtgcaggaatttagcggatcgtcttttccctttctcgttggaaagatttttgtgtgccttgattgaatgaattgtgtcggtgatggatagaaaaatggggatggttccctttgctcctggctggaatgaaaaagatattggattttgtggcactatcatttggaataagtcagtacattcctgtc

SEQ ID NO: 3407 - DNA, 586 bp, Triticum aestivum
  Clone ID: PAT_TA_3407
ggcgacggctcgccccgtctcggcggccgcgatgatccaccgccgacgccgcggcgctcctccgggtggggcgtggcgccgccgtctcggcatctctgggtgggcagcctggcccccggcgtcaccgcctcggacctttcgcagctgttccaccggtgcggcgacatcgagcgcatcacccgcgaccctggccggaccttcgccttcgtgagcttcatgcgggagcaggacgccatcgccgcggtccgggaactgcagggggcccggctccaaggaacgcccgttaggattgagttttccaagggggcctgaccttttggactgcactgctaggacaaacttggagatgctttctaaacattactatgaagctgctagcagttgggtggtgttttttgtcccagaaaatgatgctgacatggcagcttataatgatttcatgaactaccttggtgataagcagcgtgctgcagtttgtaaacttggagaaaggagcaccttgtttcttgttccaccgtcagacttttctgaacatgtacttaaggtgccaggaaaagtgagcatatctggagtcattctgaagttt

SEQ ID NO: 3408 - DNA, 681 bp, Triticum aestivum
  Clone ID: PAT_TA_3408
gatgaactccaggtcatacaacaaactggacaccgcgaatgacaaaatggattttaacacccgtggaaataccgcgttcaatggcaccttagaccggaatcaatcaggtgtatctgccaatccatccacagcatccaaaccagctgcacactcgcagatcccaatggacttcagcactcgtggaaatacagcgttcaatggcgccttagaccggaatcaaccaggtgtctcagccaatccatccacagcatccaaacaggctgcacactcgcagatcccttccgataagaaaccacgtcccaagaaagaagattttgctgacaaaggaaacccgaaccacatgacaaaacgcctcgttaatcctgcggagagccctgtgctgacaccaacaaaagcagcatccagaggcatgaacagtaatacacaagagaaacttagtgattccgctctaaccattcctcaaggtagcgctgacagtccaagaagtaacagcttggatagctgcatgtccggccatgtcaagcatcacaccggaggggactgccgatgggaggccgtccagttggccagctccagggactcccctctcagcctagtccactttagacttctgaagcgccttggatacggagacattggcagtgtttaccttgtggagctcaggggcacggacacgttctt

SEQ ID NO: 3409 - DNA, 891 bp, Triticum aestivum
  Clone ID: PAT_TA_3409
gaattcggcacgaggcaggcagagtgtatggaattgtttattccgcctgatctttgaccatgatttagggcagactacaagcttccatcttgtgcgctatttccatgtctgagtttttgttcattatctaatcctgccaactactctatttgccggcgaacagaggaagctagtgctcgacgagagcacgacgaggcaggcgatgcagctgtttaaggagaccaagatcatcctgctgtccagcatgtcatcctggggcagtggatcgcccgaggagattgagaggtcctggtgcgcttgtgtcctttactgcgtgtcgaagctcggcaacgcagggaaggccaaggaagaccgtggcatcacgctgcgccagattttgagggcattcgatctcaagattgttgattttttcaaggagatgcctcagttctgcataaaggttggattcattctgactggtctctatggttcagattgggagaagaggcttgagttacaggagctgcaggccaatcttgtccatttatgctccctaggccggcattacaggcgcgcataccaggagctattcctcttaaatgatggcaaacctgcaaataattcttcagagctaaacgtgcaacaagcttctgaatattatgactttggatggttactcttcttagttctgagaaaccaagcatcaagcgccgtgaagaatcttttaacatccacaactgagttggtttctgtgttggctgtgcttattattcatatccccgtgcggttaaggaacttcagcatcgaggattcgtcctgctttgctaagaagtcagataagggagtcaatcttattgcatccctctgtgaaagatatcttacctcagaagatgagttgagcaaagcactgca

SEQ ID NO: 3410 - DNA, 972 bp, Triticum aestivum
  unsure (1)..(972): unsure at all n locations
  Clone ID: PAT_TA_3410
caaacaaggcaagcaggaagaggatggagctcaccaacatcccccatcttgcctcctcctccagcttcttcttctccagctgccggagtagaagaagaactgggagggctgtgataacagcgcttgctgctggtagtaggtgcagtgctgattctgcatgcccagagcccattgaacagcataatgtagacagcctttcagtggcctcaggtcctgcaaatacccaatgttatagaaggcggggttttgctgctgttgctctgctcccttttctacttcctcacgttgatatggcgagtgcagctgactcatatgatggatcaattattcaaaacggtgtgaggaatgtcttatccaaggtgaaagcagctggcgtgcttcgtttggttttccatgatgcagggacttttgacattagtgacaaatcaggtggcatgaatggctccataatctatgaagctgacagacctgaaaatgcaggacttagtaaatccttaaagatactacgaaaagcaaaagaaggaatccaccaggttcagcaagtgtcatgggcggacttgatcgcagtggctgggtgctgaagcaattgcaccccgggggagggcctgaaattcccatacgattaggccgtttaaatcccagcactgctggttccgaaccggtaacctccctgaaagaaacattgggtgtggtnggccttgaaaacatcatttcgcaaaaagggctttccgcgctgggtccggccgtgtctcctggcgcccaaccaattgggggtaaagggtcggggtcctccgctttgcnttctcctaacccctaatttaaaagtacnccttganaaanccacgggcaacnttcaatcctgggaatgccgaattngggcctgcccaaaaaaattggggcacnccactggaaaaatnaatgaaatgccttaangggnggnttaaattatnctattnccaaagggnncaaagn

SEQ ID NO: 3411 - DNA, 533 bp, Triticum aestivum
  Clone ID: PAT_TA_3411
aggccacacgtatcccctcgcgccgctcctctctccaacctgtggccgagaccccgcttgcctccctcgattctcctctcctctctcctctcacttgcaagcccccaatcgccgtcggccagctctcctttcctcgacgctccctcccgattccctcaggagtcacgcccgagcgcccgaggagaggagcttctagagcaccggcgcccgccgccggcaagaccacggctaggagctccccacgcgccatggtgtttgcagaggacctcccctgcctcgcgccgccgcctcgttagccccgcgcccggagcgcgccactgcggcacctctctttctccctcttttccttccttctcctccctggatcgtcctcaccccccacgcatctctctccctctctgtgttccaggaaacggccatggccgagcgccaagccggatcgagctctgccgccctctgctatccgtcgtgccggccagcctcctctacgccgaggccctgcagccatcccaccgcctcagatctcgccggac

SEQ ID NO: 3412 - DNA, 1188 bp, Triticum aestivum
  Clone ID: PAT_TA_3412
ccacgcgtccggtcaaaacaaaatccatcgccttttctcgccccctcccctctccccctcccctctgaatcccgccgccgtgccgcctccgccccctccgccccccacgccgccgtccccggtcggccccgtcgcgcccgcccctcccgccgtgctgcgccgaaccccccgccccgccgtccgcgatcttggccgtcggtttccgagggatggctgacgacggtgccagtggtgccgggggttcgacggcgagggatggcgcagatggcccggaacccgccaccatcgagatcaacatcaaaaccctggagtcgcaagtgcacaagctccgcgtcgacaagaatgagactgttctgaacctaaaggagaagatagtagatgtcgccgggattcccgtggagcagcagcggctgatttttaggggaagggtcttaaagcacgaccacctcttgtcagaataccattcggaagatggatatacattgcatttggtggctcgacgcacagctgagggccaacattcctctgagactcctgaagcaaaccccaatgctaatgctagtggtgccggaaatggagcaatgctgggagattacatgtccaggactgttcgggatattcttggtaacttccttgggatgcctggtggtgtggcaaatgctacgttctcggtgccattaaaccaccccccaccagatggggccaataatggaagagctcagccaggccaggcaccacctgggttctcaattctcaatcatcaaattcatgtgtcacagcttccaccttccggcgctattcctcgcaacatggttgttcctgattccatgacgaccctgttggagtatatcaatcgcatggaccaagtattgcagaacaatggcgttccaccatccgtggactccaatgctcaggaaccaccaacaccagcgacagatgatgcttacttgaaccaaagctttccaagtcctgaggtgctggcgtcagttgttgaaagggcccaacaacttcttggcggcagtgcttcttccgcgctttctcatcttgcacaacgtattcagacagatgctgccactgctgatccatctgtgcgaagccagatccagaatgagtcggcacagttgggagtagcgatgcagcatttggggtctatgctttttgagcttggacggacaatgatgacgctta

SEQ ID NO: 3413 - DNA, 885 bp, Triticum aestivum
  unsure (1)..(885): unsure at all n locations
  Clone ID: PAT_TA_3413
gtgcaccagcgggcgaactaacacacgggcaaggatcccaagaaaccaagccatggcgacggcggcgctccagcgcgtggcgaggaggctcggcggccgcgcgctgcaggaggaggtgcagctcccgaggttcctccacagcggcaagcctgcctgttccggcgcctccgtcggaggaagcggcagcgcaaagggccctagggttgatgcggcgaaagaggatttcacgcagcaaatcaaaagcctgaaagagggcttgtacaccacttttgccagatgggaacgggacaagctgttcgatggcactctggcacgccaaaacggtcagctgctggagcaactttctgtgcaagtcgagcctagacccaatgacccactctggcgcaaacatcgtcgcggaaaacgggtccatgatttcatgttctatggagggttgttttgttctagctatctggccttgggtggggtgcttgacttcttcacaggaccagatcattccaaggaaaggaaaagtatcgagccatcggtttagtcgtaatcatctctaggttacttatttcgatttcatcgcaggatcaactactgcatgtctcatagtncggttgtaaaattcatgtaactctcccgaattcaatagaggacgcatatgtctgtctgataacgtgggtcaacttttcatgcatttttttttacgttgatcgtaggagctcgcggagaaaaaaaataaagtttagctcctacgagctcgtacgggctcatacgatgtccaaagacaacaaaaatgtgcacacatcttgtgcacctaagatcttcagttccccaaaatttcaatttttttgatttttttctattttttcaaaaaaaaaaaaaaaaaaaaaaaaaaaa

SEQ ID NO: 3414 - DNA, 800 bp, Triticum aestivum
  unsure (1)..(800): unsure at all n locations
  Clone ID: PAT_TA_3414
tcgctcctccaggcgcactaccagcgccggtacaacggcgtgctcgccgccaacttccccgcggcgccgctgcgcaagttcaactacaccggcacgccgcccaacaacacgttcgtgacccacggcacccgggtggtgccgctcgccttcaacacctccgtcgaggtggtgctgcaggacaccagcatccagggcgccgagagccacccgctgcacctgcacggctacgacttccacgtagtcggcacggggttcggcaactacgacgccgccaacgacaccgccaagtacaacctcgtcgacccggtgcagcggaacaccatcagcgtgcccaccgccggctgggtcgccatccgcttcgtcgccaacaaccccggtgtttggatcatgcactgccacctggacgtacacctgagctggggcctatccatggcgtggcttgtcaacgacgggccgctgccgaaccagaagctgccgcctccaccctccgatatccccacgtgctagtagcctacggctcagatccttggcgattttggccccgtgcgcgcgagacacgttcgcacgccgtgcaggcatacatgctcaactggggggggggcagaggtttgcactccggttgggcctgaatgactgggggggacccttgaaggcctgtgccttctttgtggtcttggagtccaccggggggacagaaaaaaanaaattggtgtaactggtaacttngttagcaantcccatggatgcgtcctgtattcatgtttttttntnaaanggatgctgttatcctttccaattgg

SEQ ID NO: 3415 - DNA, 1097 bp, Triticum aestivum
  unsure (1)..(1097): unsure at all n locations
  Clone ID: PAT_TA_3415
tcgacccgcgcctccggggccccggtccccggcccctaggccgcaagagagtgagcatggcagggcagggcagctacagccggctcgccgccgacgaggccgccgccgtcatatccggcggcggcggcgacgactacgactcaaaaaagcttcggctgctcggctacgagccgcagctcaagcgcaatctctcgctgctgtccaacttctcggtgaccttctcgatcgtgtcggtgctgacgggcatcacgacgctgtacgggacggggctccagttcggggggccggtgacgatggtgtacggctggcccattgccggcgccttcaccaccgtcgtcggcctggccatggccgagatctgctccgcctacccgacctccggcggcctctacttctggagcgccaggctctgcagcgagcgccgctggggccccttcgcctcctggctcaccggatggtttaacatcgttggacagtgggcagtgacaacgagcgtggactactcgctggcgcagctgatccaggtgatcatcctgctgagcaccggcggcaacaacggcggagggtacctggcgtccaagtacgaggtcatcgccatccacgccgccatcctgctcagccacgccctcatcaacagcctccccattgcatggctctccttctttggccagtttgcggcggcttggaacatgctaggtgtcttcgtcctcatgattgnctgtncccgntnttgttccgaaaagggcnagggccaattntgttttcaccaatttaaacacccgacaacagcgctggaatacacagccatctntacatcttccttctggggctcctnatgagccagtacacgctcttangatacgacgcgtcggcncatatgacggaggagaccaagaacgcaaacaaagaacngncccatcgggatcatcagcgccatcggcatatcgaataggtggcggntggggatcatactcggngtacctttgccgncaaaggacataccttccttgttgagccccgacatnaaagctggagggacgccatccccagntttntacaggccttaaaaccgtacnnancggtgttgngggacgttt

SEQ ID NO: 3416 - DNA, 1116 bp, Triticum aestivum
  Clone ID: PAT_TA_3416
ctcgccgccgcgatgagcgccaccaggccggaccaccggcggcaccagtcgccgttcctccgggacctctcctccccgatatcctcgtccttccgcatgcccccggcgtccgtgcgccgcgaggcccaggcctccaccccgccgccgcctcccccgctgctctccctcgatgacctgtcccgccactccccctccccgccgccccacacgcctccgcaggcagccatgtccccgtcgcctcctccccctcgcggggggctcttctccaccccgcagcgctccaacggctccccctccccggcggcgtggtggtccccctcgagggaggagaaggccagggatagttccccggtcgacggagtcgtgcatcagcagcagtccccggcgacggcctccgcacagcagccgcagcagcagcagcagcaggtggcgctgatcacgctgccgccgcccagggaggtcgcgcgcccggagatgccgagggactcggtgctctccactggccgggtcgacgaggaggaatgggtcaccgtttttggttttctgccggttgataccaactttgtactgagagaatttgagaaatgtgggttagtcttgagacacgttcctggtcccagggatgcgaactggatgcatatcttgtatcagagccgtcatgatgcgcagaaagcgctggccaagcacggccagcagctaaacagtgttcttatcattggggtgaagcaagtggatccatggcagcgaccgtatctgaatgaaaacaccgacgacacctacaacggtggcatgtcggttcccatttccgtcacaagctgtggcgccgagcggtttcgccaccaggaacgcgttggcacctttgccgagcaatcccatgcaaaacggcaacgagagcaaccgcggggcgtccggagccatcgcttcgcccgcgaaatcggtcctgtccaaggtcatggacgttatgtttggcctctaaattctgttggctaatctgattgtggaagaattttgttggtgatattacggcaaagtggggatcaatggtagatgttatttgccataacatatgttttcctgctgttcgttttcgttcaataaaaaaaaaaaaaaaaaaaa

SEQ ID NO: 3417 - DNA, 546 bp, Triticum aestivum
  unsure (1)..(546): unsure at all n locations
  Clone ID: PAT_TA_3417
cggacgcgtgggcggacgcgtgggtttttttttgcattgtagaaaacaacatcatttactaacctttctccttaaaaaacattcgaaatcaacaataaaaactcttgcagcaacccaatctaagttaatttgtctggtagagaagtacatgttgccggggacaggagtgacgccacacccagcagagcggctagatgggcgcccagcaactacagctcggcgtaaccactttggcgaacggggttgtcaaagggcgagcgtttgactttgatcgggcaccactaatgtgctgaatgatttaaggcagcacccattcatcaattcatatacttgcatctactccaacatatgacatgtgttcaggcttcaactggctagggcatatgataagtgtgtttccaaaatccaaaaccaaanaanttaantaaccaaagatcgcctcgtcctttcngtatnaacgttgnagaaagggccccnggacncccgttnacaaaaaccatnnggctnacggacaagggggggccggtaccattccccaaagggtct

SEQ ID NO: 3418 - DNA, 496 bp, Triticum aestivum
  Clone ID: PAT_TA_3418
tagccacgccacagcagcccgccccgacgagtttgtcctgctgcggtgctcccgcaactcctccctcacccacagatgcgggagtggtggtgtggtgtgggacggtgatggagagcgccggtggccatgagacgggtggtgtagcaagccacagctagaacaaccatggtggtgaccggacaacagtccatcggcgctgcaaaaccagcagccacaggtgatggagaggacacgctccggtgctacaaccggctgacttttttgctggaagctctcactgaaggcgtctgggtctaaataaagagccaacctaaggcagttgttgttttctttgagttgggttcagatagcttgaacagactatttccaaaatgatttgtcaagtgcgttttcgagcaagtttagttctccacacattgatgccatcgatggatctttctcattagatttttatttattttgaaatgtctttgttcagttgcttagtctttctatg

SEQ ID NO: 3419 - DNA, 729 bp, Triticum aestivum
  Clone ID: PAT_TA_3419
ggattattgtagctattggaatgttggatcttttgatatttggtcctcgatctgacaagtattacccttttgataaataactttgtaaaactacatcattcagttcatttcttagatcatctccagtagtagttaattttaagtctagattgaagttttaatagtaatctaaggactgtacatcttggttattgtcttattgattatacaatacatatcagaggaaactacaagtgccttaaacaacctactgaaaatctatgattacatagaggtgtagccgtggtctaagatcagggccagagccagatttggaccatgctctaaggctctgagctggctgtttggctttgtgatgttaatcaacacattttctctcttatgtctatacatctttactggtcctataagtgattctgcagggttaccttgatagataattttctcaggaacacaaatacgagagtacatttgttctgggatggggtgaatttattggaggagacggccagtaagtactattttttcttaatccctgattatttcactgaaattagcctcgccgtgcatttgtgcggtcgtgcatcactttcattggagatcttgcaactttcactcattggcgatcttaatggaattgctttgaaccaaaatgttcatagtaaagtctattctcccatttaaatttcttcgaggaatcaagaatgccaagtacatcacaacttctaa

SEQ ID NO: 3420 - DNA, 654 bp, Triticum aestivum
  Clone ID: PAT_TA_3420
gtagccagtggtaaggcacgcttccaaagctcccgccgggcccaatcccgccgccggcgcccggtccttgagaggctgcatgcatgagtagtcgcgctgccgccgccgccgccgcagaggagccatggggatggttaccgctgccgcccttctcgcctcatcgccgcagacgccgctcctccgcgggtgtctccccggcctgccgaggctgcgcctgaggcctgcctccccctgcgtcagcgctctcaggtcaaacaattttgttcaaaggtgttacatagcaaatgttgaggttgaggttagcaatgtaaataaggaagaggaggctttcgatgatcatccatcattaccaccaggctgctctattccagttgtcaatatcctaggagatgttctagattctagtccttttcctccacatgatagtgctcagcaccatgccgattttgaggagctgccggccttatctgaaggagagcaacaaacattggccgccactccagctcaccctgctggactatatgccctcgccgtttgcttcgcgcctgggctcctcgtgctcctactctcggccttcgcgtggcctgctgccctggcaattcttcatccaagcctattgcctgtggctattgttggtttcttcggaaagctctc

SEQ ID NO: 3421 - DNA, 1011 bp, Triticum aestivum
  Clone ID: PAT_TA_3421
gaaggcggcccgggggcgctcgcctctgccgcggcgtcgtgccttggtcggcgcgggcggccccccgcctcgccgcgtcccggccggctcctccccctctgcccgccccgccgtcgcccccccgggctgggtggtcccttcacctgcatcgccgccgcctcctcccactctcgtcgtcgtcgtcatgcagcaccagcgccagcgcctcttcctcccccccctcgtcgccggtcttgctgcgggacggcgtaaattgccgcaaggacgaggcaacgatggcgacggcggcgcccatcctcgccgtgtccaacgccgtctcctctccctctaatcgccccgtcgtcacgcccccgggctgggacccttcacctgcatcgccgccgcctcctcccactctcgccgtcgtcgtcatgcagcaccagcaccagcgcctcttcctcctcctcgtcgccggtcttgctgcgggacgacgagctggaccaccaggaggagcccccgcccgcttcggaggccgactcgcggccccgccgcatcgcgctcttcgtcgagccctcccccttcgcctacgtctccggctacaagaaccgcttccagaacttcatcaagtacctccgcgagatgggcgacgaggtcatcgtcatcaccacccacgagggcgtgcccgacgagttccacggcgccaagctcatcgggtcctggagcttcccttgcccctggtatcagaaggtcccgctctcgctcgccctcagccccagaatcattggagaagtcgctaggttcaagcccgacattatccacgcctcttcccctggtatcatgcgcctcggcgccctgggcgtcgcttcggtgcgctgcgtccctctagtgatgtcctaccacacccatgttccaatttatattccaaggctatacattcagctggcttgtcaagcccatgtggctagttataaaattcttgcaccgagctgcggatctcacactggtaccatcagtcgctattggcagggacct

SEQ ID NO: 3422 - DNA, 604 bp, Triticum aestivum
  Clone ID: PAT_TA_3422
ctcactccgccaatcccctctcttcctcctgtcgcccccatggcgccgctgcccctgcctcctcacctcccgtggccctgccctccccgtcgcgtctcttctctccatcgtcagtcgcggaagccgccaccatgctcgagagcgcggcgccggctctcgatccgtccggcagaagcagacgctcgatgcagcgctcccccgtccctccccctcctgcatcagctgcaggcgctcgattcagtgctctcccgtcgctcctcctcctccattgccgggaggggcgcggccttctttgcgccgctgctccagccccccctgctccaaccctaaccctagcgttgctgctgctggtcaaggtgcacacgcgtccaggtggccaaggtgtctcctctaccacttcagacgtgtttagtcagatccagaaggtggaattcagctttctcattggaacagtcagaagtgcaaaagtctacagagatttaaatgagttctggaacaaggaatacaataatcacaaggatggaggctgaataaggcaggtcatgggaggcctttgatttgttggatcagtctgccctcctgctaacaagaccaaggaagaaaa

SEQ ID NO: 3423 - DNA, 459 bp, Triticum aestivum
  Clone ID: PAT_TA_3423
aaaatcctcctactcattctgaatgtcaagttgccgcaaatatggttttcttttgtttcaccggtgctgatgattttctgctaacaatgttttgtgtgagatctggaccaagcaagatctgtttcatgccaaaaacctaacatggtcgtatttttaataatgaaataaaatgttctggcttcacccgaggatgaaggtagtagaacaaaagaggagccgcatcttttcctggaagtaaaatttgcagttactgatccagcagaacgacgtaattagaaggggaatgaaaccaaaacgcggttctgagtacctttcgcccagaacgtgtaatggagcaaaagggaacatcactggccagattgtaagagcatccctagtggcttgtctaaatttgatagtctatatctacatatacacaatggtgtaaaaagatttcttttaaaaaaaaaaaaaaaaaaa

SEQ ID NO: 3424 - DNA, 1394 bp, Triticum aestivum
  unsure (1)..(1394): unsure at all n locations
  Clone ID: PAT_TA_3424
ctgcaggnaattcggcacgagggccacgcgtccgcccgcgcgtccgctcgctgttgtctgtcctagacatcagaggcaccagggaagctcatcttcttgcatcaatgaaaaagaggcaatcatgtctttttgaaggcatgaaaaaacacttggaagatgggtgtgtagttgcgctcacagcatcatctgattcttctcgttccgagacaagcagtggaaacagatattcacccaagccaagtagtggagatggagcttcacccctatcagacattgacagtgcttctgttccaacatatctagctggtaatcttcaaaacgcatcatctgcaataggaattgaagttgggaggagaagtgatgagaagatgttgaagtgggaaaggttgcaagcgttggataaatggatctggacttctttctattcttccctcaccgctgttaagtgtggcaagagatcatttaaggaatcactcgttcattgtgaaagttgtcatgatctgtattggagagatgaaaaacattgcagaatatgccactctacttttgaggttggttttgatcttgaagaaagatatgctatacatgtggcaacatgcagggagcctgaggatttgtacgatgtgccaaatcataaagttcttccttcgcagctacaggcacttaaagcagccattcatgctattgaggcacgcatggcctacggcagctttcgctggtttgtggatgaagtcttcgcacaacctgtgggttaagcggctgcgacgaacatcatcattacccgagcttttgcaggttcttgttgattttgttggggcaattgatgaggattggttgtaccaaagctcatcagcagtaagctttagttcatatctggatgacattactgtatacttccaaacgatgccacaaacgacgtctgcagttgcactctgggttgtcaaattggatgccctcattgcacctcatttggcacaagctgattctggcagaggattaggcaaagggtccatacagacaagagcgtaggcatgcttgagatagctaggaagggactagatggattattttgtgtggtgccccagctgccactactctttttttgcatcagtttcaatcttttgattgatgcccacgctttttctcaaggcgagacaagcatgatgcccttttctttgccttcatcttgatgccttcaggtttgaggttatgatcttgaactctgcagaagccacagcatctccgtaggatggtgtgtgtacaataatgtaaacactaagaaattctttgttaataatcattgctccggccttgtaatttcctttttgtacttgaagtggtcagcgaggcacctgactggataaaacaatacctattttcgtggaaaaaaaaaa

SEQ ID NO: 3425 - DNA, 1077 bp, Triticum aestivum
  Clone ID: PAT_TA_3425
ctcgatacacgctcgtccccctcctccaccttcttcttcttcttcttcttcttcttcttctacctcccaccctcctaccctccacatcctcgtcttctgttggctcttcgcgcgcgcccaagctcactcttgacctctccgtcccaccgacgccggccacccaccgccggaacgacccgtcgtccgttggctagcgagcatgcagagcatggatttggtgtcgccgtccgagcacctctgctacgtgcgctgcacgtactgcaacaccgtgctcgcggttggggttccatgcaagaggctgatggacacggtgactgtgaaatgcggccactgcaacaacctctcctttctcagcccacggccgccgcccatggtgcagcccctctccccaaatgaccaccaccaccccatggggccgttccagggatgcactgactgcaggaggaaccagccgctgccaccgctggcctcgccgacatcaagtgatgccagccccagagctccctttgttgtcaagcccccagagaagaaacatcgcctaccatctgcctacaatcgcttcatgagggaggaaatacaacgtatcaaagctgcaaagccagacatccctcacagagaagccttcagcatggctgctaagaactgggcgaagtgcgaccctcgctgctcatcgactgtctctgcttccaacagcgccccggagcccagaataatagtgcccggtcctcagctgcaggagagggccaccgagcaagtcgttgagagcttcgacatcttcaagcagatggagcgcagcgcctaaggcatcataagcatgctggaattaattagtactgctaccgcatgcatcggtcacttatcagctagctcatcatcatcatccgtcgctatgcatatatataatgcataagcgcacgcgtttaatttgtgtttggttacttcgttgctgctgctgctgtgtcgttaagttgatggtgttgtctgttatatttgttgttggagcgtacgtactcacactttaattatgaacagctgctaccttataatatttttcatcgaaattaaacttggctgtaa

SEQ ID NO: 3426 - DNA, 263 bp, Triticum aestivum
  Clone ID: PAT_TA_3426
ccatggccgccgcaccgacgccgcagcccttgctcccggtgaccaacccctcctccgggggcggcggctctgccccgtccgccggcagcggcctcaccggctccgcgccccccgcgccggccttccggctcttcctcagcagggtctccgacacggcgcggcgctcgctcgccgaccgccgcccctgggacggagctcatcgaccgctccgccatctcgcggccggactccctctccgaggccacctcgcggctgcgccgcaa

SEQ ID NO: 3427 - DNA, 793 bp, Triticum aestivum
  unsure (1)..(793): unsure at all n locations
  Clone ID: PAT_TA_3427
gctctcaagncatggtcccaggaatagcctttttgttgtcacgctgggctggtttgtcgactgtgttcgaaggaacatgaggctggacgaatccttgtacagtatcaagaacattggggaaaacggcctgccgctcggggaatccaacaggcttgttggacttcctgttaacgagaagtcatgccttccaccaatgatttttcaagacaaagcatgctcagacacaacacgtaagcaccagcttcaggctcatagagaagaacctgaacatgatgttgttcgtttttacgaatgagacgatctacattgaccctgggatatctggtgagatgaagaagaagatatcggatgctgctacgagtgaagatgcaaaattattggaccactggtttattggttgccatgccacatatgttgtgtgtgaggatgcttctgtcaagagatatgttggtcactcagataacattgtaacaccgttttggatcttgaaaacagtgaaggaaaagaacttgcagcgcctggtccatttgtcttcagacctagctagacatgtggcagtggttctagaaaatttccacatatctcaagagaatacgtatcccgggtgcgctcctgctcttacctccagcgagctgcctgcccgccgggggtttcctgtcacctgtctggggaggcacgtctttggcgtggctgcctacaagggtaggcgtgaccgccgtctccgccgcctgctgtccggggaagtaccaatccatccgctcacacctgtcacacttctggattcaatctgctg

SEQ ID NO: 3428 - DNA, 879 bp, Triticum aestivum
  Clone ID: PAT_TA_3428
catatgcaagctcagaatcaaaggattatatcaaagacttcgattttgcttgggaatggaaatgttgcaaaaacggcttctttgggaagattcgaagcaaacaatgacagtgctactactattggctgttatctactaccagttattcacatgtggttacaccattatcacagcaatggcaaaaattttctcactaacagcactgttcttgttcattcatggcatgcttcctgcaaatgtgtttggccacaagattgagaaacttgagccctcaaacttccacatctcacaggtggaggcacatcatattgcttgctcagtcagttcatcatggaactcattagttggtgtgctaaaatctctttgtaggggaaatgattggccactttttctcaaggtggtattcttcctactggttgttagcatccttagtgctatgtcttcggaggctgcatttaaaataggatttcatataggtattcctctcattttcataggcttcaaagcatatgagaaatgggaggacacaattgacagcctggtgggtgatgcttgttcgttcgttctacagtttactcctatccagatatcttcaaggcagaaacaaacatagacaaggagagctcgttaacagttgaattttattttgtagttatatcaagttttacttttcagttattgctgattttttatgaacttatagtttgacatttactcttttagaatcatcattcagagtcttaataaagtttatagaatgtttccttaatgtcgttgatttaagatatggcggtgtacagttttttatttattctttagatgtttaccccactggactgtattgttctagcacattgaaattagcttttattgccattg

SEQ ID NO: 3429 - DNA, 726 bp, Triticum aestivum
  Clone ID: PAT_TA_3429
tcctgtgcgcgcgcaccgctgcacagtatccacccataaccaaccataagagcgcagcgcaacaggatcagtacgggttgcgctagcttattaggcaagcgagggagtagtaggcaggcactgtgcaggaggtgatccatggcaagcacggtggagtcgccgacgagctcgtgcgtgtcgtcggacacggaggaggaggccgcggcggtgacgaagccgatggtggtggtggggtgcccgcagtgcctcatgtacgtgatgctgtcgggggcggccgaggagcagcccaggtgcccccggtgcaagagccccgtgctgctgcacttcctccacggcgccgccgccgacgtcgccagcaccaacaggcagcagcccagcaagagctagccagccaagatgccgctgcttggtctctgcgtgctgcctgctgatcaaccgctaacttctcctgccatcgatctccaccatgttctaactcgtgtattctgatgcactctgtattctttttccattttcgtcgacgataaatcttttacagcctggtgcaattggttcggttttactgtctgttagcagtggctgtccttctccaacaacctttagatgtactgtatgcacgtgttctgcaccgtgaaggtcgatgtctgttttaatcccctccttaattttggtttgaataagatgagatttccttaaaaaaaaaaaaaaaaaaaaaaaaaaaaaaaa

SEQ ID NO: 3430 - DNA, 1877 bp, Triticum aestivum
  unsure (1)..(1877): unsure at all n locations
  Clone ID: PAT_TA_3430
ctcccccctctcacctcccaacccaaaggatccctcctcttcacactccgtctcgccacattcggagctcggatccaaccactgcttatcccacccgatccctcccaaatcacccacgcacccgattcgctcctcccctgcaaagagaggtctatacccctaccttgattcggcggccggcgccatggcgagcggcagcgagcagccgcaggcggagaccgagcccgaggcggtggagctcgtgctgttccaggtcgccgagtgctacgtctatctgatacctcctaggaagacggccgcctcttacagggctgatgagtggaatgtcaacaaatgggcttgggaaggggcacttaaggttgccagcaagggagaagaatgtatcatcaaactagaagacaagagcactggtgagctgtatgctagggcatttctgagagaaggcgaaccacatccggtggaagctgtaattgatagcagcagatattttgtacttcgcgttgaagagaatatagatgggcgtcagcgtcatgcttttataggtttaggcttccgtgaaagaactgaagcatatgacttccaagctgctctacatgaccatatgaaatatctaaacaagaagaagaccgctgaagagatggtgcagcactatgagaatacgtcatcagtggattatagcctcaaagaaggggaaactttagttcttcaactaaaaaataaagaaagtggcagcaagacaaaatctgcatttttcgagcaaggcctgaacaagctgtcgttcaatgaaaaagcaaacaccaaggaggccacagtgtccctcaaactcccaccacctccaccctcacccgtgtctccaactgattctggagttgccatgtcccctttcaaagcagaatttccttcccaggaacaaccaggcaccggcgatgccagagacgccgccgctcctttcaaagcagaatttccttcacaagaagaagcactggatgataccgtggaagctagagcggaagctgctcctcgtaatcaaccagccgcagcagacaagagcaaacaaggaagcgtggatgatgagtttgactttggggacttccaggctgctgcttgaatcatgtatcctgtacatacgtcaactttattacgtggacacatacatgtgtcctttctttttcttggatctcccgtcagttgtgacttttttttcgccacccgagttgttgtacagagagctgtcatatgataagccgtataaattaagcaatacatatataagccgtggaacatctaaacaagaagaagaccgctgaagagatggtgcagcactatgagaatacgtcatcagtggattatagcctcaaagaaggggaaactttagttctccaactaaaaaataaagaaagtgccagcaagacaaaatctgcatttttcgagcaaggtctgaacaagctgtcgttcaatgaaaaagcaaacaccaaggaggccacagtgtccctcaaactcccgccacctccaccctcacccgtgtctccaactgattctggagttgccatttcccctttcaaagcagaatttccttcacaagaagaagcactggatgatatcgtggaagctagagcagaagctgctcctcgtaatcaaccagccgcagcagagaagagcaaacaaggaagcgtggatgatgagtttgactttggggacttccaggctgctgcttgaatcatgtatcctgtacatacgtcaactttattacgtggacacatacatgtctcctttctttttcttggatctcccgtcagttgtgactttttttggccacccgagttgttgtacagagagctgtcatanataagccgtataaattaagaatacananatna

SEQ ID NO: 3431 - DNA, 1261 bp, Triticum aestivum
  unsure (1)..(1261): unsure at all n locations
  Clone ID: PAT_TA_3431
gcagttacctcgccaaccgtactggctcccatcacccgaacaatttcaaaggcctcgcggccccaggttcatcttggcctgaaatgaagattgaccgaaatttgcctggtgataacagtagtgctgctgttttgttcgataaggagaaggctactactaaagatcaatgtccaaactcagaggaggttgaagctcaagctgaggctgaagcagctgcttctgctgtggctgttgcagctatttgtactgatgaggcagttggaactgcagcttctgcttcagacaaaaatagctttagcagtaaggatctcactcggttaacagccggaggggcaataacaggtcaacctggtcaatcatctggagaggagccactgacggttgctcttccagcagacctgtcagttgacactccgtcaatgtccctgtggccttctttaccaagcccacaggtgccagggccaacgctttctcagttccccattgcacagccgtctcacgtctcttgtttcgagatgaacacaatgttaggagcacatccttttgcatttgggcgaagtgatgaatctgccggcacgctcgggcaacagcctcaaagaagcaacgctttgccttcagcacagttgggtgcttggccatctatggtggattcattttatcgtccccctactggattcgctggtcctttcattagccctggaggaatcccaggcgtgcaaggtcctccacatatggtggtctacaaccactttgccccacttgggcaatttggtcaaatggggcttggttttatgggagccacttacattcctggtgacaagcagcctgattggaagcaaaaccaaggaccttctgttggcgtcagccagagtgatccaaacaaccaaaatgtgctacctggtcaagtaacctcacccagttttcctactcaagtgccacatctacgtgcaacttctatcatgccaatcccatccccgctgacaatgtttgacatggcttcattccaagtcatctgcgaaaatacaggtgcaaccttgttggccacgtgtgcctatgcactctgtcccgttgtcaagtgcaactgcaacagcatccaatagatggtatagcagcatcacagttaggttgataatgtggtaattgacaagtcaagtacaaatggggcggttccaggagccctcaacatcagatagcaacaagagttcccagtatagctgcctccaatctcggtgttaacagcagctcaacagtnagatctcga

SEQ ID NO: 3432 - DNA, 386 bp, Triticum aestivum
  Clone ID: PAT_TA_3432
gcctgacaagccgcggcgggctacactgacactacgccggccgagcagcccgccgccgatggcactaaggtcaaggtgccgcccggggaggggaaggcgacgacgcccgagcagaagttcatcgagaaggtgaaccaagcgttcaagaaggctctggacgcggccaacgcggcggcgcccgacgacaagttttcggtgttcgacgccgccttcaacagggagatcaagcagtgcctcgccggcatgagtgccaaattcatctccatgatcgaccgcgccttcaagatagcgtacaactccgccgtcgccgccaccaacgcgcaggaaaagttctcctgcttggtgctcaccctcacagaggccctccgcttcattgccgccaccct

SEQ ID NO: 3433 - DNA, 1996 bp, Triticum aestivum
  Clone ID: PAT_TA_3433
ccaggaatccgcagccgtcgccttcccttccgcccctcctccgccccctcccacaccctccgcccctcgccggctcccgcgccgcccccgccgcagccactcccggccccccgctccctccctccccctcctcgccgcacccccggccgccgaccatttcctggaccatgccctcggtgaactacctcaaaatcataacaactcagaacacctggactttttcaacactccggcgcagtataatgcgaagcccggcgctactccatagaacgaagggcgtggtaaccagtatgacgaaggagctcgggatacatacagcccggtgcccacttcttcgcccgccccgggaccagaaactacggacgacgagcaactcgccgaagctgacaacgacgagctccctcacaacctggacgagcaacagcaggccaactcgagggtccatacagtggagaagagcggagaaagtggtgcttgagataacgtcgtccggatacgagtcccatacgatgagggtggtggtaacatttgccgcgatgcggagcctatcacaaggaggggcgagcagcataaaccgcacatagaagtactagaaaaccctcctcgaggagtctaaagatcccatgaaaatagtcaaggagcaagaaagcttgcacgtagaaggtgtagatatgtcggcaacggatgagccagatgaaccgatatctccagctatggatggcttgcttaaaattcataagcggataactgatggttcagatggtgaatctggccagctccaacggggtgctagtaatgtaggaccaacacgactgctagtgccagcttcccaagctggcagccttattgggaagcaaggagcaaccattaaatccatacaagattcttcaaagtcagttgtccggattgttgaaaatgtgccccctgttgcactaaatgatgatagagttgtggagatacaaggcgagcctcttggtgtccacaaagcagtggagttgatagcaagtcacttgagaaaatttcttgttgaccacagcgttctcccactatttgaacagcaaatgaaaatgcacagtgtgcagagagagcagcccatggcagccccacagcattgggcgcctcctcaaccctgggttcctcctccaaacctccctcctggtggtccaggttatggtggaaatccacagttcatgcctccaaggccacaagacaactattatccccgtccagatgtgccgcctatggaaaagcagccgcactatggcatttctgcatatggacgtgaggcaccaccaagtggtacttcaggcaatcaaccaccactgcatgtggcctctcaggtacataacatgcaaattcctctctcctatgctgatgctgtgattggggcggctggtgctagtatcagctatatccgtaggcacagtggtgcagcagtaactattcaagaaagcagaggcgcacctggagagatgactgtggagataattggaagcgcatcccaagttcaaactgcccagcaactgatccagaatttcatggcggaagctgctccacaaacccggccaccggcttccaaccctcctgctccgccagtcgatccgggttacagctcttacccgccgccaccatatggggctcctcccacaggtgcaggaggccctgctcctcacaatggcggaggctacggtggcggctcctcctaccatcccagctatggatactagctgtatcagcaagcgaaatgatttgctccatctctattgtgatggttgattgtttttattgttgctcaataattacattcatggattcctgcctatcaaattagtcagtctggtgtatggttggtcgcatactttgttagtatgtttaccgtcgtgacatgtggtctatagctgagctacctcattggatacaaaatacatgttgagttgagttggaacaatctgctaaatttggaagactgggtaaaacaaataaatcgaactaaaaa

SEQ ID NO: 3434 - DNA, 634 bp, Triticum aestivum
  unsure (1)..(634): unsure at all n locations
  Clone ID: PAT_TA_3434
gaagaagaagaagaagcggacgcgtgaaacgaaattgggaggagagctcgtgagggctcccaaattacgtaggagataagcgaaatccccaaatttctcgccccctcccctccccgtccgcagtcgttcgagtggcctgcgagcgagcgagcgagcgagcgcccccgagctccgtcttccccgcgcgcagtgcgagcgtgcagccgacgccgagagcttggctttgttgctgcttttgtgtttcctggctgattattttctttgtcttttgtccgtattttctcggtattatcctgatttgcggtgatttctcggtgattttgccgcgccctcgctcgggcgggggatctgtaatttctgcgcctggtctgccgaatcctctcgcccggggcttggattacaaccacccgcattttttccatttcgctccgggttacgttcctgctcccgtttcctttcgtttctcctcattttcccgtcattggcggctcctccatgcccccaagatagggtgctcctcgtccctccgccccaacccgttccccggntgggttaaggttctaaactgcncgaactgctgtcnctccgggangacttggctcgctttttnagaacntggngtaggngccagacn

SEQ ID NO: 3435 - DNA, 595 bp, Triticum aestivum
  Clone ID: PAT_TA_3435
ccacgcgtccgcggacgcgtgggggaaatgtcggcgcttcatcccggaatgttgtagacctggtggcgttgtctggtgaaccagagttctccagccatattaagccttgttggtttcgacggtaccgaccataatggttaaatcatttcaagcttacctgctaaatttggggtacagtgcttgttcatcttgggcattaggttgcttcttccgccgataggacgccctcctcagggcgtttctatggtctctcttgcgttcgtcttccgttttttgctctgttccttgggtgtcattcaagattacattctcatctggtgtcattcagggcattcccttatattagagaataaaacggttacatgccagccattgttgtatgagtagcctcgttatgcccccctgggcgctcctgctcattgctgggcccgggcgtttccgtccctgtcctcggaaatgttttacacctggttgggttgtctggtgaagcaaaattcatcagccatattaatgcttgttggttacgacggtaccgactataatgtttaaaacatttcaaacttacctgataaaatagggatacattggttttcat

SEQ ID NO: 3436 - DNA, 856 bp, Triticum aestivum
  Clone ID: PAT_TA_3436
agtacctattggcgctatggacccgcatgggcatggaggaccaggtggaggaggccctggagggtggggtccggtaccacctggagggcctggatttctcggtggccctggccctggttcttgggggcctggatttccgggtggctttggccctggttcttggggccctggattgcgcggtggccctggccctggttggggatctggattcggtcgctttttcggatcctgcttctatcatctctgctgctgctgcctgctccaggactgctgtggccctctattcggacacccaggcccaggcggtccaccaccccctttctgatagcctgccgagctggggaccttatctatggcgagaaactattcctgggctaaatatattcactgaagaacccatatgggtgaagatattacatcttggatatttcccttgctactatgtaaatactagtgaaaataaataatggtctttgtatgtctctgatggagatcgttgcttcagtcttagcctcttaggtagtaccgggtactagtgttatttcggatactgaatgcaattatcagggttctctaaactttgtagtaccttgctgatgcatttcaccgcctagcatgtgagataagctacaatctcatggtagttcacaaactcacaccaaccggggtaaataaggcagaaactgcaccggatgatctctctagccagcatcaacccatcctggagctagtaatccattcccagagggttctgtttgtttgtattaattagacttctgcaatgaaaatgtatttaacccttgaagcattgttgaagagagatttcctctatttcttgaaaaaaaaaaaaaaaaaa

SEQ ID NO: 3437 - DNA, 493 bp, Triticum aestivum
  Clone ID: PAT_TA_3437
ccctcctctcgccggggaggtgatcccgccatggcctcctcgctcaaggtcgccgaagacttgctcgaagtggtcgaccggagggcgaaaagcgtggccaccgagctgtccgatgagcagactgctcctcagccttcaggaccgaatggccaagaagggcaagcaaagaggggaaagcccagggagaagggtccagtggagctcactactggggatgcaggtaacaggacagcggctcagaaggagaggaaaaacaggcaaccgccgcgtgagaggattaagattgagaagatcaaaccttcggcacgtgcagattcatcaaatgatgatgctattgctattcccagtgccagtgaacctgaagtcacttcagttgatgttaagggagcgaatgctgagagcacgtcggacaaagtggagaacgccactgttgaccttaaaaatgatacagctgctaatgctatcgataatgcggttgaagtccagtcgatgg

SEQ ID NO: 3438 - DNA, 716 bp, Triticum aestivum
  unsure (1)..(716): unsure at all n locations
  Clone ID: PAT_TA_3438
agggaagcctgttgctgtgagctggaactcagttcagaaggcaagggcagtattggaggaagaaaaaattaaaacaactggacatggagatagcagtttttgcgccacaactcttcaaagtgaaacgccaaggtctgttttgatgagtagcagtttgatcatgactgatagaagtgttacaccgaatggagatagcgcagtgcaagtcactcgaatagagaaaagccacgagggtggcaaccacttgcccttgtttcaaactgggtcagggaggccaattgctataagtaagagctcagttaagagggcaactgcagttctggagccaaggaatattgcaaaggaattggaagatgaagctcaatttagatggtggccatgacactcccatgttcaaaactgggtttaagaagnccnaccttaacaagtgatgaattgtgtanctnaaaggctggaagaagcatccaaaatgttaaacaattttnaacgngaaccttttttntaanagcancttccaagctgggatacaaattttgtacccccaaatanaattcnantcataagncatttctttttgggcaacnaatncaccgggaaaacgtggaggcaactaccanttcaaacggtttggnaatcctctgatatgaaccnaancaaaacaangtntctggggaaaccaaatanaggaaatanacccctntgtggaaaaaatccgt

SEQ ID NO: 3439 - DNA, 1638 bp, Triticum aestivum
  Clone ID: PAT_TA_3439
ggcggcgtcggcggcgctgcggctggcgctggtggcgtacggggagcggcaggacgcgcacctcgaggtgcgctacacggacgtggactacctcgtcttctccgacgcggcggcctccgtcgccgccgggggctccccgttcgcgcgcgccacctaccgctactccccgctcctcgccttcctcctcctccccaactccctggcggcaccccgcctggggcaagctcctcttctccgccgcagatttgctcgttgggttgtgcatcgacgccattctcgagctgcggggcgtcccggcgaggacccggatctggtgcgtggtggcctggctgttcaaccccttcacctccaccatcggcaccagagggaactgcgagcccgtcgtctgcgccgccatgctctggatcctcatctgcttgatgaagggtgtagagtactgcaagcagcattctggtatgggctgattgtgcacttcagaatatacccaattatatatgcaatcccctttgttatagtccttggcaagaattatgccggtcctgctggtagacctgtccttacacagtggagttcgaaacaacagttacaaagcgataaagccagggaaaatgtggaagaaccaacatcactcttggcgactctatggaattttctcagtagcctcataacaagagataccatcctgtttgggttgttctctggatctatgttctttgcttggaccggcgtctttttctatctctatgggtgggagtttctaaatgaagcgctcctttaccacctcacacggactgatccaaggcacaatttctcgatatacttctatcacatatatctgcaccatcagcaagggttctcaagcatacagaggctggcttcgttcctgccgcagctgatcgtgcagttggcgctcatcatacgcttctccagggaccttccgttctgcatgttcctccagacagtcgcatttgtggctttcaacaaggtgatgacagcgcagtacttcgtgtggttcttctgcctgctgcccctcatcctcccctggaccggcatgaagctgaggtggaagggcctggtctgcgcgctggtgtggatggggtcccagctgcactggctgatgtgggcctacctgctggagttcaagggtcggaacgtcttcgtgcagctctgggccgcgggcctcgtgttcctggccgccaacaccttcgtgatgatcatggtgatcaggcaccacagtcacaccccactcttctcggcgccggcggggcccaggaccaagattgccgccaagaaggaatagccacgtggctacgtagtttactttctttgccaactgatgactgtactgttttccgataaagtgatgattgtactgttgccttgccttagcatggaatggatcttgcctgagttgcagcatgctgtagctttgcttctaataggatataaacagcaagcgtacaatagtagagtaattctctttttaggtgttcatcaataggagttttctgttcaccggaattttgaggtatggctggccaactgtaatgggatttatatgtactggaattaatttgtaattgcttcggcatagaaaacgttgtagtacctttgtgttttttttttggctgggaattg

SEQ ID NO: 3440 - DNA, 966 bp, Triticum aestivum
  Clone ID: PAT_TA_3440
tgatatctacctttgggctattcctgatattttcagtgcagaaaattcctcatcttcgagtaatcagaatctaccacttcagaggcttaaccttggatacaagctagacaaggtgccaataatctctttgagatgggttccggctcgtgggaagtctggacgtttgtatattaatggattcagcgaacatgcatacctataccaggtcctgattctgaatgaagagagtgaatctcgaatagtaaagatggtattgcccctcacagaagcttgtcaaggaatggagtttgttacaggccttagcgacccaaataagcaaagacagactgttcttgttctcttgttgaaatctggtcaaatctgtttatacgatgattcagaaattgagcgctaccttcttcaatctcagtctagatcaccaccaacacttccaagccactcatttgtgaaacaaccgtatggtgattcgggcatcaacgttgcaaagttctacacaagtgaccgtacagcaacagctaatgaggattatttttcaacattggcctccaaatatccatggctgctttcactgaaggataaaggtcagatatccgcaagtcttagcaacatccataaaaccaggaatctttatataactgggcatatggatggaaccataagcttttgggatgcatcatgtcctcttctgctgcacatttttatgatggagcagcagcatgaagataatacatcaagtcgagcccgtattacttcattgcactttgatacgtcctccagtattcttatatctggggatcacggtggaacagtccgcgtaatcacattcaaaaaggactctagcgacaatatattatccattttacaaggaaagcaaggggataactacgatgcaagaagtataaagctcaagggagctgtaacctcaacctctatgatctctaactcgaagcattttgctgttgggac

SEQ ID NO: 3441 - DNA, 1740 bp, Triticum aestivum
  Clone ID: PAT_TA_3441
gcggggacgcgacacaagaaccacccaccacacagttgaagagatgtttccagtgacgggttcgccgaaatgcgttgctttccgatcaaagcatacccgcaagtaccttggtagcgtgcatgtagggagcgaggagagcgccgtcggcggaggcaggttcttcgaggagctgagcgacggcgccgacgacgtcgatgtccttgcaagcccgtacactagattctacctggagccatccaaggagcacgacgggctcctgcacgtcaggtgctgccacaacaacaagtactgggtggccaaacatggcggtgaaggcagcggccactggatcattggcatcgtcaatgaaccgaacgacgacctgtccaagccgtcatgcacgctttttgagcccgtccctctcacggacggggacaataatctatccatcaggttcttccgtccccagcagacaaccagctctgaatctgagatggtcatggaaaaggagacagcagaagaagcctacttgcgtctgggaaccggagggcatgaaaaaacagttgatcaagtgaaatctcttcatgacttctccgccattgatctgtcgaagcaattggtactgcccaaatatgttgcttttaaaggcgacaatgacatgtacctccggcctaggttcgtccagaaataacagttacctggaattctcatcatgtgctagggcagattcaactgtggtcaacactattttccccaactatgctaatggaaacgtgcgcataaaatctaaccacttcaacaggttttggaggctcagccccaactggatctgggctgactccgccgacagcagcagcagggaccctgccgccctctccaggatggtcatgttgcctgactacatcggtctccagaacctgggaaactccaggtactgcaagaggctaactgccgacagaaagacaagctgccttaacgccgccgtcgataccatcacactggaagcaaggttacgggtggaagaagccgtactttcacgagagatctatggcgtggtgttcaagctctccgaagctaggatctacggcgagaagcctattacctttcccagcatgacttcaaccaatgacaccaacgaaccacatgccaagaccctgaccctgaaatacgaggagacgcagggccaagacctggagctcgactgttagcctcaagatcggtgtcacggccaagttaagagccgggatcccagtcatagcagaagggaaggttgaggtatccactgaattcaattcagaatacgagtgggggtcatccattcatacaacggcctcacaagaggcctcctaccatgctgtggtgcctccgatgaccaaggtgacagtcagagcggctgtgacacagggttctgttgacgtcccgttctcctacactcagagggacattctgaccacaggagaggttgttacctacaagatggatgatggtctgttcactggtatgaacaactataatttccaatttgaagccacacaagagcccatttgaagtgacgatgcatgcattagttagccgtattaaataaagccatccctgccttggagtggcccggcttttctgtgtggtgatttgatggtgtgttgtgactttcattttattttttagtttgtgggttgtgtgctcttatatgtttccctttacccactatatacatttctatttggtgtcgacagaatattgtgccccctccgtttgctttat

SEQ ID NO: 3442 - DNA, 857 bp, Triticum aestivum
  Clone ID: PAT_TA_3442
ggacaatgctgcatggattggagctgcccttgtactatgtggaagccttactgtacagctattcgggtcagctcccgaaaaatcccagaaagttgaatcgtgcagcgggaatacatttgaatccccactgaaacggcaggaccacttgtccctatctgctatccccgtcgattccagtaagaacatagggagccaggtagagaggaaggataaaacattgtagcccaggtcgaggcagtaacacatcctctaaagacaaggtcaagaactcatgatcgcgactgtatgtaaaccaaaaaagggccttataatctggcacatgctttggttcatcaagtagatgcaattgcaaccagcgtttgctccacagggaaagcttgacattcccatgatctccgaggttagttgccacttagggcatcaactggactaactagtgactagagataatccaatgcctggtacatactagaaaatgtggcatttccggctcgaggctcttgtgcatgctacagcacgccggtgtaaagtggcaactgcaaatgggaacattgtgtgtagattccgtgtaaatatatttaacatacgtagcaaggatgatagtaaatgatcacatgtaagagcactgaacatgctaccgttgttgtcaatattgtaagtctgttggtaggggtactggtttaaaccatgtaactcgaatcttagacagtcgatgacgatctgctttgatgttccatttgtaattatgtagtgctgaaatcatcataccttacatgagtatttcttcaggtgcatacattacatgactttggaatgtataacacatcaatttcatgcttttttatgtaaaaaaaaaa

SEQ ID NO: 3443 - DNA, 613 bp, Triticum aestivum
  unsure (1)..(613): unsure at all n locations
  Clone ID: PAT_TA_3443
agactttgagatattagcattcccctgcaaccagtttttgcgacaagagccaggcagtgaccagcagatccaagactttgcatgcacaagattcaaagctgaacacccagtttttcagaaggtgcgtgtaaatggcccagatgctgccccgctttataagtttttgaaagctagcaaacctggtttgtttggttcaagaatcaagtggaactttaccaagtttcttgttgacaagaatgggaaagtaatcaacagatacgcaactgctaccactccattttcattcgagaaagacatccagaaggcacttgaggaggaaccctccgagtcgcagacaaaaaaggaggaggaatcttctgactcgcagaagtaggcacttgcaaagtatccccgttgtaatatctagaccaatctctgccagtaaattaatgtgatatttcccctggtttgatcattgttcttgtatttgtgacttcctcttatgtaagtagaggttgtgtagctatcaattatttatctgttttgggtgcttttgtcgaggtacacgagctattgatgaactggaatcgtatgcagtttatggtagaacntgtatttgggctcaananaaaaa

SEQ ID NO: 3444 - DNA, 918 bp, Triticum aestivum
  Clone ID: PAT_TA_3444
gcacgcgtccggtcgcatcaaatacacgtaaatcctctctctattctctcccctaaagaaacacgataaaatggggcagaggattcgggaggacttccgccgtccgggaggcgaagagagggcgagatgggggcgtccgaatctgtgctggagacctccgtacacgaattcaccgttaaggattgcaacggcaaggaggtgtgcctggacacgtacaaggggaaggtcctcctcatcgtcaacgtcgcctccaaatgcgggttcacggagactaattacacgcagctgacggagctttatcagaagtacagggagaaagactttgagatattagcattcccctgcaaccagttcttgcgacaagagccaggcagtgaccagcagatccaagactttgcatgcacaagattcaaagctgaatatccagtttttcagaaggtgcgtgtaaatggcccagatgctgcgccgctttacaagtttctgaaagctaacaaacctggtttgtttggttcaagaatcaagtggaactttaccaagtttcttgttgacaagaatggaaaagtaatcaacagatacgcaactgctaccacaccattttcattcgagaaagacatccagaaggcacttgaggaggaaccctctgactcgcagacaaaaaaagaggaggaatcctccgactcgcagaagtaggcacttgcaaagtatccccgttgtaatatctagaccaatctctgccagtaaattaatgtgatatttcccctggtttgatctttgttcttgtatttgtgacttccgcttatgcaactagaggttgtgtaggtaccaattatttatctgcacctctcgtggttctcttttgggtgcttttgtgatgaactggaattgtatgcagtttatggtagttctgtatttggactc

SEQ ID NO: 3445 - DNA, 1744 bp, Triticum aestivum
  Clone ID: PAT_TA_3445
ctagcctcgctgccgcaaaaaactgaacgaaaaagatatatacacataactcccgatgacatgccacaaagaacctcgaaaacggggaagcttccgaaggtgatgacttcctatgtacaattttcccttgttacaactacaacttcacagcgaggtcatgaaactgataaatgtagcttcaatcctctgtagcagcccctccccttttgttgtagccaacgcggtagcccctggttggtataggaatgccgagtgactcatcaacgctttgtactttccaagcacagaactgcctgtcattgacaaggggattgcttgcacgaactggtggagatcccatgaagtatggaggagaagccttgctcaccataaaatcagagagatcttgtgcacttttaaaatcatactccctgtacggtctgctgcttttgcatggaattggacatctgatcactccatccctgctttctgtgttttggtaggcttccatcattttttctgtcctctgcttctgtagctctttcttttcctccatcgtcccatcaccacggcgttcgagacctctttgtaagatgtaacctgatgacggattcacgacactcatcagatgctccatccccatgtcagaaaaaggaaggaagatgcttcactcaacaaggacctgagcgcgtaggcgggggcgagacgtggagaaccggcagcgtcaggcgggctggcgggcgggcgcgggcggaggggaggggaagcacgataaaattcgacagaggattcgggacgagataaaattcgacagaggattcgggaggacttccgccgtccgggaggcgaagagagggcgagatgggggcgtccgaatctgtgccggagacctccgtgcacgaattcaccgttaaggattgcaacggcaaggaggtgtgcctggacacgtacaaggggaaggtcctcctcatcgtcaacgtcgcctccaaatgcgggttcacggagactaattacacgcaactgacggagctttatcagaagtacagggagaaagactttgagatattagcattcccctgcaaccagtttttgcgacaagagccaggcagtgaccagcagatccaagactttgcatgcacaagattcaaagctgaatatccagtttttcagaaggtgcgtgtaaatggcccagatgctgcgccgctttacaaggtttgtgaaagctagcaaagcctggtttgtttggttcaagaatcaagtggaactttaactatgtttctttcttttacaaagaatgggaaaaggtaatcaacagataccgcaactgctaccccatcatttttccattacggagaaagacatccacgcttggaagcttaaggaggtaccctgccgactcgcagaagaagaaggatgcaggaattctcagactcgcagcaattagacacttgcaaagtattcccgtcgagatatatctctgccagttcagtcaagtaaaatttctgtcatggtttgccccttggtttgatcgttgcttcctgttatttgtgacttgctcttatgtaagtaaaggttgtgtagctaccaattatttatctgtttgggtcccttggttttgttttgggtgcttttgtcgaggtacacaagatattgatgaactggaatcgtatgcagtttatggtagttttgtatttgggctcatcaaaatccacgtaatgcatctcggacccggatattcaaaaactcgtgccgaattcggcacgag

SEQ ID NO: 3446 - DNA, 1065 bp, Triticum aestivum
  Clone ID: PAT_TA_3446
tagacacgccccttacgccgatagcagacggggggaattcacccttcacctatataatcgtcgatagccagacgaaaactcgtacttgcatacacactcctggttatcccccaatgaagccagaggagctcacaaaggaaaacttgtttgctgctttacatggcgtagaaatggtgtattttgatgttagattgcacgagactgctttgcttgttgcagaagagtgcaggcaagccaaagaaaaattcctattttggtcgacgcagagaaaaagagggagggattggatgaccttctgaattttgcatcatatgttgtatgctctgcaaattttcctcaggcctggacaggagcctcatcgacaccagttgctttggtacacatgcttctaaggttacctaatctcaagttcgttattgtaacccggggagaaaaaggttgcttaatgcttgaaagaagtatgacagatgcttctgagactgaggaaaccgatgtagaggatctgctagaatctttagagcagaaagtcgatttgagttctagcatggcaaaatgtgttgcttccaagtcaaatttgagaataagtgcagatggggttggctcgatgagtggcaggttacttatgggtacagctgaagctataccatctgaagagctcatagatacaactggtgcaggtgatgcattcattggagcggttctatatggtttatgcaccggcatgccagttgagaagatgctgccttttgcagcacaagtggctgcttgcggctgcagagctttgggggccaggactggtcttcctcatctaacggacccgcgcctgtctctctagtatccgcgtactggccctccggatcaatatctgtttcctcgttgtctgtggccgtggaataatccgattctggtgtagtaatgccttcagaaatcctgtcttgcttttattgtgaatattgtggcaatcaagaatttacaaggggatacatttttcttcactaacccttgatatatactcgtagggcttccatacctatctcctggtatgatgaagtcaccgcaagcttc

SEQ ID NO: 3447 - DNA, 1944 bp, Triticum aestivum
  Clone ID: PAT_TA_3447
gaattcactagagattagcgtggtcgcggccgaggtcgagctccgactttttttttttttttttttttttttttttttttttttttttgaccaaatccaattagacaattagccacaaagatacacgcttagttcactgtttcgacaagactattctaatctccaaggtcgctgatacatgagttccttccatttgagctccggtacaaaaatatcaagaatgacttttgttttgatcttctaacagtagaaggatttcaaagaaattccccaaaaatgcaatctttttgtttggtaatgttctaagataaggcatgatatttgatcctaaacgggcaccaccatacacaccaccacctaactcttcttggccccttgatagtaaaatacaatctgatcccgatcgaatagcagcacttgccactaccaccaaaccctcctcgcacccttgaccggaaattacctactcctcccatagaaccagctgactttgacatagcttctagcgctggattcacaacctgcccagcttcgcgcaagatcttaacgagattccttgaatattttgcattggaatgggtgaagaacgtgaatgccatcccagtagcaccggcacggccagtgcgacctatcctatgaatataatcctcgatagttgtcgggaaatcaaaattaatctcgcacttaatttcctgcacatctgcaaattcagaatgaccatcatcagcatacatacatgataaatgcgtcaccttcattctaagatgccgagtgaccttatcacattcatcatctgtttcaaaaaatataaagattcggctcccgtccatcagatcatcctaagagtttactacgcctgggatatttttcatgatccgagataacttcaacaatttgctgtatggaatggttagctttaagttcagctgttcctatcattaccttgtaagggttttgtagaaattgtctagccagcgtttcaacttctctcggccacgtggcactccagtacaaggtttgtctgtccggacggatttgtgccaatatttttcgaatctgaggttcaaaacccatatcgagcatacgatctgcctcatccaggacaaggtatgtaacccgacgtaggtttgtgtgaccagcttccagcatatctatcaaccggccaggtgttgcaatgacaatttcaactcctctccttaggtcacgtatttgtggtcccttaggtgctccaccgtagatacatgtgcttctagttctcgagtatgatccaaattttgtagcttctgcctgtatttggacagccagttctcttgttggagcaaggatcaagacaatcgggccatcaccttgttctagtcgaggctgtgcaccaacatgaaccaaaccaggtagtatgtaagatagtgttttcccagatccagtttctgcaataccaatcacgtccctgcccttcaaggccatcggccaaccctgagcttggataggcgttggctccacaaatccggacttagcaattgcttgcatgcagtaatctggaaagttagcttcatggaagaagcggataggcttgggcacctcccggccttccacggtgatatcccggagctgacggtactgcgccacctccgtgtccgacatagcctgcacggcggggcactccacgtagaagctcttctcgaacggtataaggccccggaagtccgccttgggcagggagagcgagtcgagcccgtccctcccgttgctgcctcctctgccaccgccgccacggaagccacctggtccaccgccaccgccgcctctacctctaccgccgtatcccatgccaccgccgtagcctccgccgccctggccgaagccagcgacggggggggccatccgcgtgtccggggcagcgtaggggttctgggccggcccacgcgtccgcggacgcgtgggcggacg

SEQ ID NO: 3448 - DNA, 592 bp, Triticum aestivum
  Clone ID: PAT_TA_3448
cgtcgccggagcgaggtgcggaagaggtcatctgcgcgagccttccccgtcgtctcccatctcatcacatcgccgtcgccggagcgaggtgcggaagaggtcatctgcgcgcgggatggaggcagcggcgaacaagcgcagcggcatcgggtccggcgccacggcggccgcggaggaggagaagggccgcaagaggggccacggatccaccgcgctgttcgtggcggtggactacgccttcctgctcgccttcgccgggttcctctcctacctcgtcgtctcccagatcctcccttccgccatctagatcggtcgcccgtcgtcgtttgcttctggatgcgatgcgtgtgaaatcccgagatcttggctcggggtatggtcacctcctccttgtctcgtttgatgcaatggattccgcgtctgtaacaatcaaaatatgagacgacaagtagctcggatgctgtttctttgcgattttgcatgacgaattgtaatgccccagtcttgccgtgttctagaacaataaaatgcttcagtgttcctttgttcaaaaaaaaaaaaaaaaaaaaaaaaaaaaaaaaaaaaaaaaaaa

SEQ ID NO: 3449 - DNA, 637 bp, Triticum aestivum
  unsure (1)..(637): unsure at all n locations
  Clone ID: PAT_TA_3449
ttttttttttttttttctgtatgtatggtttgcccgtgcgccgtgcctgccgttcgagccacctggaggatttcctcaagtgtttgatgttgtccttgacaaggattgcttcatgcggatgttctccctacaagaactttgggcaatcagaggagaaggacatagcatggaagaaatgtagaggatggagatctatcgagacaccagagggcggcagtatccgagttttgttcatgagtccatggtggcgctggtgatgggggaaggaggggcaaggaagaagacctagttatatgcccgtgagctggatccagatctctgaaggtagtgggtttggtttcttagcagggtcaggcccgtttaattttgggttgtatagatggcaaaacatcagaaggggtttcagcgctggatcagtgatgtttttttccttttgggctgattcgagctgacgcttagttcaggtcagtccattttcttttgctttccatcattctgctcttctttanggaatctgactgacaccattggcgagtcagtcgattgacttgtagccgctcccatccaacatatatacttcacggccaaaaagaaggcatgcagttaaacttaaaaaaaaaaaaaaaaaaaaaaaaaa

SEQ ID NO: 3450 - DNA, 714 bp, Triticum aestivum
  Clone ID: PAT_TA_3450
cttaaccctccaacctctctcgcgcgctctccgcaacccagccacggccacggcgaccccgcttacccccctcccccctcctcctcccgcgcgtcggcacatctccgcggcccgccatccccccctgcccgacaggcgactgtccggcctagccaccgctgggaggcacaccattattctgatgcaaccatcccaaaacagcagctccaggacgttcatggattataattcaattaaccatgcattggatggaatctgtggtctctatgaaaggaaaatcagggaatctcaacccaatgatcccgaacataacctgtgacatcaccgacctgtacaacttcatcgacggcctagctgacatcagtgcgctagtctatgatcacgaaatccatgcgtttctgccatatgaccggcagtggataaagcagaagctgtttcagcaccttaagaggctggctcagagatagtgactgctgcgtggtgtttggttcagtatgtcgtcaccggcaggcatgtgtgataatttgtgtccgattagtccaccagaatggtttttcttgtacaatgatgagaatttcacatggcatgcttatattctgggtgtgaaactcataggttgatggtggtttgcctccggcaccctatatatatgagatgaacgtatatttgttgttttaaaaaaaaatgtgcgtcaacgaatgcttcaggtaccaa

SEQ ID NO: 3451 - DNA, 766 bp, Triticum aestivum
  unsure (1)..(766): unsure at all n locations
  Clone ID: PAT_TA_3451
cgtccttgcccccctgcctcccttccccggtgccttgtctggtctcgccagcctcgcccccttcccttctagctcctctggcctcttcagccccgtgtcccggtgcccgtccggggccagccccgccccacggccgcagtgccctggtcagcgtgcgccgcttccacccgccccccgtaccctgcctgcgcgaaccgtggcctaccccggcgccccccccggcgtcgccggccgccttccccggccccccgacgtcccccgccgccgacgggggccccgcccggccccccgtcctggccctccggccatctctccccggcccctccccctccgcgccgccgcggcgcaccgacgagcgcaagctagagaacctggcctacgccctccaagacggcgggccgtcggtggaagagtgcatggaggccatagcgtccgttgaggccgacgccaggagccgctacgacggagacgtcgccatggagtgggggcgcgttctgcaggatgctactgctcgatgggttccagctgattacagtgctcaagtttctcggctatgagccgccgccgcttccacctccagctccagggtgcagcagcaacaacaatggacaagggaactgcaggccgaggaccancgttgtcatcagtatcgaacatgacttgatgatgctggagaaccagataccattcttcgtcgtncagaggatccaccgcttgcgatacggcattggtggaaatggaatggacacggttgaagagctagcct

SEQ ID NO: 3452 - DNA, 632 bp, Triticum aestivum
  unsure (1)..(632): unsure at all n locations
  Clone ID: PAT_TA_3452
ncttcanaactaggtgttgctcgcgacggcattgtcaggagagagacgagtgcggcgccagaagaaggcggcggcggcggaggaggacccggcgccgtctccggccatttgagcggggcaccatgtcgatggaggacagcgcgcagccggccggtgccgccagcgccggcgaacgcgcgagctcgccgtcgccgtcgcgtcggctgccggacttcctgcagtcggtgcggctcaagtacgtgaagctggggtaccactacctcatcacccacggcatgtacctcctgctcaccccgctcatcgtgctcatcgccgtccacctctccacgctctctccgggcgacgtcgccgacctgtggacgcacctccgcttcaacctcctctccgtcatcgcctgctccacgctcctcgtcttcctctccaccgtctacttcctcacccgcccgcgctccgtctacctcgtcgacttcggctgctacaagcccggcccggagcgccggtgctcgcgtgaaaccttcatgcgctgctccaagctcaccggcaacttcaccgaaagccaacctcgatttccagcgcaagatccctcgagcgctcgggtctgggggaagacactttacttccctcccgccttg

SEQ ID NO: 3453 - DNA, 2038 bp, Triticum aestivum
  unsure (1)..(2038): unsure at all n locations
  Clone ID: PAT_TA_3453
gagacgaacatcacaacgcttggccccccctcccgtccattctccgacggcaagttcaggagagagacgagtgcggcgccagaagaaggcggaggaggaggacccggcgccgtctccgaggcggagcccggcggcgctgatcgtcgctccggccatttgagcggggcaccatgtcgttggaggacagcacgccgccggccggtgccggtgccagcgccggcgaaggcgcgagctcgccgtcgccgtcgcgtcggctgccggacttcctgcagtcggtgcggctcaagtacgtcaagctggggtaccactacctcatcacccacggcatgtacctcctgctcaccccgctcatcgtggtgatcgcccgccacctcgaaggcgctgaggtcagtgaacccagcgaaggagcagaacaacccctggatggacgagatcgacacattcccggtggacgttcccaaggtttccaaggttgctgaatagctttgcctgttcagcaataccacccggaacagcaagtgagcaaatcttgccattgaattcgactgtatgcaatttgtttgggtgatctgtcggggtattaattttagatgattccatttaggtggtactccggcgcgaagaacgctcgagtcctcgggtatggccgaggacacttacatccctcccgccttggtcaccgtgccgcccaacccctccatggaattggcgcgccaggaggcgcaggtctgcatgttcggtgccatcgacaacatgctcgccaagaccggggtgaagcccaaggacattgggattcttgttgtgaattgcagcctgttcaacccaacaccgtcactgtccgccatggtggtgaaccattacaagctcagagggaacatagtcagctacaatctgggaggaatggggtgcagtgccgggctcctgtcgatagatctggccaaggatttgctccaggtgcaccccaactcgtatgcaatggtggtcagcacggagaacattaccctgaattggtattttgggaacaaccggtcgatgcttgtgtcaaattgcctgttccggatgggctgcgctgcgatccttctgtcgaacaagcggtcagacaggaggaggtccaagtacgagctggtacacactgtgaggactcacaagggtgcagatgacaagtgcttcagctgtgtcacccaggaggaggatgatagcggcaaggttggcgtggcactatccaaggacctcatggcggtggctggggatgcgctcaagacgaacatcacaacgcttggcccgcttgtgttaccattctcggagcagctgctgttcatggtcacattggttggcaagaagctgttcaagatgaagatcaagccatacattcctgacttcaagctggcattcgagcacttctgcatccacgctggtgggcgcgctgtgcttgatgagatagagaagaacatggacctcaccgactggcacatggagccgtcccggatgactctcttccggttcggcaacacgtccagcagctcgctctggtacgagctggcctacagcgaggccaaggggaggatcaggaggcgcgacaggatctggcagatagcgttcggttcggggttcaagtgcaacagcgctgtctggaaggcgctcaggtcagtgaaccctgcgaaggagcagaacaacccctggatggacgagatcgacacatttccggtggtggttcccaaggtttccaaggttgttgaatagctttgcctgttcagtaatataccacccggaacagcaagtgagcaaatcttgccattgaattcgactgtatgcaatttgtttgggtgatctgtcggggtattaattttagatgattccatttaggtggtacagaggggtgtggtgtcgtgctgttcactttttatccattgatcagttcttaacatctttgtgttcatgtgatcgagaatcttggccccgaaagaagcaactgcgttcattaatttttccatgcgactgcnatttgatttgttcgaatgttggcatcaaaaaaaaaaaa

SEQ ID NO: 3454 - DNA, 967 bp, Triticum aestivum
  Clone ID: PAT_TA_3454
gctagctcacagctcacaagtactacgtacatgtatacgtgttgatcggagcgaagtttagccgtatacaagtggcgagtggtagctagaggcgagagagagggaagctagagcagtgatcatggccattggtgcccaggagatcaagtacttctcgcaggcgaagcttggccggcggtggcggcggcccgcgagggggttccggctcagcccgacccgcctctccgtccgccggctacgcgccaggctgtggacgatgctcggcctgctgggccgctactttcgcggcgtacggctcccgcagcttaccagggggctcgttgccagcagcagctctcccgcgtcaacgagcggcggcggcaacaagaaagggcagcagccggcagtgtcacaatcaccggcggccggtggcaacggcgccaagccgcggaggccgccgtgcatgcggtcaaactccttctacgcgcgcgccgtcgcggactgcctggacttcatcaagggcagcaacgccgccccggtcgaggacaaccgcggcggcgctgccggtgccgtccggcacggccatggccagcagcatcacgtgctgaaggccacgtgaagatccacccgttgtgtactgtaaaagtgtaaatacgacgcggcgccgcatcgtttctcggcgtgggatttgatggttttgtgaacttgttagtttccggcatggttcttggtggtcgatctggatgctcctcttttctccttgcttttctatgttctagcaagtacgtacgtagtagattgtttagggttagctggtgcaagaaaaagatggtggattgattgatcggcacaacatgcacgtgccacttgatctatcttctgttttctctttgttggaagctctatcttctgtttttttagttgagttgaatctatcttctgttgaaagctttttttcgagagtaaaaaaaaaaaaaaaaaactcgag

SEQ ID NO: 3455 - DNA, 1607 bp, Triticum aestivum
  Clone ID: PAT_TA_3455
cccggcccccgccgcctcccccccgccccccccccgccttccagcgcccggtcctctgcctgcgtggccggagtgtcgagctgtccgtggggatacagcacgattggagctaccgccccttggtccacgacgtgctgagcttcaagctgaacaagctgaagttgccaacagagaagtatgatctggatgactcggacccgttttgggtggcgaacagctggtcgccattccccaaagtggccgaggagatagaagcgcagctcgccaagtacaagcaggatgtggacgcggggcgcccgccctcgggtgctcctccgggccgggccgagcctgttcgcgcaggccgcatccgctgccccctcctcctcccggcgcccgggcccccgcccccggggctgaccgttcggaagaagatgatcgataaacacacgaagattgcaacggcggtgcttgggcacatcaaggagaggtctctggatcgatactatgagtgcgagaatgatatgctcgtgaatggtaccgggccccggttcgggcgcctgcgtctgctcagagggaagggcaccaaggaggacaagctccgcccggcccgcccagtcctgccatcctgtgggccacctccaccatctgaacttgagcaggttgaggctgcgctgcgggggtcggacggagctctgtcggcattccagtatgtgaagaggataaagtcgttgaacacacagtttgccgctgcatcaagcacggcaagcaggagcaacattgttgattgggcagagaagctttacggacagtccattagtgccgtgacagcaggcgtgaagaatctcttgtcggatgggaggcagctggctctgactaggactgttgaagccctcatggaagggaaaccaaacccagaggtggacaactacctattgttcgatccacgggcccctagatcaggaactggtgggcagtttagaggacccttcagagaagccattgttttcatgattggtggtggaaattacatcgagtataggagcttagttgagctagggcagcgctcacagccttcaaagcatgtcatatatggagcaacggagattctcaatggggtggagtttattcagcagctcgcagaactgggacagaaagcgggattaggtggtggcagcagcaacctaccaccacagtaaatatgctcttaccagatgttttgatgctaaggtgggattgaagcttcacaggttgcagtaaatagtctcttgccgacacttgatgctaaggagtgatccaggctgcatagactaatgtgtaatggtatcaaatttctctgttgtcgggtttatggcgctgctttgaatgagttatcaatacaaagatttcttgccagagttcaaactgttccagaagtccaacaagtctgtatgctcgtttctttttgtttcttttttttcttttggccccttttgagaaatgttagtggaatcttgtttgaacacccctacaatcagttcatggactgcttagaacaccttttctgatttttttttgagaaattgagtttgttagtgtttcttatgaataaaaaaaaaaaaaaaaaaaaaatcgagctcgtgccgaat

SEQ ID NO: 3456 - DNA, 879 bp, Triticum aestivum
  Clone ID: PAT_TA_3456
cagcatgatttctttgatagagggcatgggagaggatatcatcatccacctagagggccaacatttgagcccgagggtgattttggtagaccctttggtgaaaacccatatctctatgaagatgttcggcatggtgccaagaggccatattctcacatggagcccgcgcctcctggatactttgagcatggtcctcctcgtgtgcgccctcgctttgaccattacgagcagccgccatttcctggagggaaccgttttggtcattatgaccagccaccatttcctggaggggaccgccacagagactcttttgggacgaggggtggttattcacgtgatcactatggccctggtcctggtcatcccccgccccctgcccatgcccatgcccatgcccatgcccatgccccgccccctgccccagctcaatatggtaggggtgcattccgaccacaccatagaggcggcgggcattctggaggcggttattaccaccactaggtggtatcacaacttcaggtggtgccgcgtgacactagtgtttggtttggtatgactagtgagaaacattatgccgcttattagctactagtactcgcaagtcagttggttgttagttatcttgataattaccgttgttggggaccaataattacttgtccttgttaaaggacatgtttggggtcatgaatctgttgtgaggatattggtggatgatgttatatgactagaggcatgacatggaccgacctctctgtatttgattagataacattatggattatggattttagacagtttatttatgtggctttgcagagaattacctgagattgttgatgttggtcttgaggtgaatggggatatgacactgatatg

SEQ ID NO: 3457 - DNA, 2889 bp, Triticum aestivum
  Clone ID: PAT_TA_3457
gtccaaaataggtcttttttgtttggtccaaaataaatctatatagattattatatgttcactttaacgaatatatgtcgccaccatctgataagtctaccacaatgcactcacaacacgatctatgaggtaaataggtacagtaaaacaacatccacggttcaaacagaaaaaataagccatgtctagccagagcacccaagtttcccgcaaaacaactatgccggcctgtatcagaagacacctccacctccctacggctgtggatgaagaatatgtgcgcacaacgcctcgccatccatagggggtagtactaactaattcagaagcgaagagaacttagaccagggaggtctaaggttctgccggccaggatcaacgcgacgacagctagggcaactgcgactccgatgaagatgtactgccgcgttctccttttgaacttgttacgcaggggagcgggcatgggctgcagctgcctcactattggtttagggatcctctttatgattatgggttgtggttgaggaacatcaggatccttggtattttcgggtgtgttgctttcagtgtctgctgcaggtatagctgcagagttggtctggccacttgctaagtctgctggtgtggtgccaacctttttagacttctttgctttcttcttttccttcatctcagcttccttgcgcgctttgaactccgccctttcctgagccttctctgccttctttttctttctttcctcagcttccttagctttcgctatttgctccaagcggagttgttccttttcagctgcagccctctgcgctcttagttcctcctccttgcgtgccaactcctccgccttccttgctaactccaactcctccgccagacgagccttttccttttcaatctgttttacatctaccacttctggagctggagctggagctggggttatttctttctgggatgaaccactaccagctgcctttggtttggcctgcttatgggtctgggttggtggtaaaacaggaaaggaatcctcttctacagggacaacaactgcagtagacttttcaggtgctgcttctttagttgtaatgggaacgtttgggcttgaaacagtgagttgagatggattgttgggtcttctactgtaattgttactgggaatgacgggaggctcctcatcaggaccaagtgatcttccatcatgggtacctaatctcctcagagtgctaatctggtttgcttcaacgtacagcctgcggaagtcatcatctttgttccacatctccataaaaccctcaacctgattattacaatatgactgaagtccatcaatgtcaccacttgataagagcttgcccgcagcatcgcggtccttcttgtacatgaagaagtacttgttcttcttgcccggttcccctctcagctcaacccaattctcgtaggcctgttgacgtagttcattggcagcatacaagtcatcatttaactttctgagagcagctctttcatcctcgaaagatttttgaatcttttttctgttctcctcaagggacttcagatttttgaaaagtaaatctgcttccttcttcaaagtcttatgttgctcatgaatgtgatccttttgatggaatgcttcactcatttcagcctctgagcccatattggagcacgcttgcttcctttgggctttcagatcattaatctctttaatgaatagcttctcttctttcaaagaaattgtttcatgttccatagtcctctgtttcctcacgatcaactcatcaatttcttcaactgaagttgcttgattcaacttcccaatagttgaccgtacaccatcaagaacattcctcttgccagcatgtgcagctctcgcttcaccctcttctttccgtgctgcctctaacttttcccaatactcgtcaaaggcagccttttgctttttcttgcgagcattaattgcatctctttcctgagtcaggcgatccagatgaacttgagcatcttgtacctttgcccaagacaatcatcgcccgcaagattaggaacctttacgatgaagaacttgtgtggcctcatgagctgtatatttcccttgtcactctcaagatcaacaggctgttcaacaggcgactcactggagtcctcagcaatcttctccttgcctttgtgtgcatgttcatcatcattctcatgttccactggaactaccccgtcaacagatgaaggttccactacttccaaagatttggtttcaacctcagtagaagatatattgcatgcatttatattttcagtatctttggatgtctcatctgacgtggcggtcgccttgtccgtatgaggagccttaactccagattccaatgaaacaactggcaggcaaggatattcagtcagagaaactagctcttcgcgcgtagttgatgcgtcaagaatgtccggctggtcattattagattggcaatctgtaaccaaatcacgtgattcgcctatttgcgaaacatcaccagattcacttcctggggcagaagagggtttaacttcatctacaacagaagctttattatcagtcaatgcgacagcttcaccttgatcaacagcagtttcgctaagagatgcacctcctgtatcatatctgagttcagcgtcatctgtcacagcagttccatgatccatggaaacaccagatataacttcatcgacagcggtgctagatatttcatcagaattacactcctctgcttgtacatgatcacaactttccaactcagtatccggttttacgtaattgttatcaatgaaatcaatggaccttggctcattatggaaagtagacgttgcgttgcatgcgcggacgcgtgggtcgacccgggaattccggaccgg

SEQ ID NO: 3458 - DNA, 616 bp, Triticum aestivum
  unsure (1)..(616): unsure at all n locations
  Clone ID: PAT_TA_3458
gaaaggcagcaggagtaggaggaaaattgatatacttggactgatggtcagtataattggctcaaaggaccaattggtcaacgaatatcgtgtaatgctggctgagaagctgctaagcaaatctgattttgatatagattctgatatccgcacgctggagctccttaagattcatttcggtgagagcagcatgcagaagtgtgagattatgctcaatgacttgattgactcgaagagaaccaactcaaatattaaaacatcattattaaatgcacctgggaactgttgctggggcaagaggaggcagaaatttctcatgatgttcttggatgctacaataatttcctccaacttttgggccaccgattcagacagaagttctcgcagttcctgcttcagttggacaaactgctgtctgattttgcacaaaagattccatcaagataaaaaccccacggaagctattgtggaaggaaaatcctgggacggtcaagttggaactgcaattggaggacagaagtatgcagtttactgtagtaccggcgcctgcaatnaaatgcggttcagagaaacaagctggcttaaagnacttcaccgaatcgatactgtaattccc

SEQ ID NO: 3459 - DNA, 1253 bp, Triticum aestivum
  Clone ID: PAT_TA_3459
cggactcgtgggcggacgcgtgggcgcggaaagaaacccaaccctagcctccgccgtgcgtctccggcgacccttcagcagcaccgccgggcggcctcgcgggctctcctggagcggttccgctgcgaagctcgagcgttagaggagaggaggaggaggtgttgggatttactgatttggtttgggggaggaggatggatggggcgtccaacgtaggtggtgccggaggaggtgctggaggagctgaagaacgacgacggcaccgtcgcgctccgcatgatggatcatatcccacctcaaaaggccgacgaggacatgaagaaaaatactatgatgatggtggaacaaagcaaagttctgaagactcctcgagctgagaaaaagaccaagagggagctgtttgatgctcttagacaagaattggaaactccggttcttgagaaagcctcaaaggcagtttgggagctgatactcgacaatggtggactagggaaagagatcaccgagacagttgagaaagtcttctgccggctcagcggaattgatgtgatgccacctccagcttcaacatccggtgctcctcaagagaaacagacaaacatggctgtagaggaggatcagaaggatatggaaatggatgcctctgaaccatcgtcttcctcaaggaagaggcctttcagtgacatcagtgtgaaaggagcaggtgctataccaaacggtggcgctacataccagcatgacgatcatgaggacgggaactaggagatctgggcgtgtcgtggacaagcattcgggtgatcctggggagagcgtgtgctcaattgcatcagtggaaaaccttatgcgtcggggatcaatcagtgctactgcggcgctgtctcctgcacattgcatgggaggaggcaccaaggctggtgcgaataagggactagatggactcatgctcaaggcgcacactggatgatctctccctcctgcgtgaggatgtcattctgtaataggatagaccttacttagatcccttgctgcgcgctggatgtgttgccgaaccaattgctcttagtagttgtagtttgcatatagtctggcctgctactttggtgaggctcgagtgctaccattatatttcggtttgctgttctccgttttatgcaataaaatgagagggggaaaccccttttgtttcaaaaaaattatacagtgacaatcaatcggacatcattcacagaaaaaaaaaaaaaaaaaaaaaacct

SEQ ID NO: 3460 - DNA, 826 bp, Triticum aestivum
  unsure (1)..(826): unsure at all n locations
  Clone ID: PAT_TA_3460
tgcaggnaattcggtacgaggacacaacacaccgcagtacattccaagnctctatcgcctacaatggcgaactgtagggccttcgcgctggtgctcctcttctgcgccttgtcctgccaagccgccgccacctacgcgccggtgcctgccaaggaggacttcctcggatgcctcatgaaggagataccggcacgcctcctctacgccaagagctcgcctgacttccccaccgtcctggcgcagaccatcaggaactcgcggtggttgtcgccgcagaacgtgaagccgctctacatcatcacccccacctacgcctcgcacatccagtccgcggtggtgtgcggacgccggcacagcgtccgcctccgcgtccggagcggcggccacgactacgagggcctgtcgtaccggtccgagaaacccgagacgttcgccgtcgtcgacctcaacaagatgcgggcagtgttgatcgacggctacgcccgcacggcgtgggtcgaatccggcgcgcagctcggcgagctctactacgccatcgcgaaaaacagccccgtgctcgcgttcccggccggcgtctgcccgaccatcggcgtcggcggcaacttcgcaggcggcggctttggcatgctgctgcggaagtacggcatcgccgccgagaacgtcatcgacgtcaaggtggtcgaccccaacggcaagcttctcgacaagagctccatgagcccggaccacttctgggccgtcaggggcggcggcggagagagctttggcatcgtcgtgtcgtggcaagtgaagctcctgccggtgcctcccaccgtgaccgtgttca

SEQ ID NO: 3461 - DNA, 1404 bp, Triticum aestivum
  Clone ID: PAT_TA_3461
cttgcgccttgccttgccgcaaaaccccagtctatatatacgccattccaccggcttcgcccccaagccgaaggtaacctcacaagcgacacgccgtcctcgaggccgcgggcgccgcgcgaaccctagccgccactccgatcgcccgcaccgggggctgcgctatatgcttccgacgaagagagcggacggcgctgaggacagcggcgacgcggcggcgaagaaggcacgggtaggggaatcggcggcggaggcggggtcagaggccatggttgccggggagccggtcgccgcgcgcccgaacgggaacggggtggcggagagcgatgaggaccttcacagcaggcagctcgccgtgtacgggagggagacgatgcggctgctctttgcgtccaacgtgctcgtctccggcttgaacgggcttggggctgagaccgcaaagaatcttgctctggcgggtgttaaatctgtcaccctacatgatgtagaaaatgtggatatgtgggacctatctggcaatttctttctatctgaggatgatattgggaagaacagggctgctgcttgcgttgaaaagctgcaagaacttaacaatgctgttcttatatctgctctgaaggaagaactgactactgaacacctttctaagttccaggctgttgttttcaccatcgtccctcgcgtccgggcggttgaatttaatgattactgtcgtagccaccagcctccaattccattcatcaaaacagaagtctgtggtctttttggtagcgtgttttgtgactttgggcctgagtttactgttcttgatgttgatggtgaagatccccatactggtataattgcatccatcagcaatgacaatcctgcaatggtttcctgcgttgatgatgagcgccttgaattccaagatggcgatcttgttgttttctcggaggtcagtgggatgacagaactgaatgatggcaagcccaggaagatagtagatgcaaggccattttcattttgcatcgaggaggatacacgtaactttggcatttatgcaaaaggtgggattgtcacacaggtgaaagaaccaatgatcttagagttcaagagtctgagagaatgtataaaagaacctgggaacttccttttgagtgatttctcaaagtaccagcgtcctccgctgcttcacttcgcatttctagccttggataatttcagacaaaagtttgggcgcttccctgttgctggttgtgaccaggatgctcgaaaatttgtggagtttactgcttctattaacgaggctgcaattgattacaagatggatgaacttgatgagaagctgctgcaacattttgcaagtggttctagagctgttctgaacccaatggctgcaatgtttggtggtattgttggtca

SEQ ID NO: 3462 - DNA, 763 bp, Triticum aestivum
  Clone ID: PAT_TA_3462
cggacgcgtgggcggacgcgtgggcgaccgggccggcggctaactccaccaatgccgccgctgctcaccctctcctcctcgccggtgctgccgcccagggcccggttcagggtctcggcctccgccgacgtcggcgccaccggccgagccgccgccgcctccaacggcttcccgccgttcctgcccagggcggtcgagcgcatccgcgacggcgccgccctccgcctcgccaagcgaatcgagcgcgtgcccgtccagaccggcttctcgaagagcccgataccgagcagctgcgtgaggccactcaagcagcagcagagcgccgatccggtcgtgctgctccacggcttcgacagttcttgtttagagtggaggtacacctaccctttgctggaggatgctgggctggagacttgggctgtggacattcttggatggggcttctctaatttagaaacaaggccaccctgtgatattgtgtctaagcgcgagcatctttatcagttctggagatcctacatcaaaaggcctatggtactagttgggcctagcctgggtgctgctgttgccattgatttcgcagtcaactatccggaagcggtatcaaaattaatcttcattggtgcaagtgtatatgcggagggcacaaaagatatgaccagaatgcctaaatttgttccatatgctggggtttttgtactgaagagtcttcctctacgactattcgctacacgcttggcattttattatattccagatggat

SEQ ID NO: 3463 - DNA, 1063 bp, Triticum aestivum
  Clone ID: PAT_TA_3463
acgaagatttctagcttgcctatgtgttgtaatgttaataagtgcattcggccaaacaatttgcggaccaaatgaacttgctgtggatatagaagaataaggcggcacacaaggagttgcctgaattgcagtggcagtggtgttgtaatatgcctctattccaacacacacattccagttgccattggtgagcaaatgagatatgaagttaccagcgattttcattatacgtggtaaaaataatgcaaatcatgctttatggagagttgaaacactgactattgatcggagaaaatttagtgggtgacaactacccaagaacattgagaatgggcgccagaaattccttttgctgatatcacaaattttgtgccatggtccataaagagaacaagtgctgggtgtgtgttccgatccagtaaatttccttcatgtgccacacaagtggagacgactctacttttttaccatgatcttgagagttatgaactttatgacaataatgactctcaagttcaacaagagctcgtacaaaagatatggaaagtgtttaagactatactagaagagactggcaaattaagggaagaaaccaaggaaggcatttctatagctaagtccattgtaatcattttggattgaaattcaagtttggcaaaaggtcttgatatatgccttggtcacaggtctaaatgttataagcatggctccccacatccaatttttcaggccatggagcttctatggttggttcatatgtggttatcgaagcaggataagttcttgaggaggactctaattgctatggaccacaagatttcatatgtcgctccctattgcgtattgctgttgacattggacttgctatccagtaagagggacattgggatcattgttcatctagagaagtcagtgctatatctacgtcagaatattgggatgttaatgattggaggtgatgtttttctcttccatacctaaatttctttagtataagtccatataaagaaaactgcagtgttccaactattaaccacaattgttaaattaattaatttagcta

SEQ ID NO: 3464 - DNA, 950 bp, Triticum aestivum
  Clone ID: PAT_TA_3464
caggaactccgcaccggcctcccgtcccctccgcagccatccagatccagcgagatccgtccagatccatcccgatccctggcgaccgccggcgccgccgcccgctcccgcaagcgcgtcgaggccaccgtcctcaagcgcgcgcgggacggaagcgccgtcacccgctgcgaggcgtgcaacaaggacgtagccatcgtcctcatcgacctgcacagctgcagcctcgactccaagatacgcctcagcctcgagtcgcaggtggtggagaagtccgtcgagatccaggagaagaagaggaagacgccctccgctgccgccggaggcaaggggaagaagaagagcaaggcggacggagatggtgccaagaagccaaaggcaaagcgcccaccaactgccttcttcctcttcatgaaggacttcagggtggagttcaaggcctcgcacccggaggagaagggtgttgcccgccgttggcaaagcagcaggggaccatgactgaagaggagaagaagccctacaatgaccaggccaaggccagcccggcccagtttgccaatggcgagggcagcgcggagaacaatgtgggagatgaggagaaggcagatgctgacgcagaagaggtggaggatgcggagcaggaggtggataagccagaagatgccccagaggaggaggaggaggaagaggagaagaacgagctggatgatgacatctagacgggactgaagaagggtgctagtttctgttttgtaaatggcaggcgttctacctatctgtcctggacaacctgaatcttggcctaaactctagtagcagcagtagtgaatgttgtggctggttgcagtctgtttatcattgttatggaatggaaggaaagcagggttgatgtggtggtcgatgaatgaaaaataaaaatacaaatgaatcctattaatttatttactaaa

SEQ ID NO: 3465 - DNA, 792 bp, Triticum aestivum
  Clone ID: PAT_TA_3465
gccgtcggcacgggaatcgtggagttgggggtgcgccacaagcccatcggtaccctcctgtcttcccccgcccgccgctcgcacgccgtcgtcgtcgcctagaacccctacagttccgccgcggcagccggttccatgaacgaagtcggcgacgccgcccttggctccagttttatccttgacgctggggaatcgatcgtagccctcgatggtgacaagcctgttcttcctgtagtgcaccatattgggatttcagcttggccaggaccattgatccttacgacacatgctctttattttcagagtatcagagttggttatggtgataagattgttaaatatgatttagcaccagatgcatatctggtgatcaagcgagatcgtcctggaccattgggtgtgcggctgtttgataaagctgtgatgtacaaatcaagcactttaacagaaccgatttccttcgactttcctgagtttgggagccctgcacgaagaagctatacgttcgcagccactcgtgaagtaatgcagcgcaatagttgcatcacacaactcatccttttcgaccttccgaaggtagcggccctctcaagggcgacccgccgcttcgtcatctactccgccgtgttgggagctctgcttggcccgccctcccgcgttgggtctgctctcacgtttggcttagctgatttacccccagatgcagatctggtgttcgagccccttttcaccggccccttccgtctgcggctctctgctttggccctgttggcaacagagccagcagttgac

SEQ ID NO: 3466 - DNA, 777 bp, Triticum aestivum
  unsure (1)..(777): unsure at all n locations
  Clone ID: PAT_TA_3466
ccactncccccgcgccactccgatcccctccgcccccgccctctccgccgtctcattccctctccgctcccccccggggatcgcagtggcacccgcggctccagcaagcaaagttggagtagagaccgccagcacgagcgatcgctctttgatttatgtcgcctgctctactgctccatggttctgagctcccatcaccatcacctccttccgctttttgttgccttctcccccaagctcggcagaggggcgccagcaactcaagattatcgcttcaagatctcccgatttggatttggggtgaagtactctggatttctgcatttagaccagtgccccgtgcacgcgaagtaacaacaatacaagaatcccccaaatcacgataagcttggtttggtttgggtggatttaagttcagcactcccccctcagtttcattgacattcctcaagttcataaacaatcagccagaaagcagatttcttttgcgagtcttcacagaaaaagaataactccgtcttctctccagttttaatcagaagtttgagacaactcggtttctgattttggagattgtgcgctcaggctctcaaccaggagtttccgtcctgggatttaacatttcagtcgattgtagtcaaggttaataattcaataatctttggatcttaagattaaggggcttgttgcacaaagagatgatggtaccttgttcgcggaaggtccgcatttcctgctgtgatcctgacgccaccgattcctctgatgaagatgatc

SEQ ID NO: 3467 - DNA, 579 bp, Triticum aestivum
  unsure (1)..(579): unsure at all n locations
  Clone ID: PAT_TA_3467
gtggaagaggcaaaaccctaccgcccaccccgcgattcccgaaatttaccaaaatgccactcttctcctccaaattcgcgccgctgatcccccgcctccgccgcctctccacggcggcggcgaccgccgccggcgaggacccgaagctgtcgcgcatcgcggacgagctcctggcgctctcctcggccgagctggatgactactcggccctcatgcgcctcaagctacgcctctcgctcacctccaacccagctgccggattaggtcctggcgcagccggggatgcggcctccgggtcggcgggggccgaggaggccgcggcggtgaagacggcgttcgacgtcaagatcgagaagtacgacgcggcggccaagatcaagatcatcaaggaggtgcgcgcgatgacggacctggggctcaaggaggccaaggagctggtggagaaggcgccggtcgtggtgcgcgcggggctgcccaaggaggaggccgaggctctcgccgccaagctcaaggccgccggagctgccgttgcgctcgagtgatccataccaaaagccgttnagggnggtccccantttg

SEQ ID NO: 3468 - DNA, 555 bp, Triticum aestivum
  unsure (1)..(555): unsure at all n locations
  Clone ID: PAT_TA_3468
cccccttgtctcacccccttcgatttgagctcacccgtgaggaccagtgcgtgtcgccgtcgctcacatgaccaccggcttcccctcgccgcgcctcggtgctcaggagggccaccgtcgttcgctacgccttctacatcaccagattggagccgggacgcccccgtcttcgtctctcacatcttcttcctcatttgcggctgacgcgcgccatcgcccgatccagacactccggtccaccccgaccctcgacaagctcgccatccaccccctcgcgattacgagactgacgccgctgctggtgccccgatcaactatgttgttgacgacccctacttgctagagcaaccagacgttggagtccaggagcaagacaccaccgttgacgacgactcctactactctggaggtgcctccttcctcgtgccgcccgcggccgacgagcagttaggagatccaggaggaggctgtctcttcatnngtaccattgtgcacctctaagnaaactgttactagtcgtaccaaaatgtgctcgcgatctcaagatgacctgnt

SEQ ID NO: 3469 - DNA, 1025 bp, Triticum aestivum
  Clone ID: PAT_TA_3469
ggcttccccctcccccgttaagatcggccgccgcgtccggcaccccgttcagccgcctcgagccacccgcccacagccgcgtcgccttcttcagctgagggcggccgatgcgccaggccccccgctcccccctgtcgacctcccccccggcaactcaccccgccgctgcggccccgcgccggttcgcgcataccccgcctcccccggccaccccgccggccacgctcccgtctgcgccgtctccgatccggcgcgacggttcgcgcagcaccgcagccttcatggtagcattctccatttcgattttaggattcgtgaggtctccgatctcgacaactcttccacaaatcactggaagattgtacatcaacatggggaatcttgtggagctttcgtgaggcacaatctcatattcttgtaacttcattgatcataagctggtccatcactgagatcatcagatattctttctttggcatgaaggagacatttgggtttgcaccttactggctcctatggcttagatatagcacctttttggtgttctatcctatcggtctgttaagtgaggttggcctaatctttgttgccattccttctatgaagtcatcatggaaatgccgccttatgatgcctaataaatggaatttctccttcgactaccgctatgaattggctctcaccatggctctatatgttccagggtttccatacttgttccgttatatggtggctaagcggaagaaggtcttgtcagcgagaaaaactgcatgatgttgcaattgcttcttgagcaatcaaattgagacggaaggaatgtgaacgccataataaaactctttagatttagtcgtgttttgtgtcattcattgatcactagcttcaaacttccttgcatctcgtacgtgtaatctccaaatggggtattttcaatccttttcagcaataaatggctcgctgcaacaacttcataataatgatatgttgataattttctaaaaaaaaaaaaaaaaaaaaaaaaaaaa

SEQ ID NO: 3470 - DNA, 778 bp, Triticum aestivum
  Clone ID: PAT_TA_3470
cttctccgcggcacgggcccccgcgccccctcgtcctccagaattccccggggtagcaaggagagggtcagaggcggagcagccgcagcggccagcggccaccggcggagacgcggcgacgcgaggcaagaagtgatggagtaccgcaacaagatggtgctcgcgcccatggtccgcgcgggtactctgccgtttaggctattggctgctgaatatggcgcggatattacgtacggagaagaaataatagatcacaagtttgtgaactgtcaacgcgttataaatgaatctcttgggacaactgattttgtggagagagggactgatagtgttgttttccgaacatgcccgcaagaaagggacaaggttgtctttcaaatcggcacatcagatgctgtcagagcacttaaagctgctgagcttgtgtgtaatgatattgctgctatagatatcaacatgggttgtccaaaggctttttctgtcagtggaggaatgggttctgcattactctccaaacctgagcttatacatgatattttgactacattgcggaggaacttgaacacaccagtgacatgtaaaatccgtctactgaacacacgtcaggacactgtggagttggcacgccggattgagaaatgtggtgttccagctctggcgtgtccatgggaagaaaggtcaaaggacaggccaagggatccggctaagtgggatgagattgctgatgttgtatccgcactgtcaattccagttatagctaatgggaatgtatttgagt

SEQ ID NO: 3471 - DNA, 723 bp, Triticum aestivum
  Clone ID: PAT_TA_3471
cgaaggcagggaaccgctccaccgacaaaggcagtatccctgaccaaggtagtgtcaccagataaactgagagatgatgaggaatacgaggatattttggaagacatgagggaagaagggcgcaaatatggtaaacaaaatgaaatccatggacttgccttcatcttgttttgaacccttttgcattctgttatcattgtgttcagttactgaacttaatttggtttgtgtgctgtctttttgggtgtcttttttttactccacataaatgccattgcagagtcttttatagtccaaccccatgcaatatttgtaatcgaccttaacgtacaaaggccacaatattcttacttgattggagatgattgttcatatatcatgtccttccggcgcaggtgtttcttggagttggaaaggtgtttcttggaatatgcagatatcgacggctgcgaccaaggcgaaggtcgggatgcatgccaggaagtttgccgggaaccaggtggtggccgtgttctaccctgaaaacaagtttgctggttggagattacgatgattagatgaggtccccctgcttcgttcacacccatatccatgcgtttgcttagttttcaaattgaatccttttttaatctggttggggaacccgccgccccgtttttgggtttattttttttggcctggacctcgtcccccgcccccccgcccccaagtactgtatccaaa

SEQ ID NO: 3472 - DNA, 1185 bp, Triticum aestivum
  Clone ID: PAT_TA_3472
gcgctggcccgcgccgcgacgcccctggggccgccggccgcttccaagttccgacgcgacggcgctggagccggcggcccctccacacccccctacgcgctgacgggaaccagcggatcaagaccaggtgcaccggccgtgccccctgcttcgcgacggtcttcaccggtgccgtggggatcgcgccctctgcagccgacttgttttgcacttatggcagtctggacccgtacgatcaagtaaatcatgcgggcaaagctttggatgggatttgctcccttcctttcaaagcgttacatctccacctgcgggacatcctcgctacctccatcttcatcgagcttggtaatacaaccatggctttttattggcctcggtaaccccggtgagaagtaccaatccaccagacacaatgttggatttgatatgatagatgcatttgcagtgtctcagggcatatccctgacaacgcatcatttcaaagcactatttggtgaaggggtggtagatggtgtccctgttttgcttgccaagcctcaaacatacataaatctgagtggtgaatctgctggtgcatttgctgcctattataaactgccacttcaccgtgtcatagtggcatatgatgacacggacctgccgtgtggagttctccgtttacaacctaaaggaggatatggacgtcacaatggtttatcaggttgaagagtgtgatctaccattttcgcaagaaccgggaatttggtcgattaaggatcggaattggacgacctcctggtcagatggatcccaaagcttttgtgcttcagaagttcaataagactggtcgggaacggattgattcggccataaaagagggttgtgacattctcaagatggtggtgaccaagggcttgacggaggcggcgagagcgtcaaacgtggatcagaagtacaagcatctggtctcacatgaccagcagccgtaactcaaagatggctacaaaccgcttgggcctggagaaatactgtactgcatatgatttgctgtaagctctgacgggcctgtgctgtcctagccgcgtggtcaggcccctgtccaatcgtcgttgtgtggcaaaacttaggcatgaacaatgtggatttggacgttgtacgggccggggacctttgtccctatttcctgtcgcaaataaaacttggcag

SEQ ID NO: 3473 - DNA, 1293 bp, Triticum aestivum
  Clone ID: PAT_TA_3473
gcagccgcccaggcaaagaagaaatccaagtattctgaagcctattgcaagacaagaccctccgatcatccatgacaacaggagggggcgattccctgccgaactctctcctcgatcccctagcaaggctatccgcaagcggcaccgagagcaacttcagcgatgcggcaatggaagcttctgccagtctagccccactgcagctcgaagcgaggagcgctttccaaccaagcaccgcggcatcctccagaatcgccgtctcatcgtctgagagcagcttcgattcacctgatctccacccatttcgagtttcttcatgcaccgccgacgaaatgctgggagttattacgccgcatgcggctcagagccacatcgagttcacaagatcgacgagcgacgggtatgaggcgtcgggaggcgaagacagtgaccgcatcccgtcgagaatcgtgcacagatcgtccaactgggctaactcgcttctgcattccggtcaggctggaccggcgcctgaccagcacatgccattgtctgaagggtttcttaacaacagcagatcaggctagttatatgtgctcatctgaccaacaaaaatggtaggaagaagctgcgtggtgttggtacccggagaatcgctgcatatggcagagcaaagctgggaaaacattgattaatttgtaatctagggttaggttttgttagtggtgatgttagagcaatgctcatttgatgttagctcatgcaaactgctagtgtgttgctaacagtagcattctggtgtgtttcgacagattgcagttgttaagctaaattcagtagctgggagttacgccgcatgcggctcagagccacatcgagttcacgagatcgacgagcgacgggtatgaagcgtcgggaggcgaagacagtgaccgcatcccgtcgagaattgttcacagatcgtccaactgggctaactcgcttctgcattccggtcaggctggacaggcgcctgaccagcacatgccatcgtctgaagggtttcttaacaacagcaggcgaagctagttatatgtgctcatctgacctacagaaatggtaggaagaagctgcgtggcgttggtatctggtgaatcgttggcatatgacagagcaaagctggggaaacattggttaatttgtaatctagggttaggttttgttagtgacgatgttagagcaatgctcatttgatgttagctcatgcaaactgctagtgtgttgctaacagtagcattgtggtgtgtttcgacggattgcagttaagctcaattc

SEQ ID NO: 3474 - DNA, 776 bp, Triticum aestivum
  Clone ID: PAT_TA_3474
tcgcggccgcgtcgaccaggcagccatgccgtcgccgaatgacccgcccgcggcgttgcccctcaccctcgacctcgaggacttcaagggcgatttttccttcgacgcgctcttcgggagcctggtggatgagcttctgccggagttccacggggacgatgcggcaggggtacccccgccgccgccgcccctgctcggggccgcgccacccgttttccccgccgtcgacgagcttctcgggctcttcaagcattcctgcaaggagctcgtcgacctgcgtcgtcagattgataagaggctcctaaatctgaagaaagaggtggctacacaggatgccaagcatcgcaagacactcggggagcttgagaaaggtgtggacggtttatttgatagctttgctaggctggattctcgaatctccagtgtcgggcaaactgctgccaaaattggtgaccatctacagagtgcagaatctcagagggaaactgccagtcagacgattgatctcatcaagtatttgatggaattcaacagcacacctggggaccttatggaactttctcctttattttccgatgacagccgtgttgctgaggctgcttcaattgcacagaaattgcgatcgtttgctgaggaggatgttggaaggcatggtgtcacgtcggcagtaggttctgctaatgcaagccgtggtttggaggttgcagttgcaaatcttcaagaatattgcaatgaactggagaatagattattatctcggtttgatactgcatcac

SEQ ID NO: 3475 - DNA, 1033 bp, Triticum aestivum
  Clone ID: PAT_TA_3475
cgagacaagactttcgagaagagctcgagatcctgggcagcattaggcatatcaaccttgtcaatctgcgaggatactgccggctctccacggccaaactgctcatatatgatttcatggagctgggcagcttggacagctacctccatggtgatgcgcaggaggatcagccattgaactggaatgcgcgtatgaagatcgccctgggctccgctcgagggctggcgtatttgcaccacgattgctcaccggggatcgtccaccgggacatcaaagcaagcaacatccttctggacagatgcttggagccgcgcgtgtctgatttcggcctcgcgaggctgctggtggacaacgagacccacgttaccactgtcgtggcgggtaccttcgggtacctagcaccagagtacctgcaaaacgggcactcgaccgagaaatcagacgtgtatagctttggggtgcttttgctggaactggtgaccggaaagcggcctacggattcttgcttcctcaacaagggtctcaacatcgtcggctggctgaacacgctgagcggggagcaccgcctggaggagatcctggactcgcggtcgggcgacgcggaggtggaggcggtggaggggatcctggacatcgcggccttgtgcacggacgcggacccggggcagcggccgtccatgggcgcggtgctcaagatgctggaggaggagatcctgtcgccctgcctcagcgagctctactacgagcagcacctggagctctgagagccttgagtgtaggtgagtgagtggacagtgccagttgtgcaggtactgctgctcatgatcgaccgatgatggcctggatctggattgaagaagctcaagttttgtagatacgcttgatgatgaaccaccaccgtgtgtgtaggatggactgtgttggcatctctagactagcgagtggttcttgggtcagaaccaggaccaatgcagcaatcggctgtgctttttgtacatagggttggagacctttgagcctttctttcatcccc

SEQ ID NO: 3476 - DNA, 734 bp, Triticum aestivum
  Clone ID: PAT_TA_3476
cccaccccaggccgctgccacgccgccctgtcctccgtccaccttccgccgcggcgcccccaacccctccccgccccggcccggtcggtcctccctccacctatgccgccgccttgcccgacgaccttctgcctcctccgcaggttcgctggcccaccaccagtgtgctttccccctcctccgccactctcctgtcctagccgcccccccagacatgcgcgacagtggcgctggtactgcgcgggcgggagagatgtaggaactccacatcgacgtcgttgcctctgccctctcccggcctcgtcgaccatcccctcgcctcgatctccgtcaacgacgaggaacaggcagtatggagactgtggctatgcagctcggaggcgcacgtaatgtgattcagtgctcgcgcgcttccagccttgggcgtttctttttgcgagcggatgcagattcatcatcgtggcttgcagatgcagttcgggcggcttcagttctttcagatgcaattcagcggctcgcagtttgctaccacaagttgtgcacgtgctcgtggggtctaaagcagtgcgagagggaggaaacaaggtttgctcataaattaattttcattgcatcagctgctcacaccgaaatcggttgagcaaattctagttttgtttacctgtcgatcagtgctactgtattatattacatggctcaagtcgaagtgtacaaatgggccgtattgctttgcc

SEQ ID NO: 3477 - DNA, 669 bp, Triticum aestivum
  unsure (1)..(669): unsure at all n locations
  Clone ID: PAT_TA_3477
ctgagccttcanctgaccttgcgggaggacgcatnnatggngactggatgtgagcccgacaactaccttgtcttcttcgccttctccgcctgcacgggcgtcacaggancaggctgttaggcctagcaagagggttcggtctggatcncccggaactgcttctggangaggtggcggtggcagtggaggagggagcgctancggaggcggcagctatcccatgtgccaggtggatgattgccgcgcggatctgaccagcgccaaggattaccaccggaggcacaaggtgtgtgagatccacagcaagacaaccaaggcggtagttggcaaccagatgcagcgcttctgccagcagtgtagtagatttcatccgctctcggagttcgatgagggtaagaggagttgcaggcgaaggcttgctggacacaaccgacggcggaggaaaacccagccaacagatgttgcttcacaattgctgcttcctgaaaaccaagaaaatgcagcaaataggacacaagatattgtcaatctgatcactgttattgcacgcttgcaaggtgcttgtgcccctactctacccggcacccctccgcttccggatttggacctgctggcccttttctctggctctgttttctcaggcgataatgcaaactccctggcaaagtc

SEQ ID NO: 3478 - DNA, 1172 bp, Triticum aestivum
  Clone ID: PAT_TA_3478
cagcgtcgtcgcggccgtggttcccctcctacggacgctgatcctttgcacccctgtgctcgtccgtcccgggcgtagtggcgcagcacgggccggcactcctctagcccgccgcgctcaggtctcgttgggctcctggccagatgccgcgcggcccgtggaacttgaaaatgttcgtcgaacactactccagatgcgagtcggtcagggagagcgctgtgctccgggacaaaggcaaccctcctggcagtgacgccttcgactccacggtgcctgtcaggatacgagtggaggagctcaactctctcaacaacaggttcaagagtcgaccctctggataaagacccgggccgtcctccgagctggacgacgacatcatgatgacctgcaagcgacgtagagaaagggttcggggtgtggaagggagcaccccgagcggatggtcggcttctacccgcggatgatcgacggcgaccccccgcagtacaggaacgagcggtacgccaggggcaagaagggctacaacctgatcctcaccggtgccgcattcatggacagtgagtttgccttcaggaggtactggagcgaggaggccggggaagggagggactacgtgcacaagaacttcaactgcgaggacctgctgatgaacttcatgtacgcgaacgcgagctccggcgccggggggaggacggtggagtacgtgcacccggcgtgggccatcgacacctccaagctctcctccgtcgccatcagccgcgacacccagaagcactacgacgtgaggaccaagtgcctggccaagttctcctccatatacggccctctgccacagaaatgggagttcggcaggcgacaagatggctgggacaaatagcccgggctctggacagtgggggcgggagatagtacacaaccaacagatgcaaatgcttagaactttttttgttgttggtcccgtgggaagttttgcagcacgggacggaaatgctataacctgcttggtagaagtgtctattagattttggctagaagcctagagtgcagtagatcaagatctcttcagtgtccggttcctcaaagaacttgtgggatcaatgctcatataggccagctgcaatgcgctaagattcaattggattgtatgcctgtcttttttcttttcaaaaaaa

SEQ ID NO: 3479 - DNA, 1994 bp, Triticum aestivum
  Clone ID: PAT_TA_3479
cgcgtcccccgcttattttctgcgcccgcccccgccccctccctcccccccacccgccaccacctccaccaccaccaccccgggccccggcccccgccccagaaaaacaaaccaacaaaatacgcttcttgctcgccccgcccccccctccagcaccgcccccaccaccacccccggcccccgcccccaaaaaacaaaccaaccaaatacactccttgctagccccggcggagcggcgacgccagttgagtcgagccagtccacgcgggccggggggcgagcagagcggcggcggttgctcccggcgggcggccaatggcggaggacggcgagaaggcggcggcggctgctgcggtgggaggtgttgcgggtggaggagggggagaggcggagcaggagcgggaggagcagagcgtgaagctgttcgtggggcaggtgcccaagcacatgacggaggcggagctcgccgccatgttcaaggaggtggccctcgtcgacgaggtcaccgtcatcaaggacaaggccaccaaggcctcccgagggtgctgcttccttatatgcccctccagggacgaggccgacaaggcggtgaatgcgtatcacaacaagcacacgctcccgggggcggcaagtcctttgcaagtaaaatatgctgatggagagttggagaggctggaacacaagcttttcattggaatgcttccaaaaaatgtagcagatactgaattgactgatttgttttccaaatatggaaatatcaaggatttacaaattttgagaggttcacagcaaacaagtaaagctggatgcgccttcattaaatatgaaatgaaggagcaagcagtggcagctattgaggatctaaatgggaagcacaaagtagagggttctagtgtgccactggttgtcaaatgggctgatacagaaaaggaaaggcaggcccggaaagcacagaaagctcaactgcaatcacctaatatgccgaatggacgcccaatgccacaatcttcagtatttggagctttacagatgggatatatgcctcagtataatggatttagttatcagcctccagggacatatggacttatgcagtaccctttatctcctatgcaaaatcaaggcccctttcagaatatgggtcagcctgttaaccaagggaactcgatacgaggagtcaaccctgaactgtcccccaactcaggtcctagatcatttaacccaatgcatttaggcagcccgtatccagcagtacctggtatgcagtaccctggatcctaccctggtggtccgatgaacaatcgtccttttgggaatcctcacaatccccttaaagttccaagtgcaaatgtcaatcttatcgcatttagtccccgtagcaatggcggtggccaaacacaaacagaaggacctcctggagccaatctgtttatctaccatatcccacaagaatttggtgaccaggaactctccgatgccttccagaggtttgggagagtaataagtgccaaggtgttcgttgacaaagcaactggttccagcaaatgcttcggttttgtaagctatgacaaccctgtgtccgcgcagtcggccatcgccatgatgaacggtttccagctaggcggcaagaaactcaaagtacaactcaagagagacaacaacaagctcagtaaacctttttgacaaaaatcatctgtgatgcccatgcggtcttgttcccggtacatatttgtcagatagttgaccgtgacgctgattgtttccccacatggccctgcgtggcgcgccgcgccgcccaggggatctgccggggagcgccatgtatcttctaagttcagttgacaatcttaagaaaatttgttgcattgtgtaattttattatctcagcttagcgttagcgtcggaccccctgtatacatcagaagtcagattcattcaattatttactttgtctcatggcaaatggctctgaactttcttggtcaaaaaaaaaa

SEQ ID NO: 3480 - DNA, 593 bp, Triticum aestivum
  unsure (1)..(593): unsure at all n locations
  Clone ID: PAT_TA_3480
tggcctgcaccgtctggtccacctttttcatgctagccacctctccctcggtgaatccttatccatggtggatcaagtggaatcggtacattcgctacacagaattcaaagcaccttggaaatgtacacatgagacattattctttatcgaatttccgacatcagagacacgtatgctgttaatcaggtgctgaagaaaaaatcaatcctctccacttgaaggtaggtgatgcacacagatttcttcttaccttgcaagcaccgttggatgaagagagtaggcatgatcatggacaaacgcatagcgtggtcgcggccgaggtacatacgctgcactttatggccccgtgccgctgccatccttatcatgcctctccttgatctggctccccacagtgccgtcttgcctcgatcttgcaggagaggaggacattgtttatttgcgtagggctgtcgggggataattcgatcgagtaggagttgttacgtggaagaggagctagcagctgggcgatcgtttggctaggtgacgaggaagaaattgatacggccggccgttgtacctgcccgggcggccgctcgaaatcaatnnn

SEQ ID NO: 3481 - DNA, 757 bp, Triticum aestivum
  unsure (1)..(757): unsure at all n locations
  Clone ID: PAT_TA_3481
tccgccggcatgcggcggatgggctacaaccggagctccaagcggtgcaaggagaagtgggagaacatcaacaagtacttcaagaaggtgaaggagagcaacaagaagcggcccgaggactccaagacgtgcccctacttccaccagctcgaggcgctctaccgcaacaaggcggcgctcggctccccctccggcgccggcggcgcactggctttgccgccgcccgcagtgcacgccaatgcagctccccaggagcgcatcgaggcgttcaccgtcgcggcgccgatctcgcagacggctccgcagcagccacctgtggccaagaacgacgccagcaacgccgggaacggcaacggtaatggcggcggcgcgtcggcaggagcccccgggggagcgcaaaggctggcggcgagcaacggcggcagcaggttcgtcttcagcgaagcaggcggcgacgcggcnggcgaaaaagccagaaggcattatgaaggagacgacgatggagcagaggcagccgcagccgcagccnnangcggngcacaangcggnnatcaacaacttacaaccgtacnggcggnggnngnncccanagcnanaaacantgacnangacnaannangacnaannncaattcnnnngantaaggnncnagnnngnacnancttnnatngnnnanaaaaaacncanntnnaannaatcatttnnanagggnnnnnacannnattnnnnattnnnnnntnnaannnnnnccncnann

SEQ ID NO: 3482 - DNA, 603 bp, Triticum aestivum
  Clone ID: PAT_TA_3482
tttcttctttcctctttgcgtttcccgcgctagccgagctcgttcgatccctctccggagcctccagcagacgcggacgaacgtgcgcacgggatggcgagcatcttctggggcggcgcccaggccgacgaggtggccgacttcgacgagcacgaccccaccccctacggcggcggctacgacatcaccctcaccttcggccgcgccctcccgccctccgacgagatctgctaccccatctccaccgcctccacctcgtcgtcatcgtacgacagccacggcgcggccgagcagcaccgcaggaggccgcaggaccaggacagccacggctccgcggggcacgggaggaggccggaggagtcacacggctccgctgctggttacgggcacgggaggaaggcgcacgacgacgacgacgacgacggtggtgcgtaccggaagccgaagccgtcccacggcgacgacgacgaccggcccagctacggccgcaagaagaacgacgacgacgacgacgacgagaggcggtcgcggtacaagaagcgcgacgacgacgacgatgatgagaggaagccacggcacaagaagtgcgacgatgacgacgac

SEQ ID NO: 3483 - DNA, 1483 bp, Triticum aestivum
  Clone ID: PAT_TA_3483
cggcctcctcctccccccctctcccccacccctacccttacctttccccacacccaccacctcaccctcttcctccgccgtcttcttcttgctcgggaccgcggtcgcctctcgcttcctcctccccctctcctcctcgcccctccttctctccctgaaccatcccggtccgcggccactgggggttcttgggattgccggagatgatccatggttcacggcggcaggcccctggcccccccgtgccgcccctaggccccgctagcccccacgccacccccccgcaccctggagcccgcagtccccacgggcgccgcggggtaccgatgaggctgtccgccggcctcaaggctccagcccccaccaccctaacctattcaatggactgaagctcctccccctcccacaccctccccagatatctgggccttcccgaggttccagtatactaggtttatgttaacggggatgcctcatcatccgccatcgaaaggcgagcgcgactccatgaattctacgccataatatacccctactcgcaacaaaagtgaggagaacgtcatggcgagagactgcaaagagaaggggtggtgccagggggacggcgacagcggcggccgccggaagctttacgccgatgacaaggacgccgagagggaagacgagtgcggcatttgcctggaggcctgcaccaagatggtccttcccaactgcaaccatgccatgtgcatcaactgttaccgagactggtacacaagatctcagtcgtgcccattctgccgcggaagcctgaagcgagtccagtccagggacctgtgggtgctcaccggcgacgaggacgtgatcgacccggtgaccctggagaaggagaatgtgaggcacttccacagcttcatcgacagcctgcccctcatcgtcccggacaacctcctgctggtctactatgactacctagtctagcgacgctccggcgccagctccggctgggcgtggagatagcgatgatgtactacagtgcaagggttctccggcagccgaccatcctccgcagatcgagtctggcaagcgaaagccgaagccgaagccgtcagtcagtcagtccgtttgccaagcgccattatttgttgctctggctttgcgcaatcgcattggtgtggtaataagtgtacagaaaaatgaagtgcttgatggatcctgatgaaggtttttacttgtttggtatcgatgctctggcaaattgccaagctataattaaagaagaacagttgctgggtaatgagtcaataaaagtgtgtctgtgtcgcctcctactaggagagattacatataatccaaccattccaactttatgcgacactaaagagacacattcggtgatcccttttaattgagtgctgttcttgttttgagtttaatgggcagttgtggtacttcataccattcttagagccctgctgtttgccacactaaatacaatggacta

SEQ ID NO: 3484 - DNA, 734 bp, Triticum aestivum
  Clone ID: PAT_TA_3484
tcggcacgagggtcgatgccatctctcccttcgttctcctcctgcgccgccacacaccgatcgcctgatccccatctccctctcgtctccaccctcgcgctgccttccacagagaaagagagaggagcagagccccacgcccgatcccgctcatccttgcgccctccggcgagctcgcccgcccgcgccttcttcccttgctgcaaccgccgagaccccgccatcgtcgcgcccttctgccgctgctctgctgccgctcctcctcacctcgtctccctcgcgtcagctgaccatcagggacgcaacaccgacaagcagcagctgaccaggacccgctgccctcctctcctcccatctctctccttttccctggctcaccctcgtctcacatctctctctctctgtctgaaccaggaccccgcgttgcctccgcatcttctgctgcgagctacctcttcatggagctccaccacctccctggccttggatccggcttgttcccgccaacccagttgcccgtcccgtggccgcactcttcatcttcggcggatctcgcaccggtgcaagccccctgccccagctctgcttcgtttgagtgggggtggaggacgcatctctgctcgcccgcatcgatcggcgccaagtccgtgccgccgacctctgttttccttctcgtcgcgtgagcatcagcgcacgctctcttgcccgcgcgtgagtgctcgcgtgggccactt

SEQ ID NO: 3485 - DNA, 551 bp, Triticum aestivum
  Clone ID: PAT_TA_3485
gcggtgtaaaaaacaattgtttttcatattaaacttctatacttattttaaactaagtgtaccatattacagttgtaataaatatatttttattagttagttatataaaatcttttcaaataatagttatattattcattggtatgcagttgtaatgtatatcattgaaaattataattctacaaaatgaaaattttatgatgcaccaaaaatttctttattgttgaaacaatctttcatatttttatttttctaatactgcataaatgatgtatgtatacacatttgcatatatatgcgtttgttcatatatcttttgatattatgttgaatattatcatagagatttctaaattatagacacactaacaagtatttttcttgtgatttctattgtatattaggcagtcaaattaatggaaacttctagggaatagaaaatgtgtcttgcatgttcggtttagtaattcgaagaaccgaaaatgttgttgattatactttcacgcatgattcgattacctaacatgctcggccagattcacttgttttga

SEQ ID NO: 3486 - DNA, 690 bp, Triticum aestivum
  unsure (1)..(690): unsure at all n locations
  Clone ID: PAT_TA_3486
gcttcgctaataacggcgccaccggtatagttgctgctcgtgccctcggtagcgccgcgcggaaaccctagccagccggccggcgacgcgatgtacccggcgggggccatggtggcggccgcggcggcgccggcgcgccaggcggcgtcgcgggttgacaaggccaccagccacctgctcatgggccccgactgggccgtcaacctcgaaatctgcgacatcatcaacgccgacgtctggcaaacaaaagatgtggtaaaggcagtgaagaagcgattgcaacataaggatccgaaagttcaatactatgctttgacgttattggagacgatgatgaagaactgtggtgaatatgttcaagtttgaagtcgctgaacagcatgttctgcaagaaatggttaaaataatccaaaagaagaatgatatgcaagttaagggataagatattattacttttggactcctggcaagaagcatttggtggacctggaggtaaataccggcagtatcactgggcatatcttgaaagtaaagccggacaggtctagtgttcccaagacgtcccatagatgccccaccaatacttaccccncnggcaatacacaattcccnaaactatggtcactggatatccgcangaantttaatnaaaaggattcctcnatttganacccgagttaagggactnaa

SEQ ID NO: 3487 - DNA, 462 bp, Triticum aestivum
  Clone ID: PAT_TA_3487
cttcctcttcctcttccacccccctctgcggtttcatccagaaaaagatcgaagcaaaacattggagtgctcgccgccggccggggtttccaatcgacggtgcacgccatgcttgacgacgatcagtccttcaccgagggcatctcgagccccatagccgcgcacatcctcgacttctgcgacgatggcggcggcggcggcgacctcttcggggcggtgaacgctgcgtccgacgtgttcgctgcctcgtcggaggacgcctcgtcgtcgttcaccgccacgcctcctctctgcagccatggcgataacatgtcgtcgggtgcggccgcggccacgaccacggccagcttctcccccttgccgtcccttgactccacactctcggcgctcctcgaggaagaccagccgcctggcccagacgccgagctcctcctccccatagattacgcgttcgcggcggcg

SEQ ID NO: 3488 - DNA, 791 bp, Triticum aestivum
  Clone ID: PAT_TA_3488
tcggcacgaggtccccctgcacttcagttcttcaacacttctcctcctcctcacctcatctaattagctctcctggtctctttctctcctgcccacacaccttcatcgagcgagggcatggcatcctccagtagcaatggatgccgcatttgtagctcttccagccataagagcaaacaatgcccccgaacacagtgcggcacctgtggcggtaagggccacgtttcgagcatttgcacctcccacacctccggtggccctctgtgcttcagatgtggcttgccggggcatagaagttccaattgctggggatattccaccggccactgcgccaactgcaacggtgttcgtcacagtgaagacgagtgtgcaagtctagtccttaaccccatttgccccaactgtttgaagaaccactatgcaagggactgccctgatggtaagttgagtggacactctctcggtacatgtcatttctgtgccgttccaggtcacaatgcccctgattgcccacaacgtcgtcgtgagtgacgttgaagtaaacttagtgcatgttctagatttgtttgtctttcaaataaatgtgctactaagctgcctgtgtgcagtgtgcactgagtgtcactctcgatggcaagcatgtttgcgtcgagttcatgtatgagtttggggttcctctcgcttcattcagtcgtgagctgagtcatgggatggcatgacataataatcggatcacacatgatgttggcagagttttaaataccgcacgcactatatattcgtgggatggt

SEQ ID NO: 3489 - DNA, 990 bp, Triticum aestivum
  Clone ID: PAT_TA_3489
tacccacgcgtccgcgggcctccgaccagaccgagcagcaaggtcggcccgtcgcgcccccttccttcctggttttccttccttatcccctacctcacctctgcctcccttctctctgccttgtacaagagaacgccatggacgccgagctcgccaaaccccgccgccagggacccccctcttctcccacccgcgccgccccgcctccgctgctcctcggtcctccgccgcctcacggcctcttgcaccgctgccttctctcccggcctcttccccggcgctcgaggtgcagtagcgtgggcgctgccacgttctcgatccagtcggatctggcgcaggtcgccggcatccggcaccgcgcgccgtgattccagatcgggcgtaggtcgccggcaggagagcaggagcggctgctgcagcgagtgcagtggaggatcctaccctggtcaagccccaccccggcggctgcgtgcagaagaggagcggtcgaggatggccggcagttcgtggaggagacgctcggcacagatagggatagcgaggaggaggttgtccccgcgaggaggcaacgtgaggctgcacgggcgcctccccatctgtgcatctaccgagaatggatggactcaagtgggtaaggacgccatcagcacgtgataagattaggtgctgggtaccacatccgcccaaatccaaggtctcaagccacacaggcatggagatggggctgtcgctttggttgtagccattcatatgcatacacgcaaggatggagatttcagttgtgcttacctcgacaaaatatcattgttggtagcatagccatatcattgtacttggcatctaccttactgtattaggattcttaatgtttcatgaggttttattttgtgagttctggtattatttgttataattgcgtgaaactatttctgaacctatatgacataaatttagtgttaccagtctggaagttatgatagcaatggtttt

SEQ ID NO: 3490 - DNA, 888 bp, Triticum aestivum
  Clone ID: PAT_TA_3490
tttttttttttaaaccatcaactaattctccagtataaaacctagtgttacagcaggttcaaactagttgtcagttgtcacataccagattcacggaaatatttacatttacagttacagctgtggttatttacagattttcatcgaggggtgattacttgcagactataaccgatgccgggccttagtttatacactagtttatactaattgtttatatacaaccgatgccagactacaacagatacgatcaatgaaatagcatggtgactgccggatcttcgctgactgatccaaaaacctgctttattccaaatctattcattggttcgatgaaggaaacatcaggagctaacgattatgcttgagtatgaggtgaggatataagcatctctgatgacgaagcccttgatgatgggcaacgggaaaccttgtcccaagatacggagttcacatagggcacggaacaaatttttcaggacgatgcgcatcacactctgcactatacccagtatgaagtttgccaatgtcactccacttcaagtcgaacgagaaataatttaactcaacctctcccacaagattattcccagaaacacttgcacgtccagaaacagcaactgacagtgatatgcatgcaactggaactatatcatcagaacccaatacaattactatgacatctaagtccactgtggtgtcaattctacccacattaatcctcacagagggaggtgatatagcagaaatgttcagcagcatatccttgtttggatatttacggtacaaccttggaatcaaaaacctccagctagcagtgttcaaaagaaactgatcgggaaccttgtccaccaaatgttgtagtaaaccagccttgaagtagagagc

SEQ ID NO: 3491 - DNA, 955 bp, Triticum aestivum
  Clone ID: PAT_TA_3491
gcactgcccccacccacccaacggctaccaccaccccatccacccagtagtcaattaagcaccacccgaccatcgcgccgaagcagcttcctaccgtcctcctcgtcgtctgcgccaccctcctggccctcgccccaccgttgctcgccggcgaccccgacatgcttcaggacttctgcgtcgccgattacaaatccctcgacggcccactgcggctgaacgggttcccgtgcaagaggccggagaccgtgacggcggaccactgctactccgccgcgctggccgtcccgggtgacacgggcaacccagtcggctccgcggtgacggcggcgaacgtggagaagctccccgggctcaacacgcggggcgtctccatgtcacgcgtggactacgcgccgtggggcgtgaacccgccgcacacccacccacgcgccacagatatcatctacctgctggagggccccctcgacgtcggctgccgcccgactccccgctagctctttgcccgcgcccgccgctctcgtgttcccccccggctccgccgaccacccgaagaacagcagcggcgcaacggcctcggccaacccagcactaacccgccatcctccaggcaccttgtccccccccaggccctcgttcggtcgctcgccgcaggcgccccccggcgtcctccccacggcccgccagggccgcgccggcctgcggcggcccgtcggggccatcttcccgccttcctacctagccttgcatttgcatgcatgaggttggttgggtcggttctgcgtgtgcacgtgctgctaataatgacgacgaccaagtgcagtttcaattcatttgcttgacagtatcttttgtaccatactctgatcgattcctttgtgtcggtgcatgtttagtgaagggtgtcgccggttttactgttaattgttgcttttgttcacgaacgacctaccgg

SEQ ID NO: 3492 - DNA, 1134 bp, Triticum aestivum
  Clone ID: PAT_TA_3492
cccgccgccctcctctcactatagagagctcagaaaaccccccatctcaattcatcttatccaaaagccacaccgaaaatctcgtagaaacacttccaacaagagaaggatgggccacgccactcgtcctctacagcaactgctggattagagctaattctcttaaggattccatggcagtcaaagacaagctcaagccccgccccgacgacatcatccttgccgcgcaccccaaatgtgggaccacttggttgaaggccctcctttttaccatcgtaaacagatcccgctataccttcactgaccacccactgctcacgcgccgtcctcatcaagttgtgccttacctcgcactaaggccaggagaccttgacatagtcgagacgctaccctccccgcggctgctctccacccatctgccgctctccctgctcccatccacagtttccacccttggttgtcggattgtgtgcgtttgccgggatcccaaagatgcctttatctcaaggtggcactttgagaagagaatgaaccaaggtatgtccataggtatggatgaagcattcacaatgttttgtgagggatgctcaccttatggtcctttctgggaccgctatcttgagtactggaaagaaagcttggccaggccacatgaagttatgtttttgaggtatgaggagattgtgtctgatacaccgaaggttatcagcaagctagcaagcttcctgggcgtcccgtttacccaggaggaagatagcaatggagtggtggagcaaattgaggatttatgcggcttcacatcactgagcaacatcgcggccaatcggccaagtcgtgttgaacatgagcaagctggagaaaagcttgttgttgatcccacttcactattcaggaaagggaaggttggggattgggtgaaccacatgagcaaggacatgggagacagaatggaccaacttgtggctgagaaattcaaaggttcaggtctcatattctaacgtgtgtgcttgttgtatcgtttttgtatgattgatctctttcaatttactgcatgtgtctcctttagtactgtatcaagtaagctttattgatttaaataaaacacatttactaaaaaaaaaaaaaaaaaaaaaa

SEQ ID NO: 3493 - DNA, 941 bp, Triticum aestivum
  Clone ID: PAT_TA_3493
gacaaggagctcgcaaacggtcagtgactacagctgtaatggccggcatgtgattacaatgactagaaatctcgaccgtccgatcatcggctcagttctgcagaccatgtttggtgtctcaccaacacaccagtcatggagccctgagcacaatgccacggtcgttgattacacttgggagcaccggacacacaccatttggggccgttctcaagagaccaaatcactgtcttttgtgcagaaagatgcagcccgtaggaatgttcttcttaccaccctcaactacacaatcactagtccagttgaggttcctggaggtccctggctgcccatgggggggagaatataaccccttaaaaagagaaggcatgttgagttcattcaaagggggaatccgcccacttttaagttggagagggtggtgtcagccatgtcccgcctggattacaacaaggcaatgtaccttttgagatcttcagatcatgatatgtatgccatttacatgttggtctatcaggcttctcaggagctggaggcctcactggtttgcttcaaagacccaccattcccatggctatcagtttccttgtctggagtctttgtttttggtttcttttttgtgtattctaagagggatagtttgtttaggagcaaaaggaagcagttatgagttctgacagcagttttgttggtggatactacttgaaagcttcaacctgatgcgatcatagttgacagctgccgggaaattgcatccttgcatattacatggagcagtgactagacactgggaatgggtgcatcttgttccaagataaacttataagaggtattctagattatttgaggaagtcaacacttccacttgtcttgtaagtttaatgtacctgaattgcccttcatacataatgttgatctagattttgcagaccaaaaaaaat

SEQ ID NO: 3494 - DNA, 743 bp, Triticum aestivum
  Clone ID: PAT_TA_3494
agatgtcactttcagtgttggaggcgagacctttcaggcgcacaagatttggcttgccatgcgatcacctgtcttcaaagcagaactctttgggccgatgaaggagaagaggatgcggtgtttgaccatcaaagacatgcagcccgctgttttcaaggctctgctgcatttcatttatacagattcattgcctgacttggatgatcttgaaggcgatgataagtgtgaaatgatccggcatttgctggtagctgcagataagtatgccatggacaggctgaagattatgtgtcaaaacatccttggcaagagtcttgatgtggagaacgtggcaactacattggctttagctgatcagtatagctgtgacaagcttaaagatgtttgcattgaatttattgcctcttcagataagatggatgatgtggtggcaaccaaaggttatgcaaatctcaaaagatcttgcccgtctgtcttgatagatgctttagagaagagaagcaggcctcgcatatagagcagctcatgcgtactaaaatcagttacatgcggttgttgaggtttcttatgttatctgcacctttcctgaaacttttcgacgctcaaatagtgtaatagcatgtgtggaacttttatcatctcaaaatgaatgaatgttagtatgttacataacagtatcttgttgctttgggaatataaccacattacatcataaataacaactaaaaaaaaaaaaaaaaaaa

SEQ ID NO: 3495 - DNA, 704 bp, Triticum aestivum
  Clone ID: PAT_TA_3495
gggttgcttcacgcgttaaacgcccgctgatccagctacactttctccactgctgaaacattgaggcccccggtgaggccgccgacgcatttggttgtccccgccggcggggtttttcagccctacccccctcacttccctgggcgtcaaatccacacctcccgacgtcggaagcacgtcttccgcctccctccggcgcgagcacgtcctctccttcctgcagcctccctcgtgagcagcggcgggctcagcctcatcacgctcgcctcttcttctctctcgcaccagtagcgacgcctcgggtggtcatctccatcctgcgacctccacctccctccggatctgctcctcttccggcctttcccgagcagatccggtggcttctctccaagatcaggacactggtagtccactatggaggcgccttcgtcatcccctactctgcaagatcatctctcccggccaactggccccttgcatctcaaagtatgggagggtgtatgcattgccttgggagtgttcatggcggtcatcttctttttaactgtctggctcactatgcggagtaggaagaggaccaaacgagcatctgcaaatatcccagtcacccaaatccctgccatatccaaggaaatcaatgaagtgagggtggagcaagtccctgcaactgactttggggcgcatgacggagtcctgctaacgat

SEQ ID NO: 3496 - DNA, 879 bp, Triticum aestivum
  unsure (1)..(879): unsure at all n locations
  Clone ID: PAT_TA_3496
ggcatcccaccagggcctaccaccagccccaaggggtctgccaccgattgaggtcgcatttgatagtaatggcaacggaatcttgacgggatctggaaagggcaaggccaccaccagggcgcagcagattaccacccgatcgtctcgtggtctttcttagtgagaatgggagaggaaggtgcggtgcactgaactaggcccccggaaaggagcggcagacatgaccatccaatcaccccagagactttctgagtcggagatcgagaagatggtgcgggaggctgagttgcactcacagaaggaccaggagcgcaaggccctcattgacatcacgaaacacctgcagacaccaccatttcacagcatcgagaagagactgggagagtacgaaagggccaagatccccgcgggagatcgcctccgagatcgagacggcggtttgctgatctccgcacggagatggcctctgacgacattgagaagataaagagcaagatggaagcggccaacaaggcggtctccaaagatcggggagcacatgtccggtggtggaccggctgaaggcggcgtggttggcggttcccatgaaaggagggtcgctgggcggaggctgaccaactgccccagatgccgaataacgaggaggcgaagaaggcaagctgccccggcatcccaagcttcttctaatacagttattagctagtcttgaggaacactagggatcttgttggctgtaataaaattttgctccactgaggcatgtgaaacatgctaaatgctcttagcgcgcacggtactgccgtattgtatgacttggttgaactagcgtgttcttcgctttgagttacgttgatgttgtggttcaaaaaaagggggggn

SEQ ID NO: 3497 - DNA, 556 bp, Triticum aestivum
  Clone ID: PAT_TA_3497
atcttcctcaatctcagtccagaatctcacaagtcagctcctcgggccatcgtcggcgtcgtccctcctctttgccggcccccttcctctgcctactagtagtagtgccagtactagtgctaccagtagtatataacaattcaatcccgtccaccaaccacaccaagaaccgcgagcgagcgagctcgggatccggcttgaagttgccatggaggcggccgccgagctggcgcagcgcctgcgggccgcggccaacgaccggctggcggggcaagagccgctcctcctcgtcgccgcgccgctgctcgcgctcctcgccgcgcgcgccgtccacgccgccgccgtcgacgtagccgaccgcgggctgcgtaccgtcctgatcaccctcgccatggccggcgtcaagttgtgtgagaagttgcagacaagaagtgcgtccagcgagaacaatgtgccaaccgagctgcccgccgtggggatccccgacagggtcataggcgatctccaagccctcaaagacaaggatgtgagatggcatgggaaatgctccggcgca

SEQ ID NO: 3498 - DNA, 885 bp, Triticum aestivum
  Clone ID: PAT_TA_3498
cccgttctcctgtccccagcctcacttctccctcagcaagtgctgtcgccgggtagctcccatcagctcgctctcttgatccgctaacattgaggatgctcgtcctcacctgaagtcacccccgcagctggtgctgccacagggtgaccatcgacggcggtgatttggtcacggatttcatctcccgcaaggccgcagcctcttggatccagcttcagtatgactatgaggatgctggcgagactttcttccccaagcgcgcaagccaaacgcatcatcgctatttcccgcgcgaggcagctcaacacatcgtccacatcctctacagcgccaacatccttcgaagtttgaactgcagatggagctgatggcattaagacaggaacccactatcaaatttgagagccagctggaggaagacaatgccaaactgccattggtttgaggatgttgacttcgaagtgtcgttcgccgatctataatttcgtgcagatggtacttattggaggtggtctgattgctcgacagagccggctggtgtccgctggcaggaagatagtgccgaagtgccattggttggaggatgttgacttcgaagtgtcattcgccggaggaagatgatgtacaaggtgtaacctataatctagaggacaattaacccttgaggcggaagtgctttgtttgtggagatcgaatctctgtacgtttgtgggagtttgaagagatggcatctccataaaaaaaattgcgccagtttttttattatgggatgttctgatggctcatgttttttttgcgaatagcctccatgggatggttgaacctactgggatcatgagtttttgttgtggaatgatctaatcgctcaaaaaaaaaaaaaaaaaa

SEQ ID NO: 3499 - DNA, 662 bp, Triticum aestivum
  Clone ID: PAT_TA_3499
gctccggcatgcgcagcgatccattggtaaacaatccagcagcagctcttcgctcacctctccctactcctcgatctatctatctctaggtttcttgatccaccggtctagtctcaagtgtggccatggcgaaggtgcacccgaacttggccgtgccgtctctggggatggtggcggcggcggcccgcgacgatgagccggtgacactgacggtgtggcgcaagtcgctgctcttcaactgccgggggttcacggtgttcgacgccagcggcaacctggtgtaccgcgtggacatctacgcgtccgactcccgcgccgaggtggtgctcatggacgccgcggggcgccccgtgctcaccgtccgccgcaagaaggccatcagcctcttgggcgaccagtggctggtcttccccggcgaggagacgcgcgcgccgccgctctacgcggtgaagcgcacgccgcagtacatgcgcggcggcggcaagtcgacggcgcacgtggcggcgtgcgggggccgccgccggcggcgcgcggtagggcgccgcgggcggcgcgcggtgccggggcggcgcgtcgtacgcgcggcggtgctgcgcggtgtacgtcgggcggcggcgaacggtgccggaggtgcgacccttccgggccggggcgcaccggcc

SEQ ID NO: 3500 - DNA, 558 bp, Triticum aestivum
  Clone ID: PAT_TA_3500
gaacaccctcacgagctatcgccgtgcttctccgtacgtattacaaagtgttgaaccaatctccaaagaatttacatattacaaagtgttgaatcatctccggagaattttacgaagtgtttgaaacaattttcaagaatgcaactctaacaatcaatctctgaagagtatttacacttgtttttgtcatataaagtcacatgtcagcaaactcctcgtcgtcaacttcatcgacccactcgactcgagaataatccgctgatttcatcaactccgtcaggcctgtcaggtcttccaggtaggttggttcgttgatcacctgcatcacaaaatccaatcctctactcctgtattcacgcaataccgcattggaacatgcgatacagctgctcgaggaatagcccacgagtgttaataagctgtactgcgatagtgatcctcgcatctggtgtggcaatagaccagacggacgctcactgcttttgccagcgatatctcctggagcatgtatcccatctggatgatttaacagtcttgtgaagagatctgcagcatgga

SEQ ID NO: 3501 - DNA, 587 bp, Triticum aestivum
  Clone ID: PAT_TA_3501
gccggccgggttgggacaccgtcaaccctgccccgcctccgaccccagaccaaacgcggcagctccaccgacagcaacccttcccaagatgcagcggcagctcaacctctcgccggcgccgaagcagcagcagcacgacgacggcgacggcggcgacgcggtggaggcggtgccgctgtgggtgcccgagcagtccgcggaggccaaggccgacaaggcgcccggcggccgcccggagaggtccatccacctcatcccgctgctcaccttcctctgcttcctcctcctcttcctctgctcccacgccccttcctcctccgatatgtcgagcttcggcggtggcggcggcggcgccggcggacggaaggctggcaaccggaggctgatgatgctataagcttctcgcatcagctagtataccagaccttaaatttttgtggctccttcctttgccagtttcaatccaacagcgcgatgtaatttgcactcagctatgcagctgcgtatactgtacttgtgcagcagcagtaatgaaatcttgaattgtatgcttgccttgccaaaaaaaaaaaaaaaaaaggccccta

SEQ ID NO: 3502 - DNA, 2235 bp, Triticum aestivum
  unsure (1)..(2235): unsure at all n locations
  Clone ID: PAT_TA_3502
aaaccgtcaactctgccctgccccgcctccgaccccaggccaaacgcgagagctccaccgacaacaaccccagccttcccaagatgcagcggcagctcaacctctcgccggcgccgaagcagcagcagcacgacgacggcgacggcggcgacgcggtggaagcgatccccctttgggtgcccgagcagtccgcggaggccaaggccgacaaggcgcccggcggccgcccggagaggtccatccacctcatcccactgctcaccttcctctgcttcctcctcctcttcctctgctcccacgccccctcctcctccgatatgtcgagcttcggcggtggcggtggcggcgccggcgccggcggacggaaggctggcaaccggaggctgatgatgctataagcttctcgtatcagctagtatatcacaccttaaatttttgcggctccttcctttgccagtttcaatccaacaaagcgatgtaatcgtatactgtacttgtggaacatcagtaatgaaatcttgaattgtatgccaaaaaaaaaaaagagggcggacccgctcgcgactatagaaccggacgcgtggggcacctagcctgggataggaaccgatgggcatagcgagctggaggcgctgggtcaaggaactatcgctctgcttctctatttttctctctgtccgatgtatttagatcttagaaagtgttgaatcaatctccaaagaatttacaatttacaaagtattgaagtaatcaccgaagaatttaaaaagtgtttgaaacaattctaacaatttccaagctaacaattaagcccttcaatctctatataaagtagtttctctcgtatttgtcctatagtgtcaaatgtccgcaacctccacgtcatcgacttactcgacccactacacacccgccgattccaccaatttcgtcagccccgtcaggtcttccaggtatgctaggtagttgagaaccttgatcaccacaaccaaatctccgcatccgcttttccggaattccgcaaaggcaccttcgatacagccgctcgagctatagcccgtgagacttaaaaagctgtactgcgatagtgatcctcgcatctggtgtggcaatagaccaagacggacgctcactgcttgtgccagcgatatctcctggagcatgtatcacatctggatgatttaacagtcttgtgaagaggtctgcagcatggccagatgcaatggaggccagtccaggtcgtgttactgtacactgttggtccagcgttcggttggagaccgaatcaacaggagcgataacgtcattgcagaaatagcaccccagtctttgacgcccaagaacatcttctgcagacagcttgttcatggcagcaaccatatctgaaccttcagaatttattcctggaccagccccatgtcgcatggcaaggtagctatcatatcctagggctgcggtaatagcaatcttgttttcattcgcacagagaagcgttggcagccacctactttcccttgtgtcagtcagcaagaagacagcatcatgggcagctactaactcctggagacgctcgcaagctttaagcacaccagcagcttctttagatgatacagggtgccctggcatcggtatttccatttgaattccttcaacctccactgacgaacatctctcttttagatgctccagtatcgctgtcgcttttggggtcttgcggtctttagttgtgtaaagtgattgtcttgccaaatttgacacaacaacacaaccactgtcaacaattgttagagtccgaacaccataatccataagaatacgagcaacatcgcacccaagagttccagcacctaaaagtagacatcgagcactagacaacttcccagaatttacagggaagctggctggcaatttcaaacaagtgtccgactttatcaaattagaaatgcctgtaaggtcctttaaatatgttggttggttaatggcttgcatgacaaaattcaacccttctcttctatattcagacagtacaatattagaacatgcagtacaatcgtttgaggaattgcttatcacagttgataaatcacaccgcgggagtgatcctcgcatctggtgcggcaataaaccaagctgatgttcagtatccataccagccatatctcctggagcatgtatccctnctggatgatgtagcatcctcgcaaagagctccaccgtttgccagatacaaggagg

SEQ ID NO: 3503 - DNA, 790 bp, Triticum aestivum
  unsure (1)..(790): unsure at all n locations
  Clone ID: PAT_TA_3503
gcaggnaattcggcacgaggcaactactcgcctgctctcccgacccccattgcgaggtgatccccccggcgccggcgcccaccatcaactgcttcaattgaattggtgctcctctttctgcaacccccgcttggtttattggaggaggagtggttggatcagcagcaggcccgtcgccaaaagggtctccaactccaaccataccatgtatcgctgaccctgccctgccctgtctttctttcgcggggagctgcttccggcggcagcgagagagcgagagggagaggcagaccaggccatggcctgagctctggagtggtggactggcgccggttggggcttcttcttctgcgcccgactcctactcgcgcagccttctttgggggaggccgcgtcgaccagcgtcgccgcggcggcgtccgcgtcggcgtcggtcaagctgggatcaaagcccgacgccttcagaaggcaggggcaggcgtggttctgcacaacaggactgcccagtgatgttactgtggaggttgggggtatgtctttccaccttcataagttccctttactttccaaaagtgccgttcttgaacaattgatagaggagagttcagatcaagaagagtgcatcatcaaactaagtgatatcccagggggtgcaaaatcatttgaaatggtggcaagattctgctatggagtgaaaatagaactttcttcttcaaatgttgtccacctgcgttgcgcctctgagcatctccagatgactgaagaaatatctgatgacaacctgattgca

SEQ ID NO: 3504 - DNA, 725 bp, Triticum aestivum
  Clone ID: PAT_TA_3504
cacgcgtccgccctgatggcacctttcttgacagcagcgccatggaagtcttgctggggcttggcagccttcatgtgtataccttaaacatgttccaagactgctcaacgacaagttgaattttgaccctccatgaatggtctctacaaggggctacatgggccatgggctgaagtatatcatgagatttacccaatccaccttacattcaactatgcgcaatagcgatgccatgtttttaaataatctatatatatgcttctacattgaaatcaaatttcatcataattttgctatttgataatagtataacactggtagacgtatgggttgtccctctaaaatttaagcttcgtctccatgcttgcttttgtctattgggaccctgattttcttagaaaggtggtcttgtgattactgagttaacagctgctgtcggaatattcagaatattcagttttgttagagtcgtagctgtagttgtttgaactcagtttcgtcagctttttttcttcagttaaactttagcagaaacaaaccaagttgtgacgatgtcctagattgttaggatagatcgtcgcaatgattggatcatgggatggcacggcacaacggtcacggcgacgatgcagagaggtgtgcaaggagttctaggatggcggcactcacaactcggatatgtcatgcttttctgtttttcagttagcattgtaatcactgaataa

SEQ ID NO: 3505 - DNA, 781 bp, Triticum aestivum
  unsure (1)..(781): unsure at all n locations
  Clone ID: PAT_TA_3505
catggttcaaaaaaggtacaagccacctgtttttgatgagaaatatcaaactagtttggctgatgttgatgctgctttcggagactcggaagaaaaacaagttaaggaggaaatcgaagggcagccagcttctatgaacgcatttgagttgatatctcggcacgagggactgaagctagataatttttttgaagctgataagaagtacagaagagaaacaagatttacatcgcaatgtcctcctgaagaaatcatcagtaggatagaagaagctgctaagccacttggctttgacatccaaaagaagaactacaagatgcgaatgaagaacctagaagcaggaagaaaaggaaacctaaatgttgcaactgaggtcttccaagtggctccatctttgtttgttgttgagctgaaaaaggcaaaaggagatactctggaatttcagaagttctataaaacactctctgcgcagataaaggatgttgtttgggtttgcgagagtgaggctgaagaaagaggctccacatgaggcagctgcagagtgtctttctcaggaagtagtattttaggttctctggtatatagtggtcctttgttccttgtagattcgtccggtgctcgatgtatatagagctttaggctggttcatgacttcgtggtctagaagcagatgaaatatataccagtaggttcaagtgcctctcttttttcccttgaagaaggaaaggttaaaatcttgtctgtgtagcatcgaagcgtactgatatcaagnataaaaagg

SEQ ID NO: 3506 - DNA, 1829 bp, Triticum aestivum
  Clone ID: PAT_TA_3506
tgtaaacttacctgcttcgacttcttgaaggaaataagtacatggaagttggacggcaggcatctgatgaaacactgcatcttgttctagaaaccctccaatcagccattaaatctggtggtgaacaatcaacatcaatcgagccagtcatctctcctatcatactagatgtatgggcccaacacattgccgacccattcatcagtattgatgctgtagaagttctagaggccatcaagaatgctcctggatgcttagaaccgcttgtgtcccggattcttccaacaatagcgacaattttatcaaaatccaagatccagccggatggactagttgcaggttcactggacctcctgacgatgatactcaaaaatgctccagctgctgtggttaaggcagtgtttgacacatgctttacatctaccattcagattgttcttgaaagtgatgaccatggagagatgcagaacgcgacagaatgtttggcagcatttatatcaggtggccggcaggagttgtttgtttggggtggtgaaagtacattgaagatgctacttagtgcagcttcaaggcttttaaatccagaattggaaagttcagtgtcacttttcgttgggagttacattttacaacttattttgcatataccttcacacctatctccccacattccggagctcattgctgccattgtgaggcgtatgcaaacgagcgacattgcaggattgaagagctctcttgttgttataatagccagactagtacatctaagtgcaccaaacgttgatcagtttatcaaccttctacttgcaattcctgcccagggctacggaaattcattggcttatattatgtcagaatggtcacagctacaaggtgaaattcaaggagcctaccagataaaggtaacaactactgcattagctctgctcatatctacgcgtcatcctgagctatctaggattgaagttaacggacatcttgttaagactagtgcaggtataaccacacggtcaaaagctcgggtaactccagataactggaccaagattccactcccatctaagatattcgcactgttagcagatactttagctgaaattcaagagcaagtcggtgatgatgctgacaatattgatgaagaggatagtgattgggaagaggttcagaatggtgatgcgactccacatgatatagtgtattcagcatcagttccttcgaatgctaatccgtcagttgagcatctaaatgcaatggcaaaagttttcgatgaggatgaagacgacagttatgatgatgatctggcaaaagctgactctcttaatgaggtgaagttgttggactttctaacgaacacatttgtcaatctgtgggacagtgatcggccacttttcgagtatctttgccagggcttaacaaatccacaaagggttgccgtacagaaggttttgcggaagtgaaccgtttacatgaggttatttattgttgggcttcggatttctcctagcgctttgttaggttcaatgcatgtggtgtaggctcattggtttggtggtgtttgaatgagcattttttctggtagctttggtgtttagtccacatttgaactaaatgccaaaactctccagagaaatactgccctatatccgatcgggttgttggggcgtatgtacattatttgttgttggcggtgcgaggttttgtcagtgtgcaagatactgctattcgtttatgcctttgttgtattggatggtgcatgttcggttcctgaaagaaaggcacgaagatgttatttgggtgtgtcccccacctgttaacgccgccaataa

SEQ ID NO: 3507 - DNA, 957 bp, Triticum aestivum
  Clone ID: PAT_TA_3507
ccgcgcgccccgtcgagccgcctcccaggggcctcccggaccccgggggtgcgacgagcgtgtccgctgaaaccccgctccccgcgcccgctcggcgcgcgcggtgctttgcggtggtcggtcccacctggctcttccttctggtccccggccggagagacggcctgtcggcccatccgggctcgctggccgtggccccgctgccgcgtcccctccctgcgccggttctgggcctgcggtgcccccggtgcggcgccctgcgggccgggacgtccccggtcgccctgccggggggggagggggtgcccacaagcgccgccgggcggcctcgcatgccttcggcccgctccggtggggcgtcgcggcgcgcccctgcgacccgaccgtgcgctccctatattcggtctggaagctttgctgatatcggacctaggaggtacatggaagatgaacacatccggatagatgatctttcagctcatcttggctcgctgttggggtgccctctacctagcgccttctatggggtctttgatggccatgggggtccggatgctgcagcctacatgaaaaggcatgccatgaggttcctgtttgaggatagagagttcccacaagcattgcaagtggatgatatataccttcagtccgtcgaggaatgtattcggagcgcgttcttgcaagccgatcttgccctggctgacaatttagatatcagccgctcctccggaactacggcactcgcagcattagtctttgggaggcaactgttggttgcgaacaccggcgactgccgagcggtgctctgccggagaggcatagcgatggagatgtctcgagaccacagggcgaactacgccgaggagtgccagagggtggccgcctccggccgggttcatcgaggacgggtacctcaacggtgttgctctccggtgacgcggtgcccctgggcgactt

SEQ ID NO: 3508 - DNA, 1591 bp, Triticum aestivum
  unsure (1)..(1591): unsure at all n locations
  Clone ID: PAT_TA_3508
ttcggcgccacgcgcccccccccctgccgcgggccctccgcccgccacaaaaccgaagctctcctccgcccgaatcgaagccgtcgtctcgaactccgtccggagcccacacccacaacctgtcacccacccccacccccacccacccagacgcgaagctggcgcgggaggcggccgacgcgagcgcccgcaagcgcgacgcggccgtcggcggcgcccccccccccgcccccccggcccccgtcgacgcggccgggggcgacgcgcccccgccggaccccgcctcgcaccggttgagcccggagaccgtgtcggtggagcctgaccctaactcgcaccggttgagccccgagaccgtgtcggtggagctctccatgggcggggactactaccacgcctgctgcggcgaccccgaccccgacctcaagcccgagggaccccaggtgccgtacatcggtaacaaggaacctctctccgccttagcagcagagttccagtctggcagccccattttacaggagaaaataaagttgcttggtgaacaatatgatgctttaaggcgaacacgaggagatggaaactgcttttatcgaagctttatgttctcctacctggaacatatcctagagacacaagatagagctgaggttgagcgcatcctaaaaaacattgaacagtgcaagaagacactttcaggtcttggatacattgaattcacttttgaagacttcttctctatgttcattgaggagctgcaaaatgttctgcagggacacgaaacttctattgggcctgaagaacttctagaaagaaccagggatcaaacgacttctgattatgttgtcatgttctttaggtttgttacctctggtgaaattcaaaggagggctgagttctttgaaccatttatttctggcttgacaaattcgaccgtggttcagttttgcaagtcttctgtggagccaatgggcgaggaaagcgaccatgtgcacattattgctctgtcagatgcgttaggggtgccaatccgcgtgatgtacctagaccgaagctcctgtgacacaggcaatctaagtgtgaaccaccatgatttcattcctgcagccaattcctctgaaggtgatgctgcaatgggattaaatccggctgaggagaaaccttacattactctgctctaccggcctggtcactatgatattctctacccaaagtgatctctggctgatgaaacaccaaggttgatttttcccatgaattcaggttgagaaaacgttgtctagaaccgtgtagttgtgttgctcctgcatgctgccaaaggcggccttacaagagggaacttgtgtgttcttggggcgtaatcatagcatgctttacttgtcactgccctcaaattcgaagttttccttgttgtaagtgtactctagcacaacgatttaacattgtggttgactgttgagaagaccctctgcatatcgtgactaatcgtggttcttgtttttcccttgaattatttactcctgcatcgtaaaaaaaaaaaaaaaaaaaaaaaaaaaaanngggnancaaaaannaaaaaaanccnaaaaaaaaa

SEQ ID NO: 3509 - DNA, 804 bp, Triticum aestivum
  Clone ID: PAT_TA_3509
acagtggtaatcctgggtttcttcaaagtcagtttcagcagctgcatttgcataatcctccggcaccaccacagcaagggcatcaggttatacagcaatctcaccaggagatgcaacagcagctttcatctggttgtcatcgtatttccgatgtagattctagcatgcctggttctgagtctgcttcgcagtcacaatcttcattctaccagcagaacctcttagaaggaaacaatgacccatcgttgcatcttcacaatggttttcgtaacttctctagccaagattcctcaaaccttgttagtttgcctcgaactgaccaattaatggcgccggagggatggccttcaaagaggttggctgtggaaccccttggtcatattgaatctcggtctgtgcaacccaaacatgagaacgtaaatcaccagagtaatatgtcccactttgctggaaccttggcgccgcagtcagcaagagactcatccagcgtccaggcttatggtgcaaatgttgacaaccagtttctgtcatcgtcatttgcattccaggacggaatggcaggtgcaaggggtggcagcagcagcggaactgtttctatggccatacctttgttgaggtatagtggcgaagatttgccacccgcagacaccttagcaacttccagttgtataggcgaatcgggaaccttcaactctcttgataatatgtgtggtgtaaacccatcacaagatggaacctttgtgaaggtttacaaatcagggtccccggggagatcgctcgacatcaccaaattcagcagctact

SEQ ID NO: 3510 - DNA, 654 bp, Triticum aestivum
  Clone ID: PAT_TA_3510
cccgggctgcggaattcggcacgaggtctaacagcaacggcgccgccaagggagcagttttgttggctggacgatccaactggcccattggcttcgcttgcagcagctgatcggccgatggggtgggcgatcgcgctgcacggcggcgccggggacatcccgcgcacgctgccgcccgagcgcagggagccccgcctcgccacgctccgccgatgcctcgacctcgccgccgccgcgctccgggccggccgctccgccctcgacgtcgtcgagctcgtcgtgagggagctggaggactgcccgcacttcaacgccggcaagggctcggtgctcaccagcgacggcacggtggagatggaggcctccgtcatggacggcaccgacatgcgctgcggcgccgtctcgggcctctccaccgtcgtcaaccccgtctcgctcgccaggctcgtcatggacaagacgccccacatctacctcgccttcgacggcgccgaggccttcgccagggaccagggtgtggagactagggatcaaagccacttcataacagaggaaaatattgagaggctcaaaaacgccaaagaggccaacaggggtgcagatcgactacacccaatacaactacacccacccaatcagcgctcccaacgacga

SEQ ID NO: 3511 - DNA, 939 bp, Triticum aestivum
  unsure (1)..(939): unsure at all n locations
  Clone ID: PAT_TA_3511
aaaattaattgagcaactggagcatcaaatttctaacataattctggaagaaagggaggaaatggcattgagaaaggctgaaatggaagctacaaaggcagaaaatatgatagctcacagggatgagatatattcacgccccaagagaacctggtttgctactgagaaggaaaagaaacttttggcaaaggctgctaaagaatccttggatcaagttaaaggtggttctgtagttgttagtgctcagcaagctgaagatcttcgtctgaaggagaaaagaagaagagagcgtgagaaaaacctacctaggaagaagcgcagaaaattggaggcgcaacgggagatgctggaggaggagaaggaagatgaggaggaagctcaggaaagcaaaggagggaagaaagcaaagagtagccaatctgtagttgatgtcgcttatcgcagggcaaaatcaatgaaggcgactggcaaaaccggcattcgtgctagcaaaggaaagaatgataaagggtcaaaacagccttctgaaaagggccaaaccaggcaagaggaaatgcatgagctgttccagaatgatatgagtgaatggaagcagggccgttccctgaagaaaaaggacacctcgtttgcaaagaaatctaagaattcattcaagagcaaatcaaggtacaagcgacgtaagtagaaggcctgtcaacatgtgacggcttgtcacaactgggcgggcactgcattccgttgcgacatttttgataagtttgccctaaagaattgccagggtcctcatgttgttccctgtttagtggttctaagaattttacccatactatgtaatggcattgttctgaaattatcttgtggtttccagttcagtggtttaaaaaaaaaaaaaaaaaactcgagggggggcccggtacccaattcgccctatagtgggnc

SEQ ID NO: 3512 - DNA, 822 bp, Triticum aestivum
  Clone ID: PAT_TA_3512
gaattcggcacgagaaaaccctaacctctgagcgaccctctgctctcgccgtgctccgcaacgtccaagcaagcgccggcggcgcgaccagccgtaccacccgatctctcaccatggagaagcccgcggcgcaggcaccggggaaggcggcttcagaggagaagcagcttgacgacaaggagctggagctagagcgggagcggaaactgaagaaagagcagaaggctagagagaaagaggagaaaaagctcaaggcaaagcaaaaggagactgctaggctccaggctcaagcaacatcggatggacctaagaaaagtgagaagaagcaaaagaagaaggctgcgggggatgaaaaccccgaggatttcattgaccctgagacccctagtggggagaagaaatcgcttgcacctcaaatggctaagcagtatagcccaagcgcagttgaaaaatcgtggtactcctggtgggagtcagcaggatattttggggcagaccctgcaagcacaaaaccaccttttgttatagttctaccacctccgaatgtgactggagcgcttcatattggtcatgcacttacagtggctatagaggacgctatgataaggtggaggagaatgtcgggatataatgctctgtgggtcccaggagtggaccatgctggcattgctacacaggttgtagtggaaaagaagctaatgcgtgaaaggaagctgacaaggcatgacataggccgtgacaaatttatatctgaagttctgaaatgaaagatcagtatggtggtaccatactgggtcaattacgtaggcttggggcttcgct

SEQ ID NO: 3513 - DNA, 701 bp, Triticum aestivum
  Clone ID: PAT_TA_3513
ctcgtgccgaattccgcgccaagctaggacgcacacaagccgtagtagtaagagcaagtagccagcaggccaagcaagcaagcagccatggccatcggcacgcgcgatttgggcgccggggccggcttcggccacagcaaggcccgcggcgacctgccacacccacacctgccggcgcggtgccccccgtcccgacgcgggatcaaggcgcctgagccccaaccaggaagcaggccggatacgacggcgccgtgcggaagacggcctccctcaccgggctggcctctgaggatgcccacgcgcaagggcaacggctacgacgacggcgggttcgaggacgacgtcggaggcgccggccgcgcaggccgcaacgacgccggggcgaaccgaggccgtcatcgtgagaacacgacggcggcgacccaggctgagggccccgccgcagcgaatggcgctcaccacaacgcaaaccccgcgcaggagccccgcccccatggcggacacaaggaggcggcgtaccggcctgcaggctaggacgccgtcagccacgacagcacggcgcgggagcatggctggggtgaccacaaggacagccagagccacaccaaggcccaccgcgacagcgcgccccgctaccgcggccacggcgcgcacgacgcctacggccggcaccaccgcgacggcgagcagacgtacgacag

SEQ ID NO: 3514 - DNA, 701 bp, Triticum aestivum
  unsure (1)..(701): unsure at all n locations
  Clone ID: PAT_TA_3514
ctcctccacaaccacaaagaacgtcgcgccgtcgtcgagttcaagnaacagggaggagagagaacaacggggagaagagttccagagtcctccgggaacgcggcgatggcgtcgaggaggcaagccgccgccgccgccagcgatgctcttgctcaagaacacaagggcgatgccaagcctgtcaggagaccgaaggccgcggctggccaacaaccagcagcgagaccccgtccagcccttatcgatctcagtaatcggatgagtagccgggctgctctggctgttccaaatcgtcccaaggcagtagctgttgcagcggttgacaattgtaggaaagcaataaagaagcagaaggagaacaacagagtgaagcccgaagtgatcgtgataagctcagactccgagaatgaaaagaaaaatccaggcaagagagccacctcctggagggcgccgccgcttaccgcaattctaaccaaatgcagcagggaatctgatggggtgatctccagcacgaagaaggtctcggcgacatacaacatcgataaagctgatgctcacaatgagctcgcagtggtagattacgttgaagacatttacaggttctacaagagcactgagggaagctcacgacctctctgcacctacatgagctcacagactgatatcaatgagaggatgcgagctattctgattgattggct

SEQ ID NO: 3515 - DNA, 589 bp, Triticum aestivum
  Clone ID: PAT_TA_3515
tctgccttatccactcagggaccctttggtgataaaatcttcacagattggtcctttttcttccacacctcataattccgcaaccgtaactccgatcgaggtgaaaccaacgctcacttcttcgtaccgtcgagctctatcttttggtaacattttcactaggtggtttcacagtgaaaatgactattatgcccttgcctctaatcagccccctccgaaaaagaactgtccgacgtttcgttccgcggcttcatcgcacttcttcctggagtctctgtcaccccagtttgcaggtcatgccgggatggcttgcttgtttggtgttgttcctgtgtttgcgagctaggataaacattccagccagagtccctgcggattggagtccatcatcgccgatcgttgttccgctgccagtagttgttccgctgcttcaagttgttatgctgcttgtatagagcaaccgtggttggcgtagtgtcaccgtgccgatgttattcattgtaatataggaacccctgtattcatattcgtgttgtaatagagagctggtttgttctttaaaaaaaaaaaaaaaaaaaaaaaaaaaaaa

SEQ ID NO: 3516 - DNA, 744 bp, Triticum aestivum
  unsure (1)..(744): unsure at all n locations
  Clone ID: PAT_TA_3516
ctcgtgccgaattcggcccgcggcaggcagcttcctaatcgcagttagtcctcgctcaactcgagcaaccatgtcgctgattccccgcggcaaagctttcgaccccttctcccttgacctctcggaccccttcgatggcttccccttcggctccggcggcatcagcagcttcttcccctcgttcccgcgcgcatcctccgagaccgcggccttcgccggcgcgcggatcgactggaaggagactcccgaggcgcacgtgttcaaggcggacgtgccggggctgaaaaaggaggaagtgaaggtggaggtcgaggacggcaacgtgctccagatcagcggcgagcgcaacaaagagcaggaggagaagacgggcacgtggcacagggtggagcgcagcagcggcaagttcctgcgcaggttccgcctcccggacaacgccaaggcggaccagatcaaggcggccatggagaacggcgtgctcacagtcaccgtgcccaagaaggaggtcaaggagccggaggtcaagtccatccagatttctggctaggctgcttcgggattgaggttcgattcgctgctctgaggttggactcgctcctttcgtgacttctgctcaaaggcctgtaataagtgtggatttgggtccgtgttgggtgtgagtgtgcccttgtcagtactgtgttcaacgtccgcgtccagagttatagtcatgtaatgcaagcatcccagtccgtnnaaaaaaaa

SEQ ID NO: 3517 - DNA, 795 bp, Triticum aestivum
  Clone ID: PAT_TA_3517
ctcgtgccgaattcggcacgagacgggtcggcgccctccctaaaattcctaaccctactccccgaattccgccgccggctcacgctccttccgcccccagatcccaaatccaattgaagctccagtcttctcctatttggtcgtcgattgaccaatcggaatccatggcgacagctgccgtccttgcgagccgcgagggcaagggccgccactatatcccaagctccgtcatactcgacctctttggccaaatcggccccagccgcaacgccaccaccgccacgtccaagacgagtaccggcctgcccatcgcggtgactttctgcgccgcccgcccgccagtcctctcgcacttctccttcagcagcgcggcatgcccggaacccgagggtttgtccctggcgcccaaggtcatcagcgcggatgctgacctcgttctcctccgcgtccccgtccaaccctttggcgactctaatccgatgtttagcgactacttcgtctacagggcgcactcccaaatcccaaagctggacctgctcccgaagtctgctccatattactttggagataaggagatcgccatactgagctgcggcgacggcaagtacgctgtggcctcccttcaaaccttgggtatgtgtacctttaagcttcacgtgtaccggtctagacctgatggcaagccagggagttggacctccaagctgctggatgtagagctgaatgtgaaggagctgccgagggacaactcgtcctcgatctctctcgcatcgcagatgcttacgtatcatcgga

SEQ ID NO: 3518 - DNA, 1272 bp, Triticum aestivum
  Clone ID: PAT_TA_3518
ctcaaagctctcttgctaagacatagagttggtgccgcagcctgagtgaaagatggcagcatctgcaaagatgatgaccaagtccagcgccgagcctggtaagtcggtcaccttggtgttcgagcaggggaggcttgcggtggaagagaaggagatcaaggtgggccataatgccacaccgccggtcccggtcctgatcgtcgctcctaaggacgcggggacgtatcccgtcgccatgctccttcatgggttttgcctcgagaaccaccactacaaacaccttctccggcacattgcgtcccacggcttcatcatggttgcacccaagatccatcaaacgatcatgcatacaggtcagcacgacatcaacgaagcagccaaggtggctgattggctccccgacggtctcccgtccgtgctcccgaaaggggtcaagccagagctcttgaagctcgccgttgccggccatagcaggggtggccacacagccttctccctggccttggggcatgccaagacccgcctgcgcttctcggcgtttattggcatcgaccctgtcgctggccaagggaaagattcccatcttgaaccaaccatcctcatcgacaacccatcctatttcgacatggcggcaaggccggtcctcgtcattggcaccgggctcggtgaggtgggtaagaccatccataacattcccatacttcccttctcgcactggcctcccggcgcgcccaagggcgtgaaccacgtgcagttctacggcaagtgcaggccaccatgctactactttgtgaccaaggactacgggcatgtggacatgctggacgacgatgccattggcctacacaacttgttttgcaagcgtggggatgggtgcaaggacaagatgaggaggtgcgttgctgggatcatggtggcattcctgaatgctgccttgggtgagaaacatgatggcgatcttgaggccatactgacagacccggctgttgcgccgattatgcttgatccggttaagcaccatcctaccagtcccaagtaagctgtaatatgttttatggtcatccttggctgctgcgtcgacgactcgacgtcgtccggatcagccgcaggttgctccaacattaaaaaagttgtaatatgtactatgtatgctttggtaagcacaattcatattaaataaatcgtaatatatataacgtacgtgctttgctaagcaccactcgttatatagataattaagttgtaaaaaaaaaaaaaccccccacccccccc

SEQ ID NO: 3519 - DNA, 925 bp, Triticum aestivum
  Clone ID: PAT_TA_3519
cccaaagttcttccgctcccgacgaccgccatggccgctcagagcctcctctttgccgccgccgcgcctctcttccaggctcctgcctctgcccgccctttccagtcgctccgaattgtctgcaccccagaaggcgccaccgccgccgccagggcgctcgtcgtcgccgacgccaccaagaaggcagtcgcggtgctcaagggcacctcgcaggtcgagggcgtcgtcacgctcacccaggaagacgacggtcctacgacggtgaacgttcgtatcactggacttgctcctggacttcatggcttccacctccatgagtttggtgacacgactaatggatgcatatcaacaggtccacattttaacccaaacggcctgacacatggtgcaccagaagatgaagtccgtcatgcgggtgacctgggaaacattgttgccaatgctgaaggtgtggcggagacaaccattgtcgatagccagattcctttgactggccctaatgcagttgttgggagagcgtttgttgttcatgagcttgaagatgacttgggaaaaggtgggcatgagctcagcctcagtactggaaatgctggtggaagacttgcatgtggtgttgttggcctgaccccgttgtaggtcgctggtttccatctctggttttgcatctccagtcatactggtttccatctctggttttgcatctccagtcatacttgtaacgacgccattctcgttttacctggatttcaaatatcggatgcttaatagtttctgttgatcgtttgtatcagtgtaaagttgggtttatcaaataaatgtttgcacactttcgtcttgttgagctatgaagcgtgaactcgggaattttggtgtgcgtaagctataaaatgctcaaagaattatatttgtggatgtccttatttcc

SEQ ID NO: 3520 - DNA, 1170 bp, Triticum aestivum
  Clone ID: PAT_TA_3520
gcccctccgcaaaactctccctctctcgttcccacccccaaagaccctcccgatcccgacgacccccctgcgcgcccattgccccctcttgccccccgccgcctcacccttgcgcggcccgtgcctctcttcgcccctgccaccacctcccgcaccaacccccaaaagttcttccgctcccgacgacagccatggccgctcagcgccgcctcctctttgccgccgccgcgcctctcttccaggctcctgcctctgcccgccctttccagtcgctccgaattgtctccaccccaggaggcgccaccgccgccgccagggcgctcgtcgtcgccgacgccaccaagaaggcagtcgcggtgctcaagggcacctcccaggtcgagggcgtcgtcacgctcacccaggaagacgacggtgtcctacgacggtgaacgttcgtatcactggacttgctcctggacttcatggcttccaccctccatgagtttggtgacacgactaatggatgcatatcaacaggtccacattttaacccaaacggcctgacacatggttgcaccagaagatgaagtccgtcatgcgggtgacctgggaaacattgttgccaatgctgagggtgtggcggagacaaccattgtcgatagccagattcctttgactggccctaatgcagttgttgggagagcgtttgttgttcatgagcttgaagatgacttgggaaaaggtgggcatgagctcagcctcagtactggaaatgctggtggaagacttgcatgtggtgttgttggcctgaccccgttgtaggtcgctggtttccatctctggttttgcatctccagtcatacttgtaacgacgccattctcgttttacctggatttcaaataccagatgcttaatagtttctgttgatcgtttgtatcagtgtaaagttgagttaatcaaataaatgtttgcacactttcgtcttgttgagctatgaagcgtgaacttgggaattttggtgtgcgtaagctataaaatgctcaaagaataatatttgtggatgtccttatttccgaaaaaaaaaaaaacaacaccggcggccccccgcaatcactaaagaaattcttttctgatttagttgaaagagagtattccaggtcagccttaaaacaaaagcgagagggctt

SEQ ID NO: 3521 - DNA, 1285 bp, Triticum aestivum
  Clone ID: PAT_TA_3521
gtagaaacgaagggggagagcgcagaggagaggccgggcgtcacgccaccgcccacgcgtacgcggagcgcccgcgagacgcgaccgaaagaggagagagccatcagccatgggaggaggcgtcatgcgcaccgccgcgaaggtcggcctcgctgggggcgccgcggcggcggcgggccgcttccgcaacgtcgccccgtccttcgccacggcccccgccgccgaggccgccgcggcggcgccgctgctgtccgcggccggggagatccccgcggtggcgccggccgggtcgcagtgggcgtcctgggaggtggacgactgggagttcgcggactggaggtccgagtcggcgtccgaggcggacgtggcggtggtcggggggccgaggctggtgttcgccccgccgtcgcgggaggaggccgaggaggccaccgccgagctccgggaagctattgacagggtttattttaaagagactccagtagaagttgttaaggaacatgatcaagagcttagcaagctgggagccgatgcattaattcctgctatgccgggacatgtagtgcaggcttttacattgttaaaatcaagcccagaggcacagagcgttgttgcctcgcttgcatcagataaaaatgtgtgggacgcggtgttgaagaatgagagggttatggaattttacaagagtcaccagcaaactctggtcaatacttttcctgagggcaccgactctagtgactcagtagagtcaccggagaaatttgaagaggcatccccagaatatgcacttcccactgcctcgcctttgtcggactttgtggacaatgcgaagaagacgatgatggagatggttgacaacataaccaactttttccaagacctgttccacaacccggcagaagctgaggccggaccgggctcatcctctaaaaagccttcgttcgcggagatggcggctggcggatctttcatggctcttgccatggcggtcatcctagttgttctgttcaagagggcatgaacatatactacaagttcaaacgctcttgatgcctattgggccttaaatctgtcgaaaataactcgtgttatgaagaactatggatgtattgtacagcgtgtgtctcctgccgtactgtgtcagttaaaacttccgagtgttgagaccagtttaataaagacatgttatgctcctggttaaaaaaaaataccgcgtgttgagacagtttaaaaaaaaaaaaaaaaaaaaaaaaaaaaaaaaaaaaaaaaaaaaaaaaaaccccac

SEQ ID NO: 3522 - DNA, 473 bp, Triticum aestivum
  Clone ID: PAT_TA_3522
gccgcgccctccccctctcccgccgccgggccgtccctcgcccccacccctccgccgcgcccgcccctcgcccccccccccggccccggcccaccgcctccccgcccccccgcccccgccccccctccgcctctcgcccggggcgcccccggcgccgtccccggtccccctcctcgcgccccggccggcggggccccgtctgctgttggcgcctccggtcttcgagccccagtcctatgcggcttctcgtgtgccttgtggagggatgccttgctggtcgctggccttcccgagcaggttcctccttggccatgcgggctctgcctttacgtgctgaagaaagagatgcagaagtctgaccatcacgagcagaatcttacttcaccaaggggactgatccataaagtgcttcgtcgtacaagtagcaggcgatctccaactgcagcagagcaagatccttctcctgtatttcc

SEQ ID NO: 3523 - DNA, 964 bp, Triticum aestivum
  unsure (1)..(964): unsure at all n locations
  Clone ID: PAT_TA_3523
ggctagcaggcgccgtcgggcaaaccggatagctgccgccgcggcggccgcggccgagctaggacgggctgccgcggttcgagaagaacttctacgtggaggttcccgcggtggccggcatgacggcggaggnaggtcgagtgcctaccgccgccgccgggnagnatcaccgtcgagggcaacgacgtgcccaagccggtgcgcgacttccgcgacgtcggcttcccagactacgtgttgcaagaaatcacaaaagctggctttacagaacctacccctatccagtcacaaggttggccaatggcactgaaggggcgtgatcttattggcattgctgaaacaggatctggaaaaacacttgcttaccttttacctgccattgttcatgttaatgctcagcctattctagctcctggtgatggtccgattgttcttgtgttagcccctacacgggaacttgctgtccagatacagcaggagacaacaaaatttggtgcctcatcaaagataaaaagcacatgcatatatggtggtgtcccgaaaggtcctcaagttcgtgatcttcagaaaggtgttgaaattattatagccacgccaggaagactaattgatatgatcgaatcacatcacacaaatttgcggagggtcacataccttgttttagacgaggcagatcgaatgctagacatgggttttgaacctcagattaagaaaattgtttctcagattcgtccagatcgacaaacactttattggagtgctacctggccaaaggaagttgagctcctagcaaggactttcctttttgatccatacaaggttataattggttctgaagaactgaaagctaatcatgctatttgtcagcatgtagagatattatctgagagtcagaagtataacaagttggtcaatctactggaggatataatggatggcagccgaattttagtattcatggaca

SEQ ID NO: 3524 - DNA, 1014 bp, Triticum aestivum
  Clone ID: PAT_TA_3524
gcccccacgtcccgcaccacctcaccgcctccccctcggctcatagccatcaacctaaccgtcccacacgagctccgcggacccagcaactcccacagatccggacccggcgggctaagccaggaagcactccatcggcttcccctcctctcctctgcgcagcgagccaggcaaggcaggggatgaagcgcgtcgtggcgagcccggggagatggagcggcatggcgctgcggcggaggccgtgcgccttgcgccgccgccctcctcttctgtctggtcttcggtttccgctactccaactacatgcgcctacttctacatgaagctagcgttgatcctgcagctgatgtggagtttgggccttgcttgtaaggatatctttgctctaaggaataaaaaggatcttcacaccccagataatctattcattattgttatggttgactgggtcgtggcgactttcatgttctcaggagcctgtgcctccgcgagcttgacaattttcttcatgtgggatgtgaacttctgcgagacatactcgaagctggcctgccggcatttcgtgctttcggtcgtcctggcgttcatcacgtggttgctgcaagctgcgtcttctttctccgcgttctggctactggtttcgttctcctagtgatctcacacgctcatatttgccgtcacgtcatgctagtcagtcaggaggataaattggttgcaatgtgctcgggacacttgctagatttcagttatgggtagtccttcgtcccttgttagatagatgttgcctgtttgatagtagctcatctttattctaggagttggttatcagctccttgaggtggagtagttactgtttagatgatgtgggatcattaatatatggagataagttgcgatcgattataccggaaaaatggcaggttatggtacaatagaaggtgtgcggccatcgaaggtacttgaaatctggttattttataatggaatttatctcttaaaaaaaaaaaaaaaaaa

SEQ ID NO: 3525 - DNA, 1303 bp, Triticum aestivum
  Clone ID: PAT_TA_3525
gcgcgccccctcccccgggcccccgccccgccgcccccccgcccctcctcctgcccccgcccccgcgccggggccgccgcgccccgcccgctccccctcggctccctggcggtcccgcccggcggccggcgcgagcgggcgtggctggcccggcgctcccggcgctgggccgccgccggccccccctcaccccgcccgcgccgttggggcttcggcgtccgcggggcgagctgcggcttgctgtggcggccgcgcgcgccgtccgcctcctgggccctcccggcgcgcggcgtgctcacgctcggcgtgccgcgccagttccggtcgctggggcgcgtgactcgggccctcctcgtcggggtcgtcgtgacggcccaggacctgctctgcagcatctcgggtgccgtgagggcctcataatcaataggagcttgcgcgcttctcatgcccgccccagccgtccgactcccctcttcccgttatgcctgcagtcagctgtgccttggctctccgcatgtggggccgtccttggtgaattcaggtccctactgtctgctggctgatacacaagcttcgggaaacaagcggaaagttactgctttcattgggggcctagatctttgtgatgggcgttatgatactcctcaacataggctttttaaagaccttgacacagtatttgaaaatgatttccataacccaacattttcggcaggcgcaaaaggaccgagacaaccatggcatgatttgcactgtaagattgatggaccagctgcctatgatgtcttgaagaattttgaacaacgctggagaaaggcatccaaattccgtgatcgatttaggaaagtatctcgctggaaagatgatgccctgataaagctggagcgtatctcgtggatacttagtccttcacctaatgttccaaatgatcatgttagtttgcgggtttcaaaagaagaagatcctgaaaattggcatgttcaggtattccggtcaattgactcgggctctctaaaaggatttcctagtgattgcaaagaggcttcaaagcagaatcttgtgtgccgaaagaacctcataattgataagagcattcacacagcatatgtccgggcaatcagatcagcgcaacatttcatttatatagaaaatcagtattttcttggttcttcgtacgagtggccatcctatgtgaattcaggtgctgacaatctgataccaatggaattggccctcaaaattgcaaccaagattagagctggcgaacggtttgcagtttatatagtcataccaatgtggcctg

SEQ ID NO: 3526 - DNA, 897 bp, Triticum aestivum
  Clone ID: PAT_TA_3526
tctccatcttcatagtttctctgttgcatattttcttcctgtgaacaaaagtggtcagccatggaagcagcaggagatgaggagacgcccttgctccatcatcaccctccttctggcctctatcagaatggggattcttcgtgatacacttgtgatgcaacggtcgatgtggacggacaacctgctgctaaggcaagcacaggggactggagagcctgcttcttcgtcctaggtatccaattcagcgaatgcctggccttcttcgctatctctaagaacctggtcacctacctcaccagcgtgctccacgaaagcaacatcgacgcggcgaggaatgtgtccacttggattggcaccacattcttcacgccgcttgttggagctttcttggcagacacgtattggggaaggtacaagacattagtggttttcctctcggtttacatcgtcgggatgcttgtcctgacggtttcggcgacgctcccgtcgatgatgcaatcctccaaccacggtgagatccaccgtatcgccgtctacgcaggactctatcttacagcccttggcaacggtggcatcaagccatgcacttccacttttggcgctgaccagtttgacatcaccgacccggcggagcgggtgaagaagggctccttcttcaactggttcttcttcgcgatcaccgtcggctcccttctgtcgaccactgtgattgtctgggtgcaggacaatgttgggtgggggatcggcttccccgtcccgatgatcctcacgagcctcggtttcgcggtgtttatcgctagtaggaggatctacagatacaagtcaacaggagagagtcccatgacaacagcttcccgggttgttgttgcagctgcaagaaatcgccgtctggagttg

SEQ ID NO: 3527 - DNA, 1183 bp, Triticum aestivum
  Clone ID: PAT_TA_3527
gcacgaggagcaagcgagcccgccggcggggtcggcgaggaacaggaaggtggtgctgcgggagtacatcagccgcgcgccgagggaggacgacatggcgctcgtcgacggcggcgccgtgccgctgcgcgtccccgagggcgccgccggcccggccgtgctggtgaagaacctctacctctcctgcgacccctacatgcgcggccggatgcgggacttccacggctcctacatccccccgttcaagcccggatctgttatagaagggctgggcgtggcgagagtggtggactccactcatccggggttcgttgccggtgacattgtttcgggaatgactggctgggaggaatacagcttgattgacaagcctgaacagctgaacaagattcagcaaagtggcataccactctcctactatttggggcttctcggcatgcctggttttacagcttatgttggattctatgaaatttgctcgccgaagaaaggagagtttgtctttgtttctgctgcatcgggagcagttggccagattgttggtcaacttgcaaagctccatggctgctatgttgtcggaagtgctggaacaaatgaaaaagttaaactcctaaaagataagtttggattcgatgcagcttttaattacaaagaggagcctgacttgactgcagccctaaaaaggtactttcctgaaggtatcgacatctacttcgagaatgtaggaggaccaatgctagatgctgtactccttaacatgcggatgcatggtcgcatagcagtatgtgggatggtctcccagcacggcatgactgatcctgcagggatccacaacctcttctgcctggtgccgaaacggatcagtatgaagggcttcatccagagtgattacatcaacttattcccacagttcgtcgattacatgaccaagcattacaaggatggcaagattgcatatgtagaagacatgagcatcgggctagagaacgcgccagctgcctttgttggtctattcagtggtaaaaatgtgggcaaacaagtcgtgtgcgtctcacaagagtgaagtacatctacattctgatgaatattacgactatctcatgattcaaatacataataaagattgtgaagcgctcgtgttgatgcgcaattaaaaaaaaaaaaaaaaaaaactcgtgactag

SEQ ID NO: 3528 - DNA, 852 bp, Triticum aestivum
  unsure (1)..(852): unsure at all n locations
  Clone ID: PAT_TA_3528
cgtccgatccaaccactccctatcctgcaaccttttggctatcaagcattgtgtaagatgtttagagacaattactttgacgaggatagcaacctgaaaattggcaagaaggaagctacattaattggaaacctttgtgcattccaattttggcagcgaatgtttaaggacaagtatcgtcaagagtatctgaaaatggtggctgacacccaagagccaacagcatatcatgcttttatctctaaacaggaagagcacgagggtgcatttcataacctcttgccagcagcacttaacaacatctctgaaatttacgatgatgttatgtgcacactgcaccgttttaggcctagttttcttgtggaaatcgatcctccgaagtaccttctgccttctgaattccaccatgtgtgtcttcaccacaaagtactagagccagaggatatgaattcactctccctggaatctgagagttcccacttgggttcacagaggaagtgtgctgcaaccccttatgtttctgcaactgattttggggtcactctcactgttgtcgtactgaaggcgcttattaaggagatgaagacacaacttgcagaggacaatgtagtttcttgtagggaacgagttagtggttatgctcaacaaaccgttgaaagtgagatgtgtgtgttctttatacgtggatcctgtactcgaggcaacacatgccctttttctcattcctctcgtgcccccaaaccagtatgcaagttcttccttacattacagggttgtagaaatggtagctcttgttcattttcacatgattgtggctcctcgaacatgaaaacttcatctattacatctgnn

SEQ ID NO: 3529 - DNA, 712 bp, Triticum aestivum
  unsure (1)..(712): unsure at all n locations
  Clone ID: PAT_TA_3529
gggagccgccgtgtgccccccatctctcccccctctgcctccgccatggcccagcacggcttcctctcctccctccgctcccacctccggtccccgccgccgccgtctcacatccagccccgccgcgggtaccacgtcgagctcggcgcacgcgagaaagcgcttttagaggaagatgttgctttgaagaggttcaaatcatacaagaacagtgtgaaacgggtctcgaaaatcgggaatgttctcactctcgttgtctttgctgcctgcagctacgaggtcgttgcactggcaacaagcacccaatgaaggaaagtgcaatcggtgtgagcctcttagatcttccagaaagtgattcatctcataaactggcattatatcagtactcgttttgagcgtcctgtcgatcttatatcatgtaaaataaaaacaaactaggttggccttatttgcgagtcgctttctagtcttattgcctatttgttacctgtacacaaatcccgaggagtcgatctgctattggaggatgtttcaataaactgttgacctcggatctttgattggcttgatgtctgatcacttttttatgcatccgattgtgccgtctggtgntatgggtttgtgcgtctgagcagcaatgagagttaaaaaggctctagtacgtgctaattcgattcactgagagacattttttaatagaacacattttttt

SEQ ID NO: 3530 - DNA, 871 bp, Triticum aestivum
  unsure (1)..(871): unsure at all n locations
  Clone ID: PAT_TA_3530
cgtccgcccacgcgtccgcactttcctagctcaagctaagctccgcaaccatggcgcccaccaggttgcctctcctcctcctcctcgccgccactgtcgctgccgcggccgacctgtccgtctaccacaatgtccaccctccgtccgcctccccgctcgagtccatcatcgcgctcgcccgcgacgacgacgcgcgcctcctcttcctctcctccaaggccgcctccgccggcgccgcgtccgcgcccgtcgcctccggccagaccccgccctcctacgtcgtgcgcgccgggctcggctcgccggcccagcccatgctcctggccctcgacaccagcgccgacgccacctgggcgcactgctccccgtgcggcacctgccccgccagcagcctcttcgtcccggccaactcctcctcctacgcgcccctcccctgctcctcgtccatgtgccccatcctccagggccagccctgcccggaccgggaccccttcgacagcgcggcgccgctgccgtcgtgcgccttctccaagccgttcgccgacgcctccttccaggcggcgctggccagcgactggctgcatctgggcaaggactccatccccaactacgcgttcgggtgcgtgggctcggtgagcgggccgacttccaacctcccgaagcaggggctcctgggcctaggccggggccccatggccctgctgtcccaggtcgggaacatgtacaacggcgtcttctcctactgcctgcccagctacaagtcgtactacttctccgggtcgctccggctgggcgccgccggccagccccgggccgcgaggtacacgccgatgctgaagaacccncatcggtcgtcgctgtactacgtgaa

SEQ ID NO: 3531 - DNA, 1616 bp, Triticum aestivum
  Clone ID: PAT_TA_3531
cacgcgtccgcccacgcgtccgcttccacgagcccccgtgtgccccccatctcgctcccccttacctccgccaccccccctccgccgttctcctcgagccgccgtgtgccctccacctctcccccctgcgcctccgccatggcccagcacggcttcctctcctccctccgctcccacctccggaccacgccgccgccgtctcatgtccagccccgccgcgggtaccacgtcgagctcggcgcacgggaggaacgcgcttttaggaggaagatgttgctttcgaagaggttcaaagtcatacaagaacagtgtcaaacgggtctccgaaaatctgggaatgttctcactctccgttgtctttgctgcctgcagccatgaggtcgttagcactgtgcaacaagcacccaattggaaggaacagtgcaatcggtgtgagccccttagatcttccacgaaaagtgattcatcctctattaaactggcattatatcagtactcgttttgagcgtcctgtccgatcttatatctcatctccaaataaaagacaacactatgggctcgccttaatttgcgatgtcagctttctaattttccgctcatatatttttagatcataaaagccaaggagttggtcaccgattgtaggaaaaatcaggggaatgttgtccactgttcctgttgtcgtttggctggcctgcagctatgaggtcgttgcacttggcaacaagcacccaatgaaggaaagtgcaatcggtgtgagcctcttagatcttccagaaagtgattcatctcataaactggcattatatcagtactcgttttgagcgtcctgtcgatcttatatatcatgtaaaataaaaacaaactaggctggccttatttgcgagtcactttctagtctctgcccatttgttatttgtacacaaatcccgaggagtcgatctgctattggaggatgtttcgataaattgctgacctcggatctttgattggcttgatgtctgatcactttttcatgcacccgattgtgcgccgagcgggtacacgtcgctgggcgcgttcgacacgtgcttcaacacggacgaggtggcggccgggggcgcgccggccgtgacgatccacatggacggcggcgtggacctggcgctgccgatggagaacacgctgatccacagcagcgccacgccgctggcgtgggtgaacacgctgaaccacacgcaggcgcgacgccgctggcgtgcctggccatggcggaggcgccgcagaacgtcaactccgtcgtcaacgtcgtcgccaacctgcagcagcagaacctccgggtcgtcttcgacgtcgccaactcgcgcgtcggcttcgcccgcgtgcggcgtcctgttccgacacgagacgacatttcttcacgtgtttatgcggttattaatcgaatcattagccatgcatttgggtgtacgtacgtacgtacgtgtgcgtgtgattgttaatttgcggcttagtaattttcagtgtgtgcaataaggaatgtggcatcaaagtttgtcaaaaaaggggtgggtgcgcgtgtgttgtgctctgcgtgtcgatagaactagagaattactgtactggtcgtcgtaact

SEQ ID NO: 3532 - DNA, 617 bp, Triticum aestivum
  Clone ID: PAT_TA_3532
tggacgtgtcatctctgatcccaagcatgagaagcgcggagcagtccatggacgcctgcctgcgccgcttccgcgccacgcgccgcatgatcctctactacgaggacgtaatccgcgacgacaatgtaagctcctcggccatatcatatcgtatcagatcatatcatccatcggggtaagtgggtgatgaagcattgttgctggaatggtttggtttgcaggcgctgtctcgggtgcaggagttcctgggactcccggtgaggaggctgtccagccggcacgtcaagatccacaccagcccactcccggacctggtggacaactgggaggacgtgagacgcacgctcaagcccacggagtttgctcgtttacttgacggctgaagactagacatctgtttttgttccggcagggccttccgttttcatttctttcttgggactgcacaatgggattggaagttgttcagctgttttcttcctcgaaggtaggtgtagcattcttctgcagggcaggaagcaaatatcatgagattgaataagtttgcttttcggataacggagtagtgcccagataataaagtattcaaaagtcaaaaaaaaaaaaaaaaaaaaaaa

SEQ ID NO: 3533 - DNA, 742 bp, Triticum aestivum
  Clone ID: PAT_TA_3533
gcgatgaggtcggtgacgttggcgcccggcttgggggtgttgggggcgacgtcggcggcggacgacctgttcccgtcctgccgccccgtcggcatcgggatgtacggtcccttgctgatccgcacggagtcgcgcgcggcgagggcgagcacgtcggcgcaggagacgacgccggggcaggccgcctcgagctttgccttgatggagtcgacgacgtcgtagccgcggaggcccttgttgagcggcgagtccttctccgccgtgttgttggccgtggagtcgagaagaatcgacccctcgcggtctccgagcaagcggtcgacggagaagagcctgagcagggagccggcgaggccgggcgacttggcgaggacggcggtcatctccttgaacacgatgtcctccgcctgcgggcacgtcttgttgtacgccccgagctgcgtgtgggcctccgtcgagccacacagggcaaggagcgtcgccgccacagcgacgaccgctagagctgctgacctcggcgccatgtctggcttatgatcgttagcttgagtatatatgcagtacaccacacacgctacctatatgtatataggcttctgaaataatgtcaatacgtctcgacccatttcaatttcaagtactccttgcgcttgtgtacttgcacgcagtgtgtactacgtactacgtactgctctgtactgcgagataggagaatgtcaacggctatctagttgacatatat

SEQ ID NO: 3534 - DNA, 1180 bp, Triticum aestivum
  Clone ID: PAT_TA_3534
cccccccgcccatccattccccaatcttcgtccggcggaaccctagcgccccgcggcgcgacctccgcgcaggcacgcgcgctccccctccggcggaatcggcgcccccctcctgccccggcgccaagcacgctccggacacgccccccctgctgccccgcgccggccccgtccaagctccgcgcccggctccttcctccgtccgccgccggacaccgccaggatccgcgccgcgccgtccaagggctccgactccgcgccaagggaccaggcgaccgcccgccgcgtgccgtccgcgtcggattcgggcccgatctgtaacttcgcccgccgttcgcggctctctctgtagaactattcgatcgctcgatcgatcgatgctgtgacaagtcctccccggacctctcgcgaattgcgtgtgtgtcgtgcaaagcgagaggccgggtccgaggggacaggcagaactcgatccaccatcatgggtgtcttgtattacaaatataagagtgcaaaggaaacttaccctgtgacgttgccctaaaaaaaaaaaagccccgcgcgggcccgggccgcgcccgcggcccccgcgaggatatcgccctctccaacgcccagaccggcgaaggtttgtagcagatttaatttaggccatggttgttaaatctgtacagcagttgtgaatttcttggaattcgggtgtagctttgccttgcccacgtaaattatttgatctgatggattcacgctgtccacgagttaggtcttggtatctgtaaatcctgtatcaggagaagtgctgctagctttattgccaggatcaattaagcttagtgcctgcaggtccatcattggtggatatttttgtactgttgttgtagccttttaggtcaaaattcttatttgataggcatatcacctaatttacaatgagttgcgagcgaaaataccaggataagtgatatgtgagtccatcagcaattgctctaaccaatttagttacgtacctggacgccctgcaagatgcacataacgctagtgaaatctacagatgcatccttctgtttgaggattcctgtctgcttatcatatagtgtagtgcggggtttaagtgcacaactgaacttttagcttcggacaaagcaatgatggatatttcgtgttgctctggacgaagcctata

SEQ ID NO: 3535 - DNA, 455 bp, Triticum aestivum
  unsure (1)..(455): unsure at all n locations
  Clone ID: PAT_TA_3535
ttttttttttttaaatagaatcataattttattatagtaagaatattacaatgtctttacaagtatccaataaaaggaaaattgcaaggaaataaaagaaaatcctaaaactaatcttctagtaatcttttcttctttttcttcactttatccttccagacattgaggatctcgttgtgcccggcgaagacgctgcggagtgcgtcgcggatggactgctcacagcgatagctgccgcagatgaactcgttgtccttcttcaccttccattccactaagaaatcagtggaaaaattagggagcagaagctcaacagaatgcaccaaatcgccaaaattccatcccaagctacctctctcgcctccgtcgccagtgggggggggggaagaagangnggggggggagctcctcgggattgctcgtcgnggnaggtggntcgccgtggncgngaggga

SEQ ID NO: 3536 - DNA, 908 bp, Triticum aestivum
  Clone ID: PAT_TA_3536
gaatgtcaagctcccgttccatgtcctcagttccagtgagatccagtggaatcaagacaagaccatccataaactggtctccaaggatcatggtctgggccagaagctggccatgaagaaactgagctcttaaatccaagatgatgctgaagctggggggtggtatgaagggagcagcatcatcggtctaagctattcggtgtgcaggaatcttgccaagggcgaaggcaaggatggagaaatgcagaggaacctgcttcttgagaagcccggcttgctggtcctcgacgaggggcacacaccaaggaacaagaagagcctcatttggaaagttctcgcagaggtcagcaccgaaaagcggataatcctgtcagggactccattccagaacaacttcctagagctgtacaacatcttgtgcctggttaagcccaagtttgccaaagattttgcttgtacaagactcagcaagaaaggagttgcttccaccagccaatcaagagcagcgccttatgtggaggaggatgaaggcaaagaattctggagttcattaaggataagtaacatcacggatgaacacatcactgaaatccgggaaaagctgggcccttttgtgcacatccataatggtgacattcttcagaagtctcttccaggattgagagaatctgttgtgatcctgaaccctcttcctcgtcagaaggaaatcatcgcaatgatggaggaaagtgcagggaagggttttcttgacgcagaatacaagatatctcttgcgtccatacacccattcctcgtcacaagcacaaaactgtcagacacagaagcctctgttgtggacaagatgaagagcgtgcggctgaacccatgcgaaggagtgaagacatggttcgttttcgagatcatccgtc

SEQ ID NO: 3537 - DNA, 1263 bp, Triticum aestivum
  Clone ID: PAT_TA_3537
gcgggggcggcggcggctcgcaacctcatcccgcctccaccatcgccacatggccgccgccgcgtcagcaaaccccggcacagcgtacaagctcctcctctcctgccctgaaggcctccctcgatcccgagtttctgtgaggtttgatccgtccatcgaccggattccccacccggacgcatccctggaagaatctataggcgagatatggaatcaaaggctccagcagaacccatcgctgtacaacggtacgaaatttcggtatggagggcatgccttgcaccgcagtgatgaatcaaatcaggagtactgtgtctcacttcatttgggactcacagattataggacatttgttggaacaaacctcagtccactgtgggagaagtttttggtcccctctcaagatgactctgtgtgttgccaacacatgtcaaatccactgggaaatggtgcaatcgttgaaacatctgatgaaaaaattattgtattgcaaaggagcaacaatgtcggcgagtctcctggacactatgtttttcctggaggacattctgagccacaagaagttggaatcttggctcatcaaaatgacgaaaaagatgttgctggtctcactgaaagaatttctgatgaaatgtttgatggaatcatccgtgaagtagttgaggaaaccggagttcctgctagttcactgacagaacccattctcattggagtttctcgacgagaaacgaatgttaggccagcagcattcttttatatgagatgtaacattgattccagcgccataactgagctttatgctagagctcaagatggttatgaatccactaagatctatgcagtatcggtgaaagacttacgagatatgagccagcggttgcctggttgccacctagggggttttgctctgtatgaacttatgaggaacgcttcggaaagtttgtgaacaaaccgatatagactgagttcttcagagttcacatggaaagaaaatcgataaagattactgagattcagattaaagatgatcaagaccattcttctgtagactatatgagatgtgtccgtcttcgtccggcattgttctttttcgtggtgtgcagtgcaggagtgtaaccagtttttatttacttttgttcctggaatcctggtatgtaccgcggtaacaaaaatgtacgactaatccctatctttcgaagaacaaaacaagcttgtaactcttggaactacgtttgtaggtttaaaaaaaaaaaaaaaaaaaaa

SEQ ID NO: 3538 - DNA, 1338 bp, Triticum aestivum
  Clone ID: PAT_TA_3538
cggtgcggccgcggccaccccgtgcgcctccgcgtgccccgccgcggcctcgaccccgcgggcctgtcgtaccggtcggcgcggcaggaggtgttcggcctgctcgacctcgccggcctccgagccgtcaccgtcgacgaggcggcgtccacggcgtgggtcgagtccggcgccaccatcggggagctctactacgccgtcgccaagaacaacccccgcctcgcgttcccgtccggcgagtgccccaccatcggcgtgggcggccattgcagcggcggcggcatcggcatgatgatgcgcaagtacgggctctccatcgacagggtggtggacgccaagctggtgaacgccaacggggagctcctcgacaggtccggcatgggggaggacctcttctgggccctccgcggcgcccgccgccgcgtcgcacgtgcaggccgccatccggtgcggccgcggccacggcgtgcgcctccgcgtgcgcagcggcggccacgactaccacggcctgtcgtaccggtcggcgcggcaggaggtgttcggcctgctcgacctcgcggcgctccgtgccgtcagcgtcgacgaggcggggtgccacggcgtgggtcgatgtgcggcgccaccatccggggatgctctactacgcccgtcgccaaggaacaacccccgcctcgcgttcccgtgccggcgacgtgccccaccatcggcgtgggacgggcacttcagccggtggagggatcgggatgatgatgcgcaagtacgggctgtccatcgacagggtggtggacgccaagctggtgaacgccaacggggatctcctcgacagggccggcatgggggaggacctgttctgggccatccgcggcggcggcggcggcaacttcggcgtggtgctctcgtggaaggtgcagctggtgccagtcccggccacggtgacagtgttcaacatcgccaagacgctggagcagggcgccatcgacatcctcacgaaatggcaggacgtggcgccggcgctccccagcgagctcacgatcacggtgatggtgacggggcagcaggccgtgttccgggcgctgtacctcggcgagtgcggctcgctcgcctcgacgatgcgcgaccgcttcccggagctgaacatgacgagcgccgactgccagcccatgacgtggctgcagtcggcggcgctgtccttcttcagcttcaccaacagcaagccggtggaggacgtgctcctgccgagacccgccagcccgaccaccttcagcaagggcaagtccgactacgtccggcgcgccatccccaaggcggtgtggaaggagatctacgccagctggttca

SEQ ID NO: 3539 - DNA, 1463 bp, Triticum aestivum
  unsure (1)..(1463): unsure at all n locations
  Clone ID: PAT_TA_3539
tggggtgttctcttgcagtgaggtttgcagccacaatctggcatgtggcaatcatgcctgccaggatgtttgccacccagggccgtgcggggagtgcgagcttctgccagggaaggtcaccacatgccattgtggcaagacaaggctgcaggagaagagggctagctgcttggacccaatccccacctgtgacaaggtatgtgacaagagattgccgtgtggagtgcataggtgcaaggtcgcatgccacgaaggagagtgtccaccctgcttggtgcgtgtcgagcagaggtgccgctgtggctcatcaggccagatggtggagtgctacaaggtcttgaaggaagagttccgttgcaacaagccttgtggccgcaagaagaactccgcgcggccccggtgcagtgagctctgttgccctctgtcaaagccatttgctcagcatcaaggtgacagcatggatccccatttctgccagataccatgtggcaagaagctccgatgtggacagcatggatgccagcatctctgccacagcggtcattgcgacccttgccgtgagaccatattccacgatctcacttgtgcctgtggcaggacatctattccgccaccacagccttgcggcacaccaactccatcatgcccacatcagtgcatggtccctcagccttgcgggcatccagcttcgcatcaatgccatttcggggactgcccaccttgcgttgtgccagtcacaagagaatgtgttggggggcatgtgatgttgaggaacatcccttgtggttcaaaggatatcagatgcaaccagccctgtggaaagaaccgtcaatgtggactgcatgcttgtgccaggacttgccatcctgccccatgtgatccaccacctgcaaatggagaagctagttcaagctctgggggcaaagtttcatgtgggcagttatgtggtgtcccaaggagggaatgcaagcacacttgcaatgcaccatgccacccatcgtcaccttgcccagatgtgagatgtgaacaccgtgtgactattgcctgttcttgtggccgtatcactacagctgtgccctgcagtgctggtggagcctacaatggtgatagtgcgttcgatatctccgtcatgcagcagctgccaatgcctctccaaccagtggaatcaaatggcaagagggttcctcttgggcagaggaaactttgttgtgacgaggagtgtgcaaaaatggagaggaaaagggtccttgctgaagcttttgacattaccccgcccaatctggatgcacgccatttgggtgagaactcaaatgcgtccgatttgcttcctgatcttttccggcgtgagccaatggggctgccggccaganagtgcaagtcctggnctgggaananaagggaatctcaacaacataattcangtctccgccatataaggcaaaggatcacagncatgcaatagg

SEQ ID NO: 3540 - DNA, 936 bp, Triticum aestivum
  Clone ID: PAT_TA_3540
ctctctgaataacacggcaaccatatggatgggatcatgcagtgtgtggttcctttgacacaagaccagtatggcaattatgttatccagcatgtcttgcaacacgggaaaccagaagaacgtacttctataattaagcagcttgctgggcagatcgtgaagatgagccaacaaaaatttgcttccaacgttgttggcagtcttgcagagtttgattgttttgaggagcggcagatcctaattaatgaaatgctgggagctactgcttaccatgagccattacaggcaacgatcgtagcggactcttggaactatgtagtgcaaaaggttttggagacttgcgacgaccacaaccgtgagctgattctttcgcgtatcaaggtccacctgaacgcactgaagagatacacctacgggaaacatattgttgcccgggtggagaagcttatagccgcaggagaaaggcatatcggggtctcgtcgcagtcttgcagagattgaatggttagtttgacagaataacccctgtacagacagatagcgaggctagccttaccagtagtcgttgtccagtgccgtcgtcggagaacttggagatcttgaagatttttgactgtaaataaaggatggggcctctgggaataaagaaagagaaagagaagagattttgcttgttcaaaaggagagaagttgtatatttgtacctttttccctcttcgagtaagatacatatctatatctatatatatatataagaaaggcaaagcatggaagcaaattagctgaaatatttagggttagatgatgatgggaagcaaggacacctgtagatccttttgccttgggtttcatcagtgtataaggtttccatctcttgtaaagatttcctattttactgatgtttcgcagaagtcaaatgtttcagtctttgtaaag

SEQ ID NO: 3541 - DNA, 1101 bp, Triticum aestivum
  Clone ID: PAT_TA_3541
ggggttcccagccccaccttcctccgccgccgccatgtaatcctctccgacctcgcctggaagcagccagcaagatgccgccgccgtggccgcctctctcccttctctcctctttttccctacctttctctctcctctaaagtctaaactgtgtgcaggtcctctccacaggtgctgccatggccgtgtcatggagctcgcccccgtgggatgcatgcccctccaatgacgccctgtccaggtcctctggatcccgatttgagtgtgttattttgcgtccgatcctgatttggacggcattttttgaggcaccgcgagcgcgctggacggcaaaaagggttgcgtcaaggagcgacgcattgttgtaagcctgtagcacaccattgttgctactcccacctcgatggtctatctcatgggttgcagataggatgtgatattctgcagcgtggacatcgcctagcaatcagatttgatgttgagaaagatccggcaggaagatctcatcctggaacccaggagtgcttgatttgatattgagaattctacttgctagcagtgtacatgtttcttatgatgcccgtgtgcgtttaccttgtcaagaagttccgcgtgaatgtcaatgccgatgaagacaaaggtgctctgcttcgatcccttcttttgatttcgcaaaatggaaaacacaagggtgtctggaaattgagatcgttggttcaccatcagaagcttcgcatgaacgtcaatgtcgataatgacaaaggacagacaaagaagaaggttagggaggacatgcccgagaagctcagagataaggcagaggttggggacacataggggaagccttgaagggggagataagcaagctcaagcactatgagcatgggatgacagagcggccgaccaaggcggttgagagcaggcgtgtgcgagaggaagtgaactggggagaggcaacagggggcatcactaggaaggcagcaggtggcatgcaacattggccttatctcttatgttcgccaaggtggcctgttgtttccacaatatgtttggattgtcatgttgttatggtcacgtagggttaaattctttcaatgcaat

SEQ ID NO: 3542 - DNA, 1135 bp, Triticum aestivum
  Clone ID: PAT_TA_3542
acgcgtccgcccacgcgtccggagggagggcacacacgcgtccgcccacgcgtccgggccaccatggacgtcctctccgccaagctcctccgctcctccctccacccgcacgccccatttcttccctgcccatccctcccgtcccgacgctaccgccgcccctcctcaatctactgccgcctcaccacctcctccctctcgtcctcctccgccgccaccacatccgagggggacgcaaaccaggacctttccgccctcctctccgatgaatccaccaccgacgcgcccggcgccggttccaggaaaaagcggtcgaacagcggcgcgtcgagcatcccgtccggggtgcggctggagaacatctccaagtcttacaagggagtgacagtcctgaaggacgtatcctgggaagtgcagcgtggggagaaggtggggctcgttggcgtcaacggcgccggcaagaccacgcaactccgcatcatcgccggtctcgaagagcccgacggcggcaacgtcgtcaaggccaaggagaacatgaagatcgccttcctcagccaggagttcgaagtctgcgcctcccagaccgtcagggaggagtttttcagcgccttccaggaggagatgggcgttaagacccgccttgaccaggtgcaggcggcgcttgagcgagcaaccgaggacatggacctcatggggaggctcctcgacgagctcgacctgctgcagcggcagtcgcaggacgtcgacctgggcatggtggatgtcccgattcagaagctcatgcccgagctcgggtttgtgccggaggacgctgaccgccttgtcgcatccttcagcggaggctggaagatgaggatgtcgcttggcaagatacttcttcaggatcctgatttgcttctacttgacgagcccacaaatcatgtcgatttggacaccattgagtggctggagagctaccttaagacccaggatgtaccaatggtcatcatatctcatgacagggctttccttgatcagtgttgtacaaagatagtggagactgaatttggggtgtcgaaaacgtacaagggtaactattctggatgtgttcttgccaaagcgatttgggtggaaactcaacgtgctgcatgggaga

SEQ ID NO: 3543 - DNA, 1848 bp, Triticum aestivum
  unsure (1)..(1848): unsure at all n locations
  Clone ID: PAT_TA_3543
tttcgcttacccgtcccgcccgccactccnggagtccggggcccactcccacctgccccgcgccgcgcgaccagccgtcacgccacgccgccgctcgccccagcgatgccgccaccctccctcctgctcttccactgccgcgccccgctcccgcaccgcccactgcggatgagctctccgtcgccgagcaggagggtcgtctgctccgtctccactgccgaggggtacatctccgcggcgccgatcctccttccagacgggccatggaagcaggtagaaggcggcgtcacggcggcgaaggggtttagggccgcgggcatctacggcggcctgcgcgccaagggacagaagcctgacttggcgcttgttgcttgcgacgtcgacgccaccgtcgccggatcttttacaacaaatgttgttgctgctgcgcctgttctgtattgcaagcgtgtccttagttcatccaaaacagctcgtgctgtgttgattaatgctggtcaagcaaatgcagccactggtgatgcaggatatcaggacgcagtggatagtgcagaagctgttgccaagcttttgaatgtgagcacaaatgacatactgatccagtccactggtgtcattggtcaaagaataaaaaaggaagcacttataaattcacttcctagacttgtgggctctctgtcttcatctactgaaggttcaaattcttcagctgtggccatcacaactacagaccttgttagcaagagtattgctgtccagactgagattggaggagtgcctatcaagataggaggaatggccaaaggttccgggatgattcatccaaatatggcgacaatgcttggtgttctcacaaccgatgctcaagtaagaagtgatgtttggagagaaatggtccggacatcagtgagtagaagtttcaaccaaattactgtggatggtgatacaagtacgaatgactgtgttattgctatggctagtggattatctggtttgtcggacatcctcactcatgatagcgctgaagctcaacagctccaagcatgcctagatgcagtaatgcaaggcctcgcaaaatccatagcatgggatggtgagggtgcaacctgcttaattgaggttactgtaactggtgcaaataatgaggcagacgcagctaaaattgctcgttcagtggcagcgtcctccttggttaaagctgctgtatttgggcgagacccgaactgggggcgtattgcttgctctgtcggctattcagggattcattttgatgcagatcaacttgatatttcccttggagttattccactaatgaaaaatggccaaccactcccttttgacagatctgctgctagcaagtatctcaaagatgctggtgacatccatggtacagtaaacattgatgtatcagttgggaatggaggaggcactggaaaggcgtggggctgtgacctaagttataagtatgtcgaaataaatgctgaatacacaacgtgaaattcgtattctccatgaaaactgcatttctgaatacacatccattgtcttcatttgtctgagtgctctttcgatgcaactgcatttctgaaaattgtatcataccgaaacgatagtgtgttgtaccaataggtcgaacatgtattatcttttacaagaacagtcaggttagtgttttgtgactggaataatgcgctgaagaatctgggggtaccatgtgaaaattgtctaccatccttctcggttctgattcataaaagaggatgttggcctgacaaaataaagtttctttggattcccgtatacgccaaaaaaaaaaaaaaaaaaaaagtcgacgcggccgcgaattcg

SEQ ID NO: 3544 - DNA, 763 bp, Triticum aestivum
  Clone ID: PAT_TA_3544
tcggcacgagacccaccaaaaccctaatggcttcccgcctcctccacctgcgccgcctcctcccggccgcgcgcccgtcctgcgccgccgcgttctccaccgccgtcaccccgaccccgcgggtctccggtctcgtcgacgagatctgcggcctcaacctcatcgaggcatcctccctcgcggatgccctgcgcggccgcctcggcgtcgaccagctccctcccctagccatcctcatgggtggcgcggctccgctggccggagatggcgctggggccgccgaggaggcgaaacccaaggaggaaaaaatggcgttcgacgtgaagctggaggggttcgacgccgcggcgaagctcaagattatcaaggagctgagggcgatcacgagtttgggcctgaaggaggccaaggagctcgtggagaaggcgcccgccgtgctcaaggccggggtgcccaaggaggaggcggagaccatcgccgagaagatgcgggcgttgggcgccaagattgttctcgagtgagaggacgagatctctgtatgcctttgcttcttgatttcttcctgtttattgtacgaaggaattagagaaattttggaaccaaggagtcaataattaacgagactgactctagatatcctctcgttgatagtggaaatgccagttgagcttttgagatcatggttatagagttgatgatagagctttgagctttgtcttatgactgtttgcttgagtgtgagcaagggagaatgcatttctta

SEQ ID NO: 3545 - DNA, 815 bp, Triticum aestivum
  unsure (1)..(815): unsure at all n locations
  Clone ID: PAT_TA_3545
gccgggcgtccgtcgaacacctcgacgccattacaaaaagcttgggcggagagagcgccacgcatcatacgggcagggggtcgatagggagggagggatagccggtggttggtgcgggggagtgggtagcctggcgatcgcgggagggatgacgacaccggcggcgggggccccggggtcaccggtggcggcgccggatcaggtggcggccagggacgccgtgatcgggtggtaccgcggcgagttcgcggccgccaacgccgtgatcgacgcgctgtgcggccacctcgcgcagatcggcggggccgactacgacgccgtcttcgccgcgctccaccgccgccgcctcaactggttccccgtcctccacatgcagaagttctactccgtcgccgacgtcgccgccgagctccgtcgcgtctccggcgcccgcgccgccgcggccgccgcctactccgaggaggaggccgcgtccacggtgatccacgagcccatggacgagctcgtcgtcaccgtcgccgcggagccggaccccgagcccgagcgcgagcacgagccgataccgggaggcgcagcccgatgtctccgtccaccccgtcgacgcggaccgcgagccggaggcggacggcgaagattcctcgggagattcgtcggagcggaaggcgctctccgcggcacccgccgccgcccccgacgcgcctagctccggccggcgagctcctggcgggctcagccctccagagagcttccctccctgcgctgaccacgacgtgtgcctcgcccgcccgaatgtactngaagctaaantaaattca

SEQ ID NO: 3546 - DNA, 1941 bp, Triticum aestivum
  unsure (1)..(1941): unsure at all n locations
  Clone ID: PAT_TA_3546
gccaagagcacgcctgcacacaggagcgagcggagggctttgctttcgccatccagttcggcttctccgcacgcaaacccaaacccctagcgccagccaggcagaggcgagagcaacaagacctcgtgacccagagaccggagtggagctaaggtcgcctcccccagcccgggatggagagcctcgtcctcgcctcctcctgctccgcgtctccccgcctgcccctcctctccgccgccagccgcccgtcgcggcccctcccggcggcgccgctctccgctgccgccgggcggaggggagccaggcggccgaggctcgtcgtctccgccgcgtcccggcggatctaggaacggttcagatggatttaacacaaagggatttgcaagcatatcgtcttcaaaccagcaccgagaatacatcgacgggaactggcaccgtgcctcccatgccgcctccctcatcatatattggttcacctgttttctggattggcgttggtgtagcattatctgcagcattttccatggtctcttcgatggtaaagaaatatgcaatggaacaagcattcaagtcgatgatgacccaggcaccaccaaacacatttggtgcgaactcgccattcccattctccatgccaccacaggcaggttccacggcaccaagtagttacccatactcaggaccaaggaaaaataccccaaaaggtgcaactgttgatgtttcagctactgatgtggcagcaactggatcttcggaagcagctgatgtggcagaaacatcgaagccttcaaagaaatttgccttcgttgatgtttctcccgaagagttgcaaaaacagaaggagcttcaatcttcattgcagacggtagatgtaaaaagtgatagcactgaaagtgaaacgaagggtgatactgaacaagttcctacaaatggtgctgcttttaagccgagtgaagatccctctacctggacaactgaatccaggtagtcaggacctatgctatctattgatacaattgagaaaatgatggaagacccagctgtgcagaagatggtttacccctacttgcccgaggagatgaggaacccagattcattcaagtcgatgcttcagaatccgatgtaccgccagcaactggaggatatgctaaacaacatgggcgcatctcctggtcaatgggataaccgcatggttgatcacttgaagaactttgaccttagcagtcctgaagttaggcagcagtttgctcaagttggcatgactccagaggaagttgtagcgaaaataatggcgaacccagaagttgctgttgcattccagaatccaaaaattcaaacggccatcatggattgctcgcagaaccctctgaatattgtaaaataccaaaatgaccaagaggtcatggatgtttttatgaagatatcgcaaatcttcccccaaattaatggctagtggatgtgcaccacggaattgcagtttttgatttgccttggcctgtcatctccagcctaagcggctgcagtagcatctgttaaccggctgaggaacagaggaacttcatgtgttcggtcattatgcgcaaagatgtacccttgccgtcaaggtttttgagttgccaatgtacatcatatgatccagcgtttcggtttggttgcgaccatgcctaaagccagagtagtgaagtagcaaagtttgagatatatatttacgtcaccgctctgtagaattgtgtagttggtgctttgacactatatggtttgctgtagcctgtaggatgtgaaggtgccgatgtagttcatatcacctcaattttgatacattgtgttaccgtgacactgcatgaaaatgttagctatgttgttcaacttgtttagttggaatgtagcccgagttcaaaaaaaaagcgaggncgacaaccgccgccgcgatgaggggccaan

SEQ ID NO: 3547 - DNA, 564 bp, Triticum aestivum
  Clone ID: PAT_TA_3547
gacattcaactaattgttgattctgttcaacttaacataaagcatcttctcgatgctgctgcatcaaagctctcagaagttcagcttgaggtccagcagctttatggctttgtcgacattctgcatcctctggatcccgccccagcgcagctctctgatgtccagctcgtgctcctgcagctgtgccgctgtgcgctggtgcccctgcctctgaatctcgtcctagagcatgaccggtcgtgcaatgtgcagctcgttcttgtgactctcatgcccgtggccgcggcgcagagacttgcgcaggcaagggagcatctggaagtagtaaataagctgaaatatttggaggaaagtaaagaaatgttagaagaacatttggaagagttgaaatccagaacaaaggatatatgtaatgttgctgttgaagaaaggaaacagttagttgatgagctgaatggaatcacctgcaacattggagcagcaattcatgcggatgaagatctgaaggcaagcttggcaaggatcatgcagaaagctaacattgaggaacctctcttgagttct

SEQ ID NO: 3548 - DNA, 600 bp, Triticum aestivum
  Clone ID: PAT_TA_3548
aggaattcggacgcccaccggctgtcgcagcagggcgccatcaccaagcgcatgacggccatcgaggagatggccggcatggacgtgctctgcagcgacaagaccggcacgctcacactcaacaagctcaccgtcgacaagaccctcatcgaggtgtgctccaagggcgtcgacaaggacatggtgctcctctacgccgccagggcgtcccgtgtcgagaaccaggacgccattgacacgtgcatcgtcaacatgctcgccgaccccaaggaggcccgcgccggcattaaggaagtccacttcctacccttcaacccggtggacaagcgcacggccatcacctacatcgacggcaacggcgactggcacagggtcagcaagggcgcgcccgagcagatcatcgagctctgcaagatggcaccggacgccgagaagaaggtgcacacgctcatcgactcatacgccgaccgcggccttcggtccctcggcgtgtcgtaccagcaggtcccggagaagaacaaggagagcgcgggcgacccgtggcagttcatcgggctgctccccctgttcgaccctccgaggcacgacagcgcggagacc

SEQ ID NO: 3549 - DNA, 957 bp, Triticum aestivum
  unsure (1)..(957): unsure at all n locations
  Clone ID: PAT_TA_3549
cgtgaaccgggcgtacaagcgctgcatgaccctgctgaggtcggtgtacaccacgctccgccttctccccgcgtaccgggtcttccgtctcctctgcgctaaccagtcgtacaactacgagatgggctacaccgtcggctccttcgccgtgcctttctcgcgcgcccaggagtctgccatgcgctcccaccgcttcgttgccgttgacacccagcccggacgtctcgtcgtctccgtccagtacctatccagtctcgccgcgttcaacctggagatctcctccctctccccctccatgctgatcaccaactacgtgggcagcccagcagctgagcccatgcgcaacttcccttcttcgctcacggaggccacgggctgcgctttcccccagtcctatcagcagcagcgtccgcacagctgggcgccgcctgcgctctggccgctcgccccagcgcagcagacgagattttcgccaccgccgttgcactacgcgtcaccaactccatcgccccccaattttcctggtgggtacctgcagtcgcctctgaggggggaagtctgcaccggtgaccatacccggcgtgagaaggagccccgtgcaccgtcagagcatgctgggacccggttaaagggttaatgctgccaccgccatccccgaggagaaggtgacaagggagcagcaggttcacaagagtccccatcagatttcagccggtcattcgggaaggccagaaggactccgggggggggctccaggtgccagcccgtctcccggggccaggggttccggcagtcgcgggcattctggccgcccccctgcgctcccctcgggtgattctccacggcgagatgacctggcgggggctggttgtcctcttgcgctggctggggttgttccaagaggnggaatagaggtanancatantaaaacctnattgttccgttattctaaaagan

SEQ ID NO: 3550 - DNA, 795 bp, Triticum aestivum
  unsure (1)..(795): unsure at all n locations
  Clone ID: PAT_TA_3550
ttcggcacgaggnagtcgtagaagcaccgaatagcaacaggggaagaagaaaattgccttaagctcattgtgtctcctcgatcgtgatttagtactggacgacggggaagaagagggaaaaacattgagagattttgccagtggccggctaattgaaaagagagttctttggagatggggttttgcgcgacgcccaccagcgccccgggcggggggccaggcgccgccgtgcctccattcgtcccccctcgacggcccttctcggactactctttggtgccaccagttagcgctcccgtggtgcgcctctcgcccgtgggcgctaatgcaggtgagaagacaatgattgagaagagacatttgtacatgtctgatgagttcattaggagcagcccttctattacggcctacaattccccatcgctcaaccttcgtcaagggctagcggatgccgctataccacaactcggtgcggaagctgcacggcatgccatcgcggactggggccggcaggcatcgaacatcacacacctcgtcttctgcacgacggtgagtgggtgcatgcccggtgccgactttgagctcatcaagctcctcgacctccctctctccactagacgtttcatgctataccaggctggctgccatggtgccggcatctccatgcgtctagccaaggaccttgctgaaaataaccatggctcccgtgtacttgtggtttgctctgaggtgatcaccatggcttttcgtggcccctcgaaaagccacatggggaaccttgttgggcaggccatc

SEQ ID NO: 3551 - DNA, 648 bp, Triticum aestivum
  unsure (1)..(648): unsure at all n locations
  Clone ID: PAT_TA_3551
ctcgcctgtcctcctcctggacgtcccgtccccatcggctggcacgctcgctccgcccacgtttctcgacgccgttcggccgcagctctccagccctcttcctcgaccgtccccaactccccgtcggacgcgctcgccgtccgcgcgtgctcgggtagacgtgcctccgtcctgcgccgccgccgtcgaacgtgccgtggccggctgtccgcacgcgcagtgtcgcctctgtctcgatctccacgccggcgtcgcactcgctgcccacactgcgcggagtcgtggtgaccttctctttcgttcgtcagaagccatgggggagcctagcaaagagctcctggacctcccctcagggcccaatccaccctccttcatcgaatcgctgttcgcggacagggagcagcacaagggcaagcgcaaggcggggcctcccaccgatccactcccaaagagccaagttcttggaaaagtgaaggatttcttgggagagatggcaaaggccaatgagaaattgcagctggatgcgcagaacaagcctcctgaggagtatgacattgaagcactcactggnaaatgaaaaggaatatattgaagatggatttgatttctcggtgtaagctgatcctcattcaaagcaagctgtggatt

SEQ ID NO: 3552 - DNA, 1291 bp, Triticum aestivum
  Clone ID: PAT_TA_3552
gcggttccctccccgctcccctcctccgcctcggcctttcggatcgtttcatttgttgaggacggtgaacttggccgctccgagtctaagtgctttaccaggagtgtggagatcatgcacaagaatatagagcacggtgctgaagcccgctcgtctccgccccaccgtctcggcctgtgcccaggtgccagggcgtctggctccggggcgcgcctcctgcgttgcgtgtgtcggtgcgcatgggaagaggtcggttgcccccgtgtgctcggcggtggtgggattgccgagtcctgcgaccggagtgaggcgctggtacttcggttccgtcaagctcctctcgtttttccacgctagcccgagcctcacgggtcctcaggccctcagttagccgccgaggtaggcgggccatccgagtcccccccgtgtgagcgcgaggtttcaagacaaaaagcctccttccacatggatatgcaaaaatgcagcctgcaaagctgtgcttacctcagagaatacattctgcaaacggtgttcgtgttgtatatgtcaccttttcgatgacaacaaagatcctagcctttggctcgtctgctcatcagagactggtgacacagattgctgtgagtcgtcctgccacgttgagtgcgcactccagcgccgaaaggcagggcgcatcgatcttgggcgatctatgcacctagatggtaactatggctgtgctgcctgcggtaagggaactggattacctgggtgccggatgaggcagctagcgggggtgaaaggtcctccttgggttcatctgctttggactcgggtagacctgagtcataggcttttgcctggcacaacccgttttaaagagctgcatcggattgtacaggatgcaaaggcaaagctggaaactgaggttggtcccctagctgcaccttctatgatggcccggtactttgggcgccgacctcctggggcagctgatgtgcagtaaccttgtactctagcacgggaggcggcagacgactgaacgctggcaaactttcaggcagaaactattcaaatggacacccttcctactgactgcaggtttagatttgaaaatattacagcttcatcattatttatactcttctgtggaatttctcactcgcatttccatgtttttccctgtcgttggctttgttactgtaacagcagagatatcttcctctggggtcctttcatgtcccactgtgcataccggcacatgagtgtcgggtgactataacacagacgagacctccacaccaattctctc

SEQ ID NO: 3553 - DNA, 801 bp, Triticum aestivum
  unsure (1)..(801): unsure at all n locations
  Clone ID: PAT_TA_3553
caagggggcggagcaccgaccacccaccactgtctccctccccccttcagttccgtagagctcgcgaaggaggaagcaggaacaggcgaagcggcgggagaggaggaccgacgagatgcagatcttcgtgaagacgctgacggggaagaccatcaccctcgaggtcgagagcagcgacaccatcgacgccgtcaaggccaagatccaggacaaggaacgcgtcccaccgtgcccgcagccccccatgttgccggggaagcagctggacgacgaccggcaccgtgcccgactacaacattcagaaggagtccacgctccacttcgtttttcgcctgcgccggagcggtaggaatatcgagcccaagctctaggcccacgctcagcagtaccacctgggcaagctcagccgccggttctgctgttcacgcctgcctcccttggccaagagttgccgcaagctgaaagtgtggccacagcaaccagctgcggtcaaagaagaagtgtaggtactgctggaagtgcgcatgaatcggctgactgcttgtttaagcttgccagaactgtcagagttttaagtatcttgatgtaatgttcctgctggatgttgagcgctgtctcttttgaaaacttggtctagggttccggtgcatgctcaagatatgattgtagtatgacagcttagcgcttttggttggagggagcatttatctaatttatctatgtgctgttcttgttgttttcgatcttgaatcaactgctggtcttgtcgttcgtgccctttgtgcncttctattcagtcat

SEQ ID NO: 3554 - DNA, 621 bp, Triticum aestivum
  unsure (1)..(621): unsure at all n locations
  Clone ID: PAT_TA_3554
gcacgaggcggtcctccgcggcgtcgtcgtcgcagggcgcggtcccggagcggttcctcatgcggctgacagcggcgtccccgacgctggtgtcgctgcccgtcatcgacctctccggcggccgcgacgaggtccgccgggccgtgctccacgccggcaaggagctcggcttcttccaggtgatcaaccatggcatgccagagcgaacaatgagggagatggagatggcgtgcagcgacttcttccgcctcccaacaacggacaaggcaacattgtactcagaggacagcgagcagaccaaccggctcttatcgagcaccatgtacaggtccgccgctagtgagagctacgcgtgccattgcctccatctcgcatgccaccccgtcgagcgcaccaagccctcctggcccgaaaagcctgtcagactccgcccggcccttgaggacttcattatccctgctcgcagcattgcgatggaactcctccgtctcctctgtgaaggcatcgggctccagccggactacttcgagggcggcctcaccggcggtgatgtgatcatcaacgcgaaccgctacccgccatgcgcggacccgaaccttaccctcggtctgnnnncacann

SEQ ID NO: 3555 - DNA, 1100 bp, Triticum aestivum
  Clone ID: PAT_TA_3555
gggacaactcaaaacccgtcgtcgcctcactgtcaccgaccccggcgatcaccggcgaacaagggatcagtgtacttctctctccaaacgcgaagatggacgaagggaatgtggcgcagcagctcaagcagatgacggacttcatccgcttgctagccgtagagtaggcagtcgagatcgaggccgccgccgccgaggaattccaaatcgagaaactacaactggtggaagctgaaaagaagaagatcatgcaggactatgaaaagaaagagaaacaagttggtatcaagaagaaaatcgaatactcaatgcagctcaatgcttcccgaattgaagttcttcaagctcaagatgatttagtaaagtccatgatggattcagcacggaaagagctactgtaccaaagccgagaccatcaatcttacaagaaacttctcaggatacttattgttcagagcttgctgcgtctgaaagagtcggcggtcattctccgctgcaggaaggaggatcttgagcttgttgaatcggtcttggaatctgcgaggaatgagtatgcggaaaaggaaaatgtatatccgcctgaaatcatggtagaccaccatgtctatctgccgcctgctcccagtcattacaaggaacatgacctgtcctgctctggtggagttgtaatggcttctcaagatggaaaaatcgtctttgagaacacgttggatgctagactagaagtggttttcagaaagaagctgccagagatccgtcaaagccttattgggcagatagctgcatgaacaattcttgtaaacagaatgctgcacagctgctgctcggcacctcttgatgatgatcttcgagaaatcttttttgtggttcaccagtaatttacacaggctcgctcttttggtcagggggaagaaccctttgtcactgatgactcgagacttaattatgccacgcaagcataataagatgaactacagcattgggcgatttctcttaataaggcatcgatttgtgtagtgaagccatttatgtgtacacgtaatttgttaccttgatgaaattggcctcttcgattttcaaaaaaaaaataagaagaagtg

SEQ ID NO: 3556 - DNA, 900 bp, Triticum aestivum
  Clone ID: PAT_TA_3556
tccctcctgcgacgccgttgggcccggccctcctcccttccgttcttcattcgccctacccccgttcctcctgccccggcctcccctcccccgacgccctcccccagacaccgcaccaaccctccgcacgtccctcggctgctgccgagcgacctcctgcgaggtcgctgtgtccccgcggccgcagatctgttccgccctcccccgcatccctagcgtcgcccaaatgtcaccgctccctccatgctttctccctgggctgcaacatctcccgttgcacctcttctcgaactgccgagatgggcgtgcagcgagataggtttggcgtcgccggcccctcctggtcgtactcctcctgtgtgtgctcctccgcccctggtcacgtcatgctctccagcctatcgtccttcatccgtactaccccagttcctgctgctccggcctccccttctcgtacttcgagcccgagaatcataagttaatagatgttggtgtctcagaatgacaggttggctgtgtccacggtgctgcttttgcctaagatggattcaagttattgaggttggtatcgtcactcgaagatgtttctacatgatagtagttgtaccagtcaacttggatgtctacgtaatggttctttttacagtaataccttcaaagcattgcaagctcatgactcttctgctggagacatgtggccatcttcgaataatacaatttcacaggatggttgcaaccacgtgctgagcttaaaccatgtgtgtaccatagtttgaagactcgaaatcttatcagcttatgtaaagtttgtttaccgctgtagctggttgctaccgaacgcatgtatggatgttgaagtattggttttttcagtctaaaaatatttgtaagttcaaggtt

SEQ ID NO: 3557 - DNA, 429 bp, Triticum aestivum
  Clone ID: PAT_TA_3557
cggacgcgtgggcggacgcgtggggattgaattgccttcttcctcaattgacatctcatattccgtgatgaagggttctcacgcttcctcgtcaaatggaaaaaggggcggttagtagttcaagaactattatactgttggagtaccatgaacccaaaggagctacacctatgaggaatcaagtaccataaacatatttatgggatggtcacattgagagttagtaaagtttacgtttgaagatttaaggtagtagtggatgctgatggtggaggagacgtgttgaactttttgagagagatgggcttgcttgttgcttcaatactgataaatcaacttgggttatcgctgcaaaggaagcctctcaaatggaaactgaccttgggacgtaatggatgccgattagggatttctggaccattgaagagc

SEQ ID NO: 3558 - DNA, 579 bp, Triticum aestivum
  Clone ID: PAT_TA_3558
ctcttcaccgacatagacggggtatctcgacgccttgcggatgtggcagtggaaggtcgctcctacagttggctagagcctccaccctgcgaggacaccgagcaggcagtgcgtcttgaggccccaccaccgccaaggccttttccacctgtttcttcattgatgccaacaagattgctcattaaatatttcctgagggttgatgctgatggactctttcacacatatcctcatcgaggcggtccgtttaagagcttgaaagaagctcgggatgctatagactcccatcacactaatctgtgtaaattcaagtacatgggggatctttcagaggaggatatccatgtgtggcagaccctgtactggcctaatggtacaaggatgaattccaaacaagctttggatgtgatgatgaaccgccgccccaaatgggatgtacttaacgctttactggacaagtacaatgaggaccatcatctttttggggattttgcatatgaactgaaggaaattgtgagttacaaaccacattttcagggaaaaaactctccatacaaatgcagatcattctctcactta

SEQ ID NO: 3559 - DNA, 564 bp, Triticum aestivum
  Clone ID: PAT_TA_3559
ggacccacgcgtgcgcccacgcgtctggccttcctgtcaccggcggcggcgccctccctccctcgccctcttctcctcctctcctcacggccgcctccaccacgccacaaaccccgacgacccaccccgtctctgtgcccgcctcggcaaccacctccgtcgcgcgtctgagtcccatccgtgtccgcgccggctccgtctctgtctcctttcgtgggaggtgatccgcacccggacccgcggcggggcaggggtgggcgacggcctcgtgtagatcccatcctgatcccgtagcagccagtgtagccgcccccacctgctctcctctgctccgggatccatccatccactagggttctgcggccgaccggagtccaggccatggcgcggaagatgctcaaggacggggaggcgccccccatcgcggacggcggcgaggagagctacgactacgacccctgtctcggcgccgccggcagcggtgtcctccgcggctcccgcaccgccgcgggattcggagccaaggttgcgatctgcgagctcccgttccaccccatcaactcg

SEQ ID NO: 3560 - DNA, 266 bp, Triticum aestivum
  Clone ID: PAT_TA_3560
cggacgcgtgggcagaggaggaagaggatggccaccatccacgtcgccgacccgcacggcacgcgcgtggtcggcgcgtcggtgtctgtggagcagacgtccaaggacttcccgctggggtcggcgatcgcgtccaccatactgggcaacgacgcgtaccagaagtggttggtgcagcgaggcaacgcggctgtgttcgaggacgatgctcaagtggtactcgacggagccggcgtcggggctgctccggttcgacgtgcctgacc

SEQ ID NO: 3561 - DNA, 372 bp, Triticum aestivum
  Clone ID: PAT_TA_3561
ggtcgtcctctctgtccatggccagacgaagactagtcgtgcgccccttcaccgccatcgacgcgacttggtcaacagccaaagccatggccaccaagcgcgtccgcaacagcaacataattgaagtgcgccggggcacgcgatgcggttcggtgacgcgtggtcgtgtagttcgcggccaccacaggccccctcacctctacctccatggccacgtcctcaactagcggcgccctgccctcgtcgccggccatggcgccgcagccaccaggctcgagcgtctgctcttctcccttgaccctttgctagccggcgtcaccccgggccgatccaggcagttgggcgggggtgtggatgtgcagggtaatgctc

SEQ ID NO: 3562 - DNA, 1230 bp, Triticum aestivum
  unsure (1)..(1230): unsure at all n locations
  Clone ID: PAT_TA_3562
gcggccgcgtcgacaccgcttctccccgtcccgcggccgctccctctcctccctccctccctccggagaccggcccgccaccacggctcgtgccgccagagataagatgaggacgaggagcggctctctctatacctgcggaggtgtcggcgagccagcggctcccgtggccgggcagaagaggaagaggtcgcccgccgccgccggcgaggcgtccggcgggcgccggaagcggcaggcttccgggccggactacttggacggcatccctgacgacctcgtgctctccatcttctccaaactcgccgcatctgcgaactccccctccgacctgctgtccgtccacctaacgtgcaagaggctcaacggcctgggccagcaggacatggtgttcgccaaggcctcgccggcgtcgctcgcccgtcaaggcggcggcgtggtccgagcccgtgcagcggtttctcaagcgctgcgccgacgccggtaatcttgaggcgtgctacattctaggcatgatccggttctactgccttggcagccggagcggtggcgcggctctgctcgcgaaggcggctgtcggcgggcacccggcggcgctctactcgctggccgtcatccagttcaacggcagcgggggcgccaagtcggaccgcgacctgcgcgccggggcggcgctctgcgcgcgctccgctgcgctgggccatgtcgacgcgctccgcgagctcgggcactgcctccaggacggctacggcgtgcgccgcgaccccgccgagggacgccgcctcctcgtcgccgcgaacgcccgcgagctctccctcgcgctcgccgccgcggcggccagcgcgacctaccccttcgcctccctccccatcagcgccgtcgcaggcggcgccggcggcgtcagcagcagcccactcctctccgacttcnggtggagcctgccggaggcggagcctcacacggcgaaccagttcatgtcagactggtgggcgtcgcgcggggtgccagcgtgcgccataaagacgacccggcggcaccggtggagacgggaagggcaacttacggtgtgctcccaatgccgtgcgggcccagaaacacgggggaacaattcggggctttttcttgtgtggagcgcaatattggtccagcctggcaggcctgtatggaaggcccccaaagggccattgttgcctttgcaatgttttttgagactgataatacggtgtcgcc

SEQ ID NO: 3563 - DNA, 701 bp, Triticum aestivum
  unsure (1)..(701): unsure at all n locations
  Clone ID: PAT_TA_3563
gcaagtcagtcctcccaccccccaccccacatctatccccgccccgcccgtcccggatccacaccgccgccgcgatgccgtcgttcaaggccccggcgccgggcttctccgtccgcttcagcccgttccacgagcatcgcctcctcgctgccacctcgcagcacttcggtctcgtcggcaacggccacctcctggttctcgacctctccgccgccgggcccggcgggcccggcctcaccccgctcttctccttccccacctccgacgcgctcttcgactgcgcgtggtccgagtcccacgactccctctgcgccgccgcgtcgggggacggctccgtgcggctcttcgacgtcacgctgccgccggcgcagaaccccgtccgcctcctccgggagcacgcgcgggaggtccacgggatcgactggaaccccgtccgccgcgacgccttcctctccgcctcctgggacgacaccctcaagctctggtcccccgaccgccccgcctccgtccgcaccttccgcggccacgagtactgcgtctacgccgccgcgtggtcggcccggcacccggacgtcttcgcgtcggcgtccggcgaccacacggcccgcgtctgggacgtgcgggagccggggccccccctcggccccccggcccacgtccccgtcaactggnacgttcnnaaatcntcaatggaatccncc

SEQ ID NO: 3564 - DNA, 839 bp, Triticum aestivum
  Clone ID: PAT_TA_3564
gcccacggtctcgccccccccgccccgtcgccacctcctatggcgtccgtcgcattaaagctctcacggtcccggctcgctgggccacccgcaaactccggccgcttcgctcttcgcctacccggccgcgatctcactggagataccaccataaacgcccggtcgcgaccgttacttagatccccaaaccctcccgccgccgccgcctccaccatgcccctcggtctccttcctccggcgcagcatagctacgctcccctccggtcaggactccaatctgcctgtgggcgccgcaccagatgacctcgacgacgagctccgccctgacccggacgccgttccctacttcgacgagaaggacctcgtctcggatgaaaccctgtgggctctgtacgagcggtggtgccgcttccacggaatggcgcgcgaccacgacgagatgactaggcgatttggtcgtttcaaggatacggcgtggcatgtccacgagttcaacaagtcgggtaggagctacaccaaggggctcacccagttctccgatttggagccagaggagttcttcggccctcgtcgctgtccgaggactcccagaactggtagtcgtttcttcaccaacgacagagatgaggtcacggcgatctgtactgacgggtgtcttgaaaaatatgagggccctgtttggataatccgtaatgttaagtagccctaaagaaacggttgtatacgcaattcatccgtatctaatcaactgacagccgcttggatgcaaaggaaatgtgcttgctagatggtaatatgtgttgaacctcaagcggaacacacaatgcggaaaaaaaaaa

SEQ ID NO: 3565 - DNA, 1424 bp, Triticum aestivum
  Clone ID: PAT_TA_3565
ctcgtgcccggcccccggaccctggtcgacgtcgcccggggccccccgcccccccctctccacctgctggctgcgcctccgcacccatcagcctcacggagaggctctgccaggtcctgcgctggcccacggggtccctcgagatcttcttccccaagcccaacccgctcttgcccagcacttacctacacccgctgccgcgcgtagctcacatcaaaatcaccacccaccccatcgtcgccatcttacgaagctcctccacccccgggcctgcacctggccgcgtggccgccgttgacgacgtgccccccccccatcccgtcttctaagcctacccgtgcgtcgtgctccccccgctcctcgtctgagccgtgctggcagccctcggggcccggggccgccgccgtctagtttttcatctacggcctgttctgcatctccccgtgcgcctacgggtatcctgcgggcaggacggaaggacgccagtagttgatctcgtctggtgggaactcacctaagtcatcatcgacgtgatcttcatcaacatcccccacatgcatagctccggaggcaagcagcacaacggtgcctggtcaccatggcaagaagttcgtcgacgcagggtactacaactggccgtgagggccctgtccagtgtccatgactttgccgccgcgggacccgacaagattgacctgagacatgaaagcaacaagtcatccactcaacagtgcatgcatcaatctgatcgacaaggcagagcccgccaaaagtttgcattttttaatttttttgcttcaccttttttgcccgcttcttctgagttttgcccccgtgctcaagatcgtcttcccttacattcagagctcaggaggcaagcacacaacggtgcatgggcaccatggcaaaaacttttacgccgaagaacaagggagacggccttgagggtcctggtggcaaatgctccgccggacaggacgaccagagacaagaagcaacaagtcatccactggacaatgcctgcatccatctgatcgagaagcagagcccgccaaagtttgaattttttaattttttttcttcactttttcgcccgtttctttttagttttgtccagaaaaaagatggtgttgatttgatttagttcttaattacctgtggtaattaattatgtacttaattatacattacgcgaagaacaagggagacgacgacttaccgggtacgggatgtacatgctcgacgatgtatagagatgagagaggctgggagtgctgggcccgtggggtggagggcggtattcctttaagtagtattatatgggaaacaataaattcatttcattaaagcaggggccacggtccaaatcgcccgcccgggcctcgcgccacgccgtctttacccgctcacggcgtctttaaagg

SEQ ID NO: 3566 - DNA, 1257 bp, Triticum aestivum
  Clone ID: PAT_TA_3566
gtgggttttggatgccattgagaaacaaaagtttgaagcgccacctcccgtagccatccttccagctggtactggcaacgatcttgcgagggttttgtcttggggtggtggtcttggtgttgttgaaaagcggggaggtttattctcagttttgaaagatgtcgagcatgcggcagttactgttctggacagatggaagaacactataaaggacaatcaagggaagctcatgtgttcaccaaaatttatgaacaattactttggggttggttgtgatgcaaaggttgctctagatatccacaacctgagggaggaaaaccctgaacggttttatagccagttcatgaataaagtgctttatgcaaaagaaggcgcaaagaatatcatggataacatgttctattattttccttgggaagtcaagcttgagatagatggatccaacattgaaattcctcaggatgccgaaggtatccttgtggccaacatccggagctacatgggaggggttgacctgtggaagaatgaggatagtgtctccgacactttccaacctcaatccatgcatgacaagacgctggaagtagttagcttcacaggaatgctgcatcttggaaggctgcaggtagggctttctcgcgcgcaaaggttggctcaagggcatcatataaagattgagatcactactccgatgcccatccaagtcgatggagagccatggtctcaggagccatgcaccatagaagtttctcatcacgcccaggccttcatgctgaagagagtctccgaagagcctataagccacgccgcgtccataatggccgacatcctggagaacgccgagaacagcggtaccatctcagcctcgcagaagagtgctctgcttcaggagatagcgtctaggcttttgtagcaaactctgcgcaacacggtcttgtagctctgtagtcccctatagcatttgaccatgtctggccccttttgtacatacagccatggcttccttccttcttggatcgagcttgtgtataatttctgtaaaattttgtagggctttgagtttgagatgagcactaccagagactattgtggttactggttagcctagttcttggtgactctggggctggggaatgtgttctgagtcgcttgtttggcttgttaggtacagaccgatgattccggtgtgatgtggtatgtgcagtgcgcatatgacctcagttcttgcacaaaaaaaaaaaaaaaaaaaaaaaaaaa

SEQ ID NO: 3567 - DNA, 772 bp, Triticum aestivum
  Clone ID: PAT_TA_3567
tgcgtttacattctcacttgttctccatactctgacacgaagccactgaagaaatagagcaccatgcctgctcccgctagctcaacatctgttggttctggaggcagatcgccatccaaggcggtagcctcccgaccctctggtggtggtactgtcaggcagaggaaaaccacatcctcaactgccccaagaagtcgtgcagctggtaccagcagtggaggaatgtggaggttctacactgatgactctcctggcatcaaagttggtcccgttcctgttcttgtgatgtcactgttgttcatcgcctcagtcttcatgcttcacatctggggcaaatacacccgctcttaaactactttcattccaccctatgtttcctgattgcaattatcttttccttatcattccgtgaatgaatggaagacttggacaggatttacttatctcatcctgatcagtaaagtatcttgaaagtgtacagttatttttggaggatctcatccaaaacccttgtattgttttttagcaatacaaatttatttgtaatgggtttcaatgtgtggtttttttttttttttctttgttatcaatacttttatttattgaagggatgtaacaaactacaataattgtattttatatgttaaatattgtttttatcttttcaccttctgtcccaaaatgttaaattggatgaaaagtgccaacagcagtattttgaatacacataagttgaactaaaaaaaaaaaaaaaaaaaaaaaaaaaaaaaaa

SEQ ID NO: 3568 - DNA, 543 bp, Triticum aestivum
  Clone ID: PAT_TA_3568
cagctctacgcggctgaccagtccacaaacgtggtgaagaagtacgacaaggcaagcaacacatggaacatagtgaagcccttgcccgtcagagcggactcttccaacggctggggcctggctttcaagggatgcggcgacaggctgctggtcatcggcggccacaggggacctcgcggcgaggtgatactgctgcattcctggtgccccgaagatgggaacggcgccggcgccgccgccgactgggaggtgctctcggtgaaggagcgcgccggcgtcttcgtctacaactgtgcaataatggggtgctgagttagcagcaccctggcttcagtacatgccgccacttgtttagcaaaaaccaccgattcgttgctgccattctagctgctgccacttcgtataatgacttgtaattcagatatgacaccccctttccgcggagctgtcgattaaaatgtcgggtcgagagcatagagagcattcagttcagttcacctggaacttctcttttaacactcttcattcaaaagtccttattct

SEQ ID NO: 3569 - DNA, 1987 bp, Triticum aestivum
  Clone ID: PAT_TA_3569
cccatcagtgggagaccttgccagacgtgaacttgccgcggagactctcctcaggtttcttcatggatggcaagttctatgtcatcgggggtgtgacaagtgagaggcattctctgacttgtggagaggaattcgatctcgacaccaggacatggagaagaatacataatatgtaccccggaggcaccagcgcctcccagtcgcctccgctcatcgccgttgtaaataaccagctctacgcggctgaccagtccacaaacgtggtgaagaagtacgacaaggcaagcaacacatggaacatagtgaagcccttgcccgtcagagcggactcttccaacggctggggcctggctttcaagggatgcggcgacaggctgctggtcatcggcggccacaggggacctcgcggcgaggtgatactgctgcattcctggtgccccgaagatgggaacggcgccggcgccgccgccgactgggaggtgctctcggtgaaggagcgcgccggcgtcttcgtctacaactgtgcaataatggggtgctgagttagcagcaccctggcttcagtacatgccgccacgtgtttagcataacccacggattcgttgctgctatcttagatgccgccacttcgaacaatgtcttgtaattctgacatgaaaaaccctttccgcggagccgtcgcattcatgtctgggcacgagagcatagacgtcagttagcgcaggtcatctgtacaagctgcggaggaaatatggcattgttgagcattgggtgtatctggcctgtagtgctatgccctgggaagcattcgatccgtcgcgaaaccgatggatgaggctcccaagaatgccatgtgatgactgcttctcctgtgcggacaaggagtcacttgctgttgggacacagctgcttgtctttggccgagaatatacaggccttgctatttggatgtacaatttactgacacgccattggtctcgctgcactccgatgaattttcctcgctgtctgtttgcctcaggaagttctggtgagattgccattgttgctggtgggtgtgataggaacgggcaggtgctgagatccgcggagctgtacaattcagaggctggccagtgggagaccttgccagacatgaacctgcccaggagactctcctcaggtttcttcatggatggcaagttctatgtcatcgggggtgtgacaagtgagaggcattctctgacttgtggagaggaatacgatcttgacaccaggacatggagaagaatacaggacatgtaccccggaggaaccagcgcctcccagtcgcctccgctcatcgccgttgtaaataaccagctctacgcggctgaccagtccacaaacgtggtgaagaagtacgacaaggcaagcaacacatggaacatagtgaagcccttgcccgtcagagcggactcttccaacggctggggcctggctttcaagggatgcggcgataggctgctggtcatcggcggccacagaggacctcgcggcgaggtgatactgctgcattcctggtgccccgaagatgggaacggcgccgcctccgactccgactgggaggtgctctcggtgaaggagcgcgccggcgtcttcgtctacaactgtgcaataatggggtgctgagttagcagcaccttggcttcagtacatgccaccacttgtttagcaaaacccaccgattcgttgctgccattttagctgctgctacttcttataatgacttgtaattcagaaatgacacccccttttcgcggagctgtcgattaaaatgtcgggtcgagagcatagagagcattcagttcagttcacctggaacttctcttttaacactcttcattcaaaagtccttattcttgttgtctggcatgaatttttttggccgcagtattatttgttcactcgttacctacgcgcgcatgcgacgttatagctcttctatcgcgacacctgaagtgagtgg

SEQ ID NO: 3570 - DNA, 786 bp, Triticum aestivum
  unsure (1)..(786): unsure at all n locations
  Clone ID: PAT_TA_3570
gncgcccccctgntttttntttttttatgcgagaaaaatnnttgactgacaatacttgcccatattcgtgacgaccaataacattccttaatngctgatgatccntttaaaatttgtcatgnaccaaaattgngattgacccctcntatgtgaantgtaatccgcagcattgctaaaagagacaacaaatgtactacaacaacacagcaggcatatagtatctcatcaccactctgctactacttggtctggactgggtgtactttccgcagggacagggtcagggcaggatggggtccagatccctcctcaagtacacagaccacccaacccaatcaatcaaaacgatgaagaagatgagggcagagttgcattcatacggatcagagcagacttcgcaccacgcctggagattcattcttgcacatctatgcatcttggtaattgaccataaatggatttgaattgatccatgctatgctcgggtttctgtatctggaagagctccattaatggcgacgggcgcggatgctattgctgctgctgctacttgtgggtgtgggtgtgggtggggaacccgtcgacgagctccacggggtagcggtcgatgcagtcgtcccagggggtgctgggcgacggcttgacgttgcgcagggcgtgccacaccgcgctgttgcacttgaacccgctgccgaaggcgatctgccagatgcggtcgccgcgccggacccggcccttggcctccatgtaggccagctcgtaccagatggagctgctggaggtgtt

SEQ ID NO: 3571 - DNA, 336 bp, Triticum aestivum
  Clone ID: PAT_TA_3571
gaagctcgccggcaagtcattcacaatgcgggtcgagccactggtcgataaagccaaggaagcgggtgcctatctggcgcgggtgtcttttgggacagcactagttgcttccattgtgcttgtatatgctaccatcattgccattctctcaagctcgagtgatgaagataatcgtggaaggcggcgcagatcctatggctctacgatgttcctcccaacagatttattttggtacttggatgcaggttcctccaggaggaggcgggtagaaaaagataaggggatgagctttattgaatctgtcttctcgtttgtatttgggaatggtgatcctaa

SEQ ID NO: 3572 - DNA, 689 bp, Triticum aestivum
  Clone ID: PAT_TA_3572
ctttgagatcttctccgaggccgtggacatcgagagggagttcgtctgcgacgcgctgccctgcgcgctcgtcggcatgaacggcgacctgatgagccagtacatcgagttcgtcgccgaccgcctgctcatggcgctgggctgcaagaagctgtacaacgccaccaacccgttcgactggatggagctcatctccctgcagggcaagaccaacttcttcgagaagcgcgtgggcgagtaccagaaggcgtccgtcatgtccaacctcaacggcggcgccgcgacccagcacgtcttcagcatcgacggggacttctgatcggtccgatgataatatgcagtctccattaccaatagctcgctcgctcggtccgcgcgtctggttgcttgttagtcctagtagtagtagcggtgatacatgtttgctgggtgctccacaatgtttttacttactgttatttcgctgtctcttattggtgatgtactgatgtattgtaatgaatcaaggtattgcttctgaataaaaaaaaaaaaaaaaaaaaaaaaaaaaaaaaaaaaaaaaaaaaaaaaaaaaaaaaaaaaaaaaaaaaaaaaaaaccaaaaaaataaaaaaataaatcaaaaaaaaggggccccctcaaaagtttcaagcttaattaacccttaaagccaatttaaaccctttccaa

SEQ ID NO: 3573 - DNA, 1649 bp, Triticum aestivum
  Clone ID: PAT_TA_3573
ggcggcctgcggtccgcgccatggtcccatctcccaaatccctacgcagaaatccttcccacatcgaggccagcgccgccgccgccgccgaattccaaagatgcctgccgccctctccatggtgcccgcctgcgacgcggaggagccgctcctggcggagccatctccccaatccctagcagtaaaatccttcccacctcgaggccagcgccgtcgccgccggcgaattccgaagatgcctgccgccctctcgatggtgcccgcctgcgacgcggaggagccgctcctggcggagtcgtcggaccgcttctccatgttccccatccggttcccgcagatctgggagttctacaagaaggcggtggcctccttctggaccgccgaggaggtggacctctcctccgacgcgcgccactgggacacgactctctccaacgacgagcgccacttcatctcccacgtgctcgccttcttcgccgcctccgacggcatcgtgctcgagaacctcgcctccaggttcatgtccgacgtgcaggtcgccgaggccagggccttctacggcttccagatcgccatcgagaacatccactccgagatgtactccctgctcatcgagacctacatccgcgacgacgtcgagaaggaccgcctcttccgcgccatcgacaccatcccctccgtgaggaaccgcgggctcatggcggtccgctggatcgacgacggggagatctcccgcgacgacggcctccactgcgacttcgcctgcctcctctacgacatcctgcgcggcaagctggacgagtcacgcgtcttcgagatcgtctccgaggccgtcgacatcgagagggagttcgtctccgacgcgccgccctgcgcgcccgccggcacgactggcgccctgatgacccactacatcgagttcggcgccgaccgcccgtccacggcgccggcctgcaagacgctgtccacgaccgccagcccgtccgcctcgctggaccccacctccccgtcggccaagaccaacttctccgggacccgcgcgtcgaggtcgtggccgacgtcctgcacatcgagccggaatgccggcgccgcgaccccgcccgccttcagctcggccggagagttctcatcaggccgctgatcatatgcaacctccacgaccaacggctcgctgggtcgctcgccccgcgcgtcctggtcgcccccaactcctacgactagaagcagcgcttcttgtgtgctggctagtccaccttgtttgtatttagtgtaattgcgctctccattaccaatggcttgctcactcggtccgccggtgcggtggcttgttactccttgaagaagtagcggtgatacatgtttgctgggtgctccacaatgtttttacttactgttatttcgctgtctctttcgccccccgcgtctggttgctccccctagtcctagtagttgtagcggtgatacatgtgtgctgggtgctccacaatgtttttatttactgttattttgctgtctcttattggtgatgtactgatgtattgtaataaatcaaggtattctcttactaaataaacaaacttgcgctgcccccccctgcctcataatatgttatgtcgttactatcccttacttgttgctattaccacctc

SEQ ID NO: 3574 - DNA, 621 bp, Triticum aestivum
  Clone ID: PAT_TA_3574
ggccatgtcttcttccaattcttcaaactcaaggcgtcttcttcctcaaggcgtgcccacgctgctagcctaaggtctccggtgaggtacagggttggcccgatggactaccagccacctgtgccttgcaggtgtaagcttaagccgaaagcggccatgtggatttcctggagcgacgacaatccagggaggaggtactacacgtgcgccagggcaaggatggggggtgcgagttctttgattggcacgatgatcctattgaagatgaatacctgaaacaactgctgatagatctgcgtgacaaggtgcgtctgctggaacgaatgaatgaagagctccgttcggaagcgagggcgatgcaacatctcgaagaaagcaggcaggaggttgcacagcaagtcccagagccaaaccttggcagccaccgcggtggatatgtgatgaatgttgctgtgtgcattcttctgctagcacttgtgtacaaggtgttctgcatgtagatgcagattagttggaagcaactacgcagcaaaactcatcagtttgtgatgagttttgtgaggtttatcagctacgtgagatgaaatagtgtaatgctcgaattctcatgcaaaaaaaaaa

SEQ ID NO: 3575 - DNA, 769 bp, Triticum aestivum
  Clone ID: PAT_TA_3575
ggtccggaatcccgggtcgacccacgcgtccgatacgaccctgcgttcccgccgatcgtgtttccgtctcaagttcccacctccgcggttccgcccctaccgcatcccgccgcccatggccgccgtcgtctccgacctcgtcgactttctcaacgcctcgcccaccgctttccacgccgtcgatgaggcgaagcgactgctgaaggcggcggggttcgagcagctttcggagcgggaggagtggtcggggcttcagcccggccggaagtacttcttcacacgcaaccactccgccatcgtcgccttcgctatcggcgccaagtacgttgccggtaatgggttccacatcattggcgcacatacggacagtccatgtctgaagctcaagcctgtcaccaagataaccaagggaggttatcttgaggttggagtccaaacttatggaggtggattgtggtacacatggtttgaccgtgatcttactattgctggtagggtgcttgtgcgagagaagaaggacggtgtggtctcttatgggcataagcttgtaagggtgcaagagcctatcatgagaatccccactttggctattcacctagacaggactatctcctcggaaggtctcaagattaacaatcagaatcatcttgtcccagtgctgggcacattgattaagcatgaaatgcagaaattagtggaaggaaatgttccaggggagtcattccggtgccgaaaacacaaagcaccatccactattgttgcagttgat

SEQ ID NO: 3576 - DNA, 897 bp, Triticum aestivum
  Clone ID: PAT_TA_3576
gtgagcctgagctgcacgcactccatggagatggaaggcaagaggagtgtgatcctcctcctggtcctgggtgcggtcctcgtgctagggaccttgctgccacaggtccaagcagaggcggccgctgaccctggcgacgacgacgacgacgatcaccggaaggtgtgctgccacgacaaggaagcgagctattgcttctccttctgcacccacggcagctccacccccaagctcagaacatggtgcgcggacaactgctgctgtgtgctcaccatggactcaacatgtccgcctcgctgcacaagctccagcctcacgttcaccaaccatgctgcagtgccctccggcttgctgccaccggcccaagcagaggccgccgccactggtggtgacagaaagaagatctgctgccacgacgaggacgagagcctttgcctctccggctgcctcgaacagcacggctccggtgacgccgccagaacgtcgtgcgcgcgggactgctgctgcgtgtttacatggagcgcaacatgcccgcgccgttgcaaaagctccaaccttcttctcaccaacacagttatagtggacggcagcgaagacacgagaggcggtgccgcttaatcaaccaagcgtgcacgcacacgtacgctgcgactactgcaggtggaagcagcctagacctgatgtgtgtttgtgtgtgtgtgttgccccctgtgttcagtatatataattggattccatcgtacgtatgatggtacgtacccaagagagtgtgacgacgtccaataaatacgtgttcatcatgtaataggcacatatgatgccatgctcgttccgcatgtatgcggccgcacgtttgttttaagatttttgcccttaaaaaaaaaaaaaaaaaaaaaa

SEQ ID NO: 3577 - DNA, 756 bp, Triticum aestivum
  unsure (1)..(756): unsure at all n locations
  Clone ID: PAT_TA_3577
caaatgctttcccgtctccttccacgccgccaccaccgtcgcctcctccaaaccctacaaccggcagccgccgccgcgggtgaactccaccagaggttgtgcgctactgcggcggcatcgagcccaagcctttcgatatggcggcggaagaaggagatggggaaggaaggcctcatggcggtcgcgcagctcaagcggctcgcggcgctaccccctgccggaggccaccagaggctggtggagtacatgaaattgcatgtgtctcggctcctccgcaccgacctcctcgccgtcctcgctgaactgctccgccaggaccacgtcatcctctccatgaagatatatggcgtcgtgcggaaagagatctggtatcggccggatatgtacttctaccgggacatgctacatatgctagctaggaacaagaaggttgacgagacaaggcaggtctgggcagacctgaagtctgaaggagtgctgtttgatcagcacacttacggtgatatcgtgcgagtcttctgtgacgctggtttgattgacctggcaatggaattctacgaagacatgaggagctccccggagccacctatgtccttgccattccgggttatactgaaaggcctgatcccatatccggagctgagggagaagataaaacaagattttctggaacttttcccagatatgattgtgtatgatcccccagatagcttgtctgatatagatganaattcaaatttgacccggtataaatac

SEQ ID NO: 3578 - DNA, 748 bp, Triticum aestivum
  unsure (1)..(748): unsure at all n locations
  Clone ID: PAT_TA_3578
gcgcaacgcgcggcgccgaactcaccagccccacctcaccctcctcgtctctctcgccccgccggccgacggattcccggccaccaagctcgcctcccgcgagatcccgcagcaatggaggtgaggacagtaaaagttggcaatatttcattgagtgcctcaaaaagggagatcacagagttcttttctttctctggtgatatagaatatgttgaaatgcaaagtgaaactgattggtcacaacttgcgtacgtcacatttaaggactcacaaggagcagacactgctgtgcttctctcaggagcaacgattgttgatctttctgtcatcataactccaggtgagaactatcagttgcctcctgaagcccacaaacaattaccgggagagaattctccctctgctgaatctgcagtcaggaaggcggaggatgttgtgagcagcatgatggccaagggttttgtcctcagcaaggacgcactcaacatggcaaggtctttcgacgagcgtcacaacatcatgtgcaccgccaccgccactggcgtgtctctagatcaccaataccggctgagcgagaagatcaacctgggccggggcggtcgtcgcaagcaaggtcaaggaggtggatgagcggtaccaagtgtcggagctcacaaggtccgccctggccgccgccgagcagaaagccaacgtcgcangctcggctcttatgggcaaccagtacgtctcaccggggctttctgctgac

SEQ ID NO: 3579 - DNA, 2486 bp, Triticum aestivum
  Clone ID: PAT_TA_3579
gcaaagctgaccgaactgttaacgaaccaaagcaatcaggaatagttagtcgtgggggatcgttacctggacaaacttctactgctgactgggcacaagaggctgaatcatcatactggcctacacagcctgcattgggtgctgaacaacggctggacaacaaaaactggtggtctcaaccaccccatccagcccagtttgctgattccagacttcagaggacatcctcatccccgcaacaagatgctcagtacaatcctattgaacctattctcggaccaaggccatctcctttgcagagaatgtcatcatatcctcaccaagagccgcaatacaataatattgaactgattcgtgggaatggtagcaggtttacaccagctttgatgcagcatccaaatggatttatgccacatcaaatgccgccaccccatcaacaaaatggaatgctcccaattcaacactctccaccccagttctcacaactacatgcccagatgcgcgcggcccaacattctccgccacaaaatctgccgatgtttggtcctcggcatccttcaccacaaatgatgggtagatttgatccaaattttgtcatgcctgacttgagtgatcccagagccagatcgatgttacaccatggaaggcatggcccgcgctatcctccccaaggttttgagcctggcaatatgagaatggataataggtggcagcggttcagatccaagtacatgtccactgaagaaattgagaacatcgcaaggatgcagaaagctgccactcagatcaccgatccatatattgatgattactatcatcaagcttgtttggccagaaaatcagcaggagcacaactgaagcactacttctgtccaaccttgatcagagatacatcttctcgtgcacgcagtaaggatgagccacatgcgtatcttcaggttgatgctcttgggaggcttccattttcttccatccgcaggccccgtccgctccttgatgttgaagaagcctctgaaccaagtgatagcactactgaaaaatctgcttcaaaatctcttgaccaagagccgatgctggctgctagaatcacaattgaagatggcctttgcctactactggatgtggaggatatagatcgtttgcttcactttagtaaacagccagatggtggtttgcaacttagaaacagaagacaggctcttctcgagcagctggcagaatcactgcaattagttgatccacttacatctaataaggatgcacctctgtcgcaaaatgacgatctagtgtttctccgcatagtatctcttccgaagggtcggaaactactttctcgttatattgatcttgttacttcaggtagtgagcttgcaaggattgtttgcatggcagttttccggaatctaagatttatatttggcaatttgccctctgatagcagcatagctgggaccacaactaaacttgtaactgccgtttccacgtgtgttgttcggatggacttgagtggactcagtgcttgtcttgcagctgttgcatgttcgtcacaagcaaccacctcttcgacctctgggatatgctgctggtgatggcgcttctgtcatcataaagtctctactggacagagctacagagcttcttactgataatcgcgcgccctccgcgcacagcatgcagaaccgaactctatggcaggcatcatttgatgccttctttgggctgcttatggggtatggcatgagtaaatttgatactgtggttcatacagtgcaaatccaacctgctgctgcagctgtgataagcagggaaacaccagtggagctgttgcgtgccagccttcctcacacaaatgagtatcagcgcaagcagttgctcagtttcgctcagcgcactgtgcctgtcaacagctctagttctcatgggtctggtaatgtgccgatggcatcagaatatgtccacgagctgaaatagaagaacagagctgcttttcataatctatatacttgatatggttcttgcgagtggtgggaagaacatagatattgtggtgacgacaaagaatgatggtctcggtcaaatatacaaaggatgatcttcggccactttaggaagctcaaattgatgaattatgttgctgagactgaggtagagaaggctgctacaatggatggtgcccgaggggaacatgatcgctggatgtgttaagccttcattctgtcagccaaaacttttagggcgctttctgttgcatttctgttgcattccattgcacgacctaaacttgttttagcgctttagttttgttattcgtatatgaattttgttgttttctcgatggcctgtaagctgttcttctgttcttccggcgcttgaattggcacaaattattactgcaagccttgcgtatcagcctgacatttgaacatgctgacaaatcaacatttctgcagtttgggttaattagtgctgcaatgctggtcacgcga

SEQ ID NO: 3580 - DNA, 436 bp, Triticum aestivum
  unsure (1)..(436): unsure at all n locations
  Clone ID: PAT_TA_3580
cgaccgccacagcaagtgcccggcggggagcacatgctgctgcacccacggcgtcaggaagacgtgcttcgtctggggatgctgccctgccaagggcgccatctgctgcaaggacggccccacctgctgcccgtccgactatcccgtctgcaacgccgagaaccgcacttgctcgaagagcaagaacagcccgtacaccgtggaggcgctcatccgtactccnggccaggcgaagcaggacaacgacccttacacaactggccgattcagtgttctccgaattggacgtctagcctctgggtcttttcttattattttttagcccatggctacaatagtattaggactatttgaaatttgtatccgcaggaatatgtacatacaagataccagaatttccacattgttgaagatccgaaaaaaaaaaaaaaaaaaa

SEQ ID NO: 3581 - DNA, 589 bp, Triticum aestivum
  Clone ID: PAT_TA_3581
ccgtctctcctcccctcttcttctccacgcagcgcaaaagagcatcgtcaccaaattgggcaagattctctctttcccgcacgcaaccaatcgccagccagccagccagccagccagccagcgtcactccttctcctgcggctgtcatacaaggagaagaggctccagtgattttgcggttcttgggagctccgagcgcctgagctggcctgcttcgttggagcctaggttcttggattggccggcgagcgagcgagctggcgggaccgagatgctgtctgtgagctcgccgaggatgcacatgagccggaacgccgtggatttgggcctgctggccgcctgccgctgccgccgctgggccgcgcgcccggcgcccaggcggcgcgcgccatcggcgtgcctccggcccgcaccctgcccggcgcgtctcgcggcgatcgacgtgccggcggcagagaccatcgctagcgcggcggccgggacggcgcggctccccgagcgcgtgtccatcgcttcgctcttggatgtcgtctccgacgacctgctcaagctcaacaacaacctcaaatcgcttattggtgcagaaaat

SEQ ID NO: 3582 - DNA, 618 bp, Triticum aestivum
  Clone ID: PAT_TA_3582
tccgcctcctcctcatcttccatccccgtgcagccgtgcccaccgatctcccccttccattcatcctgtgccccatctgcagcgaccaactggtgaccaatgtagcagggaggggagagaaaaacggacaccgtttctactagtgcggcggatacgattcccgcagtgtcgtttcttcgatttccatgagtatgtcaaaaggtccacccctcaccagatctaccgagctcaacagcacgccatgctgcagcaaggaaacaactgcgccagatacttgctggcggcaaccagccgccgtttcaacctgcgcagccagcgataccagcgccggtgaatcaggtcttcaagccgggtgccgccgttgccacagccaccagctctcaactgctccctgctgctgctattctgttagcggctaccaatctgatgattacagtgctcgttctgtctttgttgtgcccgtgtactttacatcctcgaattagatattcaatggtgtgtacttagtgcgtcctgccaaccctttgtgagggatcatgtagtccagagttatcataagcctgtttgcttaatgctgcacgagtatgttgtatgataaaacataatgattatgcttta

SEQ ID NO: 3583 - DNA, 607 bp, Triticum aestivum
  unsure (1)..(607): unsure at all n locations
  Clone ID: PAT_TA_3583
tatcgctaacctcacagtaatccatccggcgaaaacctaaacaaaagtaggagcaaaatattcgtcctagtttaaggggatacgagggcagcggcggagatgtccgttgcggatgctgccgctgcggcggacaaaggtaaggagaaggtggaggagcctgtgcccccggcgagggcggcggggggcggaaatgggaggttcatggcgtacccggcgcggatggcggagcacaaaagcgtggtggcggacgccgccctcttcagggctgagctcgagaagctgcacgcgcacatgggcacaaaactcaaggtgccaattattggtggaaaagacctggatcttcatcaactatttaaggaagttacctcacgaggtggcattgataaggtcaaggcagaaaacagatggagagaagtaaccgcgtcatttattttccctgcgactgcgacaaatgcttcttttatgttgaaaaaatactatatgtctctgttataccattttgaacagctctacttctttggaggacagggctggtatcaacaagaaagtgatccagatcactgccttcatagaagtgagagctgaaacacaaaacatcgacaaaang

SEQ ID NO: 3584 - DNA, 1219 bp, Triticum aestivum
  Clone ID: PAT_TA_3584
atggaccaaagtttgttttttttttttttttttttaaccccataataaccgaaggacattttgccatttctgtgatttcagaggctaacgaagtggtatgtgttcgttcctgaatgtcacatgtaaggtgggatgtatacctggaaaattacatcaatgaatcgactcctgcatgctcatttctgactaatacaagaagcagccccatttccctatacagttatcgtaaagaaataaagtttcagcaaaacagccaatcccaactgcaacaagaatatccctgcaacgatcagaaaccaccgctccccagagtttaagatgtgggcacggagattgacagcgacgaaggtagcagacataaacccagcaacaccagcaataacccatctgaatatttctattggcacaattgacagaagcgaggctggaatgaagatgaacaaagagtacccatacaggcaccacaattgcacgagtccagcaggtgctgagaagtacttaagaatgacatataacccaaggggaacaaatgtcacatagccatagaataagccagcagaccatgtaaccaggttaatatcataggtccactctttcttgtgccatttgtgggaaaggtaggtgacaaacgtggcaatggaagcagcaacaaaaatcagggtggtgcatgtccagaatggcccatacaggtcgggtttgtcggaagtcttctctgtgaagttgccgcggaaggggaagaccgactcccagatcctctccacgacatcggacgtgtcaacgtcgaagtagggcttgtaggccgctacggagaacatccggaaccagccgccctgcgcggcatcgtccgacccaccatcgctacccctgcctccgcctccccctccaaccttggacgagaaggtgtcgtcggagtcagtgggcgggcggtaggcgccagagatcttgcccttggcttctgagggtgggaaggtctggaggttggactcggtgaacttgatggtctgcggatctggccccgtcgccgccgggacggatccggaggctttgggatcgtcgagggcggagtagccaccgccggacatcatcttgaccggcgacggaaacagccgcggcggaggatcggggaagggaagcttcggggcggagcaagcgtcccgcagcggcaaggtgagagttaggcgggccggccgcctgacgcggtgggtggatgtcttctcgg

SEQ ID NO: 3585 - DNA, 914 bp, Triticum aestivum
  Clone ID: PAT_TA_3585
ccctctgtgtgggagagtcgttggcacgcgtcgtcgcggttggatggacgccgcccttttgccttgtgacggaggaagccgcggatgagggcgcgctgcgccatgcgcgtgcgcctgagggcgctgccgtcgcgttgccgctgtgcctcttccagccccagccattcatccgggtcgccgtgggcgctctggccgttgcatcccgtggatgagcagccgagcgcccgggacgcgtggacgcgggagccgctagcgatgttgcagatcgcttgatccagtgcaagaaaaactgaacttttcttccttggtcaaggatctcttcccgttgatgcttcagccatctattcatctcaccgtgtccgcggacgccccgcatgagggcgcgttgcgccatgcgcgtgcgcctgagggcgctgccgtcgcgttgccgcagtgccacttccagccccagccagtcatccgcgtcgccgtgtgtgctctagccattgcatcccgtggatgagcagcgaggcgcatggacgcgggaaccgctagcgatgttgcagatcgcttgatccagtgcaagaaaaactgaagtacgtatggtacctttttgctctttgcatcactaaatcgaagagattttccttgtatgttttctcttgttcttcgttctttttgttgttcttgctgaccggatggttctttcttgattgaagcttttcttccttggtcaatgatctcttccggttgatgcttcagccatctattcatctcaccatatccacatactatgtgcagaaaagcagttgatgttcagatcaagggaagaactaaaattaaacggaattagtgtttcctgattgatttcccgatgctcgttcaggcagtcgctgtgctgacgccgtttaaggcgttcgtgcttgtcgtgccga

SEQ ID NO: 3586 - DNA, 779 bp, Triticum aestivum
  Clone ID: PAT_TA_3586
gaattcggcacgaggcttggcgtcgctccgcgactcctgtagtgcgcggccgtggtggcttggagaatgcgcaacgatggcgccttggagctcctctgttgtcgtccgatctggccgcccgcccagcgctccagatcgggccaatatcctcccggcaaggcttcctccatcctcccgtccgaggaacggcgaccgccttctcaccctcagcagcggccgtagccatctccgccgccgtcccggacggacgacagggctaggactggcggaggccgaagatggctgccggcggcgcatgaccgaatgggcgcgtgcgtctagataagatacacaaataaaggattgtgggttgaattctaactaatgcaggtgtgtttctccctgcctctcctccttcctttctgtcccccttacctctgtctctcgcacaggtgcagcaccgccgtcgccatggagagaccctgtcggagctcgccatgtcgatcgaaaccggcgaggaacgccaccgccatgaacttggagttcaaaccccgccgctggacctcctcccgcgcctcctagatcgcctccacgccgtacttgcaacaggatccggccaccgccgcgcctcctcggccggatctggccggagatcgccgccgccgtgcccggcgtcgtctgcatcgcggcagtctcgacatccaactcgcttcgctcgccaataaccactttgttgaatataaaaaacacagggtcctttttgtaagaacgacacgttttctcaaaaaaaaaaaaaaaaa

SEQ ID NO: 3587 - DNA, 897 bp, Triticum aestivum
  unsure (1)..(897): unsure at all n locations
  Clone ID: PAT_TA_3587
acgagggccctttccttcccctgctccagatcagggagcggccatggccggctcctacccccgcaaaggcaaatcgcgggggagggccaccacgcgccatgtccttccacccacgtgagaggaaaccatggcagggtgctccatgctcgcgcagatcttacgaggaaggaggagacgatggagcgggggagctgtaggtgtcgtgcaccgacggtgctgcgacaggggaagggtacacacgccggtgatggcgtacccccacgcgcaactggcgagtggtggagctggtccctggctacggtggagttgcaagcggcaaggggcaaagctgcaaccggcaagcggcggagctggaaccggcctgagaaggagctggaaacattgttttttttgctggaaaaggcctattcagagctacgacgatggaacaacacacttttttgctggaagagatgtttctttttgctggaagcgtcactttggattgctactgtcgatgcatcacgacgagcggcagagcttcatatctgcaacggggacaagagaaaagctacgacagatgagggaaaaagctacaaccagtgtttttttcttgtcaccgatgtgtggttttctttcactgggacgtacgacctatggtggcggacggcggcgccggcaacacgccgatcgcccccgggtgcgaccctggtcgttgtgccctctccggtgcgctcggcctgccccatccggggtctggtttggcttcggccttgcctgccgngggggnnttncaatggaaaaanttggaataaaccattncccggnnggggcctgggtttttttttggncttnannttaaccccntggaaaaatgggcncccatgannnnaaaaaaaaaaanatncnttttttctc

SEQ ID NO: 3588 - DNA, 1135 bp, Triticum aestivum
  Clone ID: PAT_TA_3588
gagcccgcccccccggcgcccggtgcggcccgcgagccgcccccccgtgtcccccggcccaccctcagcgcctcaccacgcgcccccgggccaccccaacgccgccccctcccctgccctccaacgcaccaccgcggctgcggcggcagccgcagcgccgctccgttccccgcgctgccgcccacccgctccgccgcgccctccgcggccgcggggcgcggggctcgtggcgagaggcgccgcggtccctcccgagcgatccgtagcgcctcaccacgagactctgggcgacgcccagtctgcgctgtaccaagctccggacggtatcgacggaggagtagtcggcatatcctccgccaaatcccccccgatccctgcactgggagagcgccggccgccgcgggctcctccacagcaccccaccgacgcggggcacgaccagatccacgctggcccggcgcgcctctattgcacccccgcagttccgggcgatgagtgtcataaagttcagcgcaagagcattgtagacattctcaggccaactcgctattgaggcatcctccagtatcaccacgaaaacaagagtgggtatcaagcttgagagttcaacaatcaccccagatcagttgatgaatatcttccagaagaactacgacatgctccttgccatattcaacccagaaggttggcttgagataacatatgttgacgaatctctacggatcggcagagatgacaaggcaaacatctttgttctggagaaaacagacccatctcaagtgtaagaagatccacgaagcaaaatgtgtgcaaatattcgtaatttctgacaatgagtgcatcgacactcagagaagaggccacctttgcgtggtccgcggcacttaggtttgttaactgctcagcgctgctctgccggtccccctctcggcaactgcccccgtttgggaccgccagcattcttttttacgactgtagaaacatttgttttttggatttttttagctgtgcactgtcaatgtatcaatgtaagtatgtaactatgaaagttcagttacatagagaatcaaactgccccatcacagggagcactttaacaaatatccaattttgaaatacaatttttttttcaaat

SEQ ID NO: 3589 - DNA, 1100 bp, Triticum aestivum
  Clone ID: PAT_TA_3589
tcggcacttgccaatgctggcatgtcgtgcatcaaggtagggtaatggtgaagcttcattctgacggtctagaagtttttgtttggtgtttccctcggcagggtaatggaggaagatgagacttaccccagttttcagtgcatggttggagaagaggataagaggagtcgcttgaatcttgaggtgacaagggtagtcatctggtgcaactaaaggttcagcttcatacttgtgatgatattgttcagtttgcctggatgattgcccttgtactactctttcagaaggaaggaggtaaatggagcaaaaggcacgaggagaaaggagtaacgccatagggacgatgttgtcggcagcgcctttgaaaggattcgccatggagaagctacggtggctgaccatcttgctcgggaagtgggaaggatgtcattcggaacgcccctaggttctaggggcgtgcgtccatgcggcggccgaggtggccacaaggagttggattgggcacttgccaatcaaagcgtgtcgttgctcaagtatgccaatttatccgtgatggcaacctaacatttggaggtaacgatggcctcaccagagtaaggggaaaattgtgggagtggacgcacatcatgtaggtgaaacgggagagtttcgagtcgtagcaggcctcagcttcgacacactttcggactctgaactgcatcggaaggtgacctatagttgaacccatggagttaggagacacctgatgatgtgtcaaaacctgtcctgcaaaataaaggagcgttgaggatgatggctttcatgttcgcttggatgatgctggttccgtggtggcctttgatatgtcagcctgctacaactacacttcagaggacgagcgcacaggattaccaggcaccatttcatccaagctagattgtgacccctttaactcatgatgcctatcccgtcaagtccaacatcagttgaatgtttgaaacattgtccgactcacctagacaccacatacgacctttgtatccgctaatatcttttctgcaaatctctggttgagctattctctttcttttcgtaactttattgatgaaaatgcaccgtgt

SEQ ID NO: 3590 - DNA, 783 bp, Triticum aestivum
  Clone ID: PAT_TA_3590
tcggcacgagggctccaaacacaagccaacagaaccttccatccatccagatctcgccgacgccggccgactccacctcccccacgccgtcgctgccgtccctccggcggcgcgccggctcgggcacgatgcagccggtgccgggcgccgaaccctcctcctcctcctcgttcggcgacgcccgcctcaagcccccttcccctcccccccgcccttggcactcccacctctcctaactccctcccctcacctacgcgctgcctcacccatctaacccctctccctcactcgcccctcccccggcatttctcgacaactcggaccgatctcgctcatccggaccccgtcggctccctccgtcgccgccgccgtccgcccagcgctcctcagcagctcagtgacaagcgactccatgggtgatttggcttctgattctgaaagagtgcccatggagggtcacggtgcctcttctgtctgcaaggatgacatagcttctgctagaggaggcacttcctccagcggggcaggctccacgttcttgtgtggagctccgtcatagcctggagggaactcataaacaagccagggatgctgcttctttggacactgaagtggatacctcaggttctcccagctcaggaataaagagaggcaaaggaggtgatgggagctcccatgcaatctccaatcacagtgaaccaaaggcctcttcaccttatgagcgctcgccgtcctttccgtcgacgtcaaggcttctcgtctccgctatgaaaggaggccgtg

SEQ ID NO: 3591 - DNA, 448 bp, Triticum aestivum
  Clone ID: PAT_TA_3591
gctggcgttcataagggaggctcacagggcggcgtcggagcgggtggacatggaggccgccgccgccaagggggtgaccaacgtggagaaggtggaggacgcgccgcaggatctggcgctggagcggtacaaggtgttcctgaagcagtacaaggagtgggtggataccaacagggacaggctggaggaggagtcctacaagtttgatcaggattactaccctggtagacgaaaaagaggtaaggactaccgagaagatatgctggaacttccattcttctaccctggacagatatgttacggtaaagtgatctctattcacctccatcaaggagcttttgtggatattggtggcacacatgatgggtgggtgcccataaaaggaaacgattggtattggatccgccaccatatcaaacctggcatgaatgtctatgtggaaattctg

SEQ ID NO: 3592 - DNA, 609 bp, Triticum aestivum
  Clone ID: PAT_TA_3592
tcgtgggcgtcgaagcggctgggcctgtgtgctgcaaccggccacgacgggcagccgcgcgcccggggcaacggcccggccgtgcaccacccatgcatctgttgtcctcggggcgtcgcgctacttgctccgacgaggctgagctacaagtggcgaccggtcaccagagaatatgtgaaccgcagcgagacatgctgcaaccggcctcggcggaagctgggaccgcatggtggcttgctgcaaccgggggcgttgaaagagctgcgacgacgccgatgatgctggaaccggcgagcttttttgctggaaccggcggcaggaggtgctactaccatgatagcaaaatgttggaaccaaccgccgcggcctccggcaggttttttttttgcttcaaacagccattgattttgctggaaccattaattttttttgctggaacctgtgatttccatgtatgcgagtacagaagcattttttttgttctgggatcataacttttggtgcgaccgaccagaaattctgcttcaacaagccattgttttgctggaaccattaagcaattttgctggaatcagcgatttccaaaaaaaaaaaaaaaaaaaaaaaaaa

SEQ ID NO: 3593 - DNA, 613 bp, Triticum aestivum
  Clone ID: PAT_TA_3593
aactctacctccaactccggccccgtcggcgaatgtccggtgtgcctcgagcccttaagcgttggtggtggcgacatgaaggcagctcatgtgtgcggccacgtgttccactcccgctgcatcgagcgttggctacgccaccgcaactcctgtcccgtgtgtcgttgcactgtcacgtgcagtcacaacccgtgaaactaagtagcatctgctactaccagtggtggtgcttccaacccccaagagaccgtggtcctagtgattgtggaacaaacgggagaataggggcactagagccgatgatggtgatatgcaaagatccatgatcacttgagctgaactactcagtggctaagacaacatgcaacaatattggtaatgacaacgagtgtgacagtttgccagtaaacaattatattgtacggttgtttttttgctttggaatgagagcttgcttagacatagtagatatatttcatttatattctgtcatttgttcagtgacagaaaattcttttgttattggtgttatatagagtttgctacaatgtacaccaaaccatagagataagggtttggaattcgatttgttcttttatttatccccaaaaaa

SEQ ID NO: 3594 - DNA, 1471 bp, Triticum aestivum
  Clone ID: PAT_TA_3594
ggcacgaggccctgctcccgcctttccggaagcggcgggtcggcggcggcccgcccataacccgccggatcccgctcgccgccgggggcctctccctccgccgctccctctccgcccggcgcctcctttgcaaccgcgccgcctgccgccgcccgttcccgcgtccacgcctccccctctccactcccccccccccgcctgcccccgtcccgcacccgcctccgcaaaacctagcctccgtcaccacctccgctcgccctccctcctggcaaccttctcctcctccgcggcgggtcgggcgtgcgggatagcgggccgttggatgggctcggttcgagcctcgccctctgaggcggggggctgggcggtggctgcggcgggtaaggagggggtggagatggagcggctggtggcggtggcccagagcgcggcggatgcggcgggggaggtgctcaggaagtacttcaggcagcgcttcgagatcatcgacaaagaggaccacagtcccgtcacgatcgctgatagagaagcagaagaagcaatgacctcagtcatactgaagagctttcctactcatgctgttttcggtgaggagaacggttggaggtgtgcagagaagtctgctgactatgtttgggtcttggaccccatagatggaacaaagagcttcataactgggaagcctctttttggtacgcttattgcgcttcttcacaatggaaagccggttatgggcattattgatcagccaatcttgagagagagatgggttggggtggacgggaagaaaactaccttaaatggacaagaaatatctgtccgtccttgcaatgtactggagcaagcttacttatatactacgagtccacatctctttgaaggagatgctgaagatgcattcattcgtgtacgagacaaggtgaaagtcccattgtatggctgtgattgttatgcttatgctctcctggcttctggttttgtggatcttgttgttgaatctggattgaagccatacgattttctctcgctggtaccggtgattgaaggagctgggggctcaataactgattgggaagggaacaagctccactggcttgtctcttcggaatctcggccaacaagtttcaacgtggtggcagccggagattcccgtgtccatgggcaggccttggcagcgctgcggtggcgctagcctgcctgcagcgcggggcggctcctattgttcatttagaaggctgcagctgttattcatctatccaataaaactgagtctgtacgcttcctcagtgggtaaagcaagttgttcacggtgcaccctttactcaataatgatcagtggtttcttgtggtgtgttatgatcagccgttatgtactcagttactcaagtcattcgatgatcgctgagcgacttgattgcaccgtgtagttcttctatgtttttcttttatgagagggatctatagttctgtg

SEQ ID NO: 3595 - DNA, 1229 bp, Triticum aestivum
  Clone ID: PAT_TA_3595
gcccccgccagacttgccgtcctgtggttcttcttccctcgtcgctgcctgccatcgccggccgtgttgcgcttgcgcgttgaagaggcatccgaccggccgtcgtgctgctgggttcgctcggtgaagagggatccggcaggccttcgtccgcggccgagttatgggagcaccggggggacaccaagcctgtcagtggcggcgggttcagtgagaatggcaagtttaactatggttaggcgagcagtgtagggaaaagatcttacacggagggcttctacgagattcgagaatcgatggcttcgatggggagaccgtcggattgttcggtgattttcgtcggccatggtggagctcgagccgcggagttcgtcaagcagaacctttccatcaacttaatcaagcacccaaagttcttaacccatcccaaggctgctactgctgaaactttcacccctacggattcggagctcccgaaggccgataccacccacaaccgagttgcggcgtcgacggcctccacggccattctcgttggcggtcgcctggtggtggtaaacgtgtggagactctagggcggtcatttgtagggggtggtgatgccatagccgtgtcaaggggccataagcctgaccagacagatgaaaggcagaggatagaggacgccggaggtttcgtgatgtgggcaggtacatggcgtgtgggcggcgtgcttgctgtttctcgggcatttggtgacaaactgttgaagcagtacgtggttgccgatccagagatcaaggaggaggtggtcgacagctccctggagttcctcatcctggcgagcgacgggctgtgggacgtcgtctccaacgaggaagccgtggccatggtgaagccgatcgtggactcgcaggaggcggccaagaagctcctcgtcgaggcaacgcggaggggaagcgccgacaacatcacctgcgtcgtcgtccgtttcctggaccagcagcccccggcggcggccaccaacggatccccagcccctgccgcagcgagcaagtgaacatttcctcctcgaagcgcgtaggtgttcacagggcaatgtgttgtgcaagcaatgtgtctgatgacgttgcccttcgcatgcgtgtttatttgcttcactccagtttacccatgcctgtactgatcatgtatgttctcagctgttctcatttcaaatctttgtgaatgtgcaaatccgaaaaaaaaaa

SEQ ID NO: 3596 - DNA, 1125 bp, Triticum aestivum
  Clone ID: PAT_TA_3596
cccccgccgtgggcggcacgagcggaggggagagccacgacgatggcgggccgcgcctcacccgcccccccctcgccgcccccgccccggccgcgccgctccccccccgcccgccccgcccccccggccggcgccgcgcccccccgcccgccagcctgcgtgcgcgctccggtcgctgccccctctattcccagcaggtcggcgcgggatgccgcccgccccgcgtctcccagcgatgccaaggaagaagaaagtattagctccagatgaagatgtttggcttgcctatgtgctgtaacattaatcagtgcatcaggccaaacgttttatgcgcctaacgggttcgctgcggacatgacgagcaagcctggagtacaaagcgctgtttgcagaaattgtggtggcggcggtgctataatatgtgacatgtgtggtggcacaggaaaatggaaggccctcaaccgaaagagagcaaatgatgtttatgaattcacagaatgcccaaattgctatggccgtgggaagctggtctgccccatctgtctcggaaccggcgtgcccaacaacaaaggactcctgcggcgaccgggcgccaaagagctgctggacaagatgtacaatggcaagctattgccgagctcgtagatacatagcatcttcagtactgcatagccaggagtatagggccacatattgaaagcagaagattttcgcgtcggtgtaatactgtaatttgagattcgcattagatctacggatgtagtacgggtttttttgcgagacacacaagtaaagcttgtatgattttgttcaagtgtcgctccggccgcattcggctcgcgctcgcccggcgcctcccgggctccacgcgggttgcgggcccgacgccggcctcaaccggcgtttccatcgcagttgtccacatcatcaacagcaagaacctccggccgactcttcgagtcgcctggaggctcggaggctacacctagtgggtgcgctcgcgcgccgccactcagccggcggattccgcgcctgcgtccggcagggcctgcgccctctagccggaggactctgcgtccgcgcccggcaacctcgacgtcatcgtcggcttcttcaacaacggca

SEQ ID NO: 3597 - DNA, 738 bp, Triticum aestivum
  unsure (1)..(738): unsure at all n locations
  Clone ID: PAT_TA_3597
cgcccccgcccctcccgcccccccccccccccccccccgcccggcctgcgccccgtgccccctggctgcgccctgcttcttctacttctcccctaaaccctgcctctccttcgccccacggtgctcctcctcctcctcctccccgccagcgccagggggaaagggaaaggggaaggcgctgagggaggactggcgagagaagtccaagcccatccctcccggaggcgtctacccggccaaggacaagtgcagccgctgcggcctctgcgacacgtactacatcgcccacgtcaacaacgcctgcgccttcctcggggacggcatgtcccgtgtcgaggatctggaaccagtggtccatgggaggggcaggaaggataccatggatgaaatgtactacggggtgcatgagcagctcctgtatgccaggaaaacggaacctgttcaaggagctcagtggacaggaatagtcacaacaatcgcagttgagatgctgaaatcaaatatggttgatgccgtggtttgtgtacaaaggcacccacgacaagaatcggataccaaatcatcatctttcctttgcaataactcgacgaaaaactcatggacttgactaatgctcctatatttattgccacaatctgcagtgacccaaacgataggtttggcccaagggctgttttaancaggacaccaagaagaagtgattgcagccaanaggtgtcaagccngacantatcacct

SEQ ID NO: 3598 - DNA, 1287 bp, Triticum aestivum
  unsure (1)..(1287): unsure at all n locations
  Clone ID: PAT_TA_3598
caccacccgtccactccccacctcacccggcttcctaatccgccatggctctcgcttccacctcccctcttgccgccaccgccgctcgtcctaagacttccgctcccctcacgctgtgtcgttcaggccgcctacagcgcatctcctgccaggcgaccaccgaccgcccccgcggcggcaatgcgtcgaacacgtcgccggcgccgccgaggtggcgcgtagcggtctctgcagccctcgcggctgccgtagtcgtagcgatgcctgcccacgcggatctgaacaagtacgaggcggatcagaggggcgagtttggcatcggctcagccgcgcagttcggcaatgcggacctcaaaaacactgtgcatgttaacgaaaacttcaggcgggcgaacttcacatctgctgatatgagggaatcagattttagtggttccacattcaatggtgcctatatggaaaaggctgttgctttcagagcgaatttcacaggtgcagatttgagtgacactttaatggatcgcatggttctcaatgaagctaatctcacaaatgctgtgctttcacggactgtccttacacgtagtgatctcggtggagcaaccattgaaggtgctgacttcagcgatgctgttattgacctaccacagaaactggctttgtgcaaatatgcaagtgggacaaatcctataactggagtcagcacccggaaaagccttggatgtggcaacagtcgccgcaacgcatatgggagcccttcctcccctcttttaagtgccccgccacctaaacttctggaccgtgatggtttctgtgatgaagctagtggtttgtgtgatgcgaagtaacggggattgatccagtatacggtaaaagttgagcacttaatgctgtatatgtatggaaaatttgaagattgggtgaaagacaaagcagaatggatcagaaattcatagaatccagccttttcatcttcttttctccgatgttgtgacaatgcaagggaatcagttaaactagggaatcttcgggaaaaaggtaaactgaggaatgtaggtaaagtattgacactgaataaatattttgatgccttctgtaaactatgtacatgtatcatgacatattatacgcacctgtcgctgaaaaaaaaaagtgccctccgaaaaaaaggggggcccgtaccaattcgcccaaaatgatcctattaccncgccaatggcctcctttaaactcctnacgggaaaanctgggtaccaactaanncctgagaaacccctttccagtggg

SEQ ID NO: 3599 - DNA, 469 bp, Triticum aestivum
  Clone ID: PAT_TA_3599
gcgctcccggaggcgttcgtgggcagggcggagaagctgcgcgccgtggtcgcggccatgtgcgccgccgcgaagcggtgcgcgcgcgagagcagcctgcacatggcgccctggaggaagcgccggtacatggaggccaagtggctcggcacgccggaccgcctctcgccgaccgcgggcgccggttcccccgtggcggccggctccccggagagcgagaagcagcgcaggttcagggcctccatgctgacgctcgactacggcggccggaccgccgtggaggtcgcgtgagcgatcgatcgcacctggagatggctgcaacctgtggaactgccggcctacgaaattaccacggtccacggatacaaacatatatactgtacctatgaattgaattctcgtgtacgaacgactattatttggctccaagccttgggctaaaaaaaaaaaaaaaaaaaaaaaaaaaaaa

SEQ ID NO: 3600 - DNA, 697 bp, Triticum aestivum
  unsure (1)..(697): unsure at all n locations
  Clone ID: PAT_TA_3600
cggacgcgtgggcggacgcgtgggcggacgcgtgggcggacgcgtgggcggacgcgtgcgcggccccgtcctccacttccccacctccacctccccgcccaagatccatggctaccgcggttgcaccggcccgatggaagcggcggccaaccctagccgctatggcgcgcctctgctgctcacgacctgggccatggatctgcgacaggggcctccctcctcctcccaggcggcgcaagtgcctcgccatctgaagatttggcgtagcaagcgccggatgaggagaggacaaggaccgtgacccgcggggcacccgagctcgacctctccggcgacgtcaacgccccgcacaagatcagcaggacctctccgcctcttcagttcaatggaagtggaccaccgagaccacacgctccagcccgacgagctggacgagctcgatggccaggtcctccgccccgaccaccatgattccgcagagaacaataagcctgaacagactctaacattggttttcgtggagacaaaacaagaagctgattcattgagatattggctatacaacagaggtttcactggaatggcgatccatggtgacgaaacacgtaaatacatattccgaactcttctgtcatcgcctaactctagtgtacggacacgcgcatncctctggctggcgctggccagcagccagcat

SEQ ID NO: 3601 - DNA, 3062 bp, Triticum aestivum
  unsure (1)..(3062): unsure at all n locations
  Clone ID: PAT_TA_3601
ttgccccgggggccgagggtgcgtggcgtgtgcgtgtgcgtgcggcgatacgacacacgggactcacgcgcggcggcggcggcggcgttgcctgctgcggctctcccctcgcggcgcccccggcggcggcggcggcgggagtagccgtcggatccggagggaggggcctgcagcgccatgaggggcggcggccggggaggagggggtggcgcgggcggcgggagggggcagcggcggcagcaggcccgcggcgcggccgccgcggcggcgggggacggggcggagatcccgcaggcctcgcggaagctcgtgcaggggctcaaggggatcctcgccgaccgcaccgaggccgagatctacgccacgctcctcgactgcgccatggaccccgacgtcgccgtcgagcgcctcatctcccaagatcccttccatgaagtgaggagaaagcgtagcaacaaaaaggaggtaaaagctcctcaggaaacaaggtctcgccccttctataaacctgcataccgaggttctaaggttggctcggatcgaggtggacgtgtttactctggtccgggagactcaactgctagcgctaaaggtcctatcaagaaggaaacagagttacttccgccaccaaacacatcaacctctgatgctgtcaaggatagcaatcctatggaaacaatttcagaagctggtaatttagctgatgcgaagtctaccagtttccagcctccgcaagtgcagcatggttggggtggggtgccagggcgcccttctttggctgaaatagtgaagatgggcaggcctcaagctaaatctggggccagaccggttgcaaataatgctgccaagccagctgttggtggttcagtcgctgccaatgcaaatcttaacacagttttgccgtcagaaggggaccgggtcacagctgagaaattaccaaatggcactattcagtccccctctgtacctaaggaggactctgttggcatattacctccaggacaggggtctgatgtgccagaaggcatcggtgctgcttccgcaaatgtgagcgcaccaagatcatttaccctggaggtcaagaatgacgacgctggagatgccaacgagcagtcgacgcggccgcgtggaagcaatgccactggcctaacatctccaggaccattatccccgtctgataaaggcacgatcttgaataatgacttgatagagaaaacagatgtctatctctctgatgaacattcatttgaacacaaccaaaattcaaatggtgatatgtctactacagcgtatgagttggaacacttgactatacatgaggaaaacagaccaaaaccatctgatgataacccagctgtaataatcccaggccatcttcaggtttccaatgcagattttgcgcacttgacattcggtagttttgtgtctgggacacttgatgcgccatgctccatgatgcctgccaatagtgacgtggaggtcgcagcagttcctgataacccgtcccgcgcccccggcgatgccagcatccacgaatttgaaaacaaggagacagtaactcctgcagccaacgagtacattgcttctgcaccagatagtaatgcggagaatcctgatattacatcagcacaacagtctgatgtgggaagagctgatttactggatgttacaaacaacaccgaatacaatttatcatctgattatgccacgtcaagtgcagtacaaccagagcctactgtgcagacttatctgcaggacaatcgtcaaatgcaaaacatttctcccctctctaacttcatgcaaggaaatatgccaaatggcctattgccaccagcaatgccgcctttccgtgagttggatccagcattctcgctgctgcttactaaccctccattggctacaatggttcatggtacaccacaatcgtccgtgaacaatgcaactgtttcttcacagccacaagagaatgttaatcaaggtggtttatccaacccacagttgacccactctcagggaagcaccggcattgctccaggtcctcctctgcctcaccatcttgctgcccttcatccctatgctcaaggagggcttccccttggatatgcaaacatgatcggatacccatctttgccgcaaagctatgcgtatctcccgcctgctgcctatcagcaagcatacatgaacagtggtctattccaccaaggcgcagctgcagctcccaactcgggcgtaaaatacccaatgccacaatacaagagcaatgttcctcttgggagccttccacagccagcctcgatgctctccaactacgttggaggtttcgggactgcaaatggcatgcctcaaaactttgccctgaaccaaagcaatccgtcggcaaccacagctcctgggtttgatggagcaatgccctcccaatacaaggatggaaacccctacatgtctctacagcagggcgagaaccctgcaatgtggatgcatggagctggttcgcgaggaatgccgcctcttgctgccaaccccttgtatggctaccaagggcagcagggctaccaggggcagcagggccatcagggcggccttaggcaggggcagatgccgtcgcagtacggcgcagcgctcgggcagtcgcagccaggcctaggacccgaacaccgaaaccccagcgacggaaacttgagtgctgccgccgccgcccaggctaaccaaatgtggccgaatggctactgattcagccccccccccctgtcagttgtcctgaatagagatatagagttggtagctactgtgaaattttggaaagaggcccgtgagatgtgttccagcatgttcaacctgtagtgtttcctagggacctcggctgtagctcaacttttattttcagatcagatagaaaagaacggtttattgtctgtcaaaaaagaaaaaaaaaaaaaaaaatgtctgtttgttcttctttctttttttctgtcgtttatttactacatatattgtgtaacaataaaccagaaaatatctatctaacaaagcagcagcattaactttggaggaggcggnacaaa

SEQ ID NO: 3602 - DNA, 1159 bp, Triticum aestivum
  unsure (1)..(1159): unsure at all n locations
  Clone ID: PAT_TA_3602
cagcgccctgctcgttcgctctaatggattggcggcacgggggcgattcaatggcgccggcgcttgccgccccgggnaacctctccggcggacggctgtaggcgcctatcgagcttggactggaaggatccggaacacccccgcgcgccgagcgtctgcctgcttctattccccaagcacgcgagcgtccgccccatcccttttccctaaagaacttctccatcttcatccatcgacgggagccgggcggattcagaaacaggtccggcggctggaacgcgaggatctcgttacgccctggtcctaggccatggagttccctaattgcaaaaacccgcctgccgtatgtggagatcttgaaggaccgtcttgccatgtttcagttccgatgacaaccttctattgggttgaagctctaagatggcacaagagaactactggagtacgaagtgatggttgatcatggagttatgaggaccaggattcatggggatggctggcgtgaggcagacgccacttcgttgctttgaatggcctatccctcatgaagcgcgagctcgtcgaccattgcgtgtacaccaagggtatacgtcagtttgaatattcagagatgaaaaagatgattagatgtgcattcggggctttggaagacgtatgatgcatctttgtgcacaagatgaatggagttgacattaaagatggctacatgaggatcccgaagaatgatctcattgagagcaatgcggccgtcttggacgattcagggatcattcttgtgcatgatgctgcaggagcccatgtaacggcatcgttcaagaaatcaaaagatggcaggcttgtaattgaaggaggttttcggaagtatgtcatacacatccaaatgaaggaagatgatcttgtggtcgtcacgttccacgaacgcgctgggactgcgtccatgactgtccgagtgtgcatcatatcttaaaacacctatgtggtgtctagtgtatggttggggcacagactatgaatcgttctgtgctatattgcgtgatcgtgcatctgcgcaatgcttgctcttttgttaaacccatgaatctgtaacttgtagccccttatgcgtggtatgtgactatgtgacgtttgcacctatgcatccccgtcgacnaattatcat

SEQ ID NO: 3603 - DNA, 999 bp, Triticum aestivum
  unsure (1)..(999): unsure at all n locations
  Clone ID: PAT_TA_3603
tagttcgggtccgcccgaggtcttcttgataccactaatgatctgcgtcttcgacttactacgccaagacttcgacgactaccattcttggcattagccgccctctgccgcatctccgcgcccccagccgctacccacgtcccccccatccaccagctccacgtccccggagcccccagcccgcatgagtagccgtcccacctccccctacaccggccccgccccgccgcatccggccgctgcgcgtgaccccctcccccgtcctcccccccgcgctgccaccctcagccagcaggtgtagggggcgcaggttcccctcacgtgcgacgctatcttccaacgcctagagtcttcaggttccaccaacgtccgtcgtcttacttccctctcgaaaaaagtgcatgttggtatcatcttctagtcagatttctaactgtcttcgtttgcttgaccaagacaacattggctcgttatccactagtgggcaacaataagattttggtagtcctacggcaagccccacacgctatgtcgtactgggaacccacaacaaagccccaaccatcagctgccccatcaccaactatctagcgagcaagaaaaagcaaacctccaaccatctgttgcgcaaatcaaatcgttgtcaacaaacttttcctgtgtggtggatcccctgggcatagcgatcatagatggtgccaataaaactcctccggctgcgcccaagccaatggctcgtgcttactttgtctccctcaccacatcacttgtagtacgccatggtcgcctctactcctgctgcgcctatgtccgacacgcgtgaccacccgctcccgttctatgcctgatgggccacggctagactgctgagtgtagttanggcanaaaacgataaaaaaatgtactggnagatccnaagngtcanncaaatctccacggggntngtcaactagtangctgngtcaaatctacannacntgtgtacttctacacaataan

SEQ ID NO: 3604 - DNA, 925 bp, Triticum aestivum
  Clone ID: PAT_TA_3604
tccaatcctccgccctccccatccatgggccgctgccactgcaccaagaaaaagccggcagccaccgcaacctcgccgtccatggccgtcttcctctctgcatcccgcatccgccgcgttagctgccgctgcaacctcttcatccacgaccatcttcccctctgcattccgcaacggccgtctgcctccgcgacgttagcctcgtctcgcaggcgaggacgcccctgaaggcggacctagtgctcgcgacgccggtgccgttgctgcggatggtgaccatcttgctgcacggagcgacaaggtccctcgtgggcgtggacaagctggatgggctgggcgcgatgactacgggcgcgctcaaggtcccgcttcagcctcaacctaacgacgcgcctggtggagttccaccgcatcggaccggcgggatccttggcaggctgtgagccgtagttccaccaggccaccaggtttacctccgcctggatgctcaaaaaaaaacctccgcctgttgcttttgacttttccatccgtccatttttgttttttcgagacgttcttggggcttctcaacatgcaggtaatacaggctctatggagtcttcatcggtggagacagtgccttccaggagcatggttctaggcaagatggttgcaaaaatggggtctctctccgatgactttggcgagtacggccgaatcggtggccataaagacactggaattaaccaaagttaacatatggcgagcgccccggcgcctgaggagctgtagagtagcttagttttctccacaagatgtttgtaattttaagtttttagggattttttgctcctgtagatgtgattttccggtttgtttatgtaacctttgtttaatttaatgaaatgagcatattttttttctgacaaaaaaaaaaaaaaaaaaa

SEQ ID NO: 3605 - DNA, 796 bp, Triticum aestivum
  unsure (1)..(796): unsure at all n locations
  Clone ID: PAT_TA_3605
caggcgttatgccgatggggagacatgcagctggtgcacgcgagctgtgtccagtgggcctgcgacggtgatgctcatgtttgcggtgctccggtgggccgaagccggaggcggaaggagttcttgtcggcgttcctcccctaaataagctcgcaggagtctcaaatctggtgcttgatttcattccttcctgcttctctttgagctaccatggaggtggatataaagaagaggggggggaggggatcaagctaccgaactatccatgttcgtccttggagcctaatttctgcagcaactcggagggggtttcggtgcagatctgagccctctgcgattctcatattatgctgctgcatctcatggtcgaagggcggcttctcggagttccgacaatggagaccggctcctttatttccccccagccgtcgagccaaaatgggaggcagcttagttgggtgcttcgacctagtatttccactgtctacctccctgtccttcattggtggtgttgtagccattcctccgcccccgagtggtctcctccccggtgccagtgggatctgggccaggaatgaagccgacaacaaggactccattgctttccagttttgtctcctggggtcctatctgcaaagtgtttgggactaggttgtaatttccctttggtgggtcccatgttaaaggtcgcggggttgtataattccaacccggccctccgcggcccttcttctattagggggccgtncaatcnccaanggagcgntaaccccccangcgnntttaaaatcgaagg

SEQ ID NO: 3606 - DNA, 793 bp, Triticum aestivum
  Clone ID: PAT_TA_3606
ttcggacgagccgcccctttccctcgctctctccggcggctctgctgcccggcgggaagatggattaagtggctggctcccccttgttcatagtagtattagtatagctagatctaggtcgtgttttgcctcagcggcgtctggcgacatgccgttatcctgctctccaccggcacgagcgagccgtgcccggtggtcgccggctgcttcctcaacctgctgtccatggaggacagaggcgactggaggcggatctggcgcgagctttccctctcgaacaagctcgtgctctcccctgatctggaggaagcctagctgtcggcgctctcttcttcaggctgccgcggtggtaggtgaaggtggaaggcgacgcaggttgctgcactctgcagatcgtgttcgagctcatcagcgaaggactctttggtggagctacgacgccggcaggctgccggtcttcatcttcctttcacttcttcaggccaaagggcggccaacctttttcctcccggcttgcgtgccgaatgggaggcagattcagctcctccttggaggccatggtgggcaggagatgcggccatggcgacttcgacgccccaagtggttcgtccccggcggcggcgacgttggatccgagcagaagctggaaaaggacccgatcgcgtttttattttcaatctggggtcctccttgtaaaagtcaggggcttagttgtctttgctatgtttcttatgggtccctaggtaaaatgtactgccgcaccgctatagtaatgcagtactagccctttcta

SEQ ID NO: 3607 - DNA, 1060 bp, Triticum aestivum
  Clone ID: PAT_TA_3607
ctcctcccctgcgggcggtcagccctcgtcgcccccgctcggggggtgttattgcccatctccttccggtgatgggacaaattggagccgcccgggattcggtgtctcctcgccgctacctctaccactttgcggcaccgcagatgcttgctgccggatccaaatccccctgctggacagatctgcagccatcaccgccatcgccacgctgctctgtgactacatcttcttcttcccccgtctggcgccgcgctcgaacaacacctcacctagcaccatgggcggcatctccagctctccagcacctcccctatggtgggtgaggccatgaggcactggctgtggatgtggacttgcaggcgctccttctcgccgacgacaacgaactattccacctcaaccaagcgaggacggagcgtccagcaccgtgctatccatcatctgcatccgactgtgtgccggggtacggctccccgtttgcgagggactaccgtggtgcgccctctttctcccgcgcctggcctcctcctgctcgggttgggtccccctgctgttagctccttggctcgacgcgaggttaccgtctgcattaaccctgttctgttttgcagttgagaatcatatggtgatgctttggaatatttaacccttagagcctttatacacttataaggctgaagaatataccactccaagtgttagctttgcaaggggttcctgttctgccaaataaaggatacgaatgccatctaccatacattgaaaagtttctacaaggagatagtgtgcagttattttgttccgatgaatctttcttatgcgagagtatgtatgtgtgaattttgtttacaatttatggatgatgattggaaagtacatgggtactgctttgaaattaggaaggactaaggaggagtagcctaattaaccagagtcagtacaaatttaggttatgtagtgtgccaatgttgatagctcctaggtacgactagctggttgtaaggatggtcctggtatgcaatgatctaatgatcttgagtgaaaaaaaaaaaaaaaaaaa

SEQ ID NO: 3608 - DNA, 593 bp, Triticum aestivum
  Clone ID: PAT_TA_3608
aaactaccaggatgatgccgacagacctaccaggtatatataacagcactaacatgcctataatgcacatgatttcattataactagatgaactacatacatgctctctttttattgatcagttggcttagcccataagagaattatcttatctaggtgtagctacaggaacaagactgtagtctcccaaaaagacacaagcaagagtatgtattacttctcagagcctacataaaaaatttctcacaagtatgaatcctttccttcaaatatttacaattccagatattctccatacgcagcaatgcagacaataataatcctgcaaccaactctgaacatccggagtaaaccaaacatgcagaaaaattaggtaatctgtattgacagtatgtacttcaatttttaattccaaccttatttgtggtgcttgcagattaacaaagttacgtttcacaacacatgcaggacaacatccgttgtgctaccgctgaaaaataatcttcgccttccattgtaacccagaaatgttatgaaatgaaatacttatgtttcgtgcaacaacacatctacgtaaaaaaaaaaaaaaaaaa

SEQ ID NO: 3609 - DNA, 432 bp, Triticum aestivum
  Clone ID: PAT_TA_3609
cccacgcgtccgctggatcagacgactacctgaagtaccatgatcgtcctgaccttcctcatgggcttgttttcgacgcacatggcagggcagagctgttttctcctgcacagtttggtgtattgtagagctgtcgtttcgtgaacctctgtatgggttttcagtgtttaatagaggtttggtttgtgttaactggatagttagcctcgtaaggatcagctgtacattacctagtggagtgctttgtcgtccacagcgatgaaaatgttgcgctatttcgatcttcttgctcttgagcaagcagtatgtatacatagttgacttgctacgcgaagtctgaagtttggttgtctgcacggtgatgaagccagaagcaaagacttgctggctgctaagctggtcggaccgggactgtattggatggcccattgc

SEQ ID NO: 3610 - DNA, 1951 bp, Triticum aestivum
  unsure (1)..(1951): unsure at all n locations
  Clone ID: PAT_TA_3610
ttttgaatgttcccgccccccatggggccccggggactgcatgggtggccgcccccccgcccggcgtaccccccctgttcttctccacatttagctccatgggactttatagtgaaacatcctaaaatggacacccgccattatctccgaccacacagccaaccaagccgctaccgacctcccgctttcctctttcggcgatcccgagcagactcaccttcctccgccccccaggcgcgactcccccgcccgaccggagccttgtccgcctgcaaaaagaggaccagtaaggacccgccggctcgccctcctctacacgggttttctcgtccgccgcaatccatccgtcgcgcggcccaccgtcgccggcggcgcggaacaccgtcttctccccggcatcctccagggcggagcgctggagatccgactccgctcggttgcttctctcgtcggacataatggcggatatccagttaggatgttacactataaagtcccatggagccaaagtggcaagactccacatgtatgactggataatacttctcctccttgctgtcatagatggactgttgaatataatcgagccttttcaccgcttcattgggaaggacatgatgactgacttgagatatccattaaagggcaatactgtgcccttttgggctgttccgctcattggaattgtcttgccatgtgtcatctttggtggaatttacttcaagaagaagaatatctatgatttgcaccatggcatactgggtattctttattcggtgctcataactgcggtgattactgatgcaattaaggatggagttggccgaccacgtcctgatttcttctggcgctgtttcccagatggaaaggatctttatgataatgtcactactggtgttctgtgccatggagagaagagtgtcatcaaagaaggtcacaaaagcttcccaagtggacactcatcatggtcttttgccggcctaggcttccttacgtggtacttgactgggaaaatcgcagtttttgaccgtaaaggtcatattgcaaagctttgtattattgttctgcctctacttactgctgcacttgttgctgtttctcgagtggatgactactggcatcactggcaagatgtggttgcaggagctgttttaggtctcacagtggcttcattttgctacctgcaatttttcccatacccttatgatgcagatggactgtggcctcacgcatacaccctccagctagccgaggcgcgcaacagcggcattgcaaactccttcagtgtgcgaccacccacggagactgaagaaggggaaggtcagggcgggatcgccctaagagacacgagtcctattctcgacaccatggagtctggcaggagatacggaaactaggaggaccggatcagacgactacccaaagtaccatgatcgtcctgaccttcttcatgggcttgtttccgatgcacatggcaggggagagcagctgttttctcatgcacagtttggtgtattgtagagctgtcgtttcgtcaacctctgtatgggttttcagtgtttaatagaggtttggtttgtgttaactggatagttagcctcgtaaggatcagctgtacattacctagtggagtgcttcgtcgtccacgccggtgaacatgttgcattatttcttgctctctccccccctggcccttcggcgatggtcgatcctgctctcaagaacacagtatgcctgcgggtctgactctgaacccgccgccagttccgtggctcccgccaccccgtggtggccagaagcagaccctgtcccttaaggcgattccgccctgacttcccttcttnatctccgtgggttggcccacactgaangagtttcaatccgctgttgcgcccccgctaactgganggtgtatccnttaggcacatccatctgcacataaggnaaggga

SEQ ID NO: 3611 - DNA, 870 bp, Triticum aestivum
  Clone ID: PAT_TA_3611
agggcacttgatctcatttcagtggcccttcttggcgcccactagacatccacaaagtcctcaacacatttcttatttctgcaacatgggcgcaaactgttcagtgcaaaaaaaattgtacgaactgttttctttctctcataatggtgatcagctgggaaagaatcttggcacatcatgcaatccgcggtgtccctgtatcatgcctgaaattttgtttgcgggtgaattagccgtcgcaactgagaactatcatctcttagtgttgcgtgtgtgcatctttgctatgcataggacgggtgtcgggtgtcctctcatgctatattttaactttttaagttaataaaagtgccctttattagaagaagaaaaatcagctggccgactaccaccccgctctcgagtgggtgctcatgaccgtccgcgcctacctcttcggccgcggccccacctgccgatatgttgccgtcgggaatgagccgtttctgtcgtccctgaatggcacgttcctgaatgtcacgttgccggccctacagaacatccagaaggccctcgacgaggccggcgtcggcgacaccgtcaaggccaccgtaccgctgaacgccgacgtgtaccaatcccccaaggacaacccggtgccgtcggccgggcggtttcggccggagatctccggcctcatgacggagatcgtgcagttcctcaaccagagcggcgcgcccttcacggtcaacatctacccatacctgagcctctacggcaacgacgacttcccgctggacttcgccttcttcgacggcgccagctcccccgtggtcgacggcaacatccagtacaccaacgtgttcgacgccaacttcgacacgctcgtgt

SEQ ID NO: 3612 - DNA, 1531 bp, Triticum aestivum
  Clone ID: PAT_TA_3612
gcagaaacacaagaggaggagaaaaaaaccagcccctctggctcgtgcgcgtgcgcctgcgcccaggccagtccgaggccggaaaagaaaaaacgccggacgccccggtccctgccgcgccgccactgctcccgggattctcgagaggctgagccgtgcggttcttggctgtgtttcttggtttcttcggcgtgttcttggtccgaggagtgggaggcggggttttctgtcttggatatgagttggtggttcttggacagggggggaggacggtttgtgggttggccggccatgtcggtctcgtcctcctccatgtgcggcggggacgccgggatgaagtgcgtggtctggttccggagggacctcagggtggaggacaacccggcgctggcggcggcggcgcgcaccgccggcgaggtggtgccggcgtacgtgtggtcgccggaggaggacggcccctacttccccggccgcgtgtcgcggtggtggctcagccagagcctcaagcacctggaggcctcgctccaccgcctcggcgccgccaagctcgtcacccggaggtcgcccgactccgtcgccgcgctgctccagctcgtccgcgacaccggcgccacgcacctcttcttcaaccatctctacgacccgatctcgctggtcagggaccaccggctcaaggagatgatgacggcagagggcatcgtcgtgcagtctttcaatgccgacctgctgtatgatccatgggaggtcaacgatgataaaggccaaccgttcaacatgttcatgccgttctggaacaggtgcctcagcatgccgtatgatccccccgcgccactgctgccccctaagagaatcaattcaggtgacctatcgatgtgcccatcagacgatctgatcttcgaggatgagtcagagaggggaagcaatgcgcttctggcacgggcatggtcaccaggctggcagaacgcagataaggcgctcagtgccttcctgaacggccctttgatcgactactcggtgaaccgcaagaaggcggacagcgcaaacacctccctcctttcaccttacctgcattttggtgagctgagtgtgcgcaaggttttccaccttgttcgaatgaagcaactcgtgtggagcaatgagggcaaccatgcagctgaggagagctgcactctgttcctccgatcggtcggtctccgggagtactcgcgatatctttgcttcaaccatccatgcagccatgagaagcccctccttgcacacctcaggttcttcccttgggtggtcgacgaaagcaccttcaagttttggcgccagggacggactggctaccctcttgttgatgctggcatgagggagttgtgggcgactgggtggctgcatgatcggatacgtgtggtagtttcaagttttttcgtcaaggtccttcaactaccatggcgatgggggatgaagtatttttgggacactttactggatgctgatcttgagagtgatgcacttggttggcagtacctcggccgcgaccacgcta

SEQ ID NO: 3613 - DNA, 689 bp, Triticum aestivum
  Clone ID: PAT_TA_3613
cgggtttggcatcctgctgctggagctgatcaccggccagacggcgcgggtgttcgggtggccatcccgccagcgcggggccgggcggctctggctgaagaagatgcaccaggagaagaaacttgatgtgctggttgacaagggcctgcggagcagctacgaccggatcgagctcgaggagatggtgcaggtggcgctcctttgcacacagtacctcccaggccaccggccgaggatgtcggaggtggttcgcatgctggaaggcgacgggcttgccgaacggtggcaagcgtcgcagcgagccgactcacacaagttcacagtgcctgagttcaccttcagccgctgctactctgacctgaccgatgactcatcgttgctggtgcaggccgtcgagctctctgggccaagatgacatgatcaccaagcgcccacagactgagaacaccaagcagcagtccttgtacagcatgataatcctatgtagatttggaaataatccaatactgaggtaaagtataaatagtgatgtatgtatcttagatgaagtgtacacaggagagtgccccaactccctggaatggtattgaactattaatattacagatttctagctgaaacaataagactagttgtaacttgtaacaaggggcttctcttgaagttgtaaagttttgatttgccccgtt

SEQ ID NO: 3614 - DNA, 1132 bp, Triticum aestivum
  Clone ID: PAT_TA_3614
ggcggcacggggagcgggaaaagggggggacccggcaggtaaaggacaacaggtcggtgggcggggggcggaagcgaaacgagaacatggtaagccggcactggaagggcgaagagggccgagatgggttggtcgaaggtggcgatgagtcggctcgcggccgagactaacaggtggccgacatgagccaaacagcccactggggggactacgagttcccacgagcgaccgctgcgctgagacgcctagagagctaccaaaaccgtcaccggacgtcgcccagacgccgacatcttaagctcaaaaagaataaacagctcgctctagatgtagccgacgagcagccccaaataccctgagaagccacagagccagattgacagtgatcataatcaccatgcatgtataaagcacatgacacaaattgaacatctaaaagacacacacagcaagcatctcgggccggagaagaacaaaataaacatgaaggagctgtaccaaatgaagagccaaatagatgaatcgctccatcaaaccagggcagagaggaagcagttcatagatactagctatgcggagctgacgcgacatccggaatagtagcacgccggaaacagtagcttcaagtggaaattgcatgaccacaacatttcctgggacttgtgtaccgcccagatcacgtggcatctcggcgcgctgggtagctccagagtgccggctcggacggagcaacatacatcgatgcaaagtcgtctctgcgcgttcttgatgtatcagcacctcgaggatagatatgattgcttttgtgtacgggagtggtggtgatgaggaccacatgtttcgactaagatgacgtgcggagactcctcagttgtctggtgtaggcacttgtctttgtatggaaatcgctgctgttggcttttgtcgtgggtttatgcaggtgacgactacgtgtatctactgacgttgcatgcatcctaggccacggggtacgcacatggcccggccggtcgtcgcctcccgcgcggtgctgaggtcgctagtgttgtgtggcccctgttatattttgtgtgccgaacgtgcggtcattacgaaccagaggcagcaccaaaattctaaaagagccgatttt

SEQ ID NO: 3615 - DNA, 677 bp, Triticum aestivum
  Clone ID: PAT_TA_3615
gccgcgcccgggcctccgccgccgccagcgccgcctcgtattcgaccggcgctacggcgggattttcgacgaatggacggacccggccgtcgccgccctctccggtggcaggggaatgtcctgcgtactcccgttggcgcagtcgctgctgcccgcggctgcatcttcgcgtcactctgcagccgagtcagttagcacaacgctcaaaccccccggccgctgctccctccgggcgtagcgtcctctcggttctgcgtactcccgatggctcagtcgctgatgagcgcggccgcatattcggttgactatgcaaccgatgctgttagcgcagctcttaaacgccctgacattttctccccactggcatatcttcctcacctgcaattgcataggaagcaacaaacttggttcgacggacttgagcgatctggagtcgtagctgataccaagttaataccatgtagtactctgtaagcggaatatggaaagaatgcacaagtcagttctgtcggcgaaacacgcgtggcctcctaacaatgtccgaaagatagcatggtcaaaatcttgaaatgctagaaaaaacccgcctggtcttgtgcaattggtttttattacttccgtgtatctctgatattatccttctcaatactttttggattaaaaaaaaaaaaaaaaaa

SEQ ID NO: 3616 - DNA, 700 bp, Triticum aestivum
  Clone ID: PAT_TA_3616
gcggcgcgcgccctcgcccatcgacaaggctgcgcgcggccggacgtcccccggcccggcccccaccgggccgcccacgcgtcctactcggcccgccggcgcgtccatccatccaacgcccagctcctcgtctacctagccctcgccgtccccttggccgccctcctggtcctcaccggcgtcacgctcaccgtcgcgtcagtcgtgctcgtcgtcctcgtcgtcctcgccccgctcttgctcctcaccagccctctctgggcgccggtggcagtggtggccatcgtctcggggggcgccttgctgtttggctgtagcctcacggtgttcgcgctgagagcgagcacgtgggcgcaccggcgcctgacggggcggcacccggtgggcgcgcgtcgggtgggctacgcccgtgggcgtggccggttcgccggcgcgggtggccacgcgacgggctaccacgggcagggacaagggtacgatcggatgaaggacgccgtgcccggggcctagctggcggcgaacaagcttctccttccgcgcattccgtttggtttggatacgttttacacgctgggtttgcgttggaactggttcgtttgcgaggtatatactgtgctgatacacgttttcatgtgtgttttgaatgcatttcttgatcctgcgggaatcaactctgcaaaaaaaaaaaaaaaaaaaaaaa

SEQ ID NO: 3617 - DNA, 1160 bp, Triticum aestivum
  unsure (1)..(1160): unsure at all n locations
  Clone ID: PAT_TA_3617
gcagcaaaccatgaaagttacaccagtgaaatcataactacgttgggtcctntgcttttcaccagagagaacaccagaagtgtcgacaaaggtgatatgatccagtagagnatgtggcatctgagagcattcaaactttgataggaatgcaccnccaaatgttgtaagaccattgaaaggcatatcagcttggactgcaattgtattgccagggacagtcctttcatcagatcctgacatcacaaccacaaatcggacgcgtgggggctctggtccaatatgagctcctggaaagtttgatttcaacaggtgcttaatgaatgttgttttccctgtagaatattgacccaagagcataaccattggcttcgcatcgaagtcactgttcgtcagcaatggagaggcaaaatcattgaaccggtatgcaacttctaaaggcttcagtttttcgatgtacagtcttttcaagccatcaattacagaagtaacagcagtcagaggcgtttgaatcttctttgcagatttggaactgaaccagctgtttgtagaaggtgcttgcacctgaggggtgccattttcttgtgggcgaactacattcacaatagccattgatctagcaagcagttcatcaagacctttcatcacaggaggatcgaagctactcagatcttcacgcttgagactgtcctgggtgatctcattgcccgcttgagcgagagaaacgagctgcatcgcagccgcgaactcgccgaagccgaggtacccctgacgcttggagtcagcaatcgcccagacctgcttgaggtcggcgcgggagaggccggacatggcgaagaacttggtggcgtcggcgcccgtgacgcgcccgtctccatctgggtcggcgatggcgaaccagtcggcgtagatcctctggtgctccttggagcagcccacggcggcggcggaccgcgcgatctccatccacggcctccctcctcgagtcggcggcggcggcggtggcggcgggcgcgagcagcagcggcagcaggagtggacaaacggaaacctcacggggtgcgggtgctcgtctcttctcccccttttgggcgtggaatggggaggcatttgaaatcggggaccccccaccctgccctaccgagcacgcgccccggcggacg

SEQ ID NO: 3618 - DNA, 636 bp, Triticum aestivum
  Clone ID: PAT_TA_3618
cgtccgggggaaagtaagcttcaaggacctggtagaggttttacgggacctaacgggctcatccatgtgagagaaacaaagagagcgggtgctaacaaaggtgttggaagaagctgggtatacacgggattccactctatcattagaagattttgtaacgatcatcgaccaccctggcctgaagatggaggtggaagtgcccatcgactagtgaagggaggatgcagatttcagcagatgaggatgcagcaagctctctgtcagctgaaaacaagtgtctattgccaatagaccgcgcgacagaatagaatgggatctcactgttttgagttcttgtgtacctgtccgcatacatgcccaaatgcagtgccagtttagtcattttttctttctgttttcgaggggattaattaatgcagtgtcaatgtagagtggatcttgttacagtttccagactttgaaaacgttccaaacttaaaattgtttatggggttgcagctgtccactccacgggaggccagtatttatgctgaagattatgatctaattcttgggttcatgtgaactacaggtatttgtaagttggcgaaaattcatatataaaattctaaaaactgtgagaaaaattgtgcatgg

SEQ ID NO: 3619 - DNA, 599 bp, Triticum aestivum
  unsure (1)..(599): unsure at all n locations
  Clone ID: PAT_TA_3619
cgggaaaatanaannnaaaaaaaaaaaaaaaaaaaaaaaaaaaaaaaaaaaaaaaaaattcctttccgaaagtggccgggccggcggaaataacctcagttcctcagccagacattgctgcatacaagcacaaaagcgaacttcaagctcgaaaacagacagggcactccatcccgtgtctctgttgggttcagtctttctcttgaccggggcgatctttcctagtcgacgacaatggcggcgacggcgaacatggccaaggtggtgttgctgctcttgctcgtgatacagatctccagcgtgctcgccgccgcggctaggccgttcgtgggggacgacggccagtggttgcagaacgggatcgggatggtgacacagatgctcggcggcgtcaagcagtcagggtccagcggccgcacgcactgctgctgacgtgctcgcatagtttatattgcataggtataggaatacttgtgaagaattgttctttggttcatttgggatccagcaaccttgaagatgaacagtacagtgccgctcttcctttgttaaacaaaaaagaacacacacccccacacaaaaacataactaataattac

SEQ ID NO: 3620 - DNA, 694 bp, Triticum aestivum
  unsure (1)..(694): unsure at all n locations
  Clone ID: PAT_TA_3620
gccggccgggctgggccatccattccaaagtaacctcagttcctcagccagacattgctgcatacaaacacaaaagcagaacttcaagctcgaaaaaagacagggcactccatcctgcgtctctgttggattcggtctacggtctttctcttgatcggggcgatctttcctgctgtctagctagtcgacgacaatagcggcgacggctaacatggccaaggcggtgttgctgctcttgcccgtgatacagatctccagcgtgctcgccgccgcggcgaggccgttcgtgggggacgatggccagtggttgcagaacgggatcggaatggtgacacagatgctcggcggcgtcaagcagtcagggtccagcggccgcacgcactgctgctgacgtgctcgcatagtttatattgcgtaggtataggaatacttgtgaagaattgttctttggttcatttgggatccaccaaccttgaagatgaacagtacagtcccgctcttcctttgtttctccggtgtttctgtgtacgtggtggggtgcaggatcttcgttttcgtacctttttctgagaccaaagcgtacgtatgactatgtccagtttctaacatcttgtgacttgtggtagaattaagccttaaatatgaattccctgctcagttcgagaacaaaaaaaaaaaaaaaaaaggcccctan

SEQ ID NO: 3621 - DNA, 1271 bp, Triticum aestivum
  unsure (1)..(1271): unsure at all n locations
  Clone ID: PAT_TA_3621
cccacgcgtccggagggcgagtcgtcgtcggagcagatcgaccgggggggcgtcccggcgatggggaacgcgtcntctatgctgacgcagtacgacatcgaggaggtgcaggagcactgcagctacctattctcgcagcaggagatcgtgtcgctgtacgagcgattctgccagctcgaccgcaggcgcgtccttcctcccccggcctcgccgctcccaccgagccacagaggggagggcgagccgtcgccggagcagatcgaccgggcagccctcgcggccatcgggggcgcggcgggactgccgaggcggagcgtcgtcgagggagtacatcggcccggcaggcctctcgtgccacggcgaccgcgctcgtcgatgctgacgcgagtacgacatcgaggacgtgcagccacagtgcagctccccattctcgcagcaggcgatcgtgccgctgtacgagcgattctgccagctcgaccgcagcgccatgtgcttcgtcgacgaggacgagttcctctccatcccggagtactccaccaacccgctctcccgtgtcttacgttgaagggtaagtggaaatgaactgcaaggaatttgtttgttttctctctactatcagcgcaagggccagccttcagtaaaagattgagttcatatttaaggtgtatgacattgataccaagggaaaagtaagcttcaaagacctggtggaggatttacgggacctaacgggctcatccaagtcagagaaaattttgagagcaagtactaacaaaggtgttggaagaagctgggtacacacgcgaatccacctctataggtaggatgatgaattacgagcatcggaacacaccaggcctgcaggaaagtagaatagcgagtgcccagcccgactaagggaagggagcgaagcaggggtgttcacattggggtgcgtctgtctctctgtccgctgacatcctcgtaatcgacgaaaaaaaaggcgacatcgaactaggttgagagggtgattggtttctggtctgtgaaactggtctcattcatggtccccttccagtcccagtttagcccttttttccatctgttgtccgtgcagttaatttattcagagcctatgtaaaaagcttctttgttcaggttcccaactttgaaaccgttccacgctttaaaattggttaaaagaaaacagacttgggacttgttaaaaaaaaaaaaaaaaaaactcgagggggggcccggtacccanttcgccctctagtggctcgtataac

SEQ ID NO: 3622 - DNA, 1537 bp, Triticum aestivum
  Clone ID: PAT_TA_3622
gtcctgctgctgcggccgggcgggcttccccaccgtctccccgggcggcctcctgctccccccgcccccgccggccgcaacgtgctcctggccagcggccccgctgctggtatggctgccgtgcaatgatgctggagactgttgccgcagtgctggggatggagacagattgcattggaaatattctgttattccttacctaatgttcttgttgctgataatagggcgggcaggtaggacggcagttccatggtgcttccgtctgctgactctgtcccgcggctgaagagagattgcacggggaacattctgtcactcttttctccgtctgcatgctcctgcacggaggtcctctgttcatgcgaggccgccggaccaggatcagcagccggcaggagtgcgtgtgcctgctgatgccgaacaagctcccgcccgatggagccagcgctcggactgcttgcacgataggggctacctccctcttgttattcgtaccgcaggagcaccttattatggatgcttgccttgtatgttctgggttctttactattctgttctgtcctcgggcaattaaacattgtatctgtttttattgtgatatgcaactcttcaagaacggaaactacattctggagttactcatctgcatggaatttctatgtattctggtagtttatttttgatattgtatggctgtattcccaatctgcgtgggagccgaagctcgatttgttcctgtttctgtttctgtttcagtactagtacaatgtaatgattttgtgctttcatgaagtattttgcgctattttttttctgtcgagcaatttagaagacctgtagagcatttaactagacagttgactttgcatgtgcaactatgcttgcttagagcagcccttgactggctacattattgtgatggaccgtgctgttcttagttgtgctacagtatgtgttccgtgttgtttgcacttgttagccaaatcattgcacacgcagtgttaacgcgatgttgtaaaattcctgtttgtacaatgtatctgctacatatgttttcatcttgatagctagcagcctagcaccatgaactttgattgtaaaatctctatatgctgtaaaattaattgggccagtctcgaatttgttgtgaattgtaagatgcttcaagtaaatggttttttgtcttctcacgtgtaggcggtcaggcgagacagcaagtagaggttcagtctgttggaggagtatggcgagctgctgattcgggctaaacaggggcacactgtggcagtatgttttctgcctgaactcccctgcactaatgtattctgtttttacaaggcgtcctgactatgagcaggagcaggtgcatgtgcctgtttgtaatgctaacgaaggagctccatcctgaagaatatagtgcttgtagagcttgtaaattagttactccacttgtagagttatttgtagagcaggagcaccattttattgcgtgttatttgtagagcaggagctccatacagaatctggctctatactg

SEQ ID NO: 3623 - DNA, 688 bp, Triticum aestivum
  Clone ID: PAT_TA_3623
gccttccctttcactcccccctcttgcgccgcacgcactacccctcccccccgacctcgtcgccgacgccgcgatgccggaggacgtcgagatgaatgactccgcccagcccgcccccgtcgccgctcctgcggccgccgacgcgcccgcgcccgcgcccgctctctccaccctgcagcatctgaaggagatcgcgtccgtggtcgaggcggggtcgctgaccaaggaggtccgccggatctcccgcgccgtccgcctcaccgtcgccctgcgccgccgcctcgccgcccccgacgtcgcggccttcctcgccttcgcgctgcccgcttcctccgaggccttcacccgccttttccctcttcttccccaaggaagatggaagtgagatggatgttgacgctgcagctccagctgctcaagtttcaatcaagcatggactcccagagattgaaatatactgctacctgcttggggtggatttcctttatgatcacaagaaatatgatgaggctaaagcatgtgcaaactctagcattgctcgtttgagaatctcaacggaggactggtgatgttttggctctaggctgattcggatactcgatgtcatgactcacacaagctgctgaaatcggggactctctgggtgacagatgcactctcacatgtagctggcagaactctctactgt

SEQ ID NO: 3624 - DNA, 653 bp, Triticum aestivum
  Clone ID: PAT_TA_3624
cccggctccccctggccatacgcccatacccaagaaacacagcacttcccatctcaactccactccactccggtccggtccggccgctatggccactccaagatttctcgccgtcatcctcgtcgcggctctcctcgcgctttccttctcgcaaggggcggtggtggtggtggagggcaggaaggtgcaggtgatgagggcggtggggcggtggcgctcgcccctccgcggcgtccggttgcaggagcagcaggagggcggcgggatggtgtcgacggtgatggactactcggaacccaaggccaacaccaacccccgcggcagcgtgcccgccgcgccggaggaccccacctcgccgccgtggcactgatcgatcgacgcatttgcgtgtagaggacgaaaacgccaggagggatccgaacgaacggctcttctcccccctgtcttccggcggtaaatctttgatgagttggttgatctggagaattgtatttagtgcttatgttttgagtttttatccctcgatctgtacgtttcccccctgcatgctgccatctgtacaacccatctatgtgtgctctgcaataagatcatcaacattgtgccattgatgcaaatatggtggatgcccttccatgaaaaaaaaaaaaaaa

SEQ ID NO: 3625 - DNA, 931 bp, Triticum aestivum
  unsure (1)..(931): unsure at all n locations
  Clone ID: PAT_TA_3625
tcctgcccacgtcccatccgccgccggcgtcatcctcctcctcacttccgcccccagccagcccccgtaagcgacgccccgtcggtccggctcacaagtgccgccatggagctcaacggcactggagtcctgttctgcaacgtcggcctccccgagctcctgctggtggcctcgatgactgccggcgctgctcctactcctgtcgccggcgtggtgcgtcgttagttcagcgagaggaagaaggcgcatgcaccccttgccgtccgttggatcccatccgtggcccagcggaggattggcggccgcggtggaacggactactccgtggacaacgccatcctgtggccagcgcatgcgcggtgcagaggccgttgatgccgcgacccgcaaccacaatgacacaagtccacggacaaccctatacgtcgggtgcattactcgcggacgttgtacgcggccgtgaccgtagtgggcttcngcatgacaacatgagcttgcataggtgagcaagattcagaaggacttccataaaacgtcagttggctttgctgtgactgcatgggcagttttgggcgtttgtggtgatggaggaggggtgcaacaacatgcagggatggcggatggtggctccgacatctctgcactgcctgtaaagcgtcacatacacgaaagctatgatgtgaagatagtagtgctacaccaaattagaaagagtatacaacaaataacttcatgctgatgatatgttcttcatttgctccatctcccatctctgttcttattttaagtaaatgcctagatgcctaacattcatctccgagggagtttttcttaatgatatcatctatacatgtcacttggttactaaacctatgtaacttcgaatccaattgataaattgctagcagcataaaaaaaaaaaaaaaaaaaa

SEQ ID NO: 3626 - DNA, 1181 bp, Triticum aestivum
  Clone ID: PAT_TA_3626
gcttagtctcttcctcctccttgtactctagtgatcgtcgagaagtgagaaagagaggcatggccttttccgtggccaagatctctgcgtccttctccgtgttcatggccctggccttcctccttcgtccctgcgcgtccgtcgagatccaccgcaagctctccggctggtccaacggcggcgccacctggtacggcggccccaacggcgcagggagcgacgggggtgcatgcgggtaccaggacgccgtcgaccgcccgtccttctcatccatgatcgccgccggcagcccgtccatctaccaggacggcaagggctgcggctcttgctaccaggtgaagtgcaccggccacggctcttgctcgtccagcccggtgaccgtcgtcctcaccgacttttgccctgacgggacgtgccaggaggagcccgtccacttcgacctgagcgggacggcgttcggcggcatggcgaagcccggccaggccgaccagctccgcgcggccggacgtctccaaatccagtacacacgggtcccgtgcagctggccggggatggacatagccttcaaggtggacgccggtctccaactcctactacctcgccatgctcatcgagtacgaggacggcgacggcgacctgtcgtcggtggagctcatgcagagcggcggcaacggcgccggctggaccaagatggaccggtcgtggggcgcggtgtggaggtacagctccggggtccaggcgccaggcgccctcctccctccgcctcacctccagctccggccagccccgcgtggcgagtaaccccctccccgccggctggccgcccggcggcacccaccgccccgtcgcaactactgataaacctaggcgtgggttgggttgcacgcaagcacgccgcgcgctcgctccctatgaagaggcgtggcgccatcctgatttatgcttggagccatgggcgtggtatatgtgtgtaacctgaccgccattaataaggcgtgtgtcgcaagtgtgtgtcgtgtgcgcgccattgttgggtgtgtgtgaagtcttgtgttatctgtccgtccatatatttttgtgaaataaactgtatcggggcggaggtggccgggaagagtttctacttcttgcccctcgctctgctcgtcccgttgcagtcatttcatttgctttcgaagtac

SEQ ID NO: 3627 - DNA, 1007 bp, Triticum aestivum
  unsure (1)..(1007): unsure at all n locations
  Clone ID: PAT_TA_3627
accaacggcttcctcatcaccggcggccagttcttgtcctaccttatcaacctcgcgttcaccaaggcgccggggacgtggaggtggatgctcggagtcgccggcctccctgccgtgttccagttcgtcctcatgcntcttcctccccgaatcgccaagatggctttacagaaaggggagggtggaggaagcagacggcgatcctgcgtaagatatacatggccgaggaagaggtgacgagggagatgcaggagttgaaggagtcggtggaggcggaggcgcgggagcggggctcgtcggagagggtaagcctgacggcgctggtgaagacgccaactgtgcggcgggcgctggtggccggcgtcggcctgcaggtgttccagcagctcgtgggtatcaacaccgtgatgtactacagcccgagcatcgtgcagctcgccgggttcgcctccaatcaaacggcgctcgcgctctcgctggtcacctccggcctcaacgcgctcggctccatcgttagcatctacttcatcgaccgcaccggccggaggaagctgctggtgatcagcctcgtcggcgtcatcgcgtcgcttgccctgctctccgcggtgttccaccaagaccaccacacactcgcccgccgtcggcaagcgccgagaccagacacttcgatggctccctcacatgcccgggctaccggacgagcagctccggctgggactgcacccggtgcctcaaggccaagctcgacggggtgcggcttctgcgcgtccggcgccggcaagcaagctgctcccgggcgcgtgcctgctgtcgaacgcgacggtgcgcgacgcgtgccacggcgaggggcgactgtggtacacgcgcggctgcccgagccgatacggttggctggcgatgtccgggctggctctgtacatcgccttcttctcccccgggaaatggggcacggtgncctggatcgtcaactcaaaagatntaaccgctggcggnaaccgcgggtgttt

SEQ ID NO: 3628 - DNA, 1086 bp, Triticum aestivum
  unsure (1)..(1086): unsure at all n locations
  Clone ID: PAT_TA_3628
gaattcgccacgggctaccgtggtcgcggccgaggtgttgagaacccggtccttgctcaactctcccgcgtgcgcccccacgccatagccccgctgctcagccacatgaacgtcgccggccccgccaccgctttcgtgccgagcgccaggccagcgccccgcgccccgcggccgctctgggggcgccccagcgcccgctgcaacccgagcccacgcgccgccaccgagccgccggcggcggcgcccgtctacgcccccactccgcgggatcggcctctgcggacgccgcacagcgggtatcactatgatggaaccgccagggctttctttgaaggatggtacttcaaggtgtccattccagaatgcaggcagagcttctgtttcatgtactctgttgagaacccattctttcgtgatgggatgactgctctcgaccggacattgtatggtccacagtttaccggggtgggagcgcagattcttggtgcggatgacaagtacatatgccagttctctgaaaaatcaaacaacttttgggggagtcgacatgagctaattctcggaaacactttcattcccaataaaggctcaactcccccggagcgtgaaatccctcctcaggaattttctaatcgcgttttggaaggctaccaagtcacaccaacttggcatcagggcttcatacgtgatgacggaaggtcaaagtatgtaccaaacgtccaaacagctcgttgggagtacagcacccgtccagtgtatggctggggtgatgtcacatctaagcagaagtcaacagctgggtggcttgctgcttttccattctttgaacctcattggcagatatgcatgggctggtggcctatccacaggatgggatagaatgggatgggagaaacggtttggatttgaaaatgctccctcctactcagagagaagactgggggtgggggggtcccccaaggaanggggcacgggctggtgttggcctcccaaggggcccggtctggtgcttgttccctgcagccggcctgcctgggtgggatttaanggaaaattgggattgngganaaataccctancaaaaag

SEQ ID NO: 3629 - DNA, 625 bp, Triticum aestivum
  Clone ID: PAT_TA_3629
ccaaattcccaatcccctccccaaaggactgaaaccctaatccccatgccaatcacgccccccttcggtctcctcgagcctctgaagctcgtcatcgatgacggccgctccccttcgataccggagagcacgccagtgcacatcatggttcccgtcgatgcccggatggcggtccttgtgtccatcgacgggagcgggaacgtcacggtgagcgctccgtcctggcgcatacctataatcagggccggaaagttcgaggccactacctcctccggcgcggggccactgtcattcgttgacctacatactgatgggcgctactccggcatagatttccccgttcccgctggggcgtacagaagcatcggggaaatcatcaaggcaacctgctcctgcttaagccgcccctgcccctctcactatcggcatgaggatggtccctctgcgctgcaacagccgagtgactcgtcccccactacaacgtttgaggacttggaggaggccatgttcgaggcagctccaacatttgaggccacttcctctacctgtccgcaggcacaggcagtaactcccgggtcacccatgtcacccattttgaggcctatacgacatgattggggtctgg

SEQ ID NO: 3630 - DNA, 868 bp, Triticum aestivum
  unsure (1)..(868): unsure at all n locations
  Clone ID: PAT_TA_3630
ccctccgtgcactccatcttcatgttcatgtccatcaagcacctgcccatctcgcgcgtcgtgcccacggagcgcttcatcttccggcaggtcgggccgagggagcaccggatgttccgctgcgtggcgcggtacggctacagcgacgcgctggaggaacccaaggagttcgcggcggcccgcggggacaggctcaagatgtgcatccaggaggagagcgcgttcgcgctcgcgcagcgcgaagagggggccggcgaggtttcggacgcccaggcgaggccggggcggtcgacggtgcacagcgaggaggcggtccaaggccaggcgcgggtgagcagccactcggcctcggggaggatgagcttccacacgaaccaggcagtggaggaggagaagcagctgattgacagggaggtggagcgggggatggtgtatctgatgggggaggccaacgtcacggcggaggccaagtcctccatcttgaagaaggtcgtggtgaaccatgtctacaccttcttgaggaagaacttgacggaggggcacaaggtgctggccattcccaaagatcagctgctcaaagtcgggatcacgtacgagatatagtgatcgaccgatcgaacgagttcaccccgagtatgtgcggtgatggttctggtgcaccatggcgttggccgttggtttggaagggcaaagtgccgacagctgtcgattcaataaggaagcaggcaggtgggggatgggaggagttttctttcttttggttgcaacaaggttttcattttcactttnctgctgtatgtacatnctaaaggtgttaaaatataagggtgatattgcaactgaagcttgaatctgttgaaaaaaaaaa

SEQ ID NO: 3631 - DNA, 480 bp, Triticum aestivum
  Clone ID: PAT_TA_3631
gtcgacccacgcgtccgtgcctccatagcccgactcacggccaccgtcgtgaacagcaccggcgctccgccggcgtcggcgtttccttggggcgacgacggcgcgacccgacgccggcggcacctaccccgcgcttctccgccgccgctcaaccaattcctctctagattagggtttcttcctgactaaatctggcaattacaccgccgctctacattttccaatccattcctcgtaccgccgaccaagcctgatcgcgacccgcagctcctctgcctcctacgccgcagtggtattccgtcggctggctctgcatcgtctccccgaggatctccatttctcgtgctcaacctgatcactccctacgtagatccgcccggcctaaagatttcgtttcttcgtcgtgttgtactgctcgcagttgtaatttgcaagctagccatggaagacaacaatgatgagcataatgtatctcttcct

SEQ ID NO: 3632 - DNA, 683 bp, Triticum aestivum
  Clone ID: PAT_TA_3632
ctccgggtcgtcggaggccatcccttccttccccctctacaccatctacgccgcttccaaacggtacgttgctcagttctcccggagcctctacgtcgagtacagaagcaaagggatcgatgtgcaatgccaggccccgctgttggtgcagacgaagatgacgtcgatagtcgcggggcccggcaagcggcgccgtggcctgctgcagcggttcctcgtgccgacgtcggacgagtacgcgcgcgcggcggcgcgctggatcgggcacggcccgctctgcatgcccaacctgggccaccggctccagtggcgcctctgccgcgtcgtgccggaccggctcctcgacgcgcagcgcctgcgcgagaacctgcggcagagggccgtcttccagcggctccggtcgccgagggcgccgtcccacgccaacggcggcgagcagagctagcttggcctaggctgcgcgccttcatatctgtgttggtgcatactactttgtgcgatggtactgtgtatgatttgacatgtatctgtgaaccgcggtttggttgaagtcgccgttgatgcgcgcgcagctgatgcctacctgtaaaaaaaaaaaaaaagactgcaatgtccttgaattaaacggttcctggccagatactttacgtaaaaaaaaaaaaaaaaaaaacaaaaaaaaaaaa

SEQ ID NO: 3633 - DNA, 685 bp, Triticum aestivum
  unsure (1)..(685): unsure at all n locations
  Clone ID: PAT_TA_3633
cagtactgctctgcttgagatgatgatctgccacctcccctctccgttagaagcacagaaattcgcgtggagaacctgtatgagggcccccttgatgataaatacgcagaagctattaaaaaatgtgaccctgaaggtccgcctcggcggtacgtttccaagnatggtcccagcatctgatgtgggcagatttttcgcgtttggtcgtgtcttctccggaaggattgcagctggcatgaaggtccgggtcatggggccttcctatgtccccggcatggaaactgatttgcacgtggagtctgtccagcgtaccattatatggatgggaaagaagcaatgtgacgttccggatgttccttgcggtaacactgttggtttgattggtctggatgcatgcataacaaagagtgctaccctgacaagcgagaaggaggttgttgcacgcccaatcagagcgatgaagctctctgtatgccctctgatgtttgttacaattaactgcaaggttccgtctgagtctcccaaacttgtacaaggtttgaagcgtctggcgatgtctgatcccgtggttctgtggagcaaggtagagcctggtacttacacagttgctggagtgggagaacttcatctggaaatttgcttgaaggatctacaggaagagtttatggatggtgttgaagttgtt

SEQ ID NO: 3634 - DNA, 627 bp, Triticum aestivum
  unsure (1)..(627): unsure at all n locations
  Clone ID: PAT_TA_3634
gacgcacgaggacgcttcgcatctcctcttcctctcaagtcctaactacctaaccgcccccaaatccccaaaccctagctctgccccacccccgcccccaacccgcagccggccgccatggccgagaccgtcgacgacaagctcgcctacttccaggccgtcacaggcatctccgaccccgacctctgcaccgagattctcgtggccaacaactgggacctccagcttgccgtctcctccatcaccggcgacccctcctcgcccgagccgtccacttacgccccgccgcccccgcctccgctggaatccgattccatcgcctaccaaccccctgccccggctccgcagcagcagcagcagccggggatcgcgtggaggctagtgacgctccccttctacgtggtttccggtggggtcggcctcgtcaccggttccatccgtctcggtgtctgggtcgcaagcggcgtgctgtcccgatccctctccctcctcggcctcgcgcagcgcggcggtgaccgcttgcttgagctgcccccgtccgccgcggaggcggctgacttcctggccgagttcgagcacgagtttggggcttnnnnnngcccgcgctntnnngctgnnnnatttgca

SEQ ID NO: 3635 - DNA, 1916 bp, Triticum aestivum
  unsure (1)..(1916): unsure at all n locations
  Clone ID: PAT_TA_3635
tccggcctcccgccacagcccccccccacctgggaccgggagcacgtaggcaggcaccgcccatcgttgcttgcgcccgattgccggcttgctggtctcgctccatcgtcatcgtcgggggctggattgccggcgagccacccttaagaggatcaagggagggccttgttgaaagcagggcgaagctttgcctcagggctgttcccgcaccatcggcacagggatccgggctccccccggcttcacccccatctacaccgctgcaacccaatgagctaccccatcctccctatacattaagtctgcatgcggacaacttctatccatcgttgtgtgatgcaggggttcaaaccagtccctctcagcagcttcaactagttgggttccgggaatccgcttggtgcttgcttggcgggctgtttcgcattacatcctcgaccttgttctagggcgaccggcattgatctctccctcaactctccttttagagtacttactcctgcgagcacatatccgccggccctcggttccgggggcatgtcccagccgctaccctacgaggaaagtctggcctatcgacttgctgactacgcggtaatccccctccattacatctttcacaccaccgagcttgaaggcggacacaagccaagatagagaaggtacccgtcgggatggcttgcatttgctccccggtctacaatcgaatcacctgcattcaataggccagccgcagaagctaccaccacacgggggcgcacccaatgtgtgccttcatctactccgctgagcactggctcgctgcagccccctgggcttaccgaccgtttcaggcagggaagagcccgcctcctctacccgcgtaaggaagtttcaatctagcctggctacaaccagctgatctacggaccatcccgagcaaaacgactgggacaccccgtcatatcctggcataaccgacgcctgaacaactgaatagagctgcttcacttctccgtccgggttctcgcccatccacgactccccaacttgatcaactactcctcgaaacaattgaactggttcaagacccctaccattcatctcagactgtgtatgattcatgggtcaaacccaatgcttctcccaagcttcaacgactgggccccgcgggttcccccggggctgctttcgcccgcccggtcggccttcctcccgcctgctcgaccttcgcagatccgccaggatctcctctgttccccgctttatacgatgattttgtgtgggtggagaagttcgcggaccctgggttccgcaggcatgtcgcagctgctagcatctggggaattatggctttgagacttgctgacgaggagatcatacccttcgattacatgtcctacaccaccgagcttgaggcatacacaaaagtagtagagaaggaaaccgaggggacgactgtcagttgttccccgctgtacaactcgatcagagctctgaaaaaggcagctaccaaagttaacagtgagcgaaaggatattcaaagggaactgtcaagcaagcagctgagcaaggactcgatgaggatccggggactcaacgaccggctcatgcaggcagagcgagccttcactaaccgggaaggcatcttcaagcaagcctgggtacaagcatctgatctacggaccgtccgagcagaacgactgggacaccgcgtcctatcccggcatagccgacgccataaccacggcgaaggagcaacaacacctcggcgtccctggaaactggtgcaacacgangttcacaaggtccccaanggccgttgcacaagcatccgccgtgctcaacggggagcctcacatgactggattgcantccgtcaccgtcagcaatggaaagacatcaacattgttcaaggccgtgcataatcatccggg

SEQ ID NO: 3636 - DNA, 507 bp, Triticum aestivum
  unsure (1)..(507): unsure at all n locations
  Clone ID: PAT_TA_3636
cccacgcgtccggcttcgtgtcccagtcatgtccatcacctaaaggcgacatgtacggggcctcaccacctcgtggcctcacactccttccactccccactggtccaactatcacagtcacagatcaggagtatcaatcagagaggtggtagatagccagaacatggcggactgggccccggtgttcgtcgggctggccctattcatcctcctctcgccggggctgctgttccagatccccggcaagggcaggatcatggacttcggcggcttccagaccagcggcatctccatgctcatccacgccgtcatctacttcgccctcatcaccatcttgctcctcgccgtccgcgttcaagtcttccttgggtgaccagcaactgcttctttacactttcaagcctcctgatttgcttgtanaggggnactggngccaatttgattttaatgggcattantttatgatttgcattttccnaaaaaagtaaatttgagttttcaaggttn

SEQ ID NO: 3637 - DNA, 733 bp, Triticum aestivum
  unsure (1)..(733): unsure at all n locations
  Clone ID: PAT_TA_3637
ggggaaagggngaaatgttggtcccggctggggacacttcacaatttataccatcaaaggaagctgacattgcaattctggaagagcctgagcacctgaactggtaccatcatggaaagcgttggactgataaatttaatcatgtcgtcggtgttgtgcatacaaattgcttggagtatatcaagagagagaagaatggtgctattcaagctttgggggtcaagcacattaacaaccttgttgccagagcttattgccataaggttttgcgactatctggggctactcaagatctagccagatccatgatctgcaatgtacatggggttaatcccaagtttctggaggttggggagagaatagcagcagagagggaatctggcgagcagtccatgtccaaaggagcttattttctggggaagatggtctgggccaaaggctacagagaactgatagatttcctgcgaagacaaacggatttgaccgnttcaactggacgtntatggaacggtgaanattcatanaaggcaatcactgcaanaactggattaaatttacttcataagccgaaacatccaacattttttatggtacaggttttttaaacccacattatgattncttcncccnctgttaggcctaccaggcaatttnggctggcgacaccctcaanttttttaaaatccaattctnctaacantaaanntttttcaanaanacatncccnnccccc

SEQ ID NO: 3638 - DNA, 1401 bp, Triticum aestivum
  Clone ID: PAT_TA_3638
gctcccaatcggccaagccggctgcgggagacgggaaagggcggcgccggagaaggtctgggtgccgctggtggcgttcccggcgagcgcgcaggtggtgccggagccgctcggggtcgtcctcatcttctcctgctggaacttccccctgggtctgtctctggagccgctgatcggggccatagcggccgggaacgccgtggcgctgaagccgtcggagctggcgccggccacggccaggttcctggaggagaacataggcgagtacctggacgccacggcggtgaaggtcatccagggcggccccgcggtgggggagcagctcatggagcacagatgggacaaggtcctcttcaccgggtgcccgcgcgtggcgcgcgtggtgatggcggcggcggcgaagcacctgacgcccgtggcgctggagctgggcgggaagtgcccctgcatcttcgacgccgtcgccggcaggaggaacctccagacctcggtgaaccgcgtgatcttcgccaagtggtcgtcctgcgccggccaggcctgcatcgccatcgactacgtgctcgtcgaggagcgattcgcgcccaccctgatcaaggtgctcaagtcgacgctgaagaggttcatcgccgatcaggaccagatggcgcggatcgtcaacgggcggcatttccaacggctgagtaacctcctcaaggacccggcggtggcggcatccatcctgcacggcggcggcttggatgccaagaacctatccatcgagcccacgatactgcttaacccgccgctggactccgggatcatgaccgaggagatcttcggccctctgctccccatcatcacggtgaagaagatcgaggacagcatcgcgttcgtgagggcgcggccgaagccgctggccgtgtacgccttcaccgacagcgcgccgctgaagcgccggatcgtggaggagacgtcgtcggggagcgtcaccttcaacgacgccgtcgtacagttcggggtggacacgctgccgttcggcggcgtggggcagagcgggttcgggcagtaccacggcaagtactccttcgagatgttcagccacaagaaggcggtgctgcggcggggattcctggtggaggccatgctgaggtacccgccgtgggacgagcagaagatcgccatgatgcgccacctcttccgctacgactacgtccgcttcatcttcaccttcctcggcctgcggagatgaatacggccatgcccaggaaattaattaattattatttgatgagcgagtggatgaacaagtacatgaataataaacataccacgttagtttgtactactaggattgcgtagcaggtttgcacttggtacttgctagtgtgccaataatagaagaagaatgttctttttgcaaaa

SEQ ID NO: 3639 - DNA, 1273 bp, Triticum aestivum
  Clone ID: PAT_TA_3639
gccccttgcatccatccatccatccatccacgggaaccatggaggagaagccggccattggcttggggagcctggtgagcagcctgcgagtggtgtacaagagcggcaggaccaaggacctctcatggaggcggtcgcagctcaaggggctcatcaggctcctgacggagaaggaggaggagatcttcgacgcgctccacgacgacctcggcaagcaccggactgaatcgttcagggacgaggtcggggttctcgtcaagtccatcaagcacacgctgcaaaacctcgagaaatgggcggcccctgagaaggctcctacgccgctggtttcctttccggcgacggcgctggtgctgccggagccgctcggggtcgtgctcattttctcctgctggaatcttccaataggacaaggcgtgtgtgtgatgtgtgacatagtttacccacacatccgttttaccacacgaaggggccggtgtgtgggcgttgagcagttcacgcacacaccagttttcagtcatgcacaagggctggtgtgtgggcatttgccatctcgcccacacgcacgtcttctctccacacggtacacggcaactgcctagtgtgcacgtaagcagatgacaactgtcttttaccgagttgccatgtgtttttgcatggtacatggcaactgccccaacgtgcacgtacatggcaactgtcctaacgtgcacgtaagcagatggcaactcttcttttttacatggcaactgccctagcatgcttgtgagcacatggcaactctctcaactgcctagtgttagtatgtggcaacttctaaagttataaaatcatggcaactacattagatcagaccatacatggcaactgcagttgagcaaccatggcaactgcagttgtccgacatggcaaccgtaattcagcgacatggcaactgcatataaacaaacatggacgagggtctggaccatgacaactgcgggcgcgcggtgggcgtcacgcgtcgcgtgcgggaccagaagggtacgaggcctgacatacgaacgtgtgggcattatcaacttcgcccacacgcacgcgtgtgagagggttcgggaggaaaaaaatatatgtgggcattagttgttttgcccacacgtaggtgtgtgggctggttgctgttcatgccacacgagacgtgtggcacaactacccgatacaccacacgtgtgacagttatcgggacccataaataaataaaaagagccgacacgcccaaccaaacacaacaatc

SEQ ID NO: 3640 - DNA, 1775 bp, Triticum aestivum
  Clone ID: PAT_TA_3640
ggtcgccccccctccgccctccgcctccatgcctggggaacacggaggagaagccggccattggcttggggagcctggtgaggcagcctgcgagtggtgtaccaagaccggcaggaccaaggacctctcatggagccggtccttgctcaaggggctgatcaggctcctgatggtgaaggaggaggagatcttcgacgcgctccccgacgacctcggcaagcaccggacggacacgttcagggacgaggaggaggttctcgtcaagtccatcgagcacacggtgcaaaacgtcgagcaatgggcggcccctgtgaaggctcagatgccggtggtctccttgcccacgacggccctggtgctgccgcacccgcgcggggcggtgcttgatttcgcctgctggaatcttcctgtcggccgagctccggggcctgtgcgggcagcgccactggatgtccgaccccttctctggcaggagaaaccgccagagctcggggcaccgcagcatctcgctgccaacataccgagataccttgccgccgaggctgtaaaggtcgtcttgggtgcagcggaagttggacaagagctaatggagcaccgatgggacaaagtcctcttcaccgggggtgcccgtgtaggtcgcattatcatgacaaaagctgcaaagtacttgaccccagtggcgcttgagcttggctcgaaatgcccgtgcattgtagattggctggacagcaaaagagacagtcaggttgccgtaaatcgcataataggcgcgaaatggtccacttgcgccggtcaagcttgcatagccatcgattacatacttgtggaggaacagtttgcgccgattctgattgagctgctgaaatcaacactcgagagactcatcacgaaaccagaggacatggcgcgcattctgaacgagagacagttcaataggttgagtggcctcctggaggatcacgaggtgagccgttccattgtgcatggtggggacgtggacccaaaggaccttgagcatcgagcccaccatcctgctgaatccaccgctcgactccgacgtcatgacagaggagattttcggccctctcctcccgatcatcacggtgaagaagatcgaggacagcatcgagttcgtgagctccaggcccaagccgctcgcgatctacgccttcaccacgagcgaggcgctgaagcagcggatcgtcagggagacatcgtccgggagcgtcaccttcaacgacgcgatcgtgcagtacgggctggagagcatcccgttcggcggcgtcgggcagagcgggttcgggcagtaccacggcaagtactccttcgagatgttcagccacaagaaggcggtgttcaggcgaagcttcctgttggagttcatgttcaggtacccgccgtggaacgacgacagcaagctcgcgttgctgcggcacgtcttccgctacgactacgtgtcgctgttcctcgcgctgctcggcctgaggaggtgaacggggcgggaggaggaagacgctgccggcgaagctggagaatctgcactcgccgttgcgtgtagccagtcatgctcgatggttatcccgtggtttacacggttgatgatgaatgtgtgttgtcgccctaggtatatacttaagcatctgaactaccgcgtccccttctaaaaatgtctgaaccatggtgcaaccctatcagtatattgcgccaacagttccatggtctaatatattcaagttgttgtactttaccttttctaattaaatctgtagctggaa

SEQ ID NO: 3641 - DNA, 1226 bp, Triticum aestivum
  Clone ID: PAT_TA_3641
gcaagctccgcctcccccccacccctcgtcttccggttcaccatccccgccgtcgtcaccatgtgggaggactcttctgagttatcagcccaggctaggggtcgactagtccggcgcggcagccgccaagtctcctgttccggggaacccacacgggactccacaggctggagcaagtactatgtgatctcgaccccgtgcccaaatgtgatgtcctccccggcccccccggccaccgccacgctcccccgccccgccccgccggcgacaaggtccccccacagcacgatctccgggcaatttgggtccagaaccggagctccgcgcgctccaggaagatgctggtgcccccggtggccgaggagcaccacccagtgggcggatcgtcctctccgattagttctttggacggtggccatgtccactttgtggcatggtcagccctcaatggcgcatgggacgatgttgctgcctttctgtcccacaggttcactggaacaatggacccggacgtactagttcgatttacttggcttggacccgaggaggatgaatgggttgatgtttgtaaatgtgtgagagtgcgttctcctcattgtgtgtttgaaggaagggaaagagcaggcccgctattttgatgcacatgttcttcaagttcaaaggcgcaggcatgacgtaagggggtgccgctgcaggtttcttgtttgtgatgatcatgatcactctgaggagtttgttcctctgggccacgctggccgtcgtgctgcgcaccaccgggcccggccgccccacgagatgatggatgtcaacactgacaaggtgacctgggggcggggttcccattccatcagatcaaggaggtccgtctgacaagccggttgctcccttacttgactcgcctactagcactggcagcaattcagtggcagatgttgaggcggggggtatggaggctaccccaaatggtgatggtgcagatgaagcacatggcgacaagattgatgtgggagcgtagctctttcacttccttgtgaactttagtcaaaaagatgttcgcctaagacaatcgagaaaggatgtttggttgcccagtaactgtaatgtgcccatgttgactggattgattgtgtcggattgggtatctatatctatataggtatgtcgtcagagaagatattgttgtgcttcagtccaataaaagtttggcagttgtgtcaaaaaaaaaa

SEQ ID NO: 3642 - DNA, 1326 bp, Triticum aestivum
  unsure (1)..(1326): unsure at all n locations
  Clone ID: PAT_TA_3642
cttccggcgcgcggcgtggggcttgctgcaacttagttcaagcggaaatcctcttcaaacaagtgcatttattgttgagaacatatttgctatagcaattggtgctatcagcctcatactctttgctcagctgattggcaaaatgcagacatacttgcaatctgttagcaaaaggctcgaagagtggaggttgaggcaacgggacatggaggagtggatgagacatcaccggctcccacctgaccttcaagaacgtgtccagcggtttgttcaagttaaatggcttgcaacgcgcggagtagaagaagaatccatcttgcaagctttgcctgctgacatacgtcgggatgtacagcgccatctttgtttggatcttgttcgacgtgtccctttcttcgccgagatggacgaccaactcctggacgccatctgcgagcggctggtgtcgttcctgtgcccggagggcacgtacatttctcgcgagggcgatcctgtgagcgagatgctcttcatcatccgcggcaagctggagagctccacgaccaacggaggccggagcaacttcttcaactccatcctcctacgccctggtgaattcgccggcgaggagctgctcacctgggccctgctgcccaagaccaacatccacttcccgctctccacaacgtccgccccccgcccgccgcgggggccggccttcgcgctgcgtgccgaggacctcaagttcgtggcgaaccagttccggaggctccacagcaagaagctccagcacacgttcaggttctactcccaccactggaggacgtggggcgcctgcttcatccaggcggcgtggcggcagcaccagcggaggaagctgtcggagagcctgagccggtgggagtcctactcgtggtggtcggaggagcacccggccgccgacaagcctaagcaggagggcacctcgaggaccgccgccgagatgcacaagttcgcctccgcgtccaagaggttcccgcgccgacgacaccagtgatccgccaaggctagcatgaaccccagtgagcgaagcccggatttgctccgccgatccatttcgacttgaagccatcatctccgcttctccatcgacagcatttgacttccgaaaatcctgaatttttgttgtaattctagttccaggtcacataagaaggaaaattgttggaagtttgtcagtgccagatatagacatccataccccactctaatgtataacacacatccctttggtgtatgtcactgtaacaatatgaactggtctgatgagcgaagctgaagctcccctgtttccgcaggattcacana

SEQ ID NO: 3643 - DNA, 744 bp, Triticum aestivum
  Clone ID: PAT_TA_3643
tcggcacgaggatttgcccgatcagtctctccatcgcagtcgcaggccgccaagtgcaagaaatggagagcgcaagggcgccggccggcgacgtgaacctggacttgcggctcgttcacccaatggcggcggcggcatggcgcccgcacccgcagacgccggtggcagccgaccggaccttctcgtgcacctactgccggcgcaagttctacagctcgcaggcgctgggcggccaccagaacgcgcacaagctcgagcgcagcctcgccaagcgcagccgcgagctctccgccgccagccaggtcgcgatcgcctcctccagcgccgcgtcttccccgccgccctccgacttgatcagctggtacacgccgggaggcggagatagtggccaagctccagggtcggccgccgcagccgcggccgtcgtcagctggatcgccgatggcggccgccgccggtacgttcatcgcgtgcacgcggccggcaacggggaagacgacatcgatctgtcgctcaagctgtaagacgcacgcacgcacgcccgcacgcacgcgtatggagtggactagaatgcatctagtagcttgtccgtccgtacgctatagttctacttctactacgtacgtacgtcagttgtttctgtgcatgtatggcacgacgttatttgttgtttaaattcttttattcaagtccagtttgttggccgggttgattatacaataaaccagtactcctacgtaaaaa

SEQ ID NO: 3644 - DNA, 512 bp, Triticum aestivum
  Clone ID: PAT_TA_3644
aaagcaggggatgcattccttgtacaccgattatgcacatatatttgacttgtcattcggagaatacaagcctgggaagctacatcgctcctaaagtggggcacctggctgtcttgttgaaacgttctgccctccttactggaagcgcattttttaccattgccatccgctacagagctctgctggacagatggatactgcaaaaatgcgccgtctcccagggtgcacctgttcaatcaaccatgatgttgcgatcctgttggcagtgtagatccctgcctgtgtttgttggcattggtgttctaatggcaaggctctgtagttacattaccattcagagtcctaacaataatcggcaagtcatccgcggcattgaagctaaccttcagggcgattcgatcatcgagaagaacgagttctgcaatcagcaatccgtccttccaagtttgcttggcagcaagcatgactatgtccgtttgctgcttcattttatttgtagcactgccattttt

SEQ ID NO: 3645 - DNA, 679 bp, Triticum aestivum
  Clone ID: PAT_TA_3645
ggggggtggcaccacgctctacacgaggagagcatgacccttgcctcagcaaggtcccgacttcgtcggtgggctggggggtccatggggtccatctcctcggcccccgcttccccgggggggggggctaccccgtcctccaaattcggcttccggggctccatggtttcggggttcgggccgtcctgggcccggtcatgccccctggagaaccaggggccgcggagccacaacggcccggggacccccgcgaccattggagaccccagggggttttagaaccggcggatcatgaagcagaagtgctagtctgaccgcgtccgcgcctcagcggtgcgggctggcgtcagggcgctcgcgtccatggttggaggtttggtcggagaagtcgggttcggtgctggaggtttgaagtaagcagattggtttgttagtttatgattctaaaagaaggaatacttttgtccttttctcggaaactttgaggcctggtttaggattgatctcaccggagtttagccctcacttggtcatattttcgatgctcgtggtctttgttcagcctgatgacattgtggaagtgctgttgttcgttccgactgaatcgcctttgctgcccttaataaagagaaccagcaggagacatttagcctacttccccagagaacgaaaaaaaaaa

SEQ ID NO: 3646 - DNA, 760 bp, Triticum aestivum
  Clone ID: PAT_TA_3646
ggacaattgtcagggtgtccgagatggtatttgtggagacgttcatatgccctcacaaggaagctgcaccgaaccttgctgaagattatgatgccgcatgcagaggggaaatgccgactaatttcagatttacatgaaccaagaacgggctatgagaattggtagctgcatatggcgcgaaaaagttttcactctgcatggtaatctgctgtgcctgaccaagcaagtggcaaatctgagctctatggaatgcttacatatatcaacgatgaaatgatctggattttgcaactctaagctcagcaagaggtgccaaaaggataatgtctttgattggcttaagactgctcatatctgtaacatagatatttggtgaggtataaagcataggatgaaatatatgaactgccaaaatctaaacccaggacaatatatcttggcttccattgggtttgatgtacatcggtaaatggctatgtgtctgcgtcaactctccaaagaatgcatcacttggtatctccaaaacttccagtgctgaaatcctgaaattgctttttgtatttcctttgcatccatagatttgatatctaccttagatgttcagtgttaaaagcttcacatcagtatattttgaattccattgggtttgatgcccattccgtagttgtttaagtaaccttagcaagacaatggtatttaaaaaaaaaattttttgatttttgggagtaaaaaaaaaaaaaaaaaaaaaaaaaaaaaaaaa

SEQ ID NO: 3647 - DNA, 602 bp, Triticum aestivum
  Clone ID: PAT_TA_3647
acaaagagatccataactcaatcggaaaactggaagggggtggggggcgatgctccgccccggttcttctccacaaagatgtgtgttgctgccatcatggtgctggccctgtcgctctcgcttcagggcaccgttgccgccggccgcctctttcccaactctgggtgggacggttgtccgcccggcacgtcgcggaaatgcactggtccgcccgcccattgcccgtgtctaccaaatcttgggcctttggatcgccaagacatgacggcgatgcctgagaagaacagcctcgtgctgtcccagctatcctacccgggaccccaaatccgtgggtgtgcgagggggggaggtgcttcctccgggaactagcgataagggtcaggacgcatccatacatccacgtgcgtggaaagaaccctgtatatgcaaaggagacgttgccgcctgatttttatttgatgcacattgtgtgcttccggtccggagcagtactgatgctgcccatgtaggtcgttgtaaggcttcctcctgtacaggtgggcagatacgagccgcgccggtatgtgccgtttaccacaaataaaaaaaaaaaaaaaaagaaa

SEQ ID NO: 3648 - DNA, 393 bp, Triticum aestivum
  Clone ID: PAT_TA_3648
caaaatgcaaacagaaagctgttagctccctgacttattttatgaaaaagtggggaagtatgtaagcgcatctgaggtgaaaagttattttctaaatttattaattgtgtaatatagcactttatctgtatttaaacagttgtaccattgctttggtatgatcttttccatatatgtacttttgagttttattggtgaaacaggtcatcgtaataagatgcaacgatgttaagaaattatagtttagcggcagaggcaaaattaaacagcagagactgtaattagtagtcataattccttctatttcattttgcagactcgtgatgatgctaggcagttcatgaagtaccttcaccctgaccttggtgttgaattacctgaaagatcctatgg

SEQ ID NO: 3649 - DNA, 740 bp, Triticum aestivum
  Clone ID: PAT_TA_3649
tctcgctcgcctctgttttccccctgtggacacacatgagactcagatcttggctcgtcgtagaggaatcgatagcaagaatcaaccagagaaaggatgtagacaagagctcgaggcagagatggcggagctcgggcgagctcgagactatggatccagggcttgagtgctcacgggatggaggtgctcaggatggaggcaggggagggcgccctgcgggaagtgatttatgtgctccttgatcagtttttttataactgatggcatcttacattgttgtcttttaccgattaactggttaactcttttcctaaatggtcttagatttctgctttctatttgcgccagtttctttttacaagagatgagatcttacacaatatatttttgccttggttgatctaattaaaattttccttcagcacgtgcatatgatgtgaatataaagctatttggaagtacatatccatgggcgaaaaaatattatcatgtattttgtctgtcattttgcttgtgttgatgtaatttattgagctttttcacacgtcatgatattatgccttaatttctactaggctgcttttacatttaaaattcattgtacaaacattatttacctaatttatggaaacaataaatttgtagcttaggtcaactaggagatgatgtaaaccaagtcactcaccagtttaagatggtgtttacagatttactttgttccagcgcctactttggatcat

SEQ ID NO: 3650 - DNA, 1081 bp, Triticum aestivum
  unsure (1)..(1081): unsure at all n locations
  Clone ID: PAT_TA_3650
gctccgcggcccagccgccgccggggctgctctcccgggtccgcctcggggtgccccggcgcccgcggcgcctcccccggcggccgggccgagcgggggcgcgcctccgcgggcaggcccgccggctcgccgcccctccccccccccgggtcggccggcctccggcccggctggacgccgcgcccccgggcgccgcccggcgcgccgcgcgcccccgcctcccgccgcgggcccgccggcccgtggaggagggcgccgccgcccgaccctcgctacgccctcttggcagggcacccgaccgcctggtgcggcgccttcggcctcgccgaatttgtgtccgacagccacaagggccaccgcacgcacccgtgtctaagggacgctggcgtctctggaccccgagtactacatgtcccagcaactgacggagaagagcgacgtctacagcttcggcgtggtcatgctcgagctgatcatcgccaggcagccgatcgagaagggcaagtacatcgtcagggaggccaagagggttttcgacgctgccgacgccgagttctgcggcctcaggggcatgatagactccaggatcatcaacaccaaccatctcgccgcgttcagcaagttcgtgcagctggccatccggtgcgtggaggagggcgctgccgcccgaccgtccatgagcgacgtcgtcaaggagatcgagatgatgctgcagaacgaggggctcagcagcgcctccacgtctgcgaccgacttcgacgtcactaaaaccgctcctcgccacccttacaacgatcctctcccaaagaaggacaaggacatgagcacagactcattcgacgactacagcggaggatattctttccagtcaaaggtccaaccaaagtagctggtttctgctagggattctatgctggccggaccttttcttcctccctcctcaccaagtagcttgcctaatacagtatgtcgacatgtcaagaatttttattctatgtgatttaccattaacactctcttattagagtggtttggtgggcaccttcttatcaaaacgttnttacttacggctaacaacgcc

SEQ ID NO: 3651 - DNA, 2219 bp, Triticum aestivum
  unsure (1)..(2219): unsure at all n locations
  Clone ID: PAT_TA_3651
tgcaggcaattcggcacgaggcctttgctgaatcggtatgagactgaccgcaaggctgccaatattgcgatggcggcagttctagatggcttccagaagatgtactctgtcgatttcggacccctcaatgttctaagagccgctgcattccatggtgcccagtacatatcaccactgaagaagaacataatatcttacgcaatgggcgacagcaaatcgcctctgttttcataagcagtactgtaccaaaatgtgttagttctaaacttgttggctcttggctgtcatggcagcactgtaccaaaatgcgttagttctaagctagctagtactatatcccacctgagaaactagttggataaaatgcaacaagtactctatctcaaaatgcaagacattattttgacaccatcatagtgtcaaaaaacttacatcttgagatggagcgggctggttgttgctgtcgtcgggggtggcttgccgggcctggctgtcgcgtgtgcacgccttgttcagtacgtactttgcttgccacggaagattagtttattttttgttggcacatttttatctgggaggttatatatgcagaatgctgtccctgtttcaagggtcagcactgttactcctgcaaccatttccttcttcagagatattggtgcatgggagcatattctacagcagagacacgctttctttggtaaaatgcaggtgtgggattacactggactgggatacacaaggtacaacgcaagcgacgtgtgcaaagaatatcttggatgtgtggtggagaacaaggtgctttgcaactcacttctgttacgcctacaggagcaaaaggaagacattaaaaagatggtctaccctacccgattggcgtctcttgctttcccatcaaagagcagaaatgtaggagtagcaggactgaagccaccatcaactgaggcggaggaactacgccgtagtaatttggttaaacttgacctaagtgatggacagactttatattcaaagttggtggtaggagctgatggttccaaatccaatgtaaggcagattgcgggcataaaaactactggttggagctatcctcagagtgcgattatctgtacagtagagcatactgcagcgaatgactgtngcatggcagaggtttctcccttctggtccgattgccctgcttccaataggcgacaacttcagcaatatagtgtggacaatgagcccagaggaggcatcacgccataagtcaatgagccctgaagattttgtgatgtcagtgaaccgtgcattggaattttgggttatggaccgcatcccaactctagtagtcttgaccattacgtggaaaggttattttctgactttggaggtactgcagcgtctacaaaagaatgctttgaagtaccaccaagggcaactgggctgatctcagagagaatggcatttccattgtccctgatgcactcccatgattatgtttcaaaaaggctagcattagttggtgatgctgctcatacagtgcaccccttggccggtcaaggtgtcaatttgggttttggagacgcagctgccttagcggaagttatttctgaaggagtttctgttggtgctgatattggggatctgtctttgctgaatcggtatgagaatgaccgcaaggctgccaatgttgcgatggcggcagttctagatggcttccagaagatgtactctgtcgatttcggacccctcaatgttctgagagccgctgcattccatggtgcccagtacatatcaccactgaagaagaacataatttcttacgcaatgggcgacaggaaatcgcctctgttttcataagcagcaggtcttacaaacttgttggttcttggctgtcactgcagcactgtaccgaaatgcgttagttctaactagtatcgtgtatgtttggcagtatcttctaagccagtaccatatcccacctgagaaacgttaggttgataaaatgtaacaagtgctccttctgtctcaaaatggaagacatttttttgacactatcatagatttgtagtgtcaaaaaacgtcttacattttgagaaggatggagagtagttaatactagtaaataagattatgtatatcctggatttgttttcatctgtataaggcttgttcagtactttgcttgccatggaagattagttatttttgttggcaccaaaaaaaaaaaaaaaaaa

SEQ ID NO: 3652 - DNA, 1301 bp, Triticum aestivum
  Clone ID: PAT_TA_3652
gattcggcacgagagcagtatatacccacgtatttagcctattattctgtacactacacagctgcccatagaaccatatccagttcaagagattgttcacgttgttgtcttcatcggatatgggcgaagctgctgctgaacatgccggactgtgaagccttgggtgcaggcttggttacctcaggagtgccaaacacgttccagaagcggagggtctcgtccgcagcagcagatgctaccgtgcaaccatcaggactctgtgccatgaagaggacacgggaggtatggccagtgagttcagccatcttgaccatggaagggtacttccacaatgtcagctggttctgggtgaacccgtgtgagctcagcagctccctctcgttcttgttccacagaagggagcacacctgcgacccggtatcaacagagttcaggcatgcgccggtgtgcgtgttccagaacttgatgcatcggtcgctgccgccaccgccagttgccagcaggttgctctggaatgggcaccatgccagcgccttcacagcggccatgtggtcctcgagcctgtgcagccactggttgcggcctgcggacggcatggaggatgccatcgacacgtcccaaatgtgcaaaaggttgtcgttgccaccgctcgccagttgctgccctgagcctgaccacttgagcccgcacacctcctggctgtgcccctggtacgtctgcacggcatggtccctgatccttacgtcgttgttcacaatcctaccgtccatgccgccagtcgtcaggatgttgttgttccatgccagcgaaccgacccttgactcatgcacacctttcagagtcctcaacaggcggttggagctggtgtcccagagctgaatgtcagacgagttgagcccaatagcaagatggcggccataaggagcccagctgacgctggtgatggggccattgtcctcctcaactgtcacaagctcagatgttgatccactggatgcgtcccacaagtacatggtgtcgcccagagcaatggacaacacgttgctgctcccccagtccatcaggttgaggtagtagtcgtcgacgaggtccggtgcatccagagtcctctcggcagactggggaatgtagcgcctctgcttggccggcgtggcctggtgagaagaaaccgtgtcggcagcgaagacgttttccggctccggcggcttgttcctgaaggcgaggatccgcgtccggttgttgagcagcttctccgcgagaagcctccggtacgcctcttggagggggacgccgcgatggcc

SEQ ID NO: 3653 - DNA, 1264 bp, Triticum aestivum
  Clone ID: PAT_TA_3653
gcgcccctgcccctgcccctgccgctcgcggttgaacccgtggaacttcgtctttctcgtctcccccaaatcgacgagcagggcgagcggaattccagggcgagctccccccccctccccctccctccccactcgccaagtcgccggcgcccagcggtttcccgccaggccgttgcccccggccctcctcccggcgccgaattcccacccccgcgacgccgacctctcattcctcggaccttccgcccgccccctggtcgctcccaaagtgccagcacaacccgctggcccagcacaacgaggagacccaggccagagagcaatcctgctgtgaagtagtcatctatgtcatctaggagtaattcaaagaggctgtcctcagatgacaatgttgcctctgacggaggactccgacgtcgagagttttatctgaatggaccttccctggaccgtgcctccaagcgtatcaccgagcgtgttctgtcccctcccaacttgaaaaactcacataagagcaaggggagccaccagttgcattctgaggcatcaggaagtaactcaagaaagggtgaaagcaatcatgggatacatgtgtcagcagggaatgatgatttgtcaaccacgcagaaaccaaggaaagtgaagctcaaaattggtggaatcagtcggaccataccggcaaaaccaaaccctgccataccagattccaggtcttcagctgcaaagcctacacggcctggagattcatcgcaccggcaaaagcatggtaatcagactgaaggtgccaaagattcaaataggttgccctcttctcaagacaagaaaacaagaaagctgaggaaaattgaagataccttgactccggaacaacctgccaaagttcagagagaagcgtcttcggatcctgtccggaagagtagaaggattgctaagaaatccaacatggacagtgaattagatgaggaatatggtttaagtactcctgaaaatcatggagcttctaatgataatgagggtcatattcgtgaacctaaaaacaaaggagggagtaaccctaagaagaatgcctcgaagaaagaccggagcaggagcacagtttatgagggtgataatgattttgttacaccccaatcaaatagagatggcaagaaaaggtcaagagattctactgatgctgatgaggataatgcagaagaggagctggcctctgataatgagcttgaagctgaaaacaagaagcagaaagcagtcactcaattgtctg

SEQ ID NO: 3654 - DNA, 957 bp, Triticum aestivum
  unsure (1)..(957): unsure at all n locations
  Clone ID: PAT_TA_3654
tgcaggnaattcggcacgagggccgccgcttcgccgccgccgccgccgccattctccgacgcgacttcctactccgacaccgactccggcgggtccggcgacagcgaggaggaggcatcttcgatggtgtgggattcacaagatttacgcggccgcgcggagcataacgaggagcagctgctggccgcgatgtcggtcgatcctggccgttttccggctctcaacgatctgctcctcgaggtgtatgccgtgctgcgccccaagcccaccgactacgagcagcggaacgccttggttgatgtcttcagcaagatggcaactaggatctttggtaacgacaatgggtttccagtcgtgcaggcatttgggtcattcacaatggatttgtttactcctaaaagtgacctggatctctctgtcaacttcagtgcggagatcgaggatcagtgtcctcgcaagaaaaagatgaaagttgtcaggaaattcgccaaagttctgtactcccttcaaagggacgggatttactgtggagttttaccggttgtaagtgctaaggtgcctattgtgaatgttattgatcggggaactggcatcgagtgcgatgttacggttgaaaacaaagatggcatgacaagatcgatgattatcaaattgatttcttcacttgatgaaaggtttcagatactaagttacttggttaagacctgggctaatatacatggtgtgaatagcccgacagcgcagacaatgagctcgatgtcaatcatttccttggttgctttccatctgcagcgcagacccgccatcctccaatattacccgcgttctctgccttgttaaaaggtctgtcttgttaccttttcttcttcagctgctgtatctttttacgcagaaaggatgatgagataactatcttgttttggccccttgcagatggttcagatttcgcaagtgttg

SEQ ID NO: 3655 - DNA, 801 bp, Triticum aestivum
  unsure (1)..(801): unsure at all n locations
  Clone ID: PAT_TA_3655
acgccccgggggaccggccgcgggccgacatggcggggctcgggccggggcccgtgcgggggggccgccacctccaccccggccgcgccgccgccggcgccctgcgcctgccgccccaccaccgcctgcccggcgcggcgcgccggcgggcacacctccgtgcacaccatccggcagggccagatcctcacgccggagcagcaggccgaccccggcacctacgccgactgcatccactggtgcctccccggcgtgcccgacatctggaacagcttgctctacaccaggatcaggtccagccccgccccccccgcgccgcctctcccggcccgcctccgtgctcccgctggggcagggctggcggttcgcccccgtcctgctgcccctcccgcgcctcctcgccgcctgcctcccttgctgcccccttggcctccccgacacctggaaccacttcctttacgcccagattgttgccgcgcctccggcgtcggtagcgcaaaagcagctacttctgtaagcgtcgtcgtcgtccgtgtcgtaccacgtgcctgcacttgtacttgggctctgcggatcttctttccttcttctctccgggttttctatctttgttctttgtgtcagctaatcaatctgttgtcaagccgtgagtaagtaattcttttgtagacaaagaaaaaaatttgtagaagcagtggcaccatnagttaaaaagattggncacgcctanaatagantgggaaatccgttgttttaaaaaaggggccgaccaatnccaagggcgaaaanngccatgcgcgt

SEQ ID NO: 3656 - DNA, 657 bp, Triticum aestivum
  Clone ID: PAT_TA_3656
gcacgactcgcgactccccccgcccctcctccgccgcgggaaatacgcgcagagcgtcccccgccccgccgcgacgcccaaatcgcctcgatccgccgcccgggtgcttcgctagatagtaaccatcaagtgaggattctcagaatttgatctgattcgtactggaatttggtttgtcaggtcgggttcacgcgtcatttgacattgcgacgtgtgccttgtgcatctggaggtgcccactgatgcagggaaggtgatgttggttgatcttgagcgcgtgtgatagtgcacaggtttcgaacaactgttgttttccaccatgagggtcaagcttgagctccttatgcccttgctggcgcaatacaaaacacccgcatgggccacattggtcgccgggttctttgtgctgcttgccctttccctctccatgtacctgatatttgagcatctatcggcatacaacaacccagaggaacagaaatttgttctgggtgttattttgatggtcccttgctatgcaattgagtcgtatgtttctttggtagatccaaatatcactgtttactgtggcatcttgcgcgagggttacgaagcattagctatgtactgctttgggaagatatatcactgcatgtttaggtgggggaagaaaaaacg

SEQ ID NO: 3657 - DNA, 570 bp, Triticum aestivum
  Clone ID: PAT_TA_3657
attgtcaccggcctgcagggccagccaccagcagaccaccctcacggttacccattcctcgcttcggttagggacaatgtgcttgcttgtgccaagcatttcgtaggggatggtggcactgacaagggtatcaacgaggggaatgccgggggctcaccagaagatttggagaggatccacacgaaaccatacccgggggggtatagctcaaggggtggcgacagtcatggcatcctactctcaatggaatggggagccgttacatgccagccgtcatttgctcacagatgttctaaagggcaagttacgcttccaggggtttgtggtgtcagactgggagggtattgacaggctttgtgagcctcgagggtctgattatcgctattgcgtcgcgcaatcagttaatgctggaatggatatgattatgatacctcacagatttgagaaattcttggaagatcttgtgttcttggtggagacaggggagatatcaatgtcacggattgatgatgctgttgagaggattctaagggttaagttcatatctggagtgtttgagcatccattttc

SEQ ID NO: 3658 - DNA, 987 bp, Triticum aestivum
  Clone ID: PAT_TA_3658
attcggcacgaggagaagagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgccaacggcaggaaggtgggcaagaagggcgtgtaccagttcgttgacaagtacggcgccaacgtcgacggctacagcccaatctacacgccagaggaatggtctgaatctggtgaccgctacgccggcggtgagtaattttactatttgtagtacctcttactcaatatccacatgcttatgcatgtagaattctggcctctgcatcgggtcgatgcacacagttgtgatacatgcatgcacacctgtacccgattaaaggtagcacttactgtacaagttgttacctaactacaaattgatacatgtttatactgggcataccgtaaaagttagctgcaaatctaagcttattcccctaaaaaaaggctaagcttattcaatcgtagctacataaccgatagagaagagatgaaagttttgcttgaaagaagagcaattatagtttttcgtggggcagaaccacagttatatactcaactggtaattggcaatgtgaattaccatgtagttagaggtgcttgtttaggtagtagttgattcatgagagagatactatcttatttgatttactatctctgttgggcatattagctcattttctgattagtttaatcaacaagtgaatcatgacgacaatgctaataataataatttcaatgtaagctaatgatccaaacgcttactaaagcatagaacatgtatatctatgataatgacaagtacaatcaatgcatgtgatagtatttacttcccattatcacagatagtaagcataaataacggat

SEQ ID NO: 3659 - DNA, 1058 bp, Triticum aestivum
  Clone ID: PAT_TA_3659
ccggccgcccccgctcgcgccgtggccccttggacctgcgggctccgcagccccggtcggagggggctcatctaggtttcggctcccgcttcttgtcgtgcttcgtgtgaagggggactgggtcctcccaataacagtttatgcaccgccaatgcgtggaccacccactcttggtcgtggcgctggatcgccgaggtgtctagaggtatctataaccttggaaacatcagaaacaattaatcctcgtgtaatacacccttcacgaagggtctcaccgaccataaccaaggtactccccgtgcagcttgaagttgttgcagttcttcacctgacacgttttctcttctcaattcccatcgatggaccaatgtcatttgctacctcaaaagtttctgtacagtggtcccttagatttgagttcttcacaactccggcaggaatggactcatcacggtatgagcacccgcttcttgttgagtaaagagaggtgggggactcgatcctcccactaactgtttatgcaccgccactgcgtagacgagctactcatggaagaaacgatagatctgcattggttggaaatcttctcagctcttgaaggcccacaagttgctgctatcatttgtaaatcggtatccgtggaccttcggtgaactatctgtagtccggcatgcacaactgggccagttcatatgtgtaaaatacctagaaggttttgaagaagactgagtgaggggaaacttgggctacagaaatagtctgcttctgtctgatgtatagtccatcaccattgaacagagcaggaaccgtggaacttgatttacgtgatgcggacatcagtcgtgcaaggtaccataccataccgaccgttagcgcacccaatgtatatgtttttaccaatggactagctttttggggtgcttgattaagcgattacacccttgcggttggttacatatacttgggatatcctccttgtaactgttttctggaaaccatacatgattgcacgctagttgtccggactacacacgtattgttccctcgaggctgccctg

SEQ ID NO: 3660 - DNA, 3386 bp, Triticum aestivum
  Clone ID: PAT_TA_3660
gccgtttgcccgacgaatggcaccgtgccacgcccacggccctcctccgcctccgcccccgcctcgcccgcgcgcggagcacgagacacgccacgcgctggcccccggccaccgccaccgccaccagtccaccaccaccagtccaccaccaccactcttcagccccactccactccccgccgctttccggcccgccgcccgcttcaagctcccctcgccccaccagtcgccctgcctctccctattccccatggcgtgctccgcggcggcgggcgtcgaggcgaccgccctcctgtccccgcgctgccccgccccttccccgcccgacggccgctcccgccgccgcctcgccctcgcttcccgcacgcgccaccgcagcctcagggcggccgcgcagcgccctcacaagagcgcaaccggcgccgaccccctttataacaacagggccaatgtgcggagcgacgaggcgtcggtttccgctgaaaaagaacggcaaaggaaatacaacgatggagatggcatatcaaaccttaagctggaagatttggtaggaatgatacagaacaccgagaagaatatacttcttttgaatcaagcccgtcttcaggcaatggaacacgctgataaagttcttaaagaaaaggaagccttgcagagaaagataaacattttagagacgaggttgtcagaaacagatgaacaacataagctttcaagtgaagggaatttcagtgactctccactagcattggagcttggtattctaaaggaagagaacattctactgaaggaggacatagaatttttcaaaacaaagcttatagaggttgccgagatagaggagggtatattcaaattggagaaggagcatgctcttttagatgcttcccttagggagctggagtctaggtttatagccgcccaagcagatacgatgaaacttggtcctagggatgcctggtgggagaaagtagaaaaattggaagacttgcttgagaccacagcaaaccaagtagagcatgctgctgtgatattggaccacaatcatgatctgcaggataggcttgacaatttagaggcatcactgcaagcagcaaatatttcaaagttctcttgttctcttgttgatcttttgcagcaaaaggtcaaattggtagaagaccgcttccaagcatgtaacagcgaaatgcattctcagattgaactgtacgagcattcaatagtggaatttcatgatactcttagcaaactaatagaggaaagtgagaaaagatcactggagaattttacaggaaacatgccttcggaactatggagcaaaatttcccttttaattgatggatggttactggagaagaaaatatcttacaatgacgcaagtatgttgcgagaaatggttcagaaaagggacagtcgtcttcgggaagcatacttgtcatacagaggtaccgaaaacagggaagttatggacaatttacttaagatggcattaccaggaaccagttctggtttgcacatcgctcacatagcagcagagatggctcctgtcgcgaaggttggtggcctggcagatgtgatatctggtcttgggaaggcacttcagaaaaaaggccatctagtagagatcattcttcccaaatacgactgcatgcaggttgaccaagttagcaatctaaaggttttagatgttcttgtgcagtcctactttgaaggaaatatgttcaacaacaaaatttggaccgggactgttgaaggcctacccgtgtactttattgagccacagcatccagcgatgttcttttcgagggctcagtactatggagagcatgatgacttcaaacgtttttcatacttcagccgtgcggcactagaattactttatcaatctgggaagaaagttgatataatccactgccatgactggcaaactgcatttgttgcacctctttattgggatgtatatgcaaatctaggcttcaactcagctagaatttgcttcacctgtcataattttgaataccaaggaactgctccagctcgtgatttagcatggtgtggtcttgatgttgagcacctagacagaccagacaggatgcgggacaattcgcatggcagaataaatgctgttaagggagcagttgtgtattcaaacatcgtgacaactgtctcgccaacatatgcactagaggttcgctcagagggtgggcgtggactccaagatacacttaaagtacattccaggaaatttcttgggatacttaatggaatcgacacagatacatggaacccttgcacagataggtatctcaaggtccagtataatgctaaggatctccagggaaaggcagccaacaaagcagccctcagagagcaactaaacctggcttctgcatatccttcacaaccactggttggttgcattaccaggctggttgctcagaagggtgtacatcttatcaggcatgcaatatacaaaacagctgaattaggaggacagtttgtccttctgggttcaagtccagtaccagaaattcagagggagtttgaaggtattgcagaccattttcagaacaacaacaatatccggctgattttgaagtatgatgatgcgctgtctcattgcatatatgctgcgtctgacatgttcattgttccctctatatttgagccatgtggcctcactcagatgatagccatgagatatggttctgtgccaatcgttcggaaaactggtgggctgaatgacagtgtctttgacttcgatgacgaaacaatacccatggaggtgcggaacggctttacatttgtcaaggccgacgagcagggcctaagcagcgcgatggagagggcgttcaactgctacacgaggaagcccgaggtgtggaaacagcttgtgcagaaagacatgacgatcgatttcagctgggacacctcggcttcgcagtacgaggacatctaccagaaggcggtggctcgagcgagggcagtggcgtgagcacacacacacacggtagttggttccctgatgcctctctcccctgccctgccctcatgatacaaacggcactggacgaaatcgagggatcatggaaacagaatcatatagcaagctccatgctctcggcgcgcatttccggtaagggtgtgacggtgtatcgctggttatatgcgctgtttattgaaggcagaacgcgagctaaaaatggagtagctaccgtgaaccctcaagatcgtagtatgcgcgctgttgttggcataatattggtgtaaattgtagtaggctgtatattttcttgaggggttgcaacggagctgtatgcgtgcagtgcaggctgcagagtcgcacgtatgtactgtattatgcagaaaaaaaaaaaaaaaaaaaa

SEQ ID NO: 3661 - DNA, 664 bp, Triticum aestivum
  Clone ID: PAT_TA_3661
atcacgcaacgcaacagccttaacaaaaatagcagttgattgaagcagggtccatccatgccatggcgaacctcgagtcgttagcctcacttgccgccatcctcatcctcgtcctcgtcgaagtcgctgtcctgtcctcgttcgcggccgcgcagctgcggccggactactacgccaacgtctgccccaacctggagggcattgtccggtactccgtgaagcagtccatggtcaagtcccccatctccgcgcccgccaccctcaggctcttcttccacgactgcgccgtcatgggctgtgacgcatcggtcatgatcatcagcccgactgggcgacgacgagtggcggaaccaggacgactattcgctgaagccggagggcttccagacgatcctggatgccaaggctgccgtggacagcgacctgcagtgccgctataaggtgtcctgcgccgacataatcgccctcgccgcaagagagtccgtctcccagagcggagggcccaactacacagtggagctcggcaggtacgatgggaagatctcgacggacggacagcgtcaggctgccgcaccccggcgacaacctcgacagcctcaatgcctacttctcaaccttgggcctctcccagactgacatgatcgccctatcaggtggccacacc

SEQ ID NO: 3662 - DNA, 827 bp, Triticum aestivum
  Clone ID: PAT_TA_3662
tcggcacgaggctcactttccccaatcagccaccatggcgtcttccaagtctctcgtcctgctggtcccctccgattcctcctccgctcgctgacaccgggtactcccctgctctcggccgtggatgaatccccgcgaggacgccgcctagtgcgcgcctccggccacgccggttgctgctggaccccccgacgccgctgcccgcccccccccctcccctggacggctaggtcgctaaggcctactgtgcttcgtcggccgtcagccggctctatccgtcgagcagtgctgcttcagctcaacgcacatgcctgcctccctagaatgccggcggtgcaggctgcaccgtaaccagctcgttttaccactagatctgtggggcgccggcggcagcaggcagctgtagcccccgctccctgaccagcatgaccattaacagcggatgcagaggacaagctcgaggacggcgattcagaggagcagccaagatctcaagcatgaagttcatttactatgaagctgggttcagttgccccacttattgctgtcaacttcacattggacatcacaagccactcagaccgccagtcgccggcaagatggcgatgaccacacacgatcgatggtggtgtgctgtccttgtgaggttggccaagttctcctcctacggcgatgtattccgtcccctgcccgtggccagcgatcgccgccacccggtgcgatctgcgggttgaacgcaccatgcggccaacaaaatcctgttatataggcaatggaaaaaggcaggaggtgagtcgcagaaagaaaaattggcgccaatgtggttg

SEQ ID NO: 3663 - DNA, 1600 bp, Triticum aestivum
  unsure (1)..(1600): unsure at all n locations
  Clone ID: PAT_TA_3663
gcccccttcctggtggtgtatgcgcccccgccgagcttcgggctcctgcgttgaagaggccgtcgtttcgccgtgatcgtctagccgcggttaagggcgcggttcccggccgcgctggtgcgcgcgcatcggagccacttgagctgcttgcgtcgttcttcggtgctggcttggcccgtgctccgggcttgcctggtccggtccagagtgcgtttgggacccgcgctgcgcccgctgctcctcagcgtcctgacgtcggggagggtgtctggctggggttccctgcggcttttgctggatccgttgtcgacggcgcatcctcccggctggaggcctgcctggcttgtagcggttctggttcaaaggttggctcaaagccaaaaatgtgctccacatgtggtgggcgagggcaagtaatgcgaaccgagcagacaccatttggtctcttctcccaggtttctagttgccccacttgtgtaggagagggtgaggtcatttcagagtattgcaggaaatgctctggagaggggcgtgttcgtgtcagaaaagagatcaaagtaaaaatccctccaggagttagtaaaggtagcactcttcgtgtacgtggtgaaggtgatgcaggaccgaaaggagggcctcctggagatctttttgtctgccttgatgtagaggagccatccgatattaaaagggatggtatcaacttgtattcaactgtgtcgataagctacattgaagctattttgggtacagttcaaaaggtcagaactgttgagggaagtagtgaacttcgaatacctccaggcacccaacctggtgatgtattggtcctagcgaagcaaggtgttccatcgttgaataggccatctatacgcggtgatcatctattcactgttaaggtctctatacccaaacgtataagtgggcgcgaaaaggagttgcttgaggaacttgcatcgttgaaaaatggtggttttgcccgtgcacctgtgaagccaaaacctgtacataaagagaatggaagccgcgctgctccagaagtatcagatcaacctgatgatggggagggtgactggttgaagaaactttctgattttgctggatccattgtcaatggggcatccaagtggctgaaagacaacctgtagcctgcaaatatttattgcacgacgcattctcttcaacaccagccatggtgttatccaatctgcaattcttcaattcatcgggattcgacgagctgttgcatgcatgtgttctgttgaagaggctcatcttttacggcctgtgggctgtgaagtggcaacgcagaggtttagtgtcaactaattttattgacgccgtttttattttgttttgagagggatatccttgtaaagcatgaattttgctgtagtcgcactcgtatttcctagagcatgtaacagtcggccgcagatattgaaatagatgaagctacatcctctgtaaatacatatatatctttttctggtagatcatctcagtacaacatcaggctgtgcaagtgattgtttttgttgcctcaaattcagaataaacggggcactcgtctcctcattccncaagtgcaatttttttg

SEQ ID NO: 3664 - DNA, 872 bp, Triticum aestivum
  Clone ID: PAT_TA_3664
aatgtcttctcaggcacatctggtggagttgctttaactgctgctggtggattaaggaaaattggattgggagatacctacgagagtccttcactgattggcgtccatcacgagggaaaattttacgagtttgtgccttggactgggacagtaagctgggacattgctccttggggtcactggaggatgtctggcgagaacaaaaatcatctggtagaaatagaagcaaccaccaaagaaccggggactgctttgcgagccccaacaatggaggctggattggtaccagcatgcaaagacacctgttatggagatctcaagctgcaaatgtgggaaaagaaatacgatgggagcaaagggaagataatacttgacacgacaagcaacatggcagcggtggaagttgggggaggtccctggttcaacgggtggaaaggcacgactgcttcgcctgagcttgtgaataacatcgttggtactcagatcgacgtggagagcctgttcccaattccatttctcaagccccctggtctgtaggtttattcagaggaactgtgaagaaattgaagccagtgtaggttcttttggctttagttctgcaatcaactggccctgttcttctctctgaaaagaaaagaaaaaaaaacttgccctgttctgagcatgttggctcagcagttggtgatgcatacagattaagttcccaatggctcagaaaagcgccactccatcacctcttggcttagtttccatgttaccgaagatgaaccctgtttaaggtggaattgtatttttcttttgaacaggggaatgcccgcagttctaacacggcccccctacaaagtgcttagtaaaataaaccaagttttttt

SEQ ID NO: 3665 - DNA, 1132 bp, Triticum aestivum
  Clone ID: PAT_TA_3665
cggctcgacgttcaggggacgatatctatctgggtgacctcgtgttcgagccaccgagagacggccctaccatgtgggagttcggaatacccgataggtctgctccccagttccacgttccagcccccaaccccaactaggtcatcagactcttcatcgagcatcctggcgggtgaaagaaacctttgcgtccagcacttaatcatgcagctgtttctaatcattcggtgttacatacagcttcaggcagtatgggctttgggggagatacgcagagctctatccggaccgtgatctggtgtacaccaccggcgaaagcatctacagcactgattggttctacgcgcaagttaccggctgatctctgtctgttgttggcgcactcagagatcatacaactaccctaaaatagggatatcacaccagtccttttgcactaacatctcgcctgatccgtccctgtctcagctgcagggcgtatggactttgggggaggcacgccagcccacctcatggccgagaagggtcagcctcgacgccgtccctcccaacagcacgtacaagttccgggtggcgctcgcgtcttcagccaacgctgaactgcaggtttctgaattgaattttcagaaccaaccccaacgtttcgttcgctgatgctcatgttgttctctttcttatcatggtcatcatcgccatcctgttgcatgcatttccaggtccgtttcaacgacgaggcacgggctgtgcctcacttcaccacggggctcatcgggcgcgacaacgcgatcgcgaggcacgggatccatggcctctactggctcttcaacgtgggtgtgagtggagcctggcttgtccgagggatcaacaccatctatctgaagcagcccaggaaccagagcccgttccagggggtcatgtacgactacctgcgtctggaaggaccctgtgctgtgcctgccgctaactcaggcccaaaagctaattgattaatcagcctgccttagccgtattgtatttgtgtaagtgacacctagctagctagtacagctgtaatgtatatgattcagcagagcatccatgtcctaattaataccacgtcatgcataatctgtaaaaaaaaaaaaaaaaaaaa

SEQ ID NO: 3666 - DNA, 693 bp, Triticum aestivum
  unsure (1)..(693): unsure at all n locations
  Clone ID: PAT_TA_3666
gcgaggcgtgcgggaggcgtgtgcgaggcctacgcgagttccacactctcgcggacgcattgaggtgtaggggggcgctcccgcgctgtggtgccacgggcgcagcgctccgcctgctgcttccgcggccacccggccgggcgcggtgagcggccgcggcggggttgcgcgtcccccggcgctgcttggggaggggcgctggtcagggtcttcctgcggtgcagcgtagcactcggagcttagttccccgggcgaacgtccctcttctgcgcaggaatttactgcaggtctgatcccttgctccgtgctctctgcttgtcctcactccgtagacctttcctttgctccgtagccatacatttttattcaagagtgctgtcaagacgcatctcctctgcctatatggcgggcagagggcctaagctccagctgagcccctccccctccctgctattgttcccttctgtgtgttcttgccgtgggcagtctctgcatgctggggccaagacgaaattaactgaggagtgaataagtnaaggtatatccacaatcattgttgggttaagntataacaacatgctacangattgaatcgtctttagtcacctaaancttggtctaaggctnacttctggggnnaaacaaatatcaaggttaagcgcgacttatntngtatcttgtttgttaagccca

SEQ ID NO: 3667 - DNA, 1319 bp, Triticum aestivum
  unsure (1)..(1319): unsure at all n locations
  Clone ID: PAT_TA_3667
ttcgagcggccgcccgggcaggtacactgaagatgatgggcactgccgaaattgaagctgaaccctgcaacacaagttcagaagtggtgacaccgccggaagcaggagtacaagagggcgggtcccacaagtcagccagacttcatgccccctctaagcgatacgctggcaatgactgggtccggtattacacagtggtccacaacggtgtaagtatcaagtgtgtgcatgtttggtatgtaaactatcgtccagtctattttaaaccctgaatttgtacctcggccgcgaccacgctagtctctgctttcatccaaatttccttcacaacgttgttcctcccattaaccatacgaaattagcacccagaatgcatccgcggggaaaacaacatgcggggcagcgattggtgtgctctcgccgtcaggacaccaccagaaagcgcagaagtggagggcaacatctagagttaagaaaggcatacatcggaacatgccgcggaaattcatcaaaagtcgcaaggcacgtccgaagttgcaggtgtgtcctctggctctaattaagtgatgacatgaccgccggaagcgtgacaatctgcgggcgggtaccgaaagccagagaaagaacttgcccagcatgttcgttaaccaaggcaagttcgggttccggaaacataccgtgcccctcaactttctaagtggaggcatatttgcgaagtagcattaaaatgcttccaggttcccttatctttagggccgcatctggcctcgataatgtaaaacttaaatcaagttggtactgcaaattggtagcgtggggttcaacaaactccgacgctaaacctataggaagacgtgcggacaggcatacaaccattatccaaatctgtggtggttgacggggagcgaaggcctacaataacccagattgttcatgaactaagtaagagtggtattgctgaaagtccacctatgagccaggcaaacaagctgactgcaacgccattgggagaaacatcgagatcatgccctggccaagcgtgcagaaagctgaacgtgccgaagaggaacttaaaactgaagctgaagaagaacgtaaaactgaagctgaagacgaacgtaaactgaagatgaagggcgctgtaactgctgagccgcaccctgccccgcgtgcgcacgcggggcggcgccgccggggccaggagaaaagaaggcgggccccgcaagccggactttacgccgcctccaagcaatatgctggcaatgactgggtccgatattagacagtggcccacaattgtaagtgtgcgcgtgnttggt

SEQ ID NO: 3668 - DNA, 1356 bp, Triticum aestivum
  Clone ID: PAT_TA_3668
gcacgagggccctccgcctcgcgccgcctctcctctcccctcccctcccctcggcggtgccgggccttccgcggcgccgcgggcggcaggcaggcaggaatatggcgggcaagtccaagggtgcgaggaacaaggccaaggcgcaggccgccagccaggaggccgtctcggtggagccggtcgctgatgtggcggaggaggccaagccccagaacggggaagtgaccgaggcccctgctgccgaggtcgcccctgctgctgaggttgctgcggcggacgtggagaaggaggagggggatgtggccgaggccgcacaggctgcagagaagccagctgaaggagagcttcatctataccctgtttctgttaagacgcaatcaggtgaaaagctggagctgcagctaagccctggagattccgtcattgatgtcaaacaattcctcttggacgctcctgaaacttgcttctacacgtgctatgatttgatattgcatactaaagatggttcaacacaccagttagaggactacaatgaaatttctgagattgcagatataactgctggtggctgttcgttggagatggttgctgcaacatatgatgagaggtctattaggtcgcatctccgccgtgtccgggaattgctctctctttctagtcttcatgtcttactatcgacatccctagctctgcagcaggagtctgcacaggccaaaaatgcagatgcaggaaaaactcgcgtccgggagcttgatggtttgaatttcatggaggatactactgtagctcttactaatttgctggcatctgcaccggcagaaatcaaatgtgtggacagcatagttttttcatcattcaatcctccaccgagttataggaggttacatggggatctcatctatattgatgttgtgacattagaaggaagcaaacactgcatcacagggagctccaaatctttttatgtgaatgctagcaatggcgtgggtctggattcaagacctttgaaacaatctcacgaagccagcactttagttggcctgctacaaaaaattagcgccaagtttaagaaaggctttcgcgaaatattggaccgcaaagcatcggcccatccttttgagaatgttcaggccttgcttccagtgacttcttggttgggagctcaccccgtgccagaacatagaagagatgcagccagggctgaggattctgttgtgctgtcatatggtaccgagttgattgggatgcagagagactggaatgaggaactgcagtcatgccgagagtttcctcatgccaatcctcaagaaagaatattgcgaggcagagcactctataaagtgacatgtgattttg

SEQ ID NO: 3669 - DNA, 726 bp, Triticum aestivum
  Clone ID: PAT_TA_3669
ccctgaccaatgccaagaacaagaagagatcagtgagaagggcaggcgaaaatccccaccgggcgagaggagaggagacgagaccagctccagcctcctccaagaacaagaacaagaaggaatcccggagcacgagggaataaagcggccggagaccggaaaggccgaggagaaaaaagcccccttttccgcggaccctcccggccggcgcagtgatcatcacgagcccgcagccgcctccaatccaatcccccaaaagagcaaagcagagcgagatttgctcgatctgtgcttgattcctttcctttttgctgctgttgcggggatagctttgttttcttcttcttcttcttcttttaactgccgccgttgttgagaagctcttgattgacggagaaggggatggatccggcgctgctggacaacatcatcgccaggctgctggaggtgaagagcctcaagcccgggaagaacgcgcagctgtccgagtcggagatcaagcagctctgcgccgcctccaaggagatcttcctcgcgcagcccaacctcctggagctcgaggcccccatcaaaatctgcggtgatgtccatggccaatattctgatctcctgaggctctttgaatatggtggatatcctcctcagtcgaactatcttttcttgggcgattacgtggaccgaggaaagcagagccttgagacaatatgcctttttttggcttataag

SEQ ID NO: 3670 - DNA, 1020 bp, Triticum aestivum
  Clone ID: PAT_TA_3670
gcatctccgtgataatcaactttatccaaaactgctggatcttgctgataggctggcaaaaatgtgggaagatatgcacatgcatcatgcgaaccagctgaaaactgtgttggatctcaagtcagttgacatttctgattccagcatcgaaacaagtgcgcatcaccacagccacacgcgtcagctgcatgatattgtagacaagtggaacacaaactttagtgatctcatgagctatcagaaggagtacataaatgctctctacagctggttgaaattgaaccttatacctatagagagcagcttaaaggagaaagtagcatcgccaccaagggtgcagcaacctcctgtgaaggctctcctccaagcatggaatgagcaactagccaagctgcccgatgaccttgccaggcatgccatcgttagcttccgggcggtcctggaaaccatactaggtgttcaagacgaaggagttgaagaaaaaggaggcctgtgaaccaatccacaaggaatacgtgcgcaaggctcgggcgtttgaggagtggtatcacaaacatggacagcgcaggacatttgatgacccggagagcggtgaggggacaagccagaaggatgcgatctcggagaagagatttgccgtggaaagcttgaaaagcaagctggataacgaggtcgaggcccataacaagctgtcgaagcaagttcgggagaaatccctttcgatcctgagggcgcacctgccggagctgttccgtgccctgaccgacttctcccatgctactgccgaaatgcactcgaagctgagactgaatgcactcatgcaggatcaaggtagtggtaacaactagatgaagaacatgtacaggagttgttagggtgctagctaaaacccccgccagaatgttgtaatgcttgtattgtctgcctagccttttttgcggtatgtgtagtagtatgtcttgagatgtggacagttaggcattgtagccgttttgttattcatttggatcctcgtggagt

SEQ ID NO: 3671 - DNA, 2758 bp, Triticum aestivum
  Clone ID: PAT_TA_3671
cgtccgaaacaatgctgctgttgaggttctggagaaaactaaagctgctgttacccatttgcatacaagatacatagttgatatgcaatcagatggattcaactgtctcagagattcagcatctccgtgataatcaactttatccaaaccttcgtgggctgagtgggggcaaaaatgtgggaagatatgcacatgcatcatgcaaatcagctgaaaactgtgttggatctcaagtcggttgacatttctgattccagcattgaaacaagtgcgcatcaccacagccacacgcgtcagctgcatgatattgtagacaagtggaacacaaactttagtgatctcatgagctatcagaaggagtacataaatgctctctacagctggttgaaattgaaccttatacctatagagagcagcttaaaggagaaagtagcatcgccaccaagggtgcagcaacctcctgtgaaggctctcctccaagcatggaatgagcaactagccaagctgccggatgatcttgccaggcatgccatcgttagcgtccgcgccaaaggctcctggacagtccaagaagaagaagggcaaggggaaggggaaggggaagaataagtctgtgcaccaccagcacactgagtccgcgccgccggtcacggtggtcggtggctgggggaaggcggggaaggttgtccccgccgaggtgccacgcgtagacctgctgcaggtgcttgcggagatcgacgataggttcttgaaggcgtcagagagcgccggggaggtttccaaggcgctggaggcgaacaggatgcactaccattccaatttcgccgacactagagggcatattgatcattctgcgagagttatgaaaataataacatggaatagatccttcagaagcatgcaaaatggtgatgatgggaaggcccacatccccacaccaccggcagaagagaggaagagagagagagggagaggggggaggggagaccctgaccaatgccaagaacaagaagagatcagtgaggggggcaggcgaaaatccccaccgggcgagaggagacgagctccggccccctccaagaacaagaacgaagacgaatccgggagcgggaacgagggaataaagcggccggaggagaccggaaaggccgaggagaaaaaagctcctagatgatggagaaggggatggatccggcgctgctggacaacatcatcgccaggctgctggaggtgaagagcctcaagcccgggaagaacgcgcagctgtccgagtcggagatcaagcagctctgcgccgcctccaaggagatcttcctcgcgcagcccaacctcctggagctcgaggcccccatcaaaatctgcggtgatgtccatggccaatattctgatctcctgaggctctttgaatatggtggatatcctcctcagtccaactatcttttcttgggcgattacgtggaccgaggaaagcagagccttgagacaatatgccttcttttggcttataaggtcaagtaacctgagaacttctttcttctaagggggacccatgaatgtgcatcaagtaaaccgcatctatgggttctatgatgagtgcaagcgcagattcagtgtaaaactctggaaaacatttacaagactgttttaactgcttaccggtatcatgcgttgatagatgaaaagattctatgtatgcatggaggtcttttcccagaggtgaacaagctggaggtcaatactcatccccaaacgcccgacagatgtggcggaaacgggtttactgtgtgatcttctttggtccgatcgttcgaaggaaacgcaagggtgtgctatgaaagatcgaggagtttcgtatacatcttgacctgacacattgggtggatttcttgagaagcatgcgattgatctcatgtgccgggcccattaggttacaagatgatggctacgtaattctttgtggatcattagcttgatacaatgtgttcggcgcataattactgtggagaattcgataatgctgctgccatgatgagtgtagacgagacgctgatgttctcctaccaaatactcaatccggcaagaaaaatgttacctggttcagataatgacaagtctggattcaagtcaatgagaggatggtgacgggggcacggcgattggtgagcaagctgtggtcacatctgcaggcaggcacgtgcctaccacgagcggctgcgactaaccggcgttttcgccgatgcctcgagcccggaccggaacaaaaacgcagattgtacaactctctcggtcgatggactgtacatctgttcatgtcgggattaacacttgttgtaatgtattattgtttttctaccgtgcggatctctttatcagtacgagaggacgatgtgaatgaaactgttgctcctccttcaacccctctaaataatgaagttcatggcaagcagatacgcccaattaaaactagaaagagaccaagggagtgagaccggcggtcgtccctgccccgtgccaagaccgacttttcccatgatactgccgatatgcattcaaagctgagactgaatgcactcatgcaggatcaaggtagtggtaacaactagatcaagaacatgtacaggagttgttagggtgctagctaaaacccccgtcagaatattgtaatgcctgtattgtctccctagccttttttttcggtatgtgtaaaagtatctcttaagatgggaacagttaggcattgtacccgttttgttattcc

SEQ ID NO: 3672 - DNA, 557 bp, Triticum aestivum
  Clone ID: PAT_TA_3672
agtgacaaacatccgcttctaccttcacaacacccatagtgtgaatgatccatcctcggtccttgtcgccgaaaacaagaatgccacggctcatgctcatggcttagtgccctttagctccgtctacgtgtttgatgacgtgctcaccgaggggcctgcgagtacttctaaggtgattgggaatgcacagggtatgtacgttgaaacggggaaagatgggtacacgatattggaaactattgattgtgagatgacagatggtccgttcaaaggcagctcgttcgtgatgttctcaagaaatcaattcagtaaaccaagcagagagctccccgttattggaggccgtggtgcatttcgaatggccaaaggatacggcttgctcaggaccgtatgcattaactgcatcaactctgtgaacccgtccaagggagatatcatcgagtataatgtgactctatatcttcattgagtttatatatggttgccatgtgttccttgtagcgataataacattaatggatgattgagtttcctaaaaaaaaaaaaaaaaaaaaaaa

SEQ ID NO: 3673 - DNA, 1088 bp, Triticum aestivum
  Clone ID: PAT_TA_3673
gcccaaattaaactccactctcgagtccgccgccgccgccgccggagttccgctccccccccccccgccgcccccgccgccgcccgcccggtcgccgcctcccctcatccccgaaggccgcccgcggtgctcgcatttgcctcaaagctgcaagactgagtgagggagatcactcaaggcaatagtgtggacagccatggacatgggggcaattttgagaagcgccactcgtcttcttgagatggccgggggcacccacccacatcctgatgctctgggacgcctccgacgggtgctgggcgccactgcggcacattgcatctctaaccccatcttcaccgattctttcaaacagatgttggacaacttcgttggcaatttcagcaatgacaccagggaaggtggacaatctcaccgctcgcctccaggccaccgcgcagccctgaaggccaccataaaggcctccgccacggtgtctcccccactgcccagctcgccggccttcatggaaatgatctattccgtgcacttatggccctgcagctgcccgtgaccgcgcctccggaattctgccttgaggccactctcgccgcgcagagcctcatcgtgcacgaccacctcgaccttttcatccacctctgtggggtcgccacctgcagcggcgtcggtacggcggtcagggtgtgcttcttcatggtcttcatggaccacataaataccttggagaagttcatgcaagagcacattgacctcgccgacgccgctgccacttcacgtgcaaccactggccaagcgaagtaaaagcttgatcgccatagttaagctagctagctgcaagtaagacgaagatgggccaggagggtcattgattgatccttatctggcttccgtgtgtactttggtggatctcgttatcgagccaagaacaaaaaccactacttatgtatgtattatgctacttgtcagcgatcgggtgtcataagtactagtaatggttttgatcaaactgcaacctatgcacttggcctgctataattaagtttgtacaatggaattgcttggccccaaaaaaaaaaaaaaaaaaaaaa

SEQ ID NO: 3674 - DNA, 650 bp, Triticum aestivum
  Clone ID: PAT_TA_3674
tcggcacgagggccgcccccgaccctgcccgtggatttgctcgcgtcgccgcctctcccaccccggcatcccatcccttggccgtcctctagtcctgcgtgctgccccgtcatccgcgcccgaggagctgctgccccgtctgcagccaaggcgccgccgccgttctggagtccactgcctaggagctggcgaggaggcaactgcagttctggagtcgccccgccgttcttcttcctccaccagcgacccctgtccagatcgacacccttgtcctgccccgactccaggccactgcagggccggccctggggggggccagggggggcggccgccccccgccccccgaaccctcgggggccccgctcggtgcgctcttggcctgtgcctcctgctgggccggcgcgccccccggcgccgctgcccgtgctcccgctccctgcgcgtcagggtgtgcttgcgtccgctctgcgggagctcccggcacatatgcaacgagcgatcggtgagctgcatcggggtctcccttcccatgctgtccgacctgtccatctgccagagtcacgcatccattcctggccccgcccttcctgccgccggccggcgccgccgggcccgcgcccgcgcgctcccgcccgggtgcctcgcactcc

SEQ ID NO: 3675 - DNA, 614 bp, Triticum aestivum
  Clone ID: PAT_TA_3675
gccgcctccttcacgtcctggacattgccgtgcgcgggcgccgccgtggcgtcactgtccgagcccccctgccccttgcgggatcttctggaggagtacgcggcggcggtgcggcggatggcgtgcggcgtgctggagctgatggcggaggggctgggggtcgcgccggcggacgcgctgtcgcggctggtgtcggacgcggagagcgacagcatggtccgggtgaaccactacccgccccggccggagctgcagggccgcctcctgacggggttcggcgagcacacggacccgcaggtcatctccgtgctccgctccaacggcacgtccgggctggagatctgcgcgcgcgacggctcctggaccgccgtgccgcccgacgccgactccttcttcgtcaacgtcggcgacgccctgcaggtgttgacgaacgggaggttcaggagcgtgaggcacagggtggtggtgagcagcgagaggccgagggttgtccacgatctttcttcgggggcccgccgttcggcgaagagggctgggcgccgctgcgccaagctgctaagggtcctggcgggcccggaagccccctacaggggagttcaacctggaaggggtta

SEQ ID NO: 3676 - DNA, 1132 bp, Triticum aestivum
  unsure (1)..(1132): unsure at all n locations
  Clone ID: PAT_TA_3676
ggagtcggggacgcggggatgtcttctctcagccgggagctcgtcttcctcatcctgcagttcctcgatgaggagaagttcaaggagaccgtccacaagcttgagcaggagtctggcttctacttcaacatgaagtacttcgaggatgaggtgatcaatggcaattgggatgaggtggagcgctacctcgggggcttcaccaaagtcgacgacaaccgctactcgatgaagatattctttgagatccgcaagcagaagtatctcgaggccctcgacaagcatgatcggtccaaggcggttgaaatcttggtcaaggacttgaaggtgtttgcatcctttaatgaggagctgtttaaggagatcacacagctattgactctggagaacttcagggagaatgagcagctctccaagtatggtgatacaaaatctgcaagagcaataatgcttgttgagctgaagaagctgatcgaagctaaccccttattccgtgacaagcttcagtttcccaatctgaagagttctagattacggacacttatcaatcagagcttaaactggcagcaccagctttgcaaaaatcccaggcctaatcctgacatcaagaccctctttgttgatcattcttgtggacaaccaaatggtgcacgtgctccatcaccagcaaacaaggcaacacttggagctatacccacatggtggggcccgcgnaaangacanngcanncgcccatccaaagaagcagcncngnataannaccngnggagacganaagacganaaaggggngggaggccaccagnggaacaaaacaannaaccnnngaagggcangaagcnccngncnatncngnnngnccacannacaaggaaaananncagnncancnnnncaactgctnaagagggaaaganaaaggcanggctctatgataatcttgggtccagagttgactatgatgcaccaggtcattggtgcactncgatggcatatagtgcggatgggtcaagattattttcttgtgggaccagcaaggatggtgaatcacacctggtggaatggaatgagagtgaaggtgcggtgaaaagaacataccagggatttcgtaagcgatcgatgggtgttggacaattt

SEQ ID NO: 3677 - DNA, 3874 bp, Triticum aestivum
  Clone ID: PAT_TA_3677
cgtccgcccacgcgtcccgactgtaacaaagcctcttataaacccattgactgctgctgccgcggcagctgccgccccccccgctgcaaacagttctggaactgctgctagatcatctataactgcaatgaatggggacaacagaagcatggttgatgtaaaacctagtataactgatcagtccaggattatttcaaatgtctagaatcttatgaagataacttataaagctcagcgcggatcactaaaactaggtgatagtgttagaaaagcttttgtctcgtggcttatttacagcaatgttgatgttattgaattgttgttatctgcaaataaggggggaattcttccgccatggccgcatgattatccgagctccagggccaaccctcctgctcgagcttcttgttccgatcagccagcaagaagtgaacttcgagttagaagtgttacacctggcaatcgcttcgacgcttcatggcggtaggtggcattgaccaagatggacttcagtgttacaacttcgcttcacggagctggttccaagtgtagtgtcgtcaagagcacaataaaaaaccaaggcttaactgcagttcgtgtgttgcttatattatatgttgctattatattaccattattaagtgagggaggaattgattagtgccagtgtttgattttgttctgtctgtcttggtacgaggaaagataaccgagtagataagctctagtagcagttgcgctgtacctaatcagtacccttgtttcattccgactagtaagaaaaaacttgttttttcttgtttgtaacactgatgggtgggagaggcaaaggagcagatttttgcagataccgtctggccgcccaacgtccaacatcttagacacacgagttcagttccaccaagatcaacagcattgtcttgttgtccatgagacccagattgccatctatgatgcctcaaaactagaacccgtgaagcagtggcctcctcgggagacctctgctcctccaataacgcatgctacattctcatgtgatagtcaactgatttatgcaagctttctggacgccactgtctgcatatttagcgcatcaagtttgagactccaatgccgaattcttccagcttcttatcttcctcaaaatatcagttcaaatgttcatccagttgtggttgcggcacatccttcggaggcaaatcagtttgctctaggccttactgatggcagtgtttatgtcatggaaccgttggaatctgagagaaagtggggaattcctccaccagcggagaatggatcgacgagcaacatgtccacacctcctaatggagcttcgagttctgatcaaccagaaagataataactagaagtttgaagtgtttagacctttctatcacttcgactcttgatggtggtatgagtcactaaccaagatgggcttcacttttacaacttggcttcacagagctggttccaagggtggtgtcgacgagagcacaataaaaaaccaaggcttaaccgcagttcgtgtgttgcttatattatgtgttgctattatattaccattattaagtgagggaggaattgattagtgccagtgtttgtttttgttctgtttgtcgtggtacgaggaaagattaccaagtagataaggtctagtagcagtttggctgtacctaatcagtacccttatttcattccgactagtaagtaaaaacttgttttttcctcacacctggtggaatggaatgagagtgaaggtgcggtgaagagaacataccagggatttcgtaagcgatctatgggtgttgtacaattcgatacgacgcgaaataggtttttggctgctggagatgaattcgtgataaagatttgggacatggacaacactagtcttctgactaccattgaagctgatggtggcctacctgcaagcccgcgtatccgctttaacaaggagggtactctgttggcagtctctactgttgataatggtatcaaagtcttagcaaatgctgatggtgttcgtttattgcgcacactggaaaatcgttcttttgatgcttcacgtagtgcatctgagactgtaacaaagcctctaataaacccattgactgctgctgctgcggcagccgccgccgctgccgccgctgcaaccagttctggaactgctgctccatcacctataactgcaatgaacggggacaacagaagcatggttgatgtaaaacctagaatagctgatgagtcaatggataagtcaaaggtctggaagcttatggagataactgatacagctcagtgcagatcattaaaactaggtgatagtattaggacagctaagatctcgagactgatctacacaaattcaggtgttgctatcttggctttagcttcaaatgccgtccatctactgtggaaatggccacgtaatgaacgaaattcaactggaaaggctactgctagtgtttctcctcaattatggcaacctccaagtggcattctcatgactaatgacacaattgacaatagtcctgatgaggccgttcactgctttgctttgtcaaagaatgattcatatgtcatgtcagcttcaggagggaaaatctctctattcaacatgatgacttttaagacgatgacgacgtttatgcctccgccaccagcagctactttcctcgcattccatcctcaagataacaacataattgcaattggaatggatgattcaaccatccaaatttacaacgttcggattgatgaggtcaaaagtaaacttagagggcactctaagaaaattacaggtcttgccttttcaaatgtgttaaatgttttggtatcctctggagctgatgcacagatatgtgtttggaacactgatgggtgggagaggcaaaggagcagatttttgcagataccatctggtcgcccaacgtccaacatcttagacacacgagttcagttccaccaagatcaacagcattgtcttgttgtccatgagacccagattgccatctatgatgcctcaaaattagaacccgtgaagcagtggcctcctcgggagacatctgctcctccaataacgcatgctacattctcatgtgatagtcaactgatttatgcaagctttctagatgccactgtctgcatatttagcgcatcaagtttgagacttcaatgccgaattcttccagcttcttatcttcctcaaaatatcagttcaaatgttcatccagttgtggttgcggcacatccttcggaagcaaatcagtttgctctaggccttaccgatggcagcgtttatgtcatggaaccgttggaatctgagagaaagtggggaattcctccaccagcggagaatggatcgacgagcaacatgtccacacctcctaatggagcttcgagttctgatcaaccagaaagataataactagaagtttgaagtgttagacctttctatcacttcgactcttcatggtggtatgagtcactaaccaagatgggcttcacttttacaacttggcttcacagagctggttccaagggtggtgtcgacgggagcacaataaaaaccaaaaccaaggcttaaccgcagttccgcagttcgtgtgttgcttatattatatgttgctattatattaccattattaagtgagggaggaattgattagtgccagtgtttgattttgttctgtttgtcatggtacgaggaaagatcaccaagtagataaggtctctagtagcagtttggctgtacctaatcagtacccttatttcattccgactagtaagtaaaaacttgtttttccctcaaaaaaatgcacattgtttcagaaaaaaaaaaaaaaaagaaaaaaaaaagaaattttattat

SEQ ID NO: 3678 - DNA, 854 bp, Triticum aestivum
  Clone ID: PAT_TA_3678
gaggacgcgcaaccggcgaggaggatggccacggagcagagttgacgcgctcctcttcctccctctcatgtggaaaagaaaaagtaggacacgacgagcgcctctctgtctctctctcgcacgcgcggaaatggagatgtgagggggaaggtgctgcctcgccggtgccgccctggctcgccgcgccggcggtggctcgcgcaccggaactgagcgggcgggcgagagaggaatggacgagcgagagaggcgctgggggcggaatggcgttagaatttctgatggatcgattgggtcagagctttgatctggcgaaaacggcgccgaaccgtcggattgaaatggacgtttcggaaggttctaaaattcttaattgaaaatgagaacggagaacattcgccaatcacaaggaacgtagtctatgaagaaatcgcccgtcgtttatagtttcgttcttacatgcttatggttcctcatgtgcacaacgaaaaccaaccttcgacattcaaggagtgcttcgctgtcgtagattccagcatgacacgtctgatgccgtgggaggaaccagtgaagcctacgattgctaatgccatcttgaaggattacgctgaacggttagagatgtccaagcggacggacggagaagggatgttaacaatctgaagcttgccaaaattgaaatcggtgatgatgcggcatcaagcaagtccaacaagattgcttagacattatcgttgcatcgaggagatcaggtcgtattttgtagtttctcatgtgtaaaaatatctgtctttgacttctatgtcaagtatgttggttgtggtctactacctaaaaaaaaaaaaaaaaaaaaa

SEQ ID NO: 3679 - DNA, 917 bp, Triticum aestivum
  unsure (1)..(917): unsure at all n locations
  Clone ID: PAT_TA_3679
ttcggcacgaggctcatgcgcaaggnatacacttaccgaggacgagtcttcgttttacgttgcagagacaatattagcaattgaatccattcacaagcataactatattcatagggatatcaagcctgacaatttattgttagatcgaactggccatctgaagctttcagatttcggcctatgcaagcctctagatagtagcagcttcccaaatctcactgaccttgacagtgcagcgggaaatatcaccaatccatcggcagatggtgataagccattaagtagcgctgctgttcccaggcgaacacagcaggaacaactattgcattggcagaagaatcgccggatgttggcttattcaactgtcggtacacctgattacattgccccggaagtcctattgaagaagggatatggaatggaatgtgactggtggtcacttggggccattatgtatgagatgcttgtgggctacccaccattttattctgaagacccaatgtcaacatgtaggaagatagtaaattggagaagccatcttaaatttcctgaagaggccagactttcgccagaagctaaagatctaattaataagctattatgtaatgtggatcagagacttgggatgaaaggagcacatgagataaaggctcatccatggtttagaagcgttgaatgggaaaagctatatcagatggaagcagctttcatacctgaagttattgatgagttggacacacaaaacttcgagaattttgaggaggctgcgcctacaatgcaaacttcatcaaaggcaggtccttggagaaagatgctttcctccaaggacatgaattttgtgggttatacttacaagaacttcgaaatagttaacgatcctgaacttccaggaatagctgaattaaagaagaagaaca

SEQ ID NO: 3680 - DNA, 1604 bp, Triticum aestivum
  unsure (1)..(1604): unsure at all n locations
  Clone ID: PAT_TA_3680
aaacatttcaactgtaatctggaacaaaagtacataaatttgtccacaacatattatatcttttttgtactttgatcgtttcacatcacaagttccttgttggtaattgtgctgcatatgtttgctcgcgtacattgtttctcgttagaggtatgttcctgaagaagtcatgaagaatttcttggagatgattggcgtagggtaagcatggttgcgggaaaacggggagaattgagcaggtagcgtgtgttgagtataagtaatgggaacatgggagggttaattaatggactatgttagattaataatgttatcgttctttgaggtagtatattatgtttggatgtacgaccaggtccatctaaaaatactattagataagtcaaatatttgccagctagatggtgcaccggccgtagcatgttagtggccatcgaaatcaacttaaaaatattttagctgattatggtggttgctcatgtaccagctgcatctgtcctcgcactgctaccccactacgatataatcatgttcgagagtcctgaaacatagttaatttcaattactacatggcaaatgccagtgtattagttaacatgtggatctccctttcttgttaatttcgactgcactactctgatgctgttcctgagccagggcgacaagcaaagtgaattagcctcagttactgtatctagcacgtacgcgagcctttgttggaatttacatttgggcaagagcaaaggtctcgtcactgttgcatggtttctagtactgttgcttcataactctattggtttcttcatgtgaccacggagtaaatggatgatttagcaagtgagtagtttaacatattggggcaagggacagtgttgttatttaacgctctatgttagcttctagttttatccttgttgcggtaataaattatggtgggagttacctccatgcacttctttaattacttttaaatctgtattttgtgcaaacaagatgtgaaagaaatgctacccaagaatatgtactttataaacatttcaactgtaatctggaataaaattaaataaataaggaaacagtatattcatatatcttttttgtactttgatggtttcacaccacaagttcctagatggtaattgtgctgcatatgtctgctctcttactttgtttttctgaacaggtaggttccggaagatgtcatgaagaatttctttgagagaatttgcgtgagctgatctgtagcagtgcggaaggtgagcttggctgccggcagcagctcctttcgctgatctgcggcgatgcagaagttgggttggaaaaaagcacgaccggctgctctgaagtgggtcgtagggagagcttcgtaagagatagggagggagctctattggcccgtgcatgacatccaacccaatggcatcatgccctggtaggcatggttgcatggccacggggagaatggagcaagtagcgtgtgaggagtttaagaaatggggacaagggacaatttagttaattaagtctatgttagtttcaagttttatccttgttgcgttaaaaaattaaggtggataaccaccatgacatcttcaatactttna

SEQ ID NO: 3681 - DNA, 950 bp, Triticum aestivum
  Clone ID: PAT_TA_3681
ctcggagggagggagattcaaatttggcctccactggcttctgatgccagtaggcggcacgtggcatccaaggccgtcggcaaagaataggcgccaccagggccaaagagcatcgtccaaagacatgcagggcagctccatcaagttcttggaggccgcactcaccatcatacgcccctcctcgctcctcggcggcgagattcagatttggcttgcaatggcatacgatgcacataggcggcacaaggactccatagcgttgtacagagaacaggggagtgcccatcctccgatgagcatcagagaccaagaaactgaatgatggtgcggtgctgccgcgagccaaccgcagaccttcagccaagcgtcttcggcaacctcgtcacctcgggtgtccgccgggggactggatgcagtgcgcctgggcgattgtcacgatgtgggctgtagagaacgggaaagcatactatctgccggccgggaccccaccggcacggtcggcgaaggtcttcggcaccctgttcctcctggggcccccgcgcgggtggaaggaaagcgcctgggcggtcgtccccctgtcggccgtgcggatcggcacagcgttctgtctgcagagatgaacaactcctgcaagtcctgaagagaccattgacactttcatcctccatggtcgctcgcgcggaaaacagtgagattgcagcaagggatgtcctgagcctgcatcggcactgcaggcgttgaaggagaattgcatttgttattttaggtgtgctatccagggaagctatacatttccttaaaaagaaaaaaagaaagaaaagaggaaagctatacatattcccttgtgtactggcatagcccagaaaatactattttcccactgaatgtaaataccaattagagatgtaatctaacaaaaaatgcttatgggttcctaaaaaaaaaaaaaa

SEQ ID NO: 3682 - DNA, 886 bp, Triticum aestivum
  unsure (1)..(886): unsure at all n locations
  Clone ID: PAT_TA_3682
cttggctgttctctgcggccacgatgccggcggtgctccggcgtcgttcccctgcttgaagcggcttcgcaatccccccctcgccctcccttccgtcggtcccggggtgaaagccccaatcctcccggattgggtggtggacggcgctccggcgtcgtttttccttcttgaatacaccaccttggtgcgacggagtggttggtcgaggcccttggcatgggagtgtggctgccggatatcgtcagtggtgtccatgctcggccacttgcggtgatgttggcgccggcgcgcggcgttggcgatgctcggtggcgcggctgcctggtgcggtcgttgtgtttgtcgtcccctcccggcaacctgttggtcctggtcatgtgagctcaggggtgagcgactctgcctgtcgancggcgtagtgtcctccgatccaggactagagggcagggggctctcttcggaggtagagacgaatggcggaccggatggcttggcccaagggggatgacagagcgtgacaatcctcctgcagcgggatctaccttggctcagccgcggcgtgtgttggctcctgttcgccgagggcttcgatgttccagcttgtgcttggctgtattcgagtcttgttagtggctcctttggtatcttgtatctttgccgtttttagtttttttcttcctttcttcttctttttctttgggcttgatgtgctgctcgccccagcattgcgatgtgtcaatggtggtttgctttggaatacaaagcggggggaaaccctttttcggtaacttgaagagtttggcatggcaatgtcatgtcaacattatttcctccacttgaaaaataccttgatgacatttcaagttgcaaaaaaaaaaaaaaaaaa

SEQ ID NO: 3683 - DNA, 1536 bp, Triticum aestivum
  Clone ID: PAT_TA_3683
ctcgcacacgcaccaccctcccccgccgccgccacgaacgacatggccgcagcgctcctgctccgcggcctccgctcgtcggcgagccgggcgcgccccgccgtcccctcgccggcctcggccccgccgcccttcgcctcctcgctcctccaccgcctctactcctccgcggccgcgtccgcggccagcccgcccgcctccgcgctgggaggcgtcaccgacccggcccgcatccgcaacgtggcggtgattgcccacgtcgaccacgggaagacgacgctgatggaccggctcctgcggcagtgcggcgccgacatcccccacgagcgcgccatggacaacatcagcctcgagcgcgagcgcggcatcaccatctcctccaaggtcacttctgtctcttggaaggagaatgagctcaacatggtcgatacccctggccacgctgattttggtggcgaagttgagcgagttgttggaatggtggaaggggcggtcttggttgttgatgctggggagggacctttagcacaaactaaatttgtgctttcaaaggctttgaagtatggtttacgcccaatcctcctcctcaacaaggttgataggccttcagtttctgaagaaacctgcaacgaagttgagagcttggtcttcgatctttttgcaaatctgggtgccacagaagaacagctagatttcccagttctttatgcatcagctaaagaagggtgggcttccttgaaattcactaagtgtccgcctgatagtgaaaaaaacatgtctcctttgcttgattcaattgtacaacatgttcgttccccaaaagctgaccttgaggctccgttccaaatgttggtttccatgatggagcgtgatttttacctaggaagaatactcactgggcgtgtaacctctggagttatccgtgttggcgacaaagttcatggtctgcgcatcacggatgaaggggttcacaagattgaggatggaaaggttgtcaagcttatgaaaaagaaaggcacaagcatggcactaatagaggctgcaggcgctggtgatataatctcaatggctggattgtctggtccagcaattggacacaccgtggcaaatccggaggttttgactgctctgcctgcacttgagttggaccctcccacaatttctatgactttcggtgtgaatgattcaccactggctggccgtgatggcactcatgtaactggagcgaaaattgggaaccgtttgatggcagaggctgaaacaaacttggcaattaatgttcttcctggaccattgtcagaatcttatgaagttcaaggaacgggagagcttcagttaggaatcttaattgagaacatgcggcgtgaaggatttgagctttcagtttcacccccaagagtgatgtctaaaacagagcgtggggaaaggctagagcctattgaagaagttactgtcgaggtggacgaagagcatatcggatttgtgttggaaacccttaacaacaggaatggggaattgttggacatgggccctgtt

SEQ ID NO: 3684 - DNA, 467 bp, Triticum aestivum
  unsure (1)..(467): unsure at all n locations
  Clone ID: PAT_TA_3684
gcagcgtcctcccgcactacacgagctctgaggagggcgagatgtctccggcggcggcgccgctcgacgacgaaaacctactctcggagatcctcctctgcctccccccgctgccgtccaccctcccccgcgcctccctcgtctgcaagcgctggcgcctcctcgtctccgacatcctctttttccgccgcttccgcgagcaccaccgccacagccctcccctcctcggctgcttcgtcgagggcgaccgatgcgtctcctacacgcccaccatggattcgcccgaccgtatccccggcgagcgcctctcattgcagctcatcgaaacctgccactcctcggtcctcgggctgccgccacgggctccgtggctcatctncccccgattcacggaatcacgttcctggtggtgggagcccgtcaccgggggacagcggaacagattnnctttcccccccgggggtttt

SEQ ID NO: 3685 - DNA, 644 bp, Triticum aestivum
  Clone ID: PAT_TA_3685
ccctgatgcttgtcatattcttgtttgtgcctggcactcacttggccgttggctctctgtcatagcgtgcacatctgaattctgtggctccctccgatccttcttctttgcagctgtccttgttctttgtcgtactgaatcagccacattggctcggcttctgcgggactgtgcttctctcagccgcggttggtggggccgcttccgagagttgcccgccgtctctcttggtgttttcatgtttggtgctccagagctctacgccggttgctgtcatgcattccgtgcactgcctggtgccgtggccgtccttgtacttggtttcccagccggtgcccctgcttgtgtttccttggctcgtcttcttcagtaagctcttctttctgtacccacctgttcggccgtgtcccctccatttcggcccgtcagctcctccagtgtcggtctccgcgctctggtttgggggccacccctttcggcatgcctcctccgtcactgtgcggccctctccctctgttcgtgggcccgcgggccacatcctcccgcctgctcgtgcggggggatgttgggtggagtaccagagttcaactcctgttggcggaatgtattccgtggagtgccggtgtctgagccgttcttgtaca

SEQ ID NO: 3686 - DNA, 962 bp, Triticum aestivum
  Clone ID: PAT_TA_3686
acggttagaggggcgcacagacacgtacaaatgacgacttagtgccggctgaaaacacatgtcgacttgcagcgcatgtcgtaactagctctgtctttcattgattacaggatataactctatacagagatccttcctagcatctaggagagaacatgcccgtgcaaagccgcatgcatagaagaactgccacttgccaaacacttaacgaaactgggaaaatctatgtttttcataaactagagtatttgttgcccatctattgaaatactgaggttttggaatactatggttttggaaaaacggtgttgccaaactaggcctaaaactttttggactaccaatgttgtagaggttaaattattatattttaaggttgtaaaggctgtatgttgtgttggctaagactaaagattgtgaattcatcatcgtaccaatgtcattctctttgcagatgattcttgaaactatattatcagttcattgctactttgtatgtgccttatgatatgtcctcgtatatgtctggactgaaatatgagtgtcttggtccttcttatattattttttatgatctcagtcagcctctttcacacccattgtgttgaggaccaatgaaaatatgttcattttgatgtcattttatttgtgagtaaatagaagttaacctgattatgtggttgcatgatttgcctgattctgtgtttcttttggactttatgtttttctatgaacttgtcaaatctatatgcgttcttatataattattctctgcactttcactactaggaaatatcttatagctttagttgtgcattagggcttaaataagaatctctgggaaaaaatgttgcacattggcacctacatgtactgcattgttttcgtgccattcttctgaagaatctgaagtttctgaacctttgtttgtaatgctgcagggttctggtggcgatgatgac

SEQ ID NO: 3687 - DNA, 1170 bp, Triticum aestivum
  unsure (1)..(1170): unsure at all n locations
  Clone ID: PAT_TA_3687
caaccatggccatgcagcaactcgtgtgctggctctgcgccttcctggccctcgtcctcctcaagcttcttaagaagcgtggcgccacgacggcggcgccgccgccgaccacgcgtccgccccagcgcaccaaccatggccatgcagcaactcgtgtactggttctgcgccttcctggccctcctcctcctcctcaagcttcttaggaagcgtggcgccacgacgacggcgccggcgctgaagctgccgccaagcccgtcgtcgctgcccttcatccacaacctgcaccacctcctccgcagcccgatcgcgcaccgtgccgtggccgacatcgcgcgcgagctggacgcgccgctcatgtacctccagctcggggagctcccggccgtgttcgtctcgtccgcggacgccgcccgcgagatcatgaaggtgcacgacatgaagttcgcctggcggccgtatccacccaccatacagaagctgcgccccatggggaaggggatcttcttcgcgccgtacggcgccctgtggcggcagctccgcaagatctccatcgtgaagctgctcagcgtccggcgcgtccactcgttccaccgcgtgcgggaggaggaggccggccgcctcgtcgccgccatcgccgccacgccgccgggagaaaccgtcaacctctgcgagcagatcttttgggtcatcgcggactcgacgatgcgcaccatgatcggcgagaggttcgagaggagggaccgaggtcctggtggtgttggcggacatcgtcaagatcgcatccgggttcaccatggccgagtggtccccctcaccccggtggacngatgacgtgcactccagtggcacgacaagccgcgcggacacagggagcnacanaacnacgcaacgagctggtggaaaaatgcataacagcaccacagaagaaggcgcatgnntttgcccgcgacagacaccncngacnggnanannagacaacagaagnncaacagaagaagaagngananacgcacanaagcagaaagtanagantatgcngtgaccacagncangatccagaagacactctcgccccgacgggnnacaaanangcacananccaaaaaagaanacagaacnacncaatagcagcanaanacacannngaacacacannaacaacaacna

SEQ ID NO: 3688 - DNA, 964 bp, Triticum aestivum
  Clone ID: PAT_TA_3688
gatctcgcaggctcgcggaggcctcgtcagccagcgcggcggaggagaaagagccgtcgccgtcctaatgagttgggaggagacgtcgtcgagctccaaggcggctgctccgccggccatccgcctcgtcagcttcgtctccgaggagcagctcgacgaggcgaagcggtcgagaggggagcgggtggaagacggcaccgcccagcgcgacaagcccctcttccagatcctgcaggagaacaaggataagaaggatgccgagttcaatgagcgcttcaagcacagacccccaaaggctttggatgaggatgaaacagagtttcttgacaaattggctttgtcaaggagagaatatgaccagcaggtggccaatgaagaagctgaacaactccgtagtttccacgaggccgtagctgcccagtccactattgctcatgaacttggtgagatgcctacagtctctatgcctgaggaaagcaagcctaagccacctccgaagaggagccagcctgagttcctgagaaatattacagtttccgtgaagccacgagccaagaaggcaaaatctgacttggaatgtaagcccgctcccaaggagttggtgccttcgaatgggcatgatacaaaccgtgagccacaaggtgacaccaagagcagcgtgcttggctctctggctgcatacggcgacgaggacgatgaaagtggcgatgaacaatgacccaacagtaatatccaagatttctagaatgctcagtgttgcataccagaatctcactgcaacgccgcagcagcctgcaagagggtttttcttggcgagatgcaaaggttgcatccatgattccattgcagtgtatgaacgttttgtcgaaaacgatgagttctatctgacaaaaggatctaacaccgtaatagcaagcgaaacgattttttagtgcgattaggtactacaaaccatcacagcgag

SEQ ID NO: 3689 - DNA, 671 bp, Triticum aestivum
  Clone ID: PAT_TA_3689
actgccgtccgcgcgggtctggtttgtcggtccgcctcccatctgctcggttctctctctctttcgcttcggaggtttgttgttgagcagggtgttgttgggctctatatcatgagtcaacagcaggcgccgttcaatggcgccctgtctgccgcatggagcctagaatgacaagccaggagaagattgtttggagatccatcttttaactccaagccacaatatctggccataattcttcaagaacaaataattcggatttgttctggtctttcagtcccagcacagatgctgcatgttgaaatattgggtctgcggtttccaccaaactgatcgagttgcatctcagtgtcatacgcagaggctacaagttcatggataacagccaaatgtagctgcatacaagaacggtactggaacattcgaacaagatggcatcatgtcaccattttctgttcaacaagatatctttatcaatgagcaagctctattagtctcagggattaactactactccctgagttcacaaatataagatgtgtattgtgtgtttgttcaagtccacgttgaaatatctaaaacatcttttgacttgccaatcaaatacttaaaaagacacaccgcccacccgggtacacagtccactccttaccaatagcaaaattccaggg

SEQ ID NO: 3690 - DNA, 1610 bp, Triticum aestivum
  Clone ID: PAT_TA_3690
ttcgtcttttggcatgaaattgaactttgaattttggaacttcctttttttgcttctataaactccctattgttgttacaaatgactaatgttgaaatatgaaccttgcttttataaacttttactgttacaataaatagttaaatcctcatatgccactgcaaagttgaacctcctgtgtttatgacacatgtgggtacatggggcaccctgcatctatgacattgtgtgcctaggggcatataagggtttcaattttagaaatggcgagtgttatggatgcttacttatgtcctctacacatacagaaacatatatttgtcattgtaggaaagccaatattttgtagcgagctatataagtattttgttgtttttatttttgttttgggcacttcctggaattgttgttggcctatttaccttgcagggaatctgggatgttgaacaagacagcctagatgagaacagttgccacctcagggtatatactaatgtagcgttctcgaagaggaccatttttagagggaaaatagagcaatcaacgaaggatgaatgtcgtgaggtttttggtctctggatcaagcttgcccatgatattttgaagcaggatggcatctctcggaaaggagcctccatccccatgaacgctgatgttgaatcagggcctagtctgaacattgaaggtcctttggaaaatacagtcgcatatatggcttcggcaccatacgattctggtttgagtagccttgttcctcccattgaacattgtcaacaaagcgtaggcactttggcatccacttcacaagaattctggcgctcactcgcctcatatatgaggtctagtcaatttggtccggttttaggagtgatgctggtggccatcgttatcttaatgcaggtaacaatcatcgttctgctcagtagatcccccaaggtcctcatggtcagtcccgaggcttctgcgagcagcttgggttcatatagcaaggagagcatagagtggttgcagaagcgagtgagcttactgagcgaggagatgcacatggcggaggcgcacatggagaagatgagccacgagtttgcatggctcaagtctcaccttgaaagactggagaggttgaggagcagctcatgaccggccaaggtgaatacggacgttggttgcatgatgaaggatgtctgttgtgtgtagagaccgtacagttacatgagtacagggtgagacatgtctgttgtgtgttagtcctggtatagcattggtgaggtgtatatatatccggactgcgccccgctgtgccccgggtgcaaggtggtgtatgtataagacggcacggcaggatggggatggtgatgtgcaacaaggaacgctggtgaccaagcatattcaattttttaactgcctcttctcttctctcctatatctgctaccctacataaggccccgcttggaatgtctgtgaaattttacaactataaatgattacacctgaatattactgtacactagcaaaatacaaccgaataaatttccgcttgtaatctgccgcagcgtttcaatttggttgtaaaaataagggctcccagattgcaaaaaaaaaaaaaaaaaaa

SEQ ID NO: 3691 - DNA, 581 bp, Triticum aestivum
  Clone ID: PAT_TA_3691
aaagagcttgaggctgaggagaagcctcaaaaatcacttaacgagaagcaacaggaaaaccaagacctgctaatcaagtgtgtatcacaagatttgggattctccagtggtagggctattgcagcttgcgttatatacaggtgtcttctgcactggagatcatttgaagttgaaagaactggtgtttttgaccgtattattcaaacaataggctctgctatagaggtccaggacaatgacgacaagttagcgtattggctctccaattcatccacattactcctacttctgcaacggacactgaaaacgactggagcagctggactcactcctcagaggcgaaggtcaactgctgcatcgtttgggagggttttttcggggattcgagcttcaccacaaagtgccgcgcgaccttttcttggtagccgcttgattggaggactaggtgatcttcgtcaagttgaagccaagtatcctgctctgcttttcaagcaacaacttacagctttcctcgagaggatattgggtatgttgggaccctccctgaagaaggtgatatctccattgcttggtctttgcat

SEQ ID NO: 3692 - DNA, 1842 bp, Triticum aestivum
  unsure (1)..(1842): unsure at all n locations
  Clone ID: PAT_TA_3692
cgtccgcccacgcgtccggtcttctaggaatggaaatggctttctggaagacgatctggattcagatggtgatactgccatgcaagaaccatctggaagtaaatcagaacagaaggatcattcaaatgtggatagtgcttggaggatcaacatgtagtatttcgagatcaagtccggaatcctagctcatcaaccaatgaaaatacccattcagtgtgaccagtttcattgtcagctcgtccggcaggttccaagaagtccctgcagcatgtttttagagacggaggatgccatccaaagatggccatggtgattgatgataggctgcaagtttgggatgagaaagatcagcatcgagttcatgtcgtccctgcctatgctccatactatgccccacaagccgagatggcaaacgctgttccagttctttgtgttgcaagaaatgttgcttgcaatgttcgtggtggtttcttcagggaatttgatgaaaatctattgaagaaagtatttgaactattgcacgaaaatgagttactggatcttccctatgctccagatgtcggtgactacttagtctgcgaggaccctaattttccacaaagcaataaagatcctgcccctatacctgagggtatgagtggagctgaagtagagaagagattgaatgggcgggcataccaggcggaccaaaaacagacatcgtcatcaatccgtccatcagatgatgcacgagtgccaatccggggaactctaggcagttcaaatgtgcaacccaatgggggctcaatggcaattgtcccttctttgtttgtcatggtattgcaagagattggacgactatgcaactcgaaggtggagtttaggtcgactgtaagcaccagcaaaattacgcaattttccgttgaggttctatttagtaatgaaaaaattggaaatggcattggaaaaacaagggatgaagctcaagtacaagctgctgaaaaagctctccaaaatttgcaaagcaattacttgtcatatgttgctcctatcgctggagtccttcccaaagtcccgagcaagccttctaggaagggaaatggctttctggaagacgatctggattcagatggtgatactgccatgcaagaaccatctggaagtaaatcagaacagaaggatcattcaaatgtggataggttgccctctgtattaagtcttattagtcaactttgcttggaggatcaacatgtagtatttcgagatcaagtccggaatcctggctcagcaaccaatgaagaataccatttccaggttgaactagcgggacagattcttgggaatggtattggtgtgaacaaagatttcgcgaagcttcaggcggcagaagaggcactgaggttcttgaaaacaaccactgacccacagattaagaagcatttgagaccaataagatgcagcagttgatttcttcaccctctggccccaaccaaacgagttgaaagaacgcggaatgtgaaatcaatcccttggctatcagcacacctttagccttcggacaggcaacttttggaaatggcattacggagaacgggacgtggtgctcttgtgaccaccttcgccggagaaccttctggtagactattttgcctccgggcaactacaactgcagccgtagtcatctcggtaggatgctgtggcgtagttggctgtaaacaggtaggaatgtaggattagtcgtgaatagtaactgtttacctgacggatgcggttgcttgtaaattgttcaggggcattgaaactggaatgctcgtgctgatttcaaagtttatatgttcataagaaaaaaaaaaaaaaaantcg

SEQ ID NO: 3693 - DNA, 1078 bp, Triticum aestivum
  Clone ID: PAT_TA_3693
aagttgatagaaattctgcagagacttctgagtcgttcatggagagcgattggatagattcgtcaccgccgaccaagtccaactcgtcatctatgataataaacgagttatgtttgacatggaagccctcagtacacaccaattccctcgagaatgtgttacttcatattcaacgtgacaactttatgaagaccatcacacacgttcagggaatcattcgcagttttccttcagacctacattgtgcggctataattgaagctgttgtgcagaaagaaattcttaagtgggattcatgtcttcaggatgttgatgctcaaagggtagtgattgcattactggagcatgctaaaaaaatcaaggagattcacaatttcaatatggagagccggaaggaagagttttccacaaagctacaagatcagctgaagtggcagctcaaagaactggaaagcgtatgcacttccttggaatttgattacaagaaggtaacatgtgatggtaacgtcgctgtctcgacctcgcgagaacagaagaaaaaattgcgtgcccttcaggatgagatcaaaggcttgcagcagtccatgatgatggaggatgaattacagaaattggtgcttcaagttgctgagcatgagagattagtacagaagtctttattggaaagagtaagggttaagacggttttaaggagctttaagcaggtttttgtggaagtaaaagaacggctggcctttgatgaacttggattaattgatgtcgatgcattggtcaaggtagagttggataacttgtggaaggagatcgagatatccaaaggaagactcctaaatatcattttcaagtaatagtggagagatggccatgttagctgtaggtattcctttttttgaccatgttccaccctgttgtaatcctttagcatcgtgtaacaacttaaaatccgcagcatgttgtcaggagaggagaacaacattagtgcccatactcctccttttttcttttgtttcgtaacacttcctaaattaagctgatgatcgagaattgcccaaaaaaaaaaaaaaaaaaaaaaaaaaaa

SEQ ID NO: 3694 - DNA, 897 bp, Triticum aestivum
  unsure (1)..(897): unsure at all n locations
  Clone ID: PAT_TA_3694
cggcacccggtccaccacaccacccgcgctcgtccaccactaccaccagctggcagccatggctgcgagcacgaagaagctccgtccgctcctgctcaccctcctcctgctcctcaccaccgccgtcgcggcgtccaccatcgactgcgactgcgacaagccgaaggcccccaagccctcccacccgcccaagaccaagccccccaccaagggccccaagccgggacccaagggccccacctacccgtcgccggcgcccaagggccacctcccgcacccgccggtcgtcggcccgccgaagggtcacgtccctcgcccaccggtcgtcggccctccgaagggccacgtcccccgcccgccggtctacggtccgcccaagggccccatcacgcgcccgccggtcacagctcctcccgtcgtcgtcgggccgccggtgacctaccccacgccgccagtcacctaccccgcgccaccagtgaccgcccctccagtcacctacccggcgccaccagtgaccacccctccggtcacctaccccgcgccgccggtgaccaaccccccggtcacgtacccgtcgcctccggtgaacacgccgccccctccgcccccgccgccgacgcccgcggcgccgacgtgcccggcggactcgctgaagctcggcgcgtgcgtggacctgctgggcgggctggtgcacgtcggcctcggcgaccccgtggtgaacaagtgctgcccgctgctggaggggctggtgggagctggaggcggccgtgtgcctctgcaccaccatcaagctcaggctcctcaacatcaacctctacctgccactgggcgctccaactcctcctcacctgcggcaagacgccgccgccgggctacacctgcaacgtctgatntggn

SEQ ID NO: 3695 - DNA, 1292 bp, Triticum aestivum
  Clone ID: PAT_TA_3695
ggcctggcccgctacgaaccccaaacgcgcatctctcctagccccctccctgctgctctaccaccaccgtgccgccgtagaacgccgtacctgaccccccgccccctcccgcccctgcctcgccgctcccccccccccccccccccgtcgcccccggcccggccgtcggcgcccattcgtcggcgcaccgccgtcgccgtccccgccccgttcgtccgcggcgtctggccaacgagccgtgaggtcccgccggccgccaccatgtgcggcatcctcgccgtcctcggcgtcggcgacgtctccctcgccaagcgctcccgcatcatcgagctctcccgccgattacggcacagaggccctgattggagtggtatacacagctttgaggattgctatcttgcacaccagcggttggctattgttgatcctacatctggagaccagccattgtacaacgaggacaaaacagttgttgtgacggtgaatggagagatctataaccatgaagaactgaaagctaagctaaaatctcatcaattccaaactggtagtgattgtgaagttattgctcacctatatgaggaatacggggaggaatttgtggatatgctggatggcatgttctcgtttgtgcttcttgacacacgtgataaaagcttcattgctgcccgtgatgctattggcatctgtcctttgtacatgggctggggtcttgatgggtcagtttggttttcttcagagatgaaggcattgagtgatgattgcgagcgcttcatatcgttccctcctggacacttgtactcaagcaaaacaggtggcctaaggaggtggtacaaccccccatggttttcagaaagcattccctcagccccctatgatcctctcctcatccgagagagttttgagaaggctgttattaagaggctaatgactgatgtgccatttggtgttctcttgtctggtgggcttgactcttctttggtggcttctgttgtttcacgctacttggcagaaacaaaagttgctaggcagtggggaaacaaactgcacaccttttgcatcggtttgaagggtctcctgatcttaaagctgctaaggaagttgctgactacctttgcacagtccatcatgaaatacactttacagtgcaagagggcattgatgcttttggaagaagtattatatcacattcagacgtatgacgtaacgaccattagagcaagtcccccgattgtttctaatgtctcgggaaaaataaattcgtggggggtgaagaatggtcttttccggtg

SEQ ID NO: 3696 - DNA, 638 bp, Triticum aestivum
  Clone ID: PAT_TA_3696
gatcccggtgcccgccgccgcccaagtccctcgccacccgcacaagaccttgaccaaatcgccgcgcaagctctacctccccacccgcacaagaccttgcgtgaagttctgttgatcatcaagtcaagttcagacagggtgttcttttggtttggttgggagaccagcaacgacgaggatgaacaggcgctttgtcaatctggtgatgcataactgggtcgaaggcgtttattcggtgcgccggatcaatccttacaatcatctcttctacccgtcagcaaaggcagcacttgaagcagcagatgaagcagcaaagtataaggattattttccaagtgatgcagtccctgcagctgccggacccaggcatcaagttcacagcaactccctctggtggcggtcttgatatgttcgcgctcttcaacccccgcggcaccagcgaaggcagaattgtttttagcaattcgatcggtgaggctgtgctgtacgacgccgacaagcagctcttcaacaccatgggttgcctcaacgagcctaagggagcagaccccatgtgcctgcccatcgagcaccctggcaccgaccaagacagcttgtatgtcctggacagttgcccctggaaagctgatagtcgatgc

SEQ ID NO: 3697 - DNA, 1063 bp, Triticum aestivum
  Clone ID: PAT_TA_3697
tatttttgcgttcttcctgaattggaaatctcttttttatgattttagttgttgtgaaattttggatatgaaaattcttcgagtaccaagtcctcgtcattttatattgctttaaaaggtgttttgtgatgcgttaagctgggggtgtttccagtgagaagggggtaccattttgtctgtcttgcgcagaatgcattgttctccagtcattctcattttgatgattgtcggaaggctgtttgttccgtgttgggcatgggttatttctataggcttcttttttgaactttttcatacgacatgatactccattgaaagttttcattccgttttttctgttgttgccttcaatgttcgtttgagtttgattcgactatgtgtatccaccatatatgatattttttcctgcagaggatatcacaactttgttttgacaagttgtgttcatcctatgcggtacaaattttggtctagtgatacccacggaaccctctatgcatatgtggaattcatttgttcggaaacaaagggtgctagctgatggtcatattccttgggcctgtgaggcattctcccggcttcatggaaaacatcttgtacagaatcctcctctactatggagctggcgtttccttatgattaaactctggaaccacagtctattagatgcccgcgccatgaatgtctgcggcacaattcttcaaggctaccaaaatgaaagctcggaccccaagaaaatgtgagtcgagcatagtgcgctcattataatttaaatcaagtgggtgtttggaggaggccttaggagcaggctaaagagaggtgaaagctgcacctgaggccatggaggactattctcgattctatttatcgatcggttgtgttgaagcagcagtgatccggatgagatgtgtttacatggattgttgttgttcgtcgtgttctgttccatggataagcgcctttagtgtcgcagaacttgccgtatggtctgcaaacttgaatcagtgttccttgctgcaataaaacctatctaaaattatacctaaaaaaaaaaaaaaaaaac

SEQ ID NO: 3698 - DNA, 774 bp, Triticum aestivum
  Clone ID: PAT_TA_3698
cggcacgaggacgctattaacgcaaccaaagacaaaagccgcaaaggattccacacaccaacaccaacactgccaacaagtcttcttctacctcccccctgaacccattccattcccttctctctctagctgcctggccaggtagcttctctctctcctccacgctcctgccgacaaaaacaagaaacgacgtagcacggtagcagcaaagagaaagagagagagaccactggtagccaagggtgggagagaagcaggagtgccgctgccgatcgaccatggagccgggccccgacgcgcctcgcggcgagggagcgagcgcgccggaggagtctggaccgtcctcatcctcggtggccgtggagaaagctgaagagccacaggcacaagcgcagccgccggaaggaggaggccagcaagtcgcactgcaggagcacctgcagccgcagccgctgtcgcagcagccgccggtgccagcggggctgagccgctacgagtcgcagaagcgccgcgactggaacacgttcctgcagtacctgcgcataccacatagccgccgctgacacttcgcgccggttgcagcggcccccgcgccgtcgcgtcccgcttccccctgggccccctcggcccgaccttcgggcgcgccgaccgctgcgcccaccgcccccaccccctcccgcccgctccgtccgcgcgccccccccccccggccggggctcccgttgcgccgtggccccggttttcggacaggggcattggggggcaacgccctcg

SEQ ID NO: 3699 - DNA, 1212 bp, Triticum aestivum
  unsure (1)..(1212): unsure at all n locations
  Clone ID: PAT_TA_3699
ccgggcgccaccatgcccgcccttccctttgaccgatctcctccttcctcccccgtcaacaccgtgggagcacccatcccgccgccgagaccccagccggtgacgcggccaccgccacgcagccgcagtcacgcccctgccgccgacgccactacagcaccgaccccaaccgatgacgcgccacaccacctgctggagcacctcggggtccccggatccgacgaggatccttcaccgcccttcactcgccggcaaccacgagcactatcgcagattggacactatcctgcagctggagaagcggttgaacttcagcaagtaggagtcaacgacctgcagctggtcgccgcgaaagacctctcccgcaacccaccgctgatccctccaagcgtcgtcgcctctgcccgaagctctcangtgacacgcccaagggtcgtccgtcctacctcagcggtgttcctgctcatccacgccgctgatctagatcacggttgccccagccgccgcgaaggcctacagcgagttggtccggggtcgacatcctcctcccccgctgcttgcttgggtagccgtcgagcccaccctccctctgcccatggcgtgtggacgctaatgacggtggctccgccgtgctgtagcctactatcgctgggtgtgtttgtgtgcagctttgtgttgggtcttggctcttggtgtgtgatgatggtgagtgagtaaggtgtgtgtgtgcacacgaactgaaaaaagtttcagatcttgtagccaactcgtgtgcaccacaagtgtttgcgtttatgcaccaaaaaagaaggtcaccaagctggaggggagaaggtcagatgaagtgcagggagcaggggtgtcgcctttgatgaggaacatggtcgctgttccataacgtggtgttctttttgttgttgctgagtgagtgagtgagcgggtaacttcagaggcataaaagaacatgcaaacaatgtacgtgcgtgtgcagtgatctgaggcgagatgcagagggtgtaaagacagagttttgagtctgggtggatgcaagtgaagtgctcatgatcatggccagactttcactatcttaatggggcagcatagagtgtatatgttgataaaaaaattatgagttgttgtaaaaaggcacttggttctcggataaatgaaatccgagagcgatccctttttgtcaaaaaaaaaaaaaaaaaa

SEQ ID NO: 3700 - DNA, 2084 bp, Triticum aestivum
  Clone ID: PAT_TA_3700
cgtccgatatggttcagctacagaattaggatggtcaacaggaagaggatatacactaagagaaggagcttagaaaataaagagacacagtaaaaatttccaggagaggaaaagtataagaccaacattctccatagaacgtgtgtttggtggagtattattggctatgtgtacaaatgatttcatctgcttttacgactgggcggattgcaggttgatacgtcgaattgatgtcaatgtgaagaatctctactgggctgacagtggtgatttggtgacagttgcaagtgatacatcattctacattttgaagtacaatagggatgttgtatcttctcatttggacggagggggttcagttggtgagggaaggtgttgaagatgcctttagaactgcttcatgagatcaatgaacgcatccgaactgggctatgggttggcgatttgttttatctacaataaattctgcatcacggcataattactttgtaggaggagaggtcacaaccttatttcacttggaccggccaatgtatttactaggatatcttgctaaccagagccgtgtctatcttattgacaagcaatttaatgttgttgggtacactctactccttagtttgatcgagtataaaacactagtgctgcgtggggattttgatcgtgcaaatgatattttgccatctataccgaaggaacaatatgacagcgtggcacatttcttggaatcgcggggcatgttagaggaagcccttgacatagcaacggactctaattacagatttgacctggctgttcagcttggccgcgttgatgatgcaaaggcaattgctcttgaggtgcaaagtgagtccaagtggaagcagttaggggagttagctatctcaactggaaagctcgagatggcagaggagtgcctcctacatgcactagatctcagcggtctattgcttttgtattcatccattggggatgctgaagggataacaaaattggcatctatggctaaagaacaaggaaagaacaatgttgcgttcctttgtttgttcatgctaggcaagttggaggaatgccttcaattgttgattgaaagcaatcgcattccggaagcagcattgatggcgagatcttatcttccgagcaaagtccctgagattgtagcattatggaaaaaagatctccaaaaggtaaactcaaaagcagcagagtcattggcagatcctgatgagtacccaaacttatttgaagactggcagattgctctcaatgtagaagctactgtcgcccccaaaaggggtatctatccacctgctgaggaatacatgattcattctgaaaggcccaatgagagtcttgtggaagctttcaagaacatgcatgtacaagaagaggaggacgtacatgaagaggatgtacacgatgaggaggagctaacaaatgaaaatgacactgttcaagaggtttttgaagatgacgaagcagaagagagccaagaagatgctgttgaggtcgaggctgatggttctactgatggcactatccatgtgaatggaaatgatagtgaggaacagtggggtacgaacaaagaagaaccatcagcataaaagctgtagttgagcaagttgctgactcctgaccaatagtggatagtggaacagcagcctgcttaagaggttcggtttgtaaaggtttgttactgggatgatgtaaaacccgtttctcctcattctataagctttcatgtgatctaggattggcttatccggttacagtttgggcagcaatttaattagcattttagttcatgttatagaaaattttgcgcttcatttcaaatagatagtcttccgggatgtttcacagggttgtatgaggctgttcgtttggagatggatttttgtttggtggttggaaaggtgctatatgttacaccaagtacatagggcagtcgcctgtcagtttgggaacattaccctggtcccgtatgtaaacctcagattgttgaacacagttatcggatgtggtgggggctctgtatctccactgtacaagtttgtttcaaaagataaaaaaaaaaaaaaaaa

SEQ ID NO: 3701 - DNA, 979 bp, Triticum aestivum
  unsure (1)..(979): unsure at all n locations
  Clone ID: PAT_TA_3701
taggcttgccatttctccttgttgtgcgtgcttttatgggaattggagcgcgggccgccttccccgcgaggaataatatactttcaaaatgggttcctgtatcagagaggagcagatcattggctcttgtatataagtgggatgtacctagggtcagtgacaggactcgcattttcgccattcctgatcggcgagtgtgggtggccatcagtcttctattccttcggctctctcgggactggctggttcgcgacatgggcggccaaggcttatactactccgcttgaggatccggggattagtgctgaagaaaagaagcttatcattagtcaaaccacatcacgagagcctgttacaacaattccatggggagtaatattgtcaaaaccgcctgtttgggcacttatagcttgccacttttgccataactggggaacttttatcttgctcacatggatgcctacgtactacaaccaaggtttttggaattcaacctcacggggtccagnccttttctggcgtccttccctgggctaacaataggcgatttctgcaaatgttggtggttgggattgcagacacacttgttaagtaagaggaacatcaagtggacaacggttccgcaagatcatgcaacaaatgggttcctaagggccancttttttctcaatcaaactggaccatatccgattcaaccaacactggcatttttgtgcanggctngttaccaaggaaatgagcatttcctcaatccnggccaatacccaaacaatcaagattcnncctccgatacccggtgtacactnggctccccaacanaactgggtccaactngtgtatttggacagcacaaccggtacncctgcaacatgtcttggacangtctcaaatgccggaancttactgttggacggganangattattcaacggnanaaattcnatgaantaaccnctcgtaanaccacccgcaaanaaac

SEQ ID NO: 3702 - DNA, 699 bp, Triticum aestivum
  Clone ID: PAT_TA_3702
gccggcgccacctccgggcgccctctggcgatcgggttggcccggcacggtcgtgctcccattacggtttgacctcctgcccgccgtcttggccattcgcccaaccggctgccaaaccactaggtacgtcttcgttggcgcgagagcggatggggactgcacgatggcgggcaaaacaaggacgacctggcacacccccaccctgcgtgggtgggcccccgccctcgccggcctcggccgcaggcccaacgactggtggcactatggcgaactagaattcccctgcacgcacgtgctccagtttatcatctgcatcccctgctgtgtccgcgacactctccctggcgtctatggcaacaatcaatactgctcactgcccccccccggggtgtggactgcctcctcgacggcctcggcggccatccaaacgagtacgacctggagaaccttgacaatgggcggatgagcagctgctttatagtggcaagtcctcgtggctgcaatacaatggcatggagaggtgctagatacagtcctaagattgcttgtttattttccgagtttgattcacttttggacaagccaccgtatgtgtaatgcaagtagatagctcattgctactcccctttgtttgtactgtcacctctaaggctttggctgtcattcattcaaataatcctaagctgtaaaaaaaaaaaa

SEQ ID NO: 3703 - DNA, 691 bp, Triticum aestivum
  Clone ID: PAT_TA_3703
ctctttccgctccgtctcgtctcccctgctctcgcaccgccgccttctctcccggcgctcaaggtgcaacaacaagggcacgttctccatccagccggaacctggtagggtgcaggtcgccggcatcacgcgccgcgtcccatgattctggatctggcgcatatcttcgtcaggagactaggagcagcagtgagggcagcagaggaacccatcctgaacgagccccgctccggcgtttgcccgcaaaggagagggcgaggatggctcccagttcgtggaggagacgaacgggcacagggcaggcatgtcttcatggtgcttgcggaggggcagggccgctgaggaaaagtggtggtgggggaggaggacgcccttgtccttgatgttcgggcagccatggctgacgccagagccgttggctggccttgaaattgtccgttgtcggcgtcctcgtcatccaaccaccagaaatttggtggcactggatcctgcgggaggaggtccctgaggcatttgattcttgtgggattcccacacatcttgttggatcagcaacaagtggctgggcctctacattattcataaaatctatttttatctttcatttatttgtctaatttctgtgcccgtgtcctcgcctctgttcggctcttgttgaagttccaatgaatttctgtgctacctaagaagt

SEQ ID NO: 3704 - DNA, 1721 bp, Triticum aestivum
  Clone ID: PAT_TA_3704
cccacgcgtccgcgtgccttttctagcatggacgcgtataaagcaccacccaggctcacccaacgcctttacgccatccgcccgcccgcattccttccttcgtctcgccgcagtccacctcgcttcatccgccgagcagagccctccagacgccatccacgctcccgtgaacagatttcttacaggaaacttgacaaatggctgatgaggatgttcaacctatcgtgtgcgataacggcactggaatggtcaaggctggttttgccggtgatgatgcacccagggctgtctttcctagcattgtaggaaggccacgccataccggtgtcatggttggtatgggccaaaaggatgcctatgtgggcgatgaagctcaagcaaagagaggtatcctgactttgaaataccccattgaacatggcattgtcaacaactgggatgacatggagaaaatatggcatcacacgttctacaacgagctccgtgtcgcaccagaggatcatcctgtgttgctgactgaggcccctctcaaccccaaggccaacagagagaaaatgacccagatcatgttcgaaaccttcagttgcccagcaatgtatgtcgcaatccaggccgttctgtccttgtatgccagcggtcgaacaactggtattgtgctcgactctggtgatggtgtgagccacactgttccaatctatgagggatacacgcttcctcatgctatccttcgtttggaccatgctggccgagtctgcacggataatgtgatgaagtgccccacactaagagggtactccctcacaacaaccgctgagcgggaaattgtcagagacataaaggagaagctcgcttacgtggcccttgattatgagcaggagctggaaacggctaggagcagctcctctgtggagaagagctatgagatgcctgatggtcaggttataacaattggttcagaaaggttcaggtgccctgaggtgctattccagccatctcatgttggtatggaagttcctggtatacacgaagcgacatacaattccatcatgaagtgtgatgttgatatcagaaaggatctgtatggtaatgttgttctcagtggaggttctaccatgtttcctggaattgctgatcgcatgagcaaggagatcacggcccttgctcctagcagtatgaaggttaaagttattgcaccacctgaaaggaaatacagtgtctggatcggtggctctattttggcctctcttagcactttccagcagatgtggatctccaaggcagagtacgacgagtctggtcccggcattgtccacatgaagtgcttctgaagagtcggggaaggttgtttacaaaggggactttgctgccaagaatatatagtagtacatggtacatggttagtgttctgtagaagatgtgtaccctcagaggaataaggggtacaggaaaatcagtttcggttcagcttttccttttggcacaattgcatggccttgcatggtgcttgcctgctgtatgaaataatgaaatggaacgtatctgtatggctaatttacatggtgtatgaaataatgaatggaacatatgtgtattccaaactgtgcctaagagcatctctacccgatccctcataagccgacggactaccacccttagtagggtatatatactccactatttttttttctttctagccgatcccttaaacttaaaaaaaaacc

SEQ ID NO: 3705 - DNA, 988 bp, Triticum aestivum
  Clone ID: PAT_TA_3705
ttggtatgacaccattgcgaacgccgcaacgaacgccaggtgggaaacgtgatgctattatgatggaggcacagaatcttgcagcgtctaagggaatcacaaacacctcttttacgaggcgataacccagaccttcacccatcagatctctcaggcgttacaccacgtaagaaagagatacagactccgaatcccatggcaacgcctctggctagccctggccctggtgttaccccaaggattggtttgacaccgtccagagatggaaattcctttgggttaactccaaaaggaacccctttcagggatgagcttcacataaatgaagaggtggaaatgcaagacagcgctcagcttgagcttcgttcgccccccgcgtccggaagaggtctgcggtctggttttgcttctattccacagcctaagaatgagtaccagatagttatgccacctatcacagaggagaaggaagaagctgaagagagaattgaagaggatatgtcagacaggttagcacgagaaagggctgaggaacaagcaaggcaggaggcattgctcagaaagaggtccaaagtgttgcagaggagtttgcctaggccacctgctgcttcagtggagattctccggcaatctcttattaaaggtggtgaaagcagaagtacctttgtgcctcctacatcacttgaacaagctgacgagctaataaatgaggaactccttaggctccttgagcatgataatgctaaatatcctcttgatgaacaaactcagagagagaaaaagaaagggagcaagcgtcagacaaatgggccagctttcgtccctgaaatcgaaggttttgatgagcatgagctaaaagaggcaagttctatggttgaggaggagattcagtatcttcgtgtggccatgggccatgaaaatgaatcttttgaggattttgtaaagtcacatgatgcatgccaagaggaccttatgtttttccctgcta

SEQ ID NO: 3706 - DNA, 660 bp, Triticum aestivum
  unsure (1)..(660): unsure at all n locations
  Clone ID: PAT_TA_3706
tgcaggnaattcggctcggggcaccgcccgactactgccagccatcgtcagagtggccttgcgcgcaaggaaggcagtactacggccgcggccccatcatgctctcctggaactacaactacggccccgcggggcgcgccatcggcgaggacctgctcaacaacccagaccttgtggccaccgatgccacggtgtcgttcaagacggcgttgtggttctggatgacgccacaggcaaacaagccgtcctcccacgccgtgatcaccggccagtggacaccgacggccgcagacaatgcggcgggaagggtgcccgggtacggcgtcatcaccaacatcatcaacagggggctcgagtgcggcagggggcaggacagccgtgttgccgaccggatcaggttctaccagcgctactgcaacatccttggcgtcggctacgggagcaacctcgactgctacaaccagaggcccttcgtcgaggggcttttgatccagcaagtgacgcagtaacaacatactacgatctaaatctagcgtcagtcctcgatgcatgcctgtgtgcatgtgattactgataaataatctcgaggagtagtctataagtaaataaatggatgaataaagttgccgttgtgtgtgagcatcgctccacccggatcac

SEQ ID NO: 3707 - DNA, 861 bp, Triticum aestivum
  Clone ID: PAT_TA_3707
tcttcccttaacttctctttctttccaatggacttcttattgcggctattatggacaatgagagggcttctgcgattttctgttcgtgagtttggagatcagttccccacgacccgcaccatggatcggtaatggattttttttgttgcaggtctatttttctgaacctctctttttatctcagaactttttaatttgtttgtgagcttgaggaggctcagcaattagtatcagcacctcaccacttccgcgcgtccgctgcagtcaaggtgtttgacctccacctcccccgcctgatacagggctcgatgctgctataaaatcccgtgcgaaattttcgattcatggagctagctacaaccgaaccaggtgatgaaaagcacctgatgatcccactccggcgcctggtaactaggctcactaggatagcccccatggagacgtcttggcagttgcggccagcatttgtttgtgttgatgcctgaatgaaaacaacatgatgggctctgagtttggacttgggcatggccgccgtgcagtccgccaccgctgtctccccctctgcgtcagcatcccgtctcctgcaggaccatggcctccgcagcgccggcgtcatcgagcacagcaatgccgacgccactggggcgtgtagtatactggaggctctgtgtcatacgagtagatcatccaagatggttcccacttgcacatcaatgctcacaagtacttgcagtactagtttgttttaggctgctgctgtaatcaactatgtgcttcctagtcattttctgcatcgtattgaacattatttagtttaatgtatggcatgaaactattttcaccaaaaaaaaaaaaaaaaaa

SEQ ID NO: 3708 - DNA, 716 bp, Triticum aestivum
  Clone ID: PAT_TA_3708
ggcatccacttgcacttcttctcccctaaccccagtttgaccagcgttccccaacatcaatggcggcggtatccaaggtgctcgaggacgacaacctcctcactgagatcctcctccgcaccgtcttcaccaccacccttctcaactccgccctcgtatgcacacgctggctcgcccatgtctccgaccgcgccttcctccatcgatttcgtgagatccacccgccccgccttcttggcttctacatcaacaaaggtgagcacaccccaaacttcatcccaatactgcctcagccccgtgaactcactgctgtcatccaacgcgcaacctctagctttggcacctatcagagagtaccgtcggtaccaacctacatccttggttgccggaatggcaacgtcctcattaggcagcatgatgaaattggaaccacgtttgcagtgcacaaagtggtgtgtcctgagagaggcatggacatcctcccaccatttccacgcccccaatctcagtacttattcgacggcactacttactctaaaatcctgcccaaagaagaaggggatgaattgccttacttgtatgcgttgatgcaccaaaccaagggacggaaaacacagggtatacctatatatcttgaaacatggcatatggcgcctgattcatagcttgaacctacagaagccccctcgaccatggtcagtcctttaaatctgggg

SEQ ID NO: 3709 - DNA, 1348 bp, Triticum aestivum
  Clone ID: PAT_TA_3709
acctcctgcctcgtcttccgtctcccgcttctcttcctcctctctcccgccccgcgtggaaccgaccgacccgcacacgcacacgcagcggccggcatggggagaagggaggcgctcgtggttctcctcgcggtcgtcgtcgcggcggcggcggccggggaggcgggcgctgccaaggccaaggggaaggccaaggggaagtaccgggcgctgttcaacttcggggactcgctggccgacgccggcaacctcatcgccaacggcgtgccggacatcctcgccaccgccaggctgccctacggccagacctacttcggcaagcccaccggccgctgctccgacggccgcctcgtcatcgaccacctggcgcaggaattcgggctgcccctgctgccgccgtccaaagccaatcgctccgacttaagtcacggtgccaacttcgccatcaccggcgccaccgcgctcgacacgccctacttcgaggccaggggcctcggcgccgtcgtctggaactccggtgccctcatgacccaaatccagtggttccgtgatctcaagccttccttctgcaacgccaccaaggaagaatgcaaggaattctatgccaactcgctgttcgtcgttggcgagttcggtggcaacgactacaatgcacccctgttcgccgggaagggcctcacagaggcgtacaagttcatgccggatgtcatccagggcatctccgatggcgtcgaggaattgatcgccgagggggcagtggatctcatcgtgccaggggtgatgcccactgggtgcttccccgtgtacctgaacatgctcgacatgccagcccacgagtatggcgcccggagcgggtgcatccgtcagtacaacaccttctcatgggtgcacaacgcacacctcaagagagcactcgagaagctccggcccaagcaccccaatgtgcggatcatatatggcgactactacacgccagttgtccagttcatgctccagcctgagaagtttggattctacaagcagttacctagggcatgctgtggggctcctgggtccgttgccaaagccgcttacaacttcaacgtgacagccaaatgcggggagcctggtgccactgcttgtgctgacccaacgacccattggagctgggacggtattcacttgacggaggctgcttacggtcatatcgccaggggttggctatatggccctttcgcagaccaaccgattgttcagtcctcgtgagcattccacctctgctgttgcacctgtagagcgtctgagaatagcacactaaactggagaagggaaagtagttcttccatatagtcccaatggttcatacctg

SEQ ID NO: 3710 - DNA, 1078 bp, Triticum aestivum
  Clone ID: PAT_TA_3710
ccgcctcgcgccccccgcgcctcgccaccgcctccgccgtcccggcaggcattgatccgccggccggggactgcctccccccgcgcctggtcctcgcctcgcggggcgcgcccccctctacccggcccacgctcgacatgccagcccgcgggcatggcgcgcggagcggctctcgcggttattcccgcgcttgttcatctctgcgcaacggcggccgcggaagcggacgcgggcaggtccggcccaagggccccggtgaacgaccgagcgctggtcaccttctggcgctcgctgtccggcgccagcaaccgcatcaccaacttggcgtcgaagagcaactacccagcgcaggtgaccttcggccaggctccgttgcaaaagcccactatacggtgatcatacggcgccactgccaaccgcccgctggcgaggctacttcacgcccagccatcctccggcgctacaagcagttacctagggcatggtgtgcggctcctgggtccgctgccaaaggcgtttacaacttcaacgtgacagccaaatgcggggagcctggttgccactgcttgtgctgacccaacgacccattggagctgggacggtattcacttgacggaggctgcttatggtcatattccccaggggttggctatatggcccttttgcagaccaaccgattgttcagtcctcgtgagcattccacctctgctgttgcacctgtagagcgtctgaaaatagtacactaaactggagaagggaaagtattcttccatatagttccaatggttcatacctgtatattttcatttgattgaattcattgcaagtggggtacaaaggtgaaataggggatgccagaagcatgattttctttaactgtgaggtggtataaatgtaaaatgtaatgaacacctcgattacgaatattgcatctgggaaatatgacagtgatagtatttttgagtggcttctgatccccacgtgtggcatattttgtgctttgctgcgacgagatgtttcctctgtgtttggaagccaaaaaaaaaaaaaaaaaaggccctaaccgaaccaaactttc

SEQ ID NO: 3711 - DNA, 991 bp, Triticum aestivum
  Clone ID: PAT_TA_3711
tctcttgtcacctggaagccggagttggaggcgcggttcgcgcaattggagctctcggttgcggctctccaagccgcatcgtcttcaactgcaccatccatcggatcgccgccgcttgcgacccctaccatggtcgcgcgcgagatccaagggcaatcaggccacggcgttcctgggggatcctggccgctggcccccggctcgccgtcgacttccccggtcacgggactgggtgcaagtagcagcaggtcaatctgggacggcacaagctcaagttgcatatggaagtgcatttaacaatctccctgctcaaacaactcaagcttatggcatgccttacgcatacactaatcccatggcgggctatcaagatgtgcaagctagtggacatgctggctacccagttgccagttatgatcagaatgccatcccctactatacaatctatcctggctaccctgcaggttatgatcagaatggcctcccctactatactggctacccagcaggtgatgatcagaatgccatgcacttctatcttgtcgcctatgctgcaactgcggtgggcgtcccagcaactgatgctgccaacatggacggcaatgctggatctcctgccggcgccgggcaggccgaatcgacgggccacatcacacttgcatcagatgctcctcccgtcgctgcaatcggctctccgctactggagatgtgagaacctgaggtttgcaatgcaaatgaggtgtcggcacctcgtaccaaatttcctttcatttaccggcaagacatttgttatgccattcctgtggtgctattaggacgtagggtgcgatcacccaagttacctggattctggacttgcattttcttttgcttgtcgtcgttcctgactggactgatggaccgcagacacatcactcactgttatcgtccttgaactctgattggcgatgtgactctggatttaaaaaaaaaaaaaaaaaaaaaaaaaaaa

SEQ ID NO: 3712 - DNA, 1319 bp, Triticum aestivum
  unsure (1)..(1319): unsure at all n locations
  Clone ID: PAT_TA_3712
cgccgggcgggtcggctggattccatctccccactcggccactcccccaccccacgccgcggatccactgcgctgcggcgaggacgacggcgaggcgatcccggccctgtgcaccaggggcgcgatggctgaccatgacccagagttggaggccatcaggcagaggcgaatgcaagagctaatgggacagcgtggtggtgcggcaagcccacaaaatgcagggccaacaaaaggctcaggaagatgcaaagcaggaagctgaggaacgccggcagaatgatgcttgctcagatactgtctttttgaagctagagaaagaatctcccgcatagctttggtcaagcctgataaagcaagaggagtggaggatgttctgctgagagctgcacaaactggtggaatatctgaaaaggtgtctgaagaaaggcttatctcacttctggagcaaatcaacacccacacaagcaaacaaaccaaagtgacgattcagaggcgtcgctttgacgacgatgactagttggtaagctttgatgtactagcgaatgggtgcagcagcggtctgttgcttgattcaacaaccgtcagaacctgacaaactatttgattggtcttgggttgtatatgatctggatattatttggtggggtttttcattgataactgttggatgcgtcacttctacccctgaaactctctgcgaaacctttgagttgtgcccgataaatcaagttctatccgatgagttgatgtggtcaatttatcaagttctatcagataatgttagtctgcaagggatcctcctgtgcaatgggaagtctgtcttcaggctgctcccggactgggaggcaaaacagaagtccgagaagaggacgaaggtttgaaaattggtggttcaagagagccacattaattagccttagaagaggagatttaaagtgaaactttgatgtgctatgtatgaagaaatgtaaaaggaacgactgtacactcgattttggtctacggtacaagtttgtggtgaagcgaaattttgttgtacgctggaggtgattgtgtaatctaaacactatcatctttttggttctgtattggtctagagaatttgcccggtctttggggtgtttcgctgttccaatttggnaccaagaagtcccctttttaaagaaccnnggccttccaaccttnaaangggcgnaaaaacccgttnttaangggccaatgggccccttncnnggaacccttnaccctaataaaattttttnggggnccaaggggccccnaaagcccttnaaatgggaacccttaangggggcccccct

SEQ ID NO: 3713 - DNA, 845 bp, Triticum aestivum
  Clone ID: PAT_TA_3713
ggcaaatccaataaccaaatatccttggcttgtcaattatttctcttcacaggcgttgggtttctccccactgtgtcttcggcagatgcggtgtcgggtcactgcttctccggcgaatccgccgagtctcagttcaccctcaacttaccggagaatctggtggtttccaagattgccgtctgggctacggtggcaaatccgataaccaaatatgcattgaccataaccccactggccatgagtctggaagagttgctgccgcgaagccagcagaagtactccaacataatcattcttagatcagccctggtggtgtcaaccctcatcattgctctgtcagttcccttctttgcgcttgtgatggctctgattggctctttattcgcgatgcttgtgacctacattctaccttgtgcctgctttctggccatcctcaaggcaaaagcgacttggtatcagactgcgacatgctcattcatcatcgccgtaggggttacctgcgcctgcgtggggacatactcatccctctccgggattgtccagaactatgccacctgactccgaagtacttccttccctacatacataatagagaagattgctcgttcgaccgcattattatacatataattaagcatatgtatgagcgagagtggaggattcaaattttgccgaacaatgaattatgtccatcgatatataaatgttgtatgattaaatttgtattgttgttaaatttgtggcaaccgcaataactttgcattattattgttaaatttgtgtgttgatgatctttatcagtataaagtcccagttctgctggctaaaaaaaaaaaaaaaaaaaa

SEQ ID NO: 3714 - DNA, 544 bp, Triticum aestivum
  Clone ID: PAT_TA_3714
cagatcaagcgtggaggagacgagtgcgcaggcggcgcgcacaattgcgaacagttgaagatgctgccacgctcattgacaagcttgtctctgcgaagtcatcttgaagggaggtcgtaaatcgtaatgattggagctcgtaagctagtattcttaccttgggttgatccttgttgttctaccatagtcgttattatatggtgggttggtgattttctcaggactatcgtctcctgctgtgtgtaataagataattggttaagtatgtaagctgttgaacatcgaagtgcctagttttcgtgcggctgtggtgcatgtagatgtatgcatcttttgtgcccaaaaagaagaatatgcgggtacgagccaactgcatctgcatgtgttgtgaatctgtgatgtgtccttttcttgttagagatcagcagaacagatgttctattagggtgccacaaattcctccctggaaagaaaatgttttatacagtgagctcagcagccacttgttgggctatatggctggcgcgcaatcgagctacttctg

SEQ ID NO: 3715 - DNA, 839 bp, Triticum aestivum
  Clone ID: PAT_TA_3715
gccgctccgagccggccgggccgggaccgcaccccaccccacccacccagtccatcccccgtcgctctcacgctcttcgtgctcgccgcctcccttcgcgtgctgcctcatggcttccatcgccggatctgccgtgtccttcgccaagcccgtcaaggcaatcaacacgaactcgctctctttctctggtgcaaggaggggcaatgcatttcttcgtctgcagccagtgccgatgagatttgctgtttgctgctcagcaaagcaggatacagtggagaaggtttgtgaaattgttaagaagcagcttgctgttcctgaaggcactgaagtttgcggtaccaccaagttctctgaccttggagctgattcactggacacggtcgagattgtgatgggcctcgaggaggagttccagatcagcgtggaggagacgagtgcgcaggcaattgcgacagttgaagatgctgccacgctcatcgacaagcttgtctctgcgaagtcatcttgaagggaggtcgtaaatcgtaatgattggagctcgtaagctagtagtcctaccttgggttgatccttgttgttctaccatagtcgttattatatggtgggttggtgattttctcaggactatcgtctcctgctgtgtgtaataagataattggttaagtatgtaagctgttgaacatcgaagtgcctagttttcgtgcggctgtggtgcatgtagatgtatgcatcttttgtgcccaaaaagaagaatatgcgggtacgagccaactgcatctgcatgtgttgggaatctgggatgggtccttttcttgttagagacagcagaacagatgctc

SEQ ID NO: 3716 - DNA, 1474 bp, Triticum aestivum
  Clone ID: PAT_TA_3716
cccacgcgtccgccacctctttccccgcctcgcctgcctcttcgccgcctctccccttctctcctaggtttagggtttccccggcggcgactcgagtcaaggctgtaagcctgtaacacgccgtgactgccaagtcactacagtataacgaggtgcgtttccttcaaagctgtcaattgtacggagatggaaatgacccctgaattattgtatggacaaaatgtatatgttccaactgctgtaaattcctatacatatggttatgcagaagttggatcacctatggattggtataaccatcagaactctctaggatatgatgctcaagatgtttattttccggctttccagactgacggcacacagtgtgtttactgcttccccggagctcaaccccaccccacccacccagtccatcccccgtcgccctcacgctcttcgtgctcgcttccccgtcgccctcacgctcttcgtgctcgccgcctcccttcgcgtgctgcctcatggcttccatcgccggatctgccgtgtccttcgccaagcccgtcaaggcaatcaacacgaactcactctctttctctggtgcaaggaggggcaatgcatttcttcgcttgcagccagtgccgttgagtggtgcaggttggtgctaatgaaagcaggctactgtggagaaggttgatgaaatttgctgtttgctgctcagcaaatcctgatgccgttgaagatgtttgtgtaatcactaaggagcatcttgctgttcctgagggcactgaaactttgaggtgccaccaagtactctggacctgggacttctgatgcagtaggacacggtctcagcattgtgagtgggacctcgcaggcggagtaatcgcgaacagtgtggaaggatgctgtgcgcagcgcaattgacaacagttgaagctgcggcctcagcccttcggggcaagccgttattcgtaatcataggcatcttgtaagggaggtttcttaatcgtaatgagttcgagcttttctacgataggtaggtcctatacgttgggttgatccttgttgcttctaccatagtcgtttattatatggtggggttggtgattttctcaggactattcgatctcctgctgtgtgtaataagataattggttaagtatgtaagctgttgaacatcgaagtgcctagttttcgtgcggctgtggtgcatgtagatgtatgcatcttttgtgcccaaaaagaagaatatgcgggtacaagccaactgcatctgcatgtgttgtgaatctggatctgatcctcagaagtgggcttcagctgagaaatttcagcctatttcgaagtcgattggtcaactaaaggcacatggctctagtaatgcggagaaacatagcggcctaaggtcacctgccacagttgcaaaatcctactccttgtgcccgcgagcggacctccgccgcggcccccccccatccctagtgaattc

SEQ ID NO: 3717 - DNA, 1354 bp, Triticum aestivum
  Clone ID: PAT_TA_3717
tgcccgctcgcccccgcgccgccccctcggcctccatgtccgccgaggcgcgggcggccccgtcgcccctgccgccgccggcgcaccccacctacgacctcagcgccgtcatcgccctcgccctctccgacgacgccggcgaccgacggacgcgtgggtgtttggctaccataccaaccgatgtaaaggctgaagccacttttatcgctaaggaggatggtgtcatcgcaggcataagcctagctgagatgatatttaaccaggttgatccgtcgttgaaggttgaatggtttgaggctgatggaaattatgtccgtaagggattgcagtttggcaaagtatatgggtgtgctcagagtatcattgttgctgagagggttgtgctaaatttcatgcaaagaatgagtggaatcgctacaatgacgaaggccatggctgatgctgctcgtccagcatgcatactggaaacaagaaaaactgctccaggtttacgtctggttgacaagtgggcagtactaattggtggtgggaagaatcacaggcttggattatttgatatggttatgataaaagataatcatatttctgttgctgggggcattacaaatgcaatgacatctgttgatcagttcttggagaaggaaaatcttgcaattcctgttgaggttgagacgaggacactcgaggaagttagagatttattgaagtataccgatgagaacaagacttcattaactcgtataatgttggataatatggttgtacctcttcctaatggggacctagatgtgtcaatgctcaaagatgcagttcagttgataaatggaagatttgagacagaggcgtctggaaatgtgacgatcgatacggtgaagaaaatcggagaaactggagttacatacatttcaagtggagcgttgacgcattccgtgaaggcgctcgacatatctctcaagatagacaccgagctggctcttcaagttggaaggcgcacaaagcgcgcctgacaccacaggatgtttggcgtcgctggccggttcatcattcgacaacgtgatcgccacgctgtgatttctaactaatatagtgaaggatgcaatccccgcctcacgatcatccagttcggatgaacgccacagttgctatagtatccaacggaaggacaataataatagcctgaatgcccagctttcagtagattgcgaaacatttaagccgttgactagacaggcagaaattgttgctaaatggcgtagaagttgtatgtgacgccacaaaacatctgtttcccaggaactgagaaagaaataaaatggtgtgcctgttgcctttagtaaaaaaaaaaaaaaaaaaa

SEQ ID NO: 3718 - DNA, 1179 bp, Triticum aestivum
  Clone ID: PAT_TA_3718
cttgattccactctgggacggcggcctgcgtggtcccagggctcgcggctcccgccggccgcgcccgcctccgcggcgcctcagccgcgtccgcgcggccaccctgctcctccctgccctcgcgtggcgttgtgtgctcggcgccgccgccggcggggcgcacggtctgctccgccgcggggccgaccctgctcgcggccacgggccccccgccgacgccaagccctgcctgcccgcgcggcccgcgccgcccggcgccgctggcccgccccccgccctgcgcctgcccccgcgccggccccgccccctccgccccgccagatgccgcccgccccgccccttcgcccatgggcaccggcggcgaatgcgtctccatccgcccccggagccgattcgtcaccgtggacggaatcgtgtgcggccccggccctggcttaagtgtggggagcctgggcaagaatggagcgaccgcatccgtggagtacatcgacgtgaaaaacgtccacttcatcaacaccacaaatggggcaaggatcaagacgtggcagggtcggaaaggttacgcgaaatccatctccttcaccgacataaagttcaccaacgtggaccgtcctgtggtcatcaaccaattctacgtagaccgccaccatgtcccaaatatgggggcggtggcgctgagcaacataacgtacaagatacctgaagggcacatcgaagcaccagacggccgtggacttcaactgcagcgagagcggcagctgcacgaagatccacgtcaactccgcggagaatcaccgttgcggacggcggaggaaccatggcccgctgccagaacgcgcaaggggacacctccggatacgtctaccccaagatcccttgccttagatgataataactagcaggtagaagacgtggcagcacgcccgcgccctgatctaagcccgcgcgtgtttatggggggggaatttttttggtttaattttaaagtaagagaaggggtggcagtggtattggggtcgagcagttgcgaatgaatctttttgacagacttcagaaattttcattgcatactggtagactatgaaattggaatccggaatcagttgtttattactacatccgttccataatataggagcgttttttacactagtatagtgtcgaaaacgctcttatatt

SEQ ID NO: 3719 - DNA, 943 bp, Triticum aestivum
  unsure (1)..(943): unsure at all n locations
  Clone ID: PAT_TA_3719
catactgttcgccaatgccaacgaagcaagggcattctgcgagctaacctcagaagagagcacggtctcagctgcgagatacttgagtcattctatccctctagtgtctgttacagatggtatgcatggttcttacatcggtgtgaaaggtgaagcaatatacatccccccgccggcatgtatacctgtggacacctgcggagctggtgatgcatacgcatcaggaatcctgtacggtatcctccggggcgcatcggatttgaagggcatcggcctgctngcggcccaggtagccgctgttgtcgtcgggcagcaaggcacgcgcctgagggttaaggatgctgacaggttggctgaatcgttcgagttccaccttgacaacttggagttctgttcagatgctggaacggaccaggttcccaacttatgatttttcctccccctcaagtcccaagtcctcgacaggcggcggcgatgggaactaccgagggccgaaaagggccgtgcccccttctctagaagatctcttaagcgattgcttagttttaccactcagactcaggttctatataaatgctaaaccagcacctccttcgaacagcaaaatgctagaagggttcatcagattgatgccccttcaacttcaagcccggcgcgacaggtcctaggcacattcacttgtatatagcatctcattcctttagtcctagctctttgtcaggcctctcggcctctgtcaccatcccattacttacatttttgcactgcaaggatgctacatactccgacttttggccgagcacatggggtatttttttgtcgaaggcgcatgatatcatacgtttggctgtaatgtataatgcacagccgaaagacaattgccgtcttggtctagaatgtgaataaattctttcggctaaaaaaaaaaaaaaaaaaaaaaaaa

SEQ ID NO: 3720 - DNA, 716 bp, Triticum aestivum
  Clone ID: PAT_TA_3720
gcccccccgccgccgccgcgcccggggacctcaccgccgccgccatccgcaaaaggcccccgacgtcggcgcgcgcgccctcgcgctccgcgcccccggccccgccgtcggcggcgccgtcatgcaagcccccccggccccgcccgcgccggcccggcgcccccgccccaccaaccccggccccgccccgtcgccctccgcccgccccggcggcgaccagggagcccctgggctcccccccccggcctgctgggtgcctgccgcctcccgccgcctgcgtgcctgcttcggctgcggcttgctccgtcgccgggtgcatccccctgcgccctcccgcgccggagctgagcgtcttccttctcactgagcaagcagatactacttcagctcagtcagttcaagaagaaagacatggggaagcaagcgtggatccgacaggcaaggtgttcggtgaaatgccgggcgagctcgggggccaaccctaccaataatggagccgcgcgcgacgtcgcagtcagctcggccagggggttactaagtaggggccgcgacggcgagcttagacaaagggtgtgcgtgcagccaagcatggcgcatggccatgtgtgtagtagctcccttgagaagttgagatataaagagtgtttgtaaaggaagaagataccgagcggcaaacaaaatgaaagcttcaagaatcattccatgcaaaaaaaaaa

SEQ ID NO: 3721 - DNA, 694 bp, Triticum aestivum
  Clone ID: PAT_TA_3721
cccaaaggtggccaaagcttctccgagttgcaccgaagcgaacaccgccgaacaccacctcccgccggagccagcagaccaccacaggcccgccacgcccacccccgccggcccccccgcccccgcccccacccccccctccgccgcccgcgcccccgcgccctcccccccggccccgccctccttctgctccggcccccccccgccggccccaccccccgccggctccgcccccgggcccgcccccgcggcccgcccctcccccccgccctcatccccctccacccgcgccccatcctcgcccgcccccccgcccgccccccccccgcgcctgcccgccccccgtgcccgggggcggcgtcggtccagggcgccctcggcatccgctacccccacgggccggtcgtccgcgccgtaacgaccggctgagcggggtacgtggtgtcaccgcgggggcaggccatcagcggcgccgggcggcagatgccgcccgctcggtgcagggaccccggacagtcgccggtggtaagtggccgcccgtgatcggggggcgggcggggcggcccccgtgcccgtgtcgcccgggaggccggcgggcgggcccccgcccccctacgtcaccgcccgcgacggctgtggtggttgccgttcggccgcggtccctgcgtcgccgcccccgtgcggggttcgtggt

SEQ ID NO: 3722 - DNA, 832 bp, Triticum aestivum
  Clone ID: PAT_TA_3722
gcgacgcaggaggaagcgctcggggagaggccgccgcccgcctgggcgggtctcggcggcgacgcaagacgaagcggtcggggagaggccgccgcccgccggtgagggtcccggcgtgcgtggcggacgcgcccggcggcgggcgcgggccggccggccgcgcccccgcggccgtccccgggggccgcgccggccgccgctcgcgcctggaccaacgtcgcctcctgggccgtcgccgggaccctcgcctactacctccggctccgacccgcgcgccagctccacaaggagcggcagcaacgagctgctctagctgctgcctccgatccataccgttatgtcgggaaacggaacccaattcctgacccccaggacacttggctaacttatcgggaagaagaaggatcctccgaagtctgacaactagttcatctgagtaacatcatgtagcaagtgcggccttcgtttgactggacaacgtaacccaatatgggatttctgcaacgcctgattgctacctacatgataagcatataccgtcaaaaaagttgcttcctcatgctagcaagcccaggtcttgttggcgcgaagtctctttcgttttgaagtgatttagtgttcatctttcgaagtttcctgcttgtttggacggataccgttttgttggacacgaggaatcatactcggaaatgtaaatgtgtaactgctagatgttcacaaatcggtgtatggagacgctacaatccgtgcattgtgaccgtcactgctactgctactgtgctagtgtttccaacatgctaaataataaatccactgtctatgatgggagtgc

SEQ ID NO: 3723 - DNA, 984 bp, Triticum aestivum
  Clone ID: PAT_TA_3723
tgccctcactgctctgtctctgtatgtggagacagagcccgttgacaagatcatctttggcaatgctgggttctcagttctcaagtacttcaagttcaggtgcagtgcaccttggctcaaatttgagtcagctgcaatgcctaatcttgagaagctcatgttaggtttcaatgtcatcccccaaatggatcaacatcgacatgctaatgcagttatcaccattgagcgtatgccaggtcttaaagagatctctgcaaaaattggaggagcaactgctaatactgatgcagtctctgccttgaggaccgtcgttagtaatcatcagagcaatccgaagatcaacgtccaattggtggattacagtttctatggtcatgaaaacgaactgcagtttctatggtgacgaaagcacaaagcagaaacaagaaccggatgagattgtgggattgctccttggaaagatcagccgattaaagattgtatggctgcaactaaccacaggtcgttaccatggttgaggcggctcaagatcaccgttggagaagcttatgttgccatcgtgctgatcgtgaggcttttgtaacagtttctgcaccattaagtgattctaaagtccggagttcatgcagttggtgactacacaaaagacacgaatgagctcaagagagtccccgaagaaatatccggcttttaagttgcttgtagtttggataccattaagtgttgatgtttctttattgcattatgatctcaactagcaaaaaagcccgtgcattgtaacgggagaaaaaaaatatcactctccgaacctaataattatgaatcaagaccctaataggttcatgtcttttcttttaccacatggcatttcatttgtgttgtcacttacctggtggcctcaattgtcacacaatcacaacgtgtttgaattttgtccatgctaagacgtctctgtcaacataagataaaaaaaaaaaaaaaaaa

SEQ ID NO: 3724 - DNA, 1591 bp, Triticum aestivum
  unsure (1)..(1591): unsure at all n locations
  Clone ID: PAT_TA_3724
gngnttnatccgtaagctcgaaattaaccctactaaagggaacaaaagctggagctccaccgcggtggcggccgctctagaactagtggatcccccgggctgcaggaattcggcaccagcctcccctctccatctctgtgaaagcatcggcgcaaaaaccagttgacctgaccatgccgtgcgcgggcgcctattaatacccctcgtcttcctcgcgcccctcctcgatatccctctcggtagacggtacaatcataccgatcaggagccagctgctgcttcttgtgttgtgttggtcccactgccgagatcggcagcagaagcagccgtcggtcctctgtacctctcgttgatcgcttgatccgaggggatccgaggggatccaaggcgagctgcgtgcgtggtggcggcgatgagttcgctgagcatggtggaggcgaggctgccgccgggcttcaggttccacccgcgggacgacgagctcgtgctcgactacctgtccaggaagctcggcggcggcgccggaggggcggcggccgcggtggcgagcatctacggctgccccgccatggtcgacgtcgacctcaacaagatcgagccctgggacctccccgaaatcgcatgcattggcggcaaggagtggtacttctacagcttaagggacaggaagtacgctacaggccagcgaacaaatagagcaactgaatcaggctactggaaggccaccgggaaagaccgtgcgataagccggaaagggttgctagttggcatgagaaaaaccctggtgttttatgaaggtagagcccctaaggggaagaagactgagtgggtcatgcacgaattccgcaaggaagggcaaggcgatctgatgaagttgccactcaaggaggactgggtcttgtgtagggttttctacaagactagggcaaccgttgccaagccacccacagggagcagctacaacattgacagtgcagccgcaacctcactgcctcctctcgttgacaactacattgcctttgaccatcctggaatgtcgacggtgcaaaacctagagggttatgagcaagtgccctgcttctccaatggcccctcctctcacccgtcgtcgtcggcctcgatgaacatcccggtgacggcgatggcgcccatggctgctgatcaggagcagcagcacatggggaaggcaatcaaggacgcgttgagccagctcaccaggtttgagcaaggcaatgtgaagagggaggcgcctgcccagggtggtgtgtttgctcaagatgggttcgagtacttagctgatagtggcttctcacagatgtggaactcactcaattgattttctagctagggctattattgctactcctaaaagacgcagatcgcccttgtccccaggctctcgtcttgggggtgtgtccctatacgcgccagtccatgcagttgtggtatatagctagtagtactatcattcaagttcacattatttgtcaaaaagaaaaggagggtcagaggagagagcngatatatgtcatcagtgatgtaaatctgtatatacattatttgtgtacgactangnataagaaggaaaaat

SEQ ID NO: 3725 - DNA, 470 bp, Triticum aestivum
  Clone ID: PAT_TA_3725
ggaatagggttacctcggttccagataaataccgtatacatgtctcaaaaacaagataaataccatatacaaagaccagtttccgctgggatttcagcttggtgcaaaatcatggatagtacgcatttctgacttagaaaagctactaggctcataaatgaacaaacaagatgacagtacatgacagtcagagtcgaacggtcaatgtttatttgctagaataagtcactcttgtatttctcttcggatacagttcttcccctggcacatctaatggctttatgcagtttttacatcaactgtggatgaaattgaaattcttagtgttgaggacagttaatcttgtcaagactggagggacttgctatagcgctccttcgcgaacgccacaaatcgttctagcccattgaaaagtaaaccttccagaaatggtttcagggctgatgcaaccggggtcagaatttcagcgg

SEQ ID NO: 3726 - DNA, 736 bp, Triticum aestivum
  Clone ID: PAT_TA_3726
tgcaacttcaagtgtgggttcaaagtttgtctttacaatcaagtgacggaaaagtcaatctggttggagatgccaatcagttggctcatacaagaagaaaccgatgacagctgcagccttctcaggtgatggatctgttcttgcggttgcagctgagagcgtcattacactctgggaccctgataataatgcactcgttggcgtgattgcagaagcactatcgcccattacaaaactttctttcgctggggattcggcttatttgatgtctctatctcagagttcaaaaccacaggttgctgtgtggaatgtgtcaaatctttccatgcaatggtcttacacccttttcgcagaagctgcatgttgttcgtcaagtaagagtgaatttgcggttctttctcttctaagctgtcctgaaggaggagcaccagcagagcaagatgggataatactgattttcgatgcagaaaattcaaaacccgtttcatcctggtctgtgaagaaggcgaaagggggtagcattgcttttgtgaagaatgacctctctttggatgcaaacactgatgacacaagagatggagaggcttcattgctggtttacttaaatggtttacatgaatatgttatctttgatccccgcaacaacgaggagcaacaaatcagccagaacacacggaaaaacattcaagctgatgaacctgcaccaatcggttatgcttctatttatggagaactt

SEQ ID NO: 3727 - DNA, 1465 bp, Triticum aestivum
  unsure (1)..(1465): unsure at all n locations
  Clone ID: PAT_TA_3727
cgggaaagagagcaatctggggttacaagctcttgccattgcatgtggacgtacttggctgatctccgggcttctggtggtagcttccatgagcacattaatccattttatgaccgagagaggtattggctcccccttgtaccccctgctgcagcacttgctccaactctatggcctcagttttatttgagatggacatgtccccctgaatcacaaggtggcggtcttgaatcccatgggcattccatgcgtaaaaaatacgaggcctcagtcaagtcaaaggagatggctgaatcaagatcaagggatattaaaatgaagatggagtctatgctgacagacttgcagagggagaggcgtgcaagtagttcagccttagccatggctcaaagggctcgaagggagaacgtcgccattaaaagggcgatccaaactatagggtgcactgttaatttctcgacgaacgaaaaccaagtggacaagtccgaggagatgtcatattcatttcgaagagaagctgacactgtatcccagcaagatgataatgctgacctgtctgtatccatctctgcgattgaggacagtttggtatcagagacaccaagcaaccaagtttgcgaaacgctctgccccttccgcagcagagaggggtgcagatggccgcatgctgcttgtgcgcagctaggaagccagtttgttggtttaaaggcaaattttgatgcttttgaccggctatctgtaaaagattgctattttcctaaagaataggcgagaccatgagctcaaggcagttctaggtgcactttgacagctgccggtagaatttttttccccgcggtggcgcctctcagtttgcattgacagcagaagatatgcgctgggagcaaatgaagatttaattattttgagttgaagctcacgtctgactcacaagttcctcagaagatatgcgctgggcagttggtattctagattaggggttagcgattcgttaagacccactggggactgaaaaggcagtcctttgtgttgtatatagtttaaagcaaagtaatgccagatgtgagaggtggtttcttttcacctgttgttttggttgaaaaaaatcatctggttgcttgggaataagagctaatgtacgtcctgctctggggttttcactgccatctgtcaaaaacaaaananaaaaannaaanaaaaaaaaaactcgagggggggcccggtacccaattcgccctatagtgagtcgtattacaattcactgcccgtcgttttacaacgtcgtgactgggaaaaccctggcgttacccaacttaatcgccttgcagcacatccccctttcgccagctggcgtaatagcgaaaaggcccgcaccgatcgccctttccaacagttgcgcacctgaatggcgaatggcnaaattgnaagcgtaatatttggtnaaaatcgcgttaaattttgttaa

SEQ ID NO: 3728 - DNA, 926 bp, Triticum aestivum
  Clone ID: PAT_TA_3728
ctctcgcagtcgcgctccgccgcctgctgccgccgccgtccgccgcggcagccgctcgcggggcagcgccggtggccgcggaggcatgttccggcagaggaatccctatcctacgccgcgccggtggcgccgaggtcgcggcgggcggttggagtggcggatctgggacccgcttgtgccgcaggctctgcacctacaacgagagagatgacagggcacttgaggaggaagttgagaagaaatttggatggatattaaagatattcttcatagggactgctggccttgttggttggcaattctttccctacatgggggataacctactacagcaatccattacgcttttacatgtcaaagatcccttgttcaagcggatgggggcctcccgattagctcgttttgccgttgatgatgaaaggagaatgaaggtggtagagatggggggagctcaagaaattctgaatgtgttagaaggcgctaaagatgataaaacacgcaaagaagctctgaaagctcttgtggcacttgcaaagttggataaagctgcggggtttttggacaaggcaggtgcctacgccatcgtctcctccactcctaattcccctgaatatgccgagatcgaggcctgcaagactagccttctcaagacgtttgatcaactgaagtcgtgatggtaaatgcccgtgtggatatatctacatgttttctccaaactggactaggcagttctttttggcgatgggattgaaatcactagtgttctcgttatgtgccagcatctgacctgattatcaaacgctctttaataagaatatacgatatgccgggcatgaactttttcgttgcttcatttgcgaagagcccaccgatcttaaactggacttatttggcttttgttctacagtgtaacttatagacattct

SEQ ID NO: 3729 - DNA, 1601 bp, Triticum aestivum
  Clone ID: PAT_TA_3729
ggggcgaaccggttgcagcggggtttcggctgcgttggcgctttgtcgcggacgctgctttccggaaggcctctcaggtgctcgctcggcttcgtgctgttccccttggttcggtggtcgtccttgactaagttgccgaagacactgtcccctggcgcgagtgctccccgctacatgggggaccatacatctggtgcatgctacacaactttggtggtaatattgaaatgtatggagtactagattcaatttcatctggccctattgatgcacgtacaagctacaattcaacaatggttggtgttggcatgtgcatggagggaatagaacataatccagttgtttatgagcttatgtctgaaatggcattccgtagtcaaaaggtcgaagttgaggattggttaaaatcgtactcctataggcgatatgggctattaaatgtcgaattacagaaagcttgggctatactgtaccatacgttatacaaatgcacagatgggattccggttttttatcaagaagattcaactttatagcagtcttgcaatcctagctgatagatttccggatagttgtcttatcctgttcgcaggaccgtaattgagactacctagttgaatttccagacatcagtccaagttctttcagttcccagtattccaaacgaagaagtatctcagttgtgaggaaacatacaaggttcttaggcgaggtctctgcaagcctaccacaaccacatctatggtattctacggaggaggccgtcaaatcccttgaactatttcttaaagcaggagatgatctttcagaaagtctcacatataggtacgacctcgttgatttggcaaggcagtcactgtcaaaattagcaaataaagtgtaccttgatgctatggattcttaccaaatgagggattcaagtggtttaaacttccacacaaagaaattcctcgaactcatcatggatatcgagacgctactagcttctgatgacaatttcctgctgggcccttggttagaaactgcaaaaagccttgctacgactgaagacgaaaggaagcagtacgaatggaatgctagaacacaggtgacaatgtggtacgacgacacaaagaccgagcagagcaaactccatgactacgccaataaattctggagcgggcttctgaagagctactaccatccaagggcatctaaatacttcactcggttgtcgagaagcctccaagagaaccggagttttcaactggaggaatggaggcgagactggatctcgtactctaacgaatggcagtccgggaaggagctgtaccctgtaaaagccacgggtgatgccttggcgatctccaggtctctctttgcaaagtacttcaggtagatgtgggctgcggccacaaaactatgaggagtgtttgttataaataaagcaaaataatgtactgcatgagatgttgtgaagcaaacggcgtacatctgctcttgactctgcaactagtctcatctcatgtaaaaggttcagccgtcaatacttttcgcggtgggaaataaattgaaacctttgatgtgatgtttcaagctcagccaaatttgtccgccttatc

SEQ ID NO: 3730 - DNA, 692 bp, Triticum aestivum
  Clone ID: PAT_TA_3730
cctctgccgcccgcggcccctgccccctcccccctctctccgagccccgagcccagcgcccctcccccccccccccctcccccccccgccgccggcccccgtcgcggctctccgccccccgaccacgccttccccccacccgcgacccgcgagccccggcccccccggctgctggcgtgctggccgtcgagcgagccccaccacggcgaccagccgaccaccaccaccttctccttcccgtcctccggccagatccgccccgcccccctccgtcgcgcccgtcgcccttccccgcacccggcgtgcgctggcgacttgcggttcccgtgcccctgcccgccggccggcgggccggtgcgggggtcctgggatcctccagccctccagccttgctgtcggggtctcggtgtcatcaatttttcataatttgtttgtttcttccagctctcctctccaccagcatattcctgtctttctttttataaaactcctgtgctactacgatggatcttggatcttgtagaatgccatcacttgcgacttttgttgccggttgttcgatgatatggatttgtgctaccaggttggagacctcagattttattttctggtccccctgggtgcctccccccggcggccccccgcccccggctgtcatgcgtgtttgtgccctcgcgtgtgaaaaaaaaaaa

SEQ ID NO: 3731 - DNA, 732 bp, Triticum aestivum
  Clone ID: PAT_TA_3731
gctcggctccgcactggcttttgctttcgtagactctgtatcttcgacgagctccgaccctggcttagctccgggcagccggcgacgatgtcggtgagcctcgtgagggcgtcgctgccggcctggtgcacggcggcggccgcggggagcagcggcctgcgctctcgcctgcgcggcacggcgtgctccggtcggcgcgtgggcgtccggtgcaggcgcaccaccccgccgggcttccctcccgggccgacgccgccgggggggcccgcgcgcccggcccccgcccgggggccggccgccccccgcccgcccgcccgggggccggccgcgcccggcccgcccgccgcaggagatgccaggcatcgacatgccgccggagttcaacgcgccccctgggcgtggacgtgccgacgcctggcgcgccggtgccgggcacgcctcccagcccggagcagccggggccgttcgtgccatcgccgccgaggccggagatcccggccgtgccgccgaaccccgacgtgatcccgacgccgccgccggaggtggacccaccgcgcaccccgcccgaggtggtgcctccgcagccgtccgacgtcccgcctcccttcgtgtgagtaagcgcgcgcagggccgccggccacgacggtgaccgagatccgctgtaaaatagcgtagtagtactactatgtgtaccttccagctgcttcaaataaagaggatcggccgcggctc

SEQ ID NO: 3732 - DNA, 905 bp, Triticum aestivum
  Clone ID: PAT_TA_3732
ggctccaacgaggaggtgaggcggatgaaggcggagacggccgacgtggtgctcgacgtccgcgaccacaactacctccccgggtcgcgccgcacttcctcaagtggagggcacagtatggagagccatttctgttctggtttggtgccaagccccggatctgtgtctttgactacgagttggttaggcagatcctttcaagcaaatccggacactttccgaagaacgacgcgcacccgaacgtgttggaattgctcggcaagggcctggtgttggtgaacggtgtggattgggtgcgccatcgcagggtcatcaaccctgcttttgcaatggataagataaaggcgatgacggaaacgatggtgtcttgtgcccaacgcacgttcagtgtgtttgaagatcaggcatgcaagaacacaaatagagaaatcctagtggaattcgacaaagcagtccaagggttaacagcagatatcatatcccacacagccttcggaagtagctacaaattaggaatggaagccttccatgcccagaaagagctccagtcaatcgccatatccagtttacttaatgtgcagataccaggattcagctatctgcccacaaaaaggaataggaggaagtggatgcttgaaaagaagcttcgaagcacgctcatgcgtgtcataaactcgcggttagcgtcgaaggggagcggatatggaaatgacctacttggtttgatgtttgagggctgcactacgacagtgcaagggggcaagcaggagcagctaagcttgagcatggaggagatcctacacgagtgcaaaacattcttcttcgccggttacgaaacgacatcgcttctgctcacctggacagtgttcttgctcagtgtgtacccagagtggcaggagaggcta

SEQ ID NO: 3733 - DNA, 950 bp, Triticum aestivum
  Clone ID: PAT_TA_3733
ttaacaaaaagatagccgaagctccgtctttccctcctcttccaagacagctccacagctccctgaattcaatgagtttcaccttaaaacgatggaaagagtgtctcgacatgctgacacgtgttcagaagcttcttccgtaggaactatgcggagtcaggggagtaagccacttaaacttgctgaagcgaaacccccacaacttgagacagcactgcgcgcaaggccatctagggtgaaaagcactcaggaattggaactagaagaattggagaaagcccccaagttcaaggccaagccactgaacaaaaagattcttgagagcaagggtgatattggtgtttttgcccacccgaaggcccaggcaacagagcccaaggagttccattttcgtactgacgaccgcttgggacctcctgcagttgcggatcttctcgacaagctttctctgtactctgaatcttcttcctaccatgacaagaaagatatgccgagactgacgatacccaaccctttcaatctacatacagatgaaagagggcatgacaaggagaggcaactagaggcacaactgttgcagaagaagctagaggaagagaaagcccggaaattcaaggctaatccctatccttacaccacagactatccagtggtgccaccaaagcctgaaccgaaaccatgcacgaggccagaaggttttcagctggagagcttggtgagacatgaagtggagcagcaaaggctaatggaagaaagagagaggatggcgagggaagaggctcagaggagaattgtcagggcaccaccgatactgaaagaggatcctattcctcttccacagaaggagcgaaagcctcttactgaagtgcaacagtttgaactgcatgttgatgagagggcggttcaaagatcagaatttgataacaaagtgaaggagaaggagatcactt

SEQ ID NO: 3734 - DNA, 1234 bp, Triticum aestivum
  unsure (1)..(1234): unsure at all n locations
  Clone ID: PAT_TA_3734
ccacgcgcccgcgggtttgcctgccaccgccgccgccatccgcctctcctcgtcgcgagcatctacggtcgccgccaccgccactgccaccgtcggccctccgatggaggtgccgtcggattggacggccgcccgggtccgggaggttttcatcgacttcttcaagtccaagtcgcacacgccatggccgtcgagccccgtggtacccgtcgacgaccccacgctcttgttcgccaacgctgggatgaaccagttcaagcccgtattcctcggcaccgccgccccggactcgcagcttggccgcctgagccgcgcctgcaacacccagaagtgcatccgcgctggcggcaagcacaacgacctcgacgacgtggggaaggacacctaccaccacacatttttcgagatgctcgggaactggtccttcggagattacttcaaggagggggccatcgggtatgcatgggagctcctcacccaggtctacaaattgcccactgatagaatttatgcaacatactttggtggtgatgagaaagctggtctcgctccggataccgagtcgaaaaacatatggttgaagtatctacctaatgaaagagttctgcctttcggttgcaaggataatttttgggagatgggtgacacaggtccttgtgggccatgcacagagatccattttgatcgtattggcaatcgtgacgcagcttcattagtgaataatgatgaccctacatgtattgagatatggaatcttgtgtttattcagttcaacagggaatcagacggtactttgagatccttgccagcaaaacacgttgacactggaatgggcttcgagcgtttaacctctatccttcagaataaaatgagcaattacgacacagatgtattcatgccattatttgatgccatccacaagctggcaggcgctggaattcaaccatactctggtaaagtaggatccgatgatgttgggaaagttgatatggcatatanggtttgttgcagatcacataaggaccctttcctttgctatcgctgatggttctcaaccggccttgtggatgtttttgtccaagtgttggctgatctgcgtcccgtgggcatcaaaattatggaaacaagattttaccctgtaangtttgtcaatatggtgantttccnancgaaacaagaaagagttaagttattaggcaaggaacttaaaancacaaggttaaattaaactcaa

SEQ ID NO: 3735 - DNA, 1668 bp, Triticum aestivum
  Clone ID: PAT_TA_3735
catcggcgccccctctccccgcgccgtcaccgacgcggtgtcccgcgtcctcgcggcgcacccgggccccttccgctgcgtgcacctcacacgcaccatcatggaggagcaccggggcgagatggcgcgctggctcgacatcctcgtcgccaagggggttcaagaactcgtctttgtcaaccgcccttggccgctagacttgcgcctccccgccaccatcttcagctgctcctcactcacccgtctctatctcggcgtctggaggatcccggacaccgccgccgtaccgcgcggcgccagattccccaacctcctggagctcggcctctgcatgactgtcatggaggaccacgatctggcattcatgcttgaaagaagccccgtcctggagtccctcatcatcatggggagccagaccggagtgcgcctgcgcctcgtcagccaaagcgtgcggtgcgttcagctgggatatacctacttggaggacatcgaggtggtggatgcacctcgcctggagaggctcttccagtcggataattttcgccagagcgagctcactggccccagcatcaagaactgctcttccaagatcaagattgggcgtgcacctaacctgcgtgtgctgggatacattctgccaggagagcaagagttggggattagcaacaccctcatcgtggctggggccaaggagagcattgcgcctagtgtccagattttggccatagaggtgcaattcggttgccgcaattcgatcaagaaagtgcctggttttctcagatgctttcctaacctggggaccctccatgtccagtccccacgcatacctaaagagtccactggcaaggtcaatctcaagttctggcaggagggtggccccatcaaatgtgtcctgcagagcttgaagaagttgttcttctacgagttccgtgggtcaagaagcgaagttgctttcctcaagttcatcgcggagagaggtcgggtgctggagcagatggtggtcgtggtggccaaggaatgtttctctccgggaggtgatggtgtgaatgccaagctgaagcctctgaccaatgcaaaatggaacagcaaaggttgcaaacttgagctcttcaagagcccactcactgatgtggcaggtccaatttgcagccaccgacatgcttctgacttcgggtttgctgacccctttgacctcgagttctactgcgaatctgaaacgatctccgtaagttaataagtagcagtatgccgtgcctcttgtggtgcaagactactggtaactagttagactttgtgttgtcgggaatcacaggagctaaaaatacctgcatttctattggcaagctttctgcatgatgaggttgtttcttgtttgtgccaagtcaagacttatgtggctaaatgctggtggaagaagtaacagatcgaattagataaaaaatattagtaccttccaagccaatcagcagggctatctagtactctagtgcctagctagtatggtttttctggtttgtccaactgcaatttcattagcatgttgtgcatttgttgttaccatgaatcaatctgttatgcattagaaaggtgtcactctcagtttgaatgagtataattaattaccgtaattatgttctttagttttgaaaaaaaaaaaaaaaaaaaact

SEQ ID NO: 3736 - DNA, 539 bp, Triticum aestivum
  Clone ID: PAT_TA_3736
gcacgaggctgaaatcggcagacgctgcctacggcaagatcagcggcatggtgtccacgctaggcgaccccttcacaaggatcatcacccccaaggaatatcagagtttcagggtcggaagtgatgggaatttgcaaggggttggcatattcataaacagggaccctgcctcaggacgcttgcttgttatgaactgcattgagggaggcccagccgaccgagcgggcatacgtgaaggcgatgagctagttgagatcaacgggaatagtgttttggggttggacgtggaagctgtggctcagagacttagaggtcgtgctggaacgactgtggaagtaaaactattggatggtactggaaatgaaaggagtggtaggataaagcaaaaagaggtccagctatctcgtgaggttatcaatctttcacctctatcaacggcaattatctcccatagatcgggtgatgggcatgagggcaagactgggtatgttaggttagctgcattttctcagactgctgctgctgaaatggaaagggcc

SEQ ID NO: 3737 - DNA, 537 bp, Triticum aestivum
  Clone ID: PAT_TA_3737
caggtcgtgggatcgcgggcgtgcaggtctcaccgaccctgcggcagcgcactcagcagagtgtgccaggccgtcgtcgctgccgtgagaaattttggcgtcgagccgccgtccgacagctctcttctctacgacccgcgggaagaagacctcgcagttcagaggatcaaacacacccctgatctccggttctttgacaaggccgccgttgtcgtgccttcgggcaaggaggtggagacggcagccgcgtcgacaccgcacagcccgtggagactctgcatcgtgacgcaggtcgaggagaccaagattctcgtgcggatgcttccgctctgggcgaccgtcgtgttcttctatgccgtgttagcgcaggtctcgtcgacgttcgtcgagcaaggcatggcgatggacgccgccgtcggctccgtgcgcgtcccgcccgcgtccatgtccaccttcgaagtgttcgccatcatcaccttagttccgctctacgaccgggcattcgttcctgcggccaggaggctcaccgggaggggg

SEQ ID NO: 3738 - DNA, 404 bp, Triticum aestivum
  Clone ID: PAT_TA_3738
gggccccgtggcctggggtcgggggttaattgtcccgcctttcgtgtccccttcttaagctgaaggttggggaccggttcgccgggggggggacttaggcgagacgttgccaggatgccccgtcgccgtcaagggccttcacgccgaccagtgcggtacagatctgtcgtggccgatgcagtgacaagcgatttggagggaaaaagctgatccagccatggtcctcgcctaggaggaggacgagttccatcacaccagcagcagttcaggatgtaatcgggattatcattcaaaaaaaggaaatcgggactgatctacacaagaggcgtcatgtggatctatagtaggctatggtaaatcgggactgctatgtcatgctgatctacacgaagttgatgtacctg

SEQ ID NO: 3739 - DNA, 1227 bp, Triticum aestivum
  unsure (1)..(1227): unsure at all n locations
  Clone ID: PAT_TA_3739
caactctcgcttcacgcgccggggggggacggagcaaatatggccacggcggcggcggcggcggcgacgatgcgtctgtcttccccgttcagggccccgcctctccgtcctccctgccaccgcgtcgtcccgtcgatgcggggccccaggcgggccgggctggccgtctcggcggccgccgccgggtcgccccccaccgtgctcgtcaccggcgccggaggacggacaggccaaattgtgtacaagaagctgaaggagagggcagaccagtttgtggccagagggctggtcaggacgccggacagcaagggtaagataggcggcggcgacgacgtgttcatcggcgacatcagggatcctgggagcattgctccggcgattgagggcatcgacgcgctcatcatcctcaccagtggggtcccgaagatgaagcccgggttcgatcctagcaagggtggacggccggagttttactttgaggaagggtctgatcctgagcaggtggattggataggccaaaagaaccaaattgatgctgccaagagcattggtgtaaagcagatagttttggttggatccatgggcggaacagatatcaaccatccattaaacaagcttgggaatgggaatatactggtgtggaaacggaaggcagagcagtacctagcggactctggtctaccatacacaattataagggctggaggactacaagacaaagatggtggggtgcgtgagttgattgttggaaaggatgacgagatcttgaagacggaaacaaaaactattgccagggcagatgttgcagaagtttgcatacaggccttgctatttgaggaagcaaagttcaaggcgtttgatctggcttcaaaacctgaaggtgaaggaacaccgatgacagattttaagtctgtttttgcacaaattgctactcgcttctaagaggacaagatcattctggccaatgaaatgggacagtatctttaattaggcgatatggaatttgtactgggtcaggttagtgttctgtttattaattgaggaaatgcaacattttattctacgcactattattccatagtaaattttgtgtttatctcttttctttgtggtcaatggattctgcataaaatgtttatggcccttctgttacctggttgatctgtcctaatttggatgtacacacttagtatttgcagttagtttattttgtaactaanaaaaaaa

SEQ ID NO: 3740 - DNA, 895 bp, Triticum aestivum
  Clone ID: PAT_TA_3740
gtatgttcttcctcgtggacaggatcgaacaagcgccactggccgtcccaagcgcatctggtgctgccgtcccccgcgcgtcgtactctggctactatcactggccacgataggacgttgctccggccactgcttcagtagtccaagtgccccaccggtgtccgtccaagttcctctccctgtgctccttcatgccggagcagcttcagaggggcctggctccgctggcctctgcgttgtacgtcagttcaaccagagcgcatggggaagtccaccgatggcagccgcagcccccgccctcacatcctcaccatctcctggcaaagctcgcctcacaacctcaccatggagttccatgggttgtggctcccatggccggcttcttccccagtcgccgcgaccccatccgaacgacacaccaccacagggctactccatggagactacaccaacatgatggagacgctcggcctgggccagccctttctagtgcgcctggcacctcccaccgttcaagtactgctcccatggaggccaaatcgaacttcaccaaaatctagaaaaaaagatgagcaacaccagggagctacacgaaaacgaagttgacgttgcccataggctgccgtgatgtccatgctgaggtcaggaggttccatcccgttgctcgtcaaccctcctggagttcggcgctctttgtgcttttggtcgctgtcgtttatgtcaattgtgtgtgtgtgtgtgtgtgagagagagagagagtagagagagtttgttgtacactttacagtcctcggtgctgctgctacatgctttgtgaaaaagctagagcaaaagggaattaacaattaatatataagaatttgtgtttggttgcaaaaaaaaaaaaaaaaaaaaa

SEQ ID NO: 3741 - DNA, 618 bp, Triticum aestivum
  unsure (1)..(618): unsure at all n locations
  Clone ID: PAT_TA_3741
tgcatcatacactgcgacatcaagccggagaacatcctcctcgacgacgagctgggcgccaagctcgccgacttcggcatggccaagctcgtgggccgcgacttcagccgcgtcctgaccacgatgcgcggcacgctcgggtacctcgcgccggagtggctcgccggctcgccggtcaccgccaaggccgacgtgtacagcttcggcctcgtgctgtttgagctcgtctccggccggcgcaacaatgccccatcggaaaagggaggctacgggatgtacttcccggtgcacgccgcggtgagcctgcacgagggcgacgtggtcgggctgctcgaccagaggctggccaaggaggccgacgtgaaggagctggagaggctctgcaggatcgcctgctggtgcatccaggacgaggaggctgaccggccgaccatggggctcgtcgtgcagcagcttgaaggagtcgccgacgtcgggctaccgccggtcccgtcccggcttcacatgctgacaaaaggtgaacgcaagcgccggtggaggtgaacaanaatgaattctattcgggngaggcaagtaacaaaactancgacangaaaaaagcgntgngaggcnaaaatt

SEQ ID NO: 3742 - DNA, 661 bp, Triticum aestivum
  Clone ID: PAT_TA_3742
ctcgccgccccacgtccggactgcagcagccggcccctggatacacttcagcgcggaaccgcggcggccaccgctatcactccccggcgaccgatccaaattgcagcttccattggccaacggatcagagagcgcgagaccagccggatccgaggtttattttaatcaaagatctgaagaggagcgtgcgccccgttcaggatctgattgtttgctgactagttaatttttgtggatgagagaattttctggtgctttgtggatgtcctgctggatggaggctggatgtctcacgtggaagaattgattcatgtggcttgtgggggtgaatggcgtagcatcccatcgtcgatcttcagcacactctgttgatcctaccgctagcggcgcccagtcagccgtaaacagatcaacatatttctttaattatttttgttagtggacatatgatcaaatggattcacaaatagtgatttcagctgctatttcttctttgggaaagtagtatatacccaacaaaaaggaacagtacctctggtttctagtttaatcactatgttgaaacctttggttgaaggatcaagaacggcaccttgctgccatcttctttatatgttcagtattgtctcaatatgaaattgctgctagaattttctatttt

SEQ ID NO: 3743 - DNA, 838 bp, Triticum aestivum
  Clone ID: PAT_TA_3743
gtccgggatgcccgcgtcgccccccgcggccgcgcacgccctcccgctgtccgccgcatatgccgcggcccccgtctgtggccccgctcccgcccagtccctcccgaaatccatcggaagcccacccccccccccgtagccccgctccctccccgtcccccgacaaatccccccctgtcgctcccgaaaccgcgaagaggaacagcgaggcgacgccggataaatctccccctgtctgtctccatcgcaaagcccgtccctttcttgttccgcctgaagccctccccttgttcccgtcccctctccgcgtgtgccgaatcgatcttgcttggcggcagagggaggacggaggagggtgacctgctcggctctgccatggcattgcccgcgcgcctcgtgcgcgtcgcgctgctcctcctcgtcgcgctctccttctgcgccgccgggacgcaccgcgctccccgcgagccccaccgggcgctccactccggccaagcacgtgggggcttggtggtgagaagatcagttgctgaagctcctgctgacataaatgtcactaccaacagctcctttgtgttggcggaacatcgaacatttcgaaaggaccctctgaatgcgttcaacagatatgaaggaggttggaatatcagcgaagttcactactgggcttctgttggatacacagcgtatcccttgttcgtcgtggccttgctgtggtttgtgctgttcttccttcttatgctggggatttcctgccaccattgctgctgtgcgcaccacagttacaactactcgagaatagcatatgccctttcactgatactcctgatattattca

SEQ ID NO: 3744 - DNA, 825 bp, Triticum aestivum
  Clone ID: PAT_TA_3744
ctgtgcggcgctcaggcggcggggccggcagaggcgtcaaatcatttctttcagtccacctcttcttcttctcggcgacggcggcggcaggcgggcgggcgagcgaggaaccctaaccctaaccactacttccgatccgcaagggcttcgacgatggcggcgtctctccgcgcggcggcggcggcggccacgaggatcctgcgcccggcggtgcttccaggggagcggcttcgccggctcgtccacaccgagcagcatcccgcacccgcctgttccttgaaggaaggataccgtgggtcgcaaatccagcagaagaaagaggagctgtacgcggcttcccagctagacaggcgcccaataactacagccaagaaggtgaccgagtggactgcgacagcgtttgttcttgttgctggtgcggtcactctgggtggcctagctactgctgagggagcgcacaagcaagatgaaagtgatgaaaggcgttgccaatgtcgtccgtggctatgcgccgagtgcgagcagagtcagagtcttaggcgtacaaatgcctgagagtgtggccaagcaagtggatcggcgccaaatcaaaaggaaactgcagaagcgagtggagtgaacgaaatgcatcttgttctattccagcactatattatgcgtgtctcctgaaagttatgtctatgacttgcagtctactgtggaactttagcattataactggatgatctgtgatcgcattgtaagatatttgtcatgtcgttgacatggtatgttatgtacttcccatttgagcaaattctatgaagatgaggctgcgtttttatg

SEQ ID NO: 3745 - DNA, 947 bp, Triticum aestivum
  Clone ID: PAT_TA_3745
tagtgatgttcctgctgctaatgtgtatgcggctgaaaatcaaaagtagaagagaaaattttgctgctaatgaatatacaaagagagagggttgatgttgctattttgttccctatttatattggtcactctataggattcttatcgcattttcttgatctgggggtgattttgtgtccttttaactcatgcatatcgtgtgtgggttctgtggggatttcaccattagcagaaagatcaaggcaatgtgataacttttatgaggccatattttgtgtctaaatctgcagagttatatgatgtgtaaattggcagtgttgctgaatggaaggaggtaatttgcttgctctttctaaatttgttggtttcttcatgctatattgattaatattgtaatatttaatattccctcgccgccgccctcgcggccgtgatcttggtgttgaaaaggcagtacgaacactcgattagaggatcctgctaggcctctctacctcatagaatttgatatgggttgccttgttcctctcattcttattcttctcagaatttagggttgggcgttgaacatacatgcacaggttggtttcagttttctgtgtaaactgaaataggggataagtcaatatacatatgtcgtgttccagattagaaattaagagaagagagagagaaacgattggttagtaaaatatgtagctgcaagtttacatagtggaattgctgaccaaagtttttctccaatgtacctcgcccgcgtccccgctacttaaaacttgtttttcagcccgttttctgtcatcagaaaatacaaatagcatttttttaatcagttaacagtatgaacagtcagctaacaatacaaatatggtagcatttttcagcctattacttactgaatgcgagtcattggcattttttcagtcggttaacaaacagtttttcag

SEQ ID NO: 3746 - DNA, 569 bp, Triticum aestivum
  unsure (1)..(569): unsure at all n locations
  Clone ID: PAT_TA_3746
actctctagccaagcacgctcagccctgacgggcaagagtttgacgcgcgtgtgaccggagcgcgcggcggcgatggcgaacggcgaccaggacatggccaccgcggaattgatggagacagaggggctgaaggtccttgctgtggacgatgatcccgtctgcctccagaccttgacgcagatgcttcggcgcggcggctacgaagtgacggccagcgcctcgcccgcagatgcgctgaaagaggtggagaagaacccggatgggatcgacttcatcatgaccgtcgcacagacccggggcgggcgcgagggatggacggcttcggccttgtcaagcgcgtcgggaaacgttaccctgtcagcctcgtgttctccggcgaccgacgaccatggagacaagggaaaggggggaaagcagggattggcgcttgctacttgatggacaagcccttgcgtgacgcgcagatatatttcatctggcagcaagtcntgcggtggaggcgcaaagccgccggcgcagccacggagaaccctaaccctcgccacagccaaggcatccgtctggatga

SEQ ID NO: 3747 - DNA, 822 bp, Triticum aestivum
  unsure (1)..(822): unsure at all n locations
  Clone ID: PAT_TA_3747
gggagccttcccgtcgcttgacgcgtttctcgatcgttccccgtggcggcgggccgcgcacgccgccccgatcatttcgcgggtctctcccgccgcgggtcgccggaggaggatgcccgtggaaggcgccgtggggatcaagggcgaggagatggagcaggcctcggcgacaactcctaccaccagtacgatcaggacaaagcgagctcgtcccaagagcagtgccacgctcaagactccagtggcggctcctcctggaggggagggtggtccggaggatagggaccacatgtaccggggtgttcggcagcgcaggtggggcaggtgggcctctgaagtccgtgagcccaaccgcggcaagcgacactggctgggcaccttcgacaacgccgttgacgccgccctcgcatacgacagggccgccgtggccatctttggctcccgcgcaatcgtcaacttcccatctgccttcttcatctccaccgcccagccagtgcaatgccatcccgcgtcttcttctccttctgccgctgctgcctctgtctttgttgagcataaactgaggccgatgctcgctgctgcctctgtccttactgagcatggagtgaagccgatgatggctgctgcctctatccttgatgagcatgaagtaaagccggtgatcaccgcctctgtcttcggtgagcgtgaagtgaagccaatggtcgctgcttctgtctttcgtgaacgcgaagtgaagccggtgatcaccgnctctgtctttcatgagcatgaagtaaagccggtgatcaccgnctntgtcttcggtgagcgtgaagtgaa

SEQ ID NO: 3748 - DNA, 613 bp, Triticum aestivum
  Clone ID: PAT_TA_3748
ccacaccccaatgccggatccaagtcccaggagttgccggattcgcgcgagatacactgcttccaagcctcccgcagtggtcctcttcccggccgaccatcttcctcgcaggtttgggtgtggcgtgccctgcatctcgccggattcccacggctctcctctgtagaagggcaaaaggtttgccggatctgggcgtctgcggtagttgtttttcgacaacctccacctcaggcctcctgctcgcaagcgcctcccgtggccgtggacgccggcgagtggcgaccgtcggaccccccgcgcctgtagccacgggatccagccggatccccttatcctcacctcggatcgtgcggtgacctccatgtcaccggtgacgagctccaacaccgacgcccacacccccctcccccctccccgagcatcgatgaagaagcgtgcagtgcagtgtgcggtgcgtggagatgtagtgcagtcttccggcgcattccccggatgcgtgcgaggggagtcgacagctgcaccaacgccccatggaagagcagtaggcgtcgctttgcagttaagaaaaaaatgcttttggatttttgctgtcatttttttgtgtattcagccc

SEQ ID NO: 3749 - DNA, 817 bp, Triticum aestivum
  unsure (1)..(817): unsure at all n locations
  Clone ID: PAT_TA_3749
gattcggacgagctcgagggcttctaggtttggatacgcgatgaatccccttccggccgcctctgatgttacggagagcgtgcccgacgccgatggagccagaagcgtgcaggctcgaatcgcccgcggaccgccgtcccaaagaacattctctacctgcgattctcagaagttgatcgacctccggggattagttgggctgattgacgtcgcccgttccccaggtggttccggtcctgtgatccgcatcgccggtactagttctcttggccacgccatctacaagaaggcaccacgggagctcccggggctgattgacgtcgcccgtttccgaagaggttccggttccgtgatccagcggccgcagctgccaccgccgcgctggtccctcagagattccttaagcgaccccctcttcgagatttttgcggtatatacgcatttccctctcattggcgaagtattggtcttcaatggcatggccacacagatcatctgccagagcaagagtgtggatgcgtttaattcaagcaaagcgcaatgggaattaaaacatcccagatctaaacatgttttcaggatggagctgcctcctacggggccatcaaggtacatctcagccgaatcaggcgttctccttcaagtgaagattgacccaactgagaatgaacctgtggaggtatccaacaagctggtcgattggttcaattcgcccatgtctgacaaatgcaagtctgtcaccatccaaacacgcaaaggcaaagtagatgtgttatgcgcggtgataaatgatgctgtnnnnntcaccctgagtgnn

SEQ ID NO: 3750 - DNA, 427 bp, Triticum aestivum
  unsure (1)..(427): unsure at all n locations
  Clone ID: PAT_TA_3750
caccgacagaagggtacggctgcgagaagacgacagaagggtacggctgcgagaagacgacagaagggatctgccagtacttctactggtctctccactacgccagtgggaaggagacggcggagttcccgatcgagccagaaataacgctggagctgatgatggctgcaaactacctcgacacttagcctggaaaactgcatggttgttgacaagatgaatccatcgtccatttgggttcattcagtagaagatgcgatgttccaccattgtgcttgccatgtctcagtatatgggtttagtaaactataaactactaaggttgcgatggatgtattgcgcggttagtagcatgaatctgtcgtttctggacttaacagcttggccgggatcagatcntgttgttgtgtcatatcaatcaaaactg

SEQ ID NO: 3751 - DNA, 585 bp, Triticum aestivum
  Clone ID: PAT_TA_3751
gccggccggtttcggacatcgacaagaaggcagccatggtttccacaccctccggaacatgctcacctcacctggtggcttcgcggagacgcgcgaaggcgaggtgaggttccctgagatcagcaccgcgatcctagagaagatctgccagtacttctactggtcgctccactacgccagtgggaaggagacggcggagttcccgatcgagccagaaataacgctggagctgatgatggctgcaaactacctcgacacttagcctggaaaactgcatggttgttgacaagatgaatccatcgtccacttgggttcattcagtagaaaatgcgatgttccaccattgtgcttgccttgtctcactacagtatatgggcttagtaaactaaactgctaaggttgcgatggatgtatcgcgcggttagtagcatgaatctgtcgttactggacttaacagcttggccgggatcagatcttgttgttgtgtcatatcaatcaaaactgaggcgcgaccaaaaaaaaaaaaaaaaatcatctcttggactgtgatcagctgggcacatgtcgcttgtttctacatcgccc

SEQ ID NO: 3752 - DNA, 768 bp, Triticum aestivum
  unsure (1)..(768): unsure at all n locations
  Clone ID: PAT_TA_3752
cttcggctgtcgctctccttcgcggtgtcgtcgcctctcatccaagctttagcgagggaagggatccaggccgtgatggtggggaaaggagccgaggccgcggcgatggagcggagcacaagcgaggagcatgaggaaggatggcgacatggttggcgtggtgaagctgatcagcgccgagggtttcgagttcgtcatcgacaagaaggctgccatggtctccagcacgcctccggaacatgctcacctcacctggtggtttccccgacacgcgcgtgggcgaggtgaggttcccgggagatgcagcaccgcgatcctagcagaagatctcccagtaagttctactggtccctccactacgccagtgggaaggagacggcggagttcccgatcgagccagaaataacgctggagctgatgatggctgcaaactacctcgtgcacttagcctggaaaattgcatggttgttggcaaggttgatgccatcgtgcaatttgggttcattcagttagaaaatgcggatgttccaccatttgtgcttgccttgttcctcagtatatgggctttatgtaaactataaactactaagtgttgcgatggatgtattgcgctgttactagcgtagcatgaatctgtcgttactggacttaacagcttggccgggatcagatcttgttgttgtgtcatatcaatcaaaactgaggcgcgaccagaaaaaatcagcaaaaacccggnacaatcccaaagngctttaccgncaaggcgcg

SEQ ID NO: 3753 - DNA, 595 bp, Triticum aestivum
  Clone ID: PAT_TA_3753
actttagggttgtctcggtgtcttctatatagtttttatcagctttcttggagcccaacagggatgtctcactatcttgaaccttatctacattacttcctttaccattggataacagggtactcttctccaatattttattcgcattctaaaagagaaacaaacaaatgcatctcaggtttacaatgtagtatatgaaactcattttggtaaaccagttcagtagtaaggtggacaggataacagcatgaaacaaacatatatctatgtagtatcgtcactgtatggtctatatcattctagtttatgttgccaaatcaagatagatacagttcaaatcatatctatttaagacaaagcagcatagacataatataagtgtcggaaactagacaacaataacaacacttgtaatgtgcatggcatgagaacataactgtttcttcaattgaaactaaaatcaacatagagaaagttacaatgaactaacatgttaaagaaataggtttcaaaacatagctgttgcgccattggagtttcaattgcatccttcaaattagaaattagttggtatgagtaaatatagtgagcaaga

SEQ ID NO: 3754 - DNA, 756 bp, Triticum aestivum
  unsure (1)..(756): unsure at all n locations
  Clone ID: PAT_TA_3754
cnttccgggggggcccgagccatcagtgagataccactctggaagagctcggattctaaccttgtgtcagacccgcgggccaagggacagtctcaggtagacagtttctatggggcgtaggcctcccagctcgggccggtgcccccccgtcctgtcctcgtggacaacaccgaagtgtcggcggttggttttgcggaaggtgttggtgtcatcttcatcaagacaagggttgggttgtacaccattcagctcaaatcagaacaaagcaaccaggtgcaccgagggtacatcaataaggtcatgccctacgtgagcttctacactggagcatgggagcctttgccagcatctgatgaagcttaacgcgcagttgttgatgctacaatgatatgaccaaatggcgtcagggcctgggtttactttttctgcccaggaagaatttgaagtgaacttgagcctcatttcactgccggttgtgttgaacagtttgtttagtgtggatgcgcttttgtcctatttgtgcttgtgccataaacttgagttcgttcgttcgtccgggttgggtgcggctcaaactgtccgtcaggagaaattttagcgatcggttgacggttttgtggcatgaattggtgcagatttctccttctctatctttggctgttagagatgacgttgttgtcttgaaaatgcactctactgagatttttatgtggatctgtctattatatgcattaagaaaaaaaaaaaaaaaaaaaa

SEQ ID NO: 3755 - DNA, 1439 bp, Triticum aestivum
  Clone ID: PAT_TA_3755
cgtccgcccacgcgtccgccgccccctccaaccccaccccaaattacacttccgccccccgcctcgccgcgaccgacgagcgcctcggactagctcctagggtttgtcttaccgagccgcccgtccccaccccgtctcgtcggcggcgatggcttcggagtccgccgcggcggcggcgtcggcttcgtccccggcggcggcgcgggccgggggcgggaaggacgacgagctggccgatctggtgcggcgcatcgtcgacgtcctctcccgctactccgatcgcctccccttcgacctcgaccgccagaagcttcgctcgcttaccacacttgctgcaattgccatcacaattgtatttgcctggaaactgttgagagctcctccagagcaacctcggaggcaacggagacgggatgctccatcatctagcaacacaagcagtagatcacagccaggtgctttggtcggaacggatgcctgctcatcggtagattcaagagcacatgaagcgatcaatcagcttttccaaccagtaaatctgactcttgagcagcttgtcaggcataaactgagcgaagggcgaagggttacctgccggttacttggtgtgattttggaggaaacaactccagaggagctccagaatcacgtcacagtgagaccttctgtcttggaggttcttctagaaattgcaaaaatttgtgacgtctatctgatggagcacgttcttgatgatgaaagtgaggaaaaggtactgtctgccctaagtgaagctgggctttttaccagtggcggtttggtgagagagaaggttctcttctgcagtacggaaattggccgcacctcttttgtccggcaactggaacctgattggcacattgactcgagtcctgaaatcgttcaccagttatctaggtttatcaagtatcagctgcacatttcgccacagcaaacggaaagggtgtcacccaatgttttcagctctgcaagcttggaacagttctttggaggtcttgatcagagatgacaaagtgaggtcagactcgagcgagccgtggcatagtgagagcgcagaggaacatcattgttcaatttattttcttgaatggtgcaattcgtttttcttgtattgtgtgtaaaagtcttgttgtggctagtactaaacttgttctgcaatgccccataaactatggatagaaagacagcacctgtagattcatgtatcaacattgtccctgtataaccaaagtaaacagctgtcaagatgatgatatgtattttcacaaccgggcaaaaccagcacttcaaagctcaaaaaatccctcgaaaacataaataaaactggggggtccgctttcgaggatcccagtttccgtcctcgagcgtgccacgtcatatcttttcttttgtgtggcctacttagattttacttgccgggg

SEQ ID NO: 3756 - DNA, 499 bp, Triticum aestivum
  Clone ID: PAT_TA_3756
tcgattcggacgagcggcgcactctcccccatttaaacccctccgtctccggccagcccccccttcaccgccacccacccaaccctcgggagcaccgaccgccggagccccccctcgtccagccgaggccaccggggtttcctccgccccccgcctccgctccgccccaccccgccgcagggttttaactgcctgtgcttgcgtaatggaagatccaccaagcgatagcgggcaatcagcaaacggcactgagcctgatctggaccatatgcaattggatgacaatgaagagagcatgtcccataccatggatgattcaaatggacagtcttctatggatgttgacagagaacagctttctatggatgctgatatgaatgggaaaccatcctcggatggtgatggtaagggaaagtactcttccgagtcacatgcagaagttccaattgacatgagcttgggaagcctagagaagttttgcaaggaagcatcaaggtca

SEQ ID NO: 3757 - DNA, 669 bp, Triticum aestivum
  Clone ID: PAT_TA_3757
ggcaaaatgcaaactgcaatggcgagtgtttcaacctttatagctatgtttatcatcatgctcgcagccatgtcctctggcatccttgttgcctatgctaacaccgaattcatctcccgcacatgcaacaagaccaacaacaccgcattgtgcattgccgtgcttaccacaaagccacaaagtgcccatgcctccaccgaacacgacctcgccagaatcgcattggagctcaccattgacaccgccaaacacaacgtcaaggtcatcaatgacctagacaagaaaaaacagagcaagccgaaggcatttgcactggccatctgccttaaggcttacactgaagccactagtgcccttgagatttatgctgtctcgaacttccaaatggggtcgtaccccagtacgttggccaatgtttcattcgcgatgggcgctagtgatacatgcaagaaagcgttcaaaaggatcggcaaggaatccccagtgtcctacatagaccgcgagatgatagagcactgcagtgtcgccagcaacctcatcaacctacttgtccgcaagtgatgacattgcattcctggcacatagatgcctattgctaataacaagataataccctgctgcttgttgcgggaatttgtagcactatattgagtattatggagtaagaaa

SEQ ID NO: 3758 - DNA, 1490 bp, Triticum aestivum
  unsure (1)..(1490): unsure at all n locations
  Clone ID: PAT_TA_3758
gtcaaccgcaacgcaaagcgcaccggcctccccactccgcctcccttccttcttctgcaccctcatctcccctccctccttcgactgcaggccgcactaaccacgaggggagtacacactaaccacgaggagagccgatgggcgcggggagggggtcgcggcctgacagcatccaaacccccaccctcgccgcgaccaagcgtcacgccgcgccgctccccctcgccgccgcagtcctgcgcctcgtcggcgccctcctcgcctccgccgcccccggcttcgactacgcggcggcggtctacgtctgccccgccaactccgacacgggcggctgcaacgtcggggacttcgagcccaagccccggggccacggcgccaccgtcttcggccccccgtccccccccttctccgccgccccgcctgacgctccacctccccgcggatgcgacggatatgtcattcttgaatgcatacttgatgccatttgtcgcgccttacttccgggcaggtggttaactttgctcacgctggctgttcgattactccagcaagtgcaacatctgtcagccctttttcatttggtcttcagattaagcaattctttgcattcaaggaaaaagtcaccaggctgctctctcaaggagataggtaccgtcggtatattcctcagttggattacttttcaaagggactctacatgtttgatataggtcaaaatgaccttgctggtcaattctactcgagaacagaggaccaagtcattgcatccattccgactatcttgtcggaatttgaaactgggctcaaggcactatacgatcagggtgccaggaagttctggattcacaacacaggccctcttggctgcttacctcaaaacatagctctttttggcaaagacccaacacaactggatgaacttcattgtgtagcaaagcacaatcgtgctgcgaagattttcaacttacagctgcatgcactttgcacaaagttgagaggccagtttgctggagctaatatcacttacatcgacatctactccatcaaatatgccctgattggcaattactctcgatatggatttgaaagtcccacccaagcatgctgtggatacggagggccacccctgaactatgatggcagagtgccgtgtggacagacgaaatctgtgaacggtaagctcgtaacccgcgaaaggatgcagcgacagcactgagtatgtcaattggggatggaatacattacacggaagctgcaaatttccaacgttacatcgcagatcctgaccggggagnaccaantctccgttcgtccgacaagagccatcccttataaaaccgagtccnaatgactggnatttatcccacaacggaatantaaacaatgtaatgttgtttgacacaactgatgtataattacacagtcaatatcacatatactcttttcaataagtcaatagtttttgggantgnacgtcctggaaaatacnc

SEQ ID NO: 3759 - DNA, 926 bp, Triticum aestivum
  Clone ID: PAT_TA_3759
gaattcggcacgagccctagccccacagcccggggccgccgccgctgcgcgccgccgctccctcaccgcgaccctctctttctcctcctcctcctccatggccggggcagcaccctcggaggaagcgctccgccgggcgctggcggagaggcagacggcagtggacgcgcaggccgatgccgtgcggtcactcaaggcctccggcgccaaggagggcgtcgacgcggcggtcgaggcgctgaaggcgctcaagatcgaggctggcgcggccgcgcgcaggctgcaggccgccgtcgggtccggcggcggcgccgcgcgggaggagatgcggcaggcagtggggaacaccctcgagcggaagctcttctacataccttcgttcaagatctaccgcggcgtcgccggcctgtacgactacgggccgcccgggtgtgcggtcaagtccaacgtcctggccttctggaggcagcattttgttctggaggagaatatgttggaggttgactgcccctgtgtgacacctgaggttgtcttgaaggcatcagggcacgtcgagaagttcaccgacctcatggttaaggatgagaagacaggcacatgctatcgcgctgatcacctgttgaaagatttctgcaaggacaagcttgagaaggatctcaccttgtcccctgagacggctgccgagtttaagcgcgtccttgctgtgttagatgacctctcaccagaggaactcggtgcaaagatcaaggaatatggcattgttgcccctgatacaaagaacccactctctgctccctacccattcaatcttatgttccagacatcaattggcccaacaggtcttagcgtggggtatatgaggccagagactgcacagggtatttttgtcaacttcaaggacttgtacctcggccgcgaccacgcta

SEQ ID NO: 3760 - DNA, 749 bp, Triticum aestivum
  Clone ID: PAT_TA_3760
cgctcgttgtcactcgacaccatgtggaacaacggggcgatgagcggccaagtttacccgccgccgccgccggcgatggtgccgcagccgcagccgcacgggcaggtggcggctaacaactgggcgggtaacgacgccaacacgctgctggtggtggcgacgctgatcaccacgctcacgtaccagctcgggtgcagcgtccccggcgggtactggcaggacacgctggcggcggacggcaagcagaagccgcacgaggccggagaccccatcatgcgcgacaagcacccgcaaaggtactgggtgttcatggcggcgagctggatggggttcctggcgtccatgatgatgaacgctgagcctactggtgcgcctgccggtggactcgcggcaggtccggtggtccttcgccgtcgcctactccagcctggtgctcaccttcatcgtgtcgcaggccaagacgcacatctcaatcgacatcgtcatctggttggtcaccgtcgtcttcctgtggctcatgatcagcgtccgccctgaccaccgggagcgtatcccccgtttcttttgctgcaaccgcgagaagtgacgccccaagcttagcgttctcatgtctttgtcgattataaactgctgtgagttcagaatttttcgtcgtctaagaagttcagaagttgtaactttgtttagactcggggtaataacaaaagggggacgcctagacgtcacttttttttaaaaaaaaaaaaaaa

SEQ ID NO: 3761 - DNA, 411 bp, Triticum aestivum
  Clone ID: PAT_TA_3761
ggcagcggcgacgccaaaccaaagttcatgaagaggactgcgcatcggctcaagactctgtgggcgcgccatgacatcgcaacccagatcaaggagctcaaggctcgcgtcatgtaggaaagtgagcgccgtgacaggtacaagcttgaagagaattactacagtgcaacgaagacggtcgggatagacccgataactgctatccacgaggaggtcaagggcttggtggcaatggacggcccaatgaagcacgtcattgccttgctgatggatgagagtaaagagttgaaagtggtgccgattgttggatcaggagggctggggaagacgaccctggccatggaagtctatcgcaagattgcattaggaggagactctcagtgtcaagcttgtgtgtcagtgtcgcgcaca

SEQ ID NO: 3762 - DNA, 1159 bp, Triticum aestivum
  unsure (1)..(1159): unsure at all n locations
  Clone ID: PAT_TA_3762
gtttggtacgtagcattgaggctctacatctggaccactggacgtgacacaaccaacggcgggttcgaggttgtgtgtccatctacgaaagagtggtgtgtaatctttgtcaagcaagtgacatcgtggaggccatggacgtcaagtaccccagcggctctgtcaagaaggtgaggcaggcagctgtggcgccggcggtgcaagaggcgaagtacaacgagtgcggcaggaaccacgcactggctagcggtgggcatgtcgtggacggctgtggggagtggatgcccttgagggacctcaaccccgccgacgcgtcgtcgtacaagtgcgcagcctgcggctgccaccgcagcttccaccgcaaggtgatgacggagaggtcgccgatgttggcgcccatggtggagacagtgctccacggcctgccgcagcgcaggaaggaggagacgccggaggactggctcccgggtgtcgactctgacaccaactcagatggcatgaagtacgactcggatgccacagagtacgactcagaaggcacggagtacgatgacgagcgctccgtgccccaaccactgcaacctccacctgtgtaccatccagcacaggtgacgcaacaactctcttctgggcaacataacttcctgccgagggcactgcagatccacaggcttgccacccagctctcaccggcgacggcgccaccgcctcatggggttatgttggagaggaagcggtcccgcaccaccaccgaccagaagttgcggatggaggagttgtcggagcacctggggtggcgcctgcagaagcgcgacaaggacttcatcgaagcaagatgccacgacataggcgtcagcaagaaagtcttcaggaactggatgaacaacaagaagcgcaagtaccccagcggccacaacccctccgctgcagcatcatctgttgtcgaaccatcccgtctcngtctttccccccaccaccatcacaccaccagtgttagaataaatcttgtatgtgtctagttttctctgccatggcaagattcggctgtcatggaagcttttatctgttctgctaccatggaagcatttataattctgctaccatgggtgttttcggctgccatgaaaagcatttttatgttaaaaaaaaaaaaaaaaaa

SEQ ID NO: 3763 - DNA, 469 bp, Triticum aestivum
  unsure (1)..(469): unsure at all n locations
  Clone ID: PAT_TA_3763
gggtcgacgggggaacccaaagcaacagcttccccttcctcctcagacccaccctcgctggctagccgcatctgctgccaagctccagccccgcgctttctgctagctcgtcgagttgaagattgtccaagagcattttgaaggttgacagtaaccttcggttgtcggaagatgtatcgcgccaagagagctgcattgtcaccaaaggtgaagcgccgtgtcggcaagtatgagctcggccgcaccatcggggaagggacctttgcaaaggtcaggttcgcaaagaacactgaaaccatggagcctgttgctatcaaaatcctcgacaaggagaaggttcagaagctcagattggttgaacagattaggcgcgaaatttgtactatgaagttaataaagcatcctaatgttgttcgactgcacgaggtgatgggaaagtaagcaagaantttcattgttctggaataca

SEQ ID NO: 3764 - DNA, 1947 bp, Triticum aestivum
  unsure (1)..(1947): unsure at all n locations
  Clone ID: PAT_TA_3764
agcaattccgcacgaggcaccgacgcctcttcctcccgagaccctcccgacccttcctcctcgccgcggctcctgctggggctccgcaacgtgctccagcccgcccccgcccgcccccacccccccactcccgccttgcggcgccccagtaccccctcgtcgtcccctgccgtcacggccaaagctccctgtacctcctcccaagctcacgcgccgcctcggcgctgcgtctcccgcccgcactccgccgccacgcccgcgttctctggtccgtttgtcgacgatgacggccattaaggagcctcttggaagcagcagcctcaccttcggctgtgggaaggagtgtatatggcttggacagattcgttgccaaaatagttctagcaccgtgtcagagcatacgaacgcgggccgccccctcggggtgagggaatgtaaagacagaagtttcattgttctggaatacattactggaggggaactctttgataccatttataccaatggaaggctgaaagaagaggaagcacgcaaatactttcaacagctgataaacgccgttgactattgccacagtaggggtgtgtatcacagagatttgaagttagaaaatttgttgcttgatgctgctggaaacctcaaagtgtccgacttcggtttaagtgctttaactgagcaagtgaaggctgacgggttgctgcacacaacatgcggaactccgaactatgttgctcctgaggtgattgaggatagaggttatgatggtgcagctgcagatatctggtcttgcggggtaatcctttttattctccttgccgggtttttacctttcgaggatgaaaacatcatcgccctttataaaaagatctcagaagctcaattcacatgcccctcttggttttctactggagctaagaagttgattaccagaattttggaccctaatcctgcaactcgtatcaccattcctcagatactggaggatccttggttcaaaaagggattcaagccacctgtttttgacgacaagtatgaaactagcttcgaagatgtctatgctgcatttggagactcagaggaccagcatgtgaaagaggagactgaacataagccaacctcaatgaatgcatttgaactgatttcactgaatcagggattgaatctggacaatttgttcgaggcaaaggaggagcataaaagagagacacgattcacgtcgcaatgccctccaaaagaaatcatcagcaagattgcggaagctgcaaggccacttggatttgacattcagaagaaaaactacaagatgcggatggagaacccgaaagcaggtagaaaaggcaatctcaatgttgcaaccgaggtgtttcaagtagctccatccctacatgtggttgagctgaaaaaggcgaagggggatactctggaatttcaaatgttctacagatctctctcgacccagctcaaggatgtagtttggaagtgcggcggcgaggtagaagataacagcaccgcggcatgaagcgcaattttccatgtacatagtccctagttcatatgtgggatggatggcgggtgttggctgcggaatgggttgtgcagaccgagttctttcgttggtttgttgatgatgatgatgaataggctccgatgaaacagcgggcgcgcagccagctgtggaagagcctatctatggcttcgttagtttgcttattacatattcatggtccagagggagattaaagccagaggcgaaaggccgtattgttgcaagattgtattggtaggaggttatattgaacagcgcaatgtgttactttgttctcactctacttagcattgtactgtactagtagtagctatagccggggagatgtctctgtagtacgtatgagattctgaataaataaataaaccgctgatccttgtcggcgaanaaaaaaaanaaaa

SEQ ID NO: 3765 - DNA, 1173 bp, Triticum aestivum
  unsure (1)..(1173): unsure at all n locations
  Clone ID: PAT_TA_3765
ctccgcctcgtcgtcgacagcctctcccgcgtcgacggcatcggcgaggcgctgctcgtcgtcagccacgacggctacttccccgagatggacgagatcgtcaagggcatcgccttctgccaggtgaagcagatcttcgcgccctactcgccgcacctcttcccggactccttccccggcgtcgcgcccggggactgccgggacaaggacagggcggccgagaagcggtgccggggcgagccggaccagtacggcaaccaccgctccccgcggatcgtgtcgctgaagcaccactggtggtggatgatgaacaccgtgtgggatgggctggaggagaccagggacttcgacgggcacatcctcttcatcgaggaggaccactacatcttccccaatgcataccgcaacgtgcagctgcttgtggatttgaagccgaagaagtgcccccaatgctatgccgtcaatttggcgccctccgatgtcaaggcgaaaggggaaggctgggagagcatggttgctgagaagatgggtaacattggctatgccttcaacaggactgtgtggaggaagattcatgccaaggctaagcagttctgcgacttcgatgagtacaattggtatataactatgtgggcaaccgtgtatccgtcgtttgaagctcctgtttacagtctgagggggcctaggaggagtgctgcacattttggcaagtgtggcctgcaccaaggccaagactccagcagtgtttgtgtggataatggcgtgggagccgtagaactagatgccatcgacaaggttcctaacatcaaagctgattggccagtccacatcattaggaaacaaccggggtatcaggctggtttcaaaggatggggtggctggggcgatcggcgtgaccgggagctttgcttgagctttgcgtacatgtaccatgttaaagacaccttgtctgcatgatggggttataggcacacgaattttggcattcatgatgcccttgttgtagtgttgtttggcatgtttcgatcgattcatacacggtttgtgatataaatagtctttcaccctttttccccattttgtagaatagttctctanttgggagaaattgccttggacttgggttaactttcccaactgtatgatgtacttttaactcactgatatggatag

SEQ ID NO: 3766 - DNA, 670 bp, Triticum aestivum
  Clone ID: PAT_TA_3766
gtatgcgggatagcccgcagccttcggaggtctatctttgcttggatggttattcctggagacatggaggtcgacaaggtcaagatggcaagcttgtgcttaattttgctcatggcactcctcttgcttcctgcaggatctgaaggccactgcaggcggttaagccagacgtaccctacttcgcaatgcaagggtgaccaatgcacagaggactgcgaacatgagggttacccgtatgcggagtgtgacacggaccatcaatatcctgaacttagttactgcgcctgcttctttccatgctgattctgcctcaagttgcttcaggatgtgaagcaacgtgcaataagatcttaaggcgagccgtctgtaacatccaaatatttcgaaatttggaatgttgaataaattagccaatcaataaatatagttgatttcccttgaataaggataaaatttcaaagggattaaaactttttatgggctttcttcaacaagttacttcaagaagtgaccccccgtgctataagatgttgcggaccgctcgcccgctcgcgttaccgagcttcaccggcgcgcgtcccctccccccctcgccgccgggccctagtggcgttggggcccggtccgatcgcccccccctcccttccccggcccctttgggggtaaaccc

SEQ ID NO: 3767 - DNA, 1161 bp, Triticum aestivum
  unsure (1)..(1161): unsure at all n locations
  Clone ID: PAT_TA_3767
aggaattcggcacgaggctttgcgcatccttccttgaagcgagcagaaaacgccttctctccacatccaaattccacacaccttactttgtgtttaagttttgtgccatggcgaaagacaacgacaacaacgctccaccggcgaccagctccgactccatgagctccggcaagggcagcaagggatccaaggccagcagccggctggtcctcggcggcgctattgacaaggggaagggcgtccccaaggttgaagaagaagaggagggttgtagatctaagggtaagatcatgacagcgccggtcgtagctgctcgcagcgatggcagatcaggcggccgccgcggcgacagagaactgcacatcatcacggagcgcgagaggcggaggcggatgagcgagatgttcaccaagctgcacggcctcctccccaccctccccgacaaggttgacaagtcgagcatagtgatggaagccatacactacatcaagagcctggaggggacggtgagcgagctggagaaagcaaaagctagagagggattttcgcagcaggaggcaagctcgccgnccgcagccaatgacggggtctcctcctcagtggcagcggccatgcctatgggcatggcgacgccgggtgactgggctgtcgggtggtgggatctggcagactggggcggcgcaagcgccatccatggctctgggcgcggtgaccgtggcgccggcaccggtgccgctacagacgtggtcagggccgaacgtcgtcctgagcctgtccggcaactacgcgtacatccacatgtccgtggcgcggcgtccgggagtgctcaccatggtgacggccgtgctggagaagcacggcatcgacgtggtcacgacggggatctcgtctgaccgttcccagtgcatgtacaccatccaagctcgtataaatggaatgagcaaccagttcggagatactgtggcatgtgacgacatatacaagctggcggtgtcagagataatggtttggctctctgactaagatggaatgctgcaaacctttgatgggcgtagtagaagttgtcggtcgattacatttgaggcttttatgtcgagtcgaacttaacctctgagtcgtgatgatatcacagtcttagaaatgtgtgtgcatcgtaaaaaa

SEQ ID NO: 3768 - DNA, 975 bp, Triticum aestivum
  Clone ID: PAT_TA_3768
gagcaccgttgcaacttgaggcgcggagtgcttttcatccaagcagagctgcatcttccgctaacgtcgatgggtcatctccagatagcagcttggattcgcctgatctgcacctgtaccggttctcaggtgtctcctctgcaaccgaagacttgcagctggtagctctcactgccccgggaagcactccacatcacggcattcagctgtctagatcaaccagtgacgggtatgaagcatcaggcgtctctctcaaccctgtcgccaaaatatcgacagatgccatcgacagtaatggcaatggacatggtccagcctagcaccgttgcaacttgaggcgcggagtgcttttcatccaagtagagctgcatcttccgccaacgtcgaatggctcgtctccagatagcagtctggattcacctgatctgcacttgtaccggttctcaggtgtctcctcgtccgcagctgaagacttgcagctggtagctctcactgccccgggaagcactccacatcatggcattcagctgtctagatcaaccagtgacgggtacgaagcatcaggcggtgaagacagcgaccgcatcccgtcaaggatagtgcaccgctcctccaactgggcaagcatcatcctcagcaccgatcagggtgtgccctcgtcgggcgcccttgtgccgaagaacagattgccttagactttccatgctcagcttccttcagacccaagaatgtaaatggcctgcagcgtgttctaacttgtttgacgccacctcccgttccgtagtttcgaatcctgttgtctcagctatgcatttttggaatttggtaaggtagagaatgtagaattgtttcgtttcgccgggggctcaagtgcttgtagtttttgctgtgagatgacaatttcaaagatgttgatatcttcagtatctatcagggcctcggtttgttggttcaaaaaaaaaaaaaaaaaaaaaa

SEQ ID NO: 3769 - DNA, 1431 bp, Triticum aestivum
  Clone ID: PAT_TA_3769
tcggcaccaggcctagcctttcctgccccccgccccctaattttccggccccctggccccgggcttgcctgccagcctccagccgccgccgccgcagctggcgcgaactcgcgcccccgcgcgcctcggcgcgctcggcgggcgctcgcgcctcgtgtgcccccttgtgctcgctcccgcgcgcgccccgaggtgggcgggcacgacaagtctgctccggtcaagggccacaaaaaccacgaccaccactaacccctcctcgtccgccgcatacggcggccggctgggttgcccgccggccgccacgtgataacggcacaacccccaaacggcgacgggagcgacggcggagccgtgtggctaccgaaaaaccgctgttgcggcacccggccgttctcgtcgatgatcccccccgggagctcgcctctgttcatggcgggcaagggctgcggcgcgtgctatgatgttaaatgcacgagcaactcggcctgctccggcgtgcctgtcaccgtcctcagccccggcctccgcccccccgacctccagtcccacgtgcacatccgcgtcgacgcccggggcgccatcgcgaagcccggcatggccgacaacctccccgacgacctccgcgccggcagtctcttcaggatggtgcactgcaggttgccatgcaagtaccctgccttcaacgtggcccttcgcgccggccccggcctcctcccccccctgatcgagttcgaggaccgcgtcggcggccgccggccgcggcccctcagccgggccccccgcggcgcccggccgcccctcccgcacgcccatggcgcagaactggggcgcgctgtagcgcctcaactccgccccccggcatgccgctgccccgcccccgccccctccggctcacctccgactccggcaggaagctcgtcgtcaacaacgtcatccccgccagctgcgcgccccggtgcaacctcccctcagtctcgttaccgccatatttacctgctccctgtgtgaattttatataccgcgaaaagaaagaatgtgcgtccgggtgctgcgagaggcggcgtcggatgagggaggaggggctcgcggaattgtgatgttccctccctgggtctctgcattcccctagtgatgtatcatgctgtcggtagtccctcaggatgtaaagctttccctttaaagattgtgccagctcttccctccatggtctctcggcactcccctagtgatgcgtgtcgtcgatttgtatgtattttgtttctcttcctctgttttgtcgatgaggagaaaagcttgtagtgcagtgcaaactaaagttgcacgccgatgtatcaagttgtgtgagtgtgtttttggagccctctccttgagagaaatgaacttttaccatcagataatttatgtgctgaaaaaaaaaaaaaaaaaaaa

SEQ ID NO: 3770 - DNA, 1670 bp, Triticum aestivum
  Clone ID: PAT_TA_3770
gcccgcgcccctaaactcctacgggatggcgcaagcgaaagccatttcagccatgtgcggctgcatgaaatggccgcaatcaggaaggcctgcgcctcattggaggaggggtatatgcccccagtcacctttgtggttgtccagaatacgcatcacaccagcctgtgccctgagggtgatgggcggcctgttttgactgacatgagggggaacatacttcctggagcggcgaggtcgccggtttgccgtggagcctgttgctcgtacttatcttgttcagttcgcagtcgccagccccagtatggctcggtctgtgttccctttttctctatgtgatacctgtactctgcggacggtttaggtcaggaagtgcgggatctaggtccgctgtgacctggtctctgttccagcccgggtgccgcctccccccatgttgctatggcatgatgctggaaaggtgaaaaattgtgcgccttgtgttggacagtggaacatgattaacaagaaaatgatcaatggaggaatcatagacaactgggcctgtgtgagtttttcacgcatgcgtcctgaggaggtacacaggttctgttgtgatctgattcagatgtgcaatatgactggaatgcttgtccatccaaggccacttgtagacaaccgatcagcttgccccatccccttcgagaatgccttgcgggatctctccgggaggactaccgaaatgcccggaaaacagggacccaaaatacagctaccactgttaaccgtggtggcatctacggacagttgttgctagcgttacccaggaacgcttgccggacgccgctaacgagtcaaatctcgaagctaagtttgatattgaggaggcgatcaccgggtctgcggcacggctcggacgccggctcgacccccggcgcctcactgcaggaggggtatatgcccccagtcacctttgtggttgtccagaaaaggcatcacaccaggctattccctgaggttcatgggaggcgtgatatgaccgacaagagtgggaacatacttccaggaactgtggttgacctcatgatttgccaccctaccgagtttgatttctacttgtgcagccatgctggcattcagggaactagcaggccaacacactaccatgttctttatgatgagaatcacttcacagccgatgcgcttcagtcactgaccaacaatctctgctacacctatgctcgttgcactcgtgcggtctctgttgtcccaccggcgtactacgcccatctcgccgcattccgcgcgcgctactacgtggaaggggacaggtcgaacggcgggtcaacccctgggagcagcgggcaggcggcgattgcgcgcgagggccccgtggaggtgcgccagctcccaaagatcaaggacaacgtcaaggatgtcatgttctactgctgagctcctgtggagggagctgttccttgtgcgacctaccctagcctgagttatgtgtgagagagcctgagatggcgatgactctgttttgccgtggagcctgttgctcgtagttatcttgttcagttcgtagtagccaggatatctatgactctgtctttgttaccttaaactctatttgagacctatcctatgcaagtggttttgctgggtgcaaaaaaaaaaaaaaaaaaaaaaaaaaa

SEQ ID NO: 3771 - DNA, 611 bp, Triticum aestivum
  unsure (1)..(611): unsure at all n locations
  Clone ID: PAT_TA_3771
gcaaaagtccgcaggnagcgaaatggcggagcggggcgataatatggaggcagagacgatgccgggtgattcgctagcaatgaatttgctccggattgccatatacaacatcagctacatcagaggcctattccctgagaattgtttcattgtcaagtctatcccagatataggaattgagattcagatgctcatgcacattgatcctgagattaggagggtcattgatctgctggaaaagggtgtttatgatgcgttacaaaagaattatctcaagacccttctactttgcatatgtgaggaggaaggggaaattattgaggagtatgccttttcatttaggtatccaaacttgaatcgtgaagatgttgttatggaagtgaatctcaccgggagtgaaaaaaatggcattaaattcaagtcaaatgccgcagaagtcactcctgatcacatgaggagtgttgcttgtaaattaatcagaactcttgtttccctcatgagcaccttggaagaattgccagacaagttcaagatccagatgaagctgctatactatgatgatgagacaccagaaaattatgatgcccccccttttgagtgctgtactggtg

SEQ ID NO: 3772 - DNA, 2225 bp, Triticum aestivum
  Clone ID: PAT_TA_3772
ggccccccagcgatgcagagcgatgccggcgcggcatgctgcgggcgatggccccggtggaggtcgtggtcatcgccgccgtccggttccacccgcccccgctgctcgggccgctcctcaccgccgtcctgctgcagcggccctcgtcggcccacatgcggccgcacacgtcggcccccgcgtcacctccgttctccaggagctgaccaacatgacccccggagctgcagcacgcggtgatcccggaagcggcccacgttctacccggagtgcaggccgcaggagactgaaccactggttgcgaccctgcgggacgttacggaccctgtggacagaagaagagcaatctctgagttgcctcgtccgtgatgacccatacgggcgtttctcatggaccgatgaaaattaagctttcctctactggaagatacgcgacttggcgtatgcgtaccagtctgggatcacgacgccaacagctattactacgcttgctattgcgggcgtggaggagtcgaataataacaagccgccgatgccgatgctgatctctttttacgcgtttgatcgcaggaagcaagccgatgcttccacaaagagatttgagaaaggaagtccaatttctggtctggcaggtatctttttcgcggttcagctcgacgtcggcggagtacgatgatctactatcacagggaagctttcaggaaggttgacgtcatagcaacccctacaaccggcattactgcaccaagaataccaccaagtgctctgaaaggagagtctgattatattgtatcagctaagttgatgcaattcattgttgcggggaatcttcttggctttcctgccataactgttcctgttggtcatgacaaggcaaggccttcctatcggcttgcaactgataggccgtccatggggtgaggatagcttgctgcggacggcttcggcagtataggaacatcttcctgaagagaaggaatcgtccggtcgaaaatatcagtcatcctaaaagatatgactggggtcgtttgtgatgctgggacagttgaagttgcttcacctcttacatcaacaggtggaggattctgtgctattgtattctgcactatgcaggctctagacctatggacaaacttacgctgagaccttccctgctgtgtgttcctaacttggtgtcctccgagaatagcaagatcctgcaatcagtgaaagtgggaaaatatacagagtggtttcatgatgtccctgataatgaggtctcaaatacatgtgaagatgcacttaacctcctatgcagcacctttggatgtcagatagaagagataatcttaccagagcttgaggaaatgcgtacagcccatcttgtctctattggctcagaagcattctcagacatgaatgctcattaccaagcagggaggcgaactgaaatgacgttagatactcgagcaagtttggcactttttaagtcattcacttcagcagattatgttgctgctcaatgtctgaggagaaggataatgtactatcacatggaagctttcaagaaggttgacgtcatagcaacccctacaaccggcatgaccgcgccaaaaataccaccaagtgctctgaaaggagagtctgattatgttgtatcagccaagctgatgcaattcatttttgccgggaaccttcttggcttgcctgccatttctgttcctgttggtcatgacaagcaaggccttcctatcggcttgcaactgataggccgtccgtggggcgaggctagcttattgagggtggcttcggcagtagaggagctctgcctgaagagaagaagtcggccatccacattctacgacatcctgaagacctgaaacatcatcagtatgcaatatcaatagtatgtcagaggtttgtcatttgtcagtgactcaggatagacacagcaaacccttccccagtttataaaaaactgagaaaataattttaccagagatattgtagcagcaataagcaagtgaggtacagtagtatataaaaaaattttgtttggacgtttggggtatatctgccgttttttcttgttgtgattcatttgttcgtaatgttcttgatctggcccgtctctgcccgtcgagaaagtggagacagagatgtaaccgagatatccattactgacaaatgtgagtgaattatgaatttgtatctcgataaaaaaaaacttgatgataggtccaaaa

SEQ ID NO: 3773 - DNA, 446 bp, Triticum aestivum
  Clone ID: PAT_TA_3773
ctccatcgcgcacaccggtgacgctgacctctgccgtccgtcctctgcatcgccgctgacctccggctccgccctctttcctccacgccgttgagtcgccgactcgctgacatccgctgctccgccctccgtcgcgctcgccgacgcgcggtgccgtggagcaacacgagccgtcgacgccatcatggtgttcgagggtggcaaccttggtgctggttatgttgctagtcaaggttccctacctgaaacacaacctgatgttacccctgacagtgttagcaagaaaaggaacaagaggtcaaaggcatggacacacttcacaattcaggtggatgatccggatcatgcaaactgcaactaaatttgtttcttcatgtagcagaaccatgtcttgatcagaagttcgcgtcaactttggttaaaaaaaaaaaaaaaaaaaaaaaaaa

SEQ ID NO: 3774 - DNA, 1086 bp, Triticum aestivum
  Clone ID: PAT_TA_3774
gcccggccccctcgccgccctccgtccaccagtagcaggaactccctaacgccccagcgtgagatcgcgagattgtttgtagcttgatcgaggcagtgaagacgagaggatgcagccgccatcgcagtaccaccagtcctcctactacgccgtgctcggcgtccacccaggcgcgtccgccgccgagatacgggccgcttaccaccgcctcgccatgaggtggcacccggataagattgccaatggccgtgtggatccggcgatcgcggaggaagccaagggaaggttccagaagatacacgaggcataccaggtgttgtcggatcagaagcggagggagctctatgacgccgggatgtacgaccccctcgacgacagccaacaagaggtcgagggcttccatgatttccttcaggagatgctctcgctcatggccaccgttggtagagaggagcccgtgtattccctgggggaactccaatccatgctcgacgggatgatgcaagatttcagctccccccaaccgccaccaccaagcagcttcttcaccagcaccggttcgtcgacgcggttcagcgcacccagcggcggagcgcagcagcagcgtcgacccccctcccgggtacggcctcaggggttcggcagctcggcatgcttcggccaggccgcctgctcccgcggccaagcccccgcgcgagccccgccgcgctccctgcgccccggggcccgcccgcccggccgccacgggcgccggcgtggtcgcacgctcctccagcgtcggggtcggccacgctcgggctccgtcggccgctgcagcggcgcacacagcaggtgcccgtgcgctcccccagcccgcccgacgagccgagtaaggaagccggtcgtgcgttccagttgacagcaactcgaaaggatctccattgttagtttttcttggatagattgtaggtgtacatagatgagaatcagaagtgaagacgtgatgttttgcactgtggtgtatttacttcaaaagcaaccacgatgacacgtgttggagttgtcacaaacaaaaaatcagtaaagagtacgtgtaacgtgtttttc

SEQ ID NO: 3775 - DNA, 1759 bp, Triticum aestivum
  Clone ID: PAT_TA_3775
gctcgggagctccctgcatcgcccagtttgggttttatctatctccgatccagtccccatgaagcgatcgccctgaccaggcaactacgggacggccatcgttcgccatgcagccgaggatggagcacgcggcggcggtagccgcgccgccgcagcagcagatcagcgtccagcaggccctcgtcatgcacgcccaacagcagcagcaggacgcgactgccgcactgccgccaccggcgacgcctggccacgcgcacccgggtctccttgccgcgccgcatatagagcccatcgttagtgggaacctgcctcctgggtttgattcaagcacatgccgcagtgtgtatgttggcaacatccatcttcaagtcacagattcactactgcatgaagttttccagagtattggtccagttgaagggtgttaagctcatcaggaaagaaaagtcatcttttggtattgctgactattatgaacgtaaatatgctgtattgtctatcatgtcactcaacggtatactactgtttggctactccaacaaaattcaattgggcattttcaagtaccccagagaggtgaaacatccggtcatttgaacatcttcagtaggaaatctctggcccatgtttacggctgctgctttgtttgcttttttctcggcatattctacctcttcagatgctagagttatgtgggatcagcagactggacgatccagaggttttggtttcgtttcttttaggaatcagcaggatgcacaaactgccataaatgaattgaatggaaagtggcttggcaaccgccaaattcgttgcaattgggcaacgaagggcgctaatgctggtgaagagaagcaaagtacagactccaagggtatggtggaattgataaacggctcatcagaggctggcaaggagaatgcaaacgaagatggtcctgaaaataacccacagtatacaactgtttatgttggcaatcttccccatgatatcaacagcaatgatgtgcatcgatttttccatttactcggggctgggtcaattgaggaggtccgtgtaacacgcgataaaggatttggctttgtgagatatagtacccatgaagaagctgcacaagcaatacagacgggtaatggccaatttattggcgggaggcagatcaagtgctcttggggaagcaaaccaactccaccagggacagcatctgcgcctctgcctcctccggcattagcgccatacacgcctggcgtgtcagcagttgacctcatctcctacgagcgatcccttgctctgagcaagatggctgccaaccaggccctgatgggtcagcacgccgccctgaggcaggccgcgatgggtatgggcgccggcgccagccaggccatctttgacgggggcttccagagtgtcaaccctcagcagcagcagcagcagctcatgtactactgagtgtatgaagcaagtatgctggcgacggagggggctacaacaccctccttcctaatatatatacatatatggttgatgaagcctcaccagggccttttcttttgttattactagttcaacatcgcaattagtaatttactatccttcgccgctgttaacgctccgggtcgccggctatatatagcaccaatgtactagaacatacgtatccctgacgtgttaagagttgggcaattcttattttttagggggggggggggggggaaattaaatattttatatggtgcggccgctttataggattcaagct

SEQ ID NO: 3776 - DNA, 1085 bp, Triticum aestivum
  Clone ID: PAT_TA_3776
gccagagccgcccacccggccaccccccccccccccccgcaggagccgccgcgaggacctgggagccgccggcgctgcagtgaggacctacgtcggcgcgaggacctgcaggcgaagacgccgacgcgagatccaggaggcgaagccccggctggtcttggtcgtagtggccgctcccccacatacgtccccaccgacgccgcgtgaggttctggaggggccgccgccgcctttcggcattggcgatcccggccgcacctgctcgtacaacaggaggacttccgtgtaggagaaagcgagatgttcatagtccacggttgtcgtctgagtttgtgtattccctacggcagcaaaaataacgtcaattattaaggcagccaccggttcaaacagtgagcatcaggtttattgtctgtgttgggtgttcattgtagcagtagtgtgagtactggacagccttctgccaccatcgtttacctccgactcgccagccagccgccatcgtctacctcctgtcgacctcgtgtctcgccggacagcgcagtcgtcaaactctgtctcaccgggcaggcaccgctgtctacctctgctttgtagttaattgtgtgctagcaattcctccggaaaacttgttaggttattctaactctgccatgtatccgtgatcttgttttctgaatatgtacttttttttagtgattttcattttcattttatttatcatagcactcccctcgggtgttcgcaccttcgggttggtgtgtgttctagtctgttgcctgtctcccccgtttacctccaactcaccggccagccgccatcatctacctcctgtcttattggatcgccggacagccgccatcggctacctcccgccttgccggacagcgcggtcgtctaactctgtctcaccggacagccaccgctgtctacctctgcctcgtagttaattgtgtactagaaattccttctgagaacttgttaggttattctaactctgccatgtatccaggatcttgtttactgaatatgtattttatttagtgatttcccaaaaaaaaaaaaaaaaaaaaaaaaaaaaaaaa

SEQ ID NO: 3777 - DNA, 651 bp, Triticum aestivum
  Clone ID: PAT_TA_3777
aactcaataggcttttggaccgccagcgcaccgatttccaaccctgcattaggtggcacaatcaatcccgtgttgtaagtgaccccacatggacactgcccgcgatccatcccgctccgtccggatcagaagacatccctcgcggccgtgagcccatttatactttttcagtacccacaattgcaatcttactcgctcccgtcaacacttcgttccatcaatgccacttctaggatcatattgccccgccctgtgccctagcaatctgctgctgcccgcgaccctggcaccccctcacgcagctcattttccattcttccacaattactatctaaaactttcccacttgccccccgcctgcgcacctcgagcacgagaggacgcagcttcgcctccagaaggtgcgcacggtccgccctgggtagcacccggtgccctgcactcccacgggacccggccggaggccctcttccctctcacgggccggggtcccgcttggttcttgcgctgcctcctctcctgcctcgatccgaacatcaggtagcacaatcattgccgttttgcaagcataccaccaagcacgctgacgaagaaccctaccgctgcgtgcggttcaggcgccacaccacgcagctgcaagcacattcttac

SEQ ID NO: 3778 - DNA, 1476 bp, Triticum aestivum
  unsure (1)..(1476): unsure at all n locations
  Clone ID: PAT_TA_3778
aatcagacaagaatgagccttgacacaggagatggaccaggaaaaatatttcctggtttagattctttgatgtctcactctcggaattcgcagcctgcccagctgagcaatggacctaaggcgccagtcgcgaaactctttgagcaagttgggttacagaagatattgtcattgcttgagtccgaagaacctgatgttcgtgttcatgccgttaaagttgtcgcgaatctggcggctgaagaggcaaatcaagaaaagattgtagaagccaggcggcgctcacttccctcctaatgctgcttaggagctctgaggatgagaccatacgcagagtagcggcaggagcaattgctaatcttgcaatgaatgactcaagaacgaaccaagatcttataatggctcaaggtggtgtcacctcgttgtcaatgacagcatttctgatgcggaggacccacaaactctaagaatggtggctggagctatcgctaacctgtgtggcaatgacaaactgcaaactcgtctaagaggagaaggtggaatcaaagcattgctgggaatggtcaagtgtggccatcctgatgtccttgctcaaattgctcgtggcattgcaaacttggcaaaatgtgaatctagagcagctactcaaggaaacaagggtggggagatcattatggggggggtggatggggcacttccttggatcgtaaaaaacgcgaataatgaggctgccccaatcaggcggcacatcgagctagcactgtgccatttggcgcaacatgaggtgaatgccaaggatatcgtgagtgaaggcgcactctgggaacttgtacggatctcgagggattgctctcgggaagatataaggatgttggcataccgcacgctgacatccagccccacccttcagtcggagatgaggagattgcggatagagtgctgatgaatcgacccaaaaagattcaactgggtctcatcctcacaccgagtggagttatgtttctcgcccaaatctcccaagtcgagtagaggcgctgctgttgcgcaagtgctggcaatcaaccgcgtcggcccttgatatgcccagcttctgcaagcaggcatacatatggccgggcagcggacccgttgagttttgtctcaactgtcaatggtctgcgccatcgttctcctcaagctgattcattttatttatggtggcgattcgtttattcaaaccctagcatgtgaggctttacttacttggatgtagcctgtagaagaatttgtgttgtaaaaccccccgagcgtgggagaggtgagtgccttgccagtgcagataggttggcttgggttggggcccatgacttggattatatccctatatacnttgtattaattggacggtggacattcttttgcctgtaactttaatagtacccccaggggggtggttcttgttccggaattcccttncacccccggggaaccccattattt

SEQ ID NO: 3779 - DNA, 448 bp, Triticum aestivum
  Clone ID: PAT_TA_3779
cgcgtccctggggtgccgttggtgctgctgctccggctccccccggcgagaggccctccgcgcgctggtgccagcacgctcccgccctcgctgcctcgggtggcctccccaccgctggttgcaggcgcggcgcatgctgctcccatcctcgcctgtgttggcccgctgtcctggccgctggaagtttcactgggggcgccggcagcggtgtccttgggaagatagacccgtacatggtcgtgcagtaccggagccacgagcgcaagggcagcaccgcctgagatgcgacggacgctgccaggtccgtgccgacatcgtgctcacggagcctggcctttgtgttgtgttctccatcttgcagcgcatgatgaactacacggtagagttcagctgaagaagaatgaggtgagattctggattgctgtgtaattgtttatattgctaactg

SEQ ID NO: 3780 - DNA, 786 bp, Triticum aestivum
  Clone ID: PAT_TA_3780
ggcttcgccaagtctggcggttgcggttcgggctgtgggggcggttgcggttcaggttgtggcggtggctgcggcgccatggtcattgaaggctccaagattggcttcgccaagtcaggcggttgcggttcgggttgtggcggtggttgcggtggcatggtcatggaaggctccaagatgcgccatgccaagtcagggggctgcggttcaggttgtggcgccggctgcggcggcggttgcgggggcatggtcatggaaggctccaagatgagtcatgccaagtcagggggctgcggttcaggttgtggcgccggctgcggcggcggttgtgggggcatggtcatggaaggctccaacatgagtcatgccaagtcagggggctgcggttcaggttgtggcgccggctgcggcggcggttgtggcggcatggtcatggaaggctccaagatgagccatgccaagtcagggggctgcggttcaggctgcggcggcatgctgaacacagcctcgtaagcatgcccatgcttgaggtggtcggcgtgcgggcggtgactgccggtgatggcatgccgcacgctctagtcggagatgaagtcgaataaaaactacactctgtcctgtgcagtttgcaatgcctctactcgtggttcacaatgcgttgtggtgaatatattatgttgtacttgtggcttgtacgatattaaactatgtgatttgtgattattggacagggaaagattagagaaaaaaattggattttgaccgaataaaaaaaaaaaaaaaaaa

SEQ ID NO: 3781 - DNA, 1065 bp, Triticum aestivum
  Clone ID: PAT_TA_3781
ttacatatgaatctgaaaatgggtatttatagttagtattatattcttttgtcataaattttatgtgctaatttaacctataatggacaagaagagttctatactgcagaagcaatgattaagttaattaatacatcagatgagtggtactacataggatgccgcagatgcaacaaaaaagtacagaaacaagggaaccacttctactctccgaaatgtgaaaaagaacctgagaagatatgtccaaggtacaaacagaaactcgagatatgtgatatgagtgcaacaacaacttgcaccatgtttgaggcagaagcagcacgagggtttctcccatctgcgcgggttttgatagagagcgaggatgggatgtccgtgagcaagcatcacaactcccgggtactggggggcacagggtgctctcgccatgctgttcgttcggctgtagtttcaggtggtctgcatggtcacgtggttcatggattcttttccgttgttgctggggaagctacgtcagtgcgtcttccaaatgttggccaggagcaagcgggcaagttatcagttatgaaaactataaagcaagaaccagaggatgatgaacccactattaaccggactaaaaggggtaggagaagtagcacaactcatgttgtacaccttgatgaagaaccaaaaactgaaggtagtcgggaaataatgaaatcaaaatctatggaagcaggccccaagaggaaacgcgccgtaactcgcaaatgtgctggtattgatagcaaacaagtaaacaatcaccatgaagaagaatcagaacaggcaggtactgaggagcacaatgattcaaggcctaggacaaggcgtagttgtgtcagtaaagaattgatgaacaaagacattcagaagtgtggtgtatcaagaagtcgaaagtcaaatcgttgattagtggaaatccagttatttagcatgtaatagaacatataggagcatcagatttgtactttatatgaacatcattgtttaagattggttttaatacattaaatgcgtacctttgtgttagtaaaaaaaaaa

SEQ ID NO: 3782 - DNA, 829 bp, Triticum aestivum
  unsure (1)..(829): unsure at all n locations
  Clone ID: PAT_TA_3782
ggctagttacatacatctctttgaggtcattgtctgcagtcttaccttgttgagatcatcgtttaccagtgggtgatgattggtagaatattggcttaccttatttcagtagctgaatgtaattatcaggattgtactctactttctacctgaatgcaattaacatgaattgatacgagccaggtaaaaaaatgcagaatactgttgatctgcttatcagcatctccatcatctgcattgtcagctggacaggaactcttccgttgtgaatatgacaacaatattctgccaaggatgagttacattcgaaaaacaccgattcactagggtttgggctaccgcgtagctggtgtggctccagcgttgctccggtgagtcagatcccctctcttcccttgccacatccctccttccttatcttctttaccacgccccctctcccacgcgttcgcgtcgtcactcgagcaccgggacgccatggacaggatggccacttcctcccctgcgccggacaccatggagtggctagatctggccatggacggcgactcccagtgacaagggacggcctgtcctgccaccttgaagccatagcaaggcggatgaacaaggaggagaccacagtcggaggggagctaggaggggtctgaagcggtcgtctctttcgagcgcaaagacgggtctgcggtggatgctgggttgcagctcaggtcgatggtgcggccatggacacaacctngctaaccttgacaaccaatgcgtcggcaggggagcaactaattcctgaacctttgcttctcctctttaatttgaagttcttagtgtagtt

SEQ ID NO: 3783 - DNA, 709 bp, Triticum aestivum
  Clone ID: PAT_TA_3783
ccccgtgtacaaccacgacgagctcttcatgccccgatccgtgtcccgcgtcgagttcgaccaccgcaatcgggagtattacctgccaccgttgctcaccaacatcggcagcgaggccgtcgacgacgtcaagaagaacagcatcgtcatccacaagacgcatttcaccaaggactggataacacttctccgtgccagagcgtcggaaggccttgaccgcccgttcagccggttcgagacaatcctcgcccacctgtggcgcgccatgacgcgcgcgcggggccttggccacaacgagacatctacgatccggctgtcggtggacggccgcgaccgcctcggcgtgccggcggagtacgccggtaatctcgtcctgtgggcgttcccgcaagccacggcgggcgacctgctgaaccggccggctgaagcatgcggcgcaggtcattcacaactaggtggcgagggtggctgacgccgactacttccggtcattcgtggacttcgcgagctccggcaccgtcgaagaggaaggactcgcaccaagcgccgcgttgaacctgagagaagtgctgtgcccggacctggaggtgcacagctggctcaccttcccgttctacgacctgaacttcggcacggggacgccttcgtacgtcatgccgtcctacttcccggcagaggggctcatcttcctcatgccatcctacatcgg

SEQ ID NO: 3784 - DNA, 1107 bp, Triticum aestivum
  Clone ID: PAT_TA_3784
ccgcgacgaaccaaacgccaaagcgacccacctcctcccttccgatccgccatctccatctccctcttctgttcccgtcccgtctccgctagtcccccttcccagcgagacagcagcgcaaaccctccctcgcccacctgccgccgccccgattcgccgcctaggtccgtccggcgagggagggtgggaggagcggcggctggtggccatgtggcccggctgcggcggccgcttctactgggcgcccgcgccgccgtcgggggcgcggggcgtcgtggtcgtgttcgcgtgggtgtggagcgacgaggcgcagctgcggccgttcgtcgagctctacgcctcgctcggctggcgctgcctcgtctgccaccccgacctcgtatcgctgtatctctctgagaaagcagcaacattggcatgtggtgttattagtgagctggcaaaggaattgaaagtaaagccattgccaactgtgcttgcttctttttctggtggctcaaagggatcatgtacaaggttattcagttactagacggaagatgtgaaggagatgcaatgatgaaggactatcggttagttagaaactgtatctctggccaaatttatgactctggcccagtggattttgtgagcgatgtgggcacacagtttcttcaaaatcctgtgattggcgcttcagctcaaccatccatgctacgttccttgatggcaaaggctttggcatctggaatggatactctcttcccaagcagaattgaagctcagcgtgcagaatattggcacacgctatactcatcagcagggttgggttcagttcttatattttgctcggaaggtgatgatcttgctccatgccatgttgtctgtggtttcgccaggcgtttggtcgaactaggcacagatgttaaagtaatcaaatggagtgattcccctcatactggccattacaagttgcatgaagtggaatacagaactgctgtagatgatatactgaagaaagctcttgtcaccttctgccacagaagccagctgaagggcactagtgcatgggatcaggagtacaagatagcccactgtgtgtgcaatctacacaatgtggccgccaat

SEQ ID NO: 3785 - DNA, 646 bp, Triticum aestivum
  Clone ID: PAT_TA_3785
ctcacttgccaggttattgaccgatcaaaggtcgtgattgacggaaatttgattactgggaagggactcggaacagtcatggacttttcccccgcctttgtaagaaaattctttggccatgggcgagcgaaaggtgtggcaaatggaatggtttttgactaccccaagagctgaaacgcctagcattcctgccactacggagtgatgcgctgaatgtttggttatggtctatggatcttgcggtagcgatgctcaaactttgaggtgaccgtctctcttgcggagatggcaaaattttcttctgttgccgccttactggatagctgcagactgcagtgaaatgcccactgaatatgttctgctccgccgcggctgcctgggcctcatccgccgcgcgccccttctccgctggtgcgccggcccgcccccgccggcggctccaagggccgcggccgcgtcctgtgcggcctgcccactgggcgcctcggcgccggccccggcgccgggtaccgcgccactgccttgcgcgactttgcggaccccgcggcagacccccatccgtcggctggggccttttcggcactatgttggcaggtggggcctcatcttcggggcaaaatctgcttgcgtatgctttcctgaatat

SEQ ID NO: 3786 - DNA, 869 bp, Triticum aestivum
  Clone ID: PAT_TA_3786
ctttcttgcgattgactggcccggttcgtgcaattgtgtcgatggagactgttcacattgaaatccaactaacagtaaagggcgcaacaaaatctgaagatagagcattgattagtacattctacttctacaatggtgacagttccccgcaggtagctgaaaacagcttttgcactgtggagttatgcaatgagcaacttaaacagtcggtccaagccactagcctaagcgtgtttgttagagctgaagctggatcattgcctttcccaaatggtgcccgagttgtttgctcttcactacctcaggatgttgataaacatattgctgggccctcatctaggcaagttgtagttcttgatttaaaaggtggaatggctaaacctggctaccttgatctgacaaggcatgtagtttctgtggaattaaacggacagttgaaagtcctcatggagaccttttcgccttcgcagtctgttgaaagtactcgtgtcctcttcatcccgccccgaaaatgtaacataagtaaacatgagggcaactttggtggctatgaggtggagattactattgcttggtccttgattccctcgaagatgctatcctgatgaataggtatgaggacccttgggcagtgtgaactctgaagcttgttgaagatgataacggctatcttggtactggatatgtccatcttttgaagatgatactgctgtctttgctgtcgtttcctgatctgttgtgctattaggcatggtcaagctaggtgaacattgtaattgttgtcatgctatgtgaacctttatcctggtggaatacatgtgagctattgtccgtaaaaaaaaaaaaaaaaaaaaaataaaaaaaaaaaa

SEQ ID NO: 3787 - DNA, 1299 bp, Triticum aestivum
  Clone ID: PAT_TA_3787
ataacatcgcgatccccctttccctcgagaaaaaacaacgcgatcccctttgctcgtcttcctctccgccacgggcaggcagcactgaaaccctaaccccgctaaagaaaatccttctccagccatggccgccgcccttcccgactggatgatgctcgagcgattcgtgttctgcagggagtccttgctggacagcgaggccgcgcccttcatcaaggccgacggcaccagctcccacggcggcagcttctccgtggccttcctcgtcctccagcccccgggcatctcacgcctttacctgcagtggcccggcggcccaaagggcggctctcagtgcgttctcgtagcggcacaccgcaatcttgtcctgttcaggctcaccccagatcctgtaatcacccgcaaggcccccttcgtggattaccggcaagaccacttcatctgcggagcccaattctcgccgtctcagcggtcgctgctgctccgaaagatccccaagtgtgaccaacctgcgctggtggactggagggatggggagaaggtaaccatgccccgctcgtttgatcttaaccccgttagcatcttgtgccgaggagatgaagaatttgccttggcgcagttgaacctccgtagatccaacgatgagtggggcaaaattgaggctgagctgtgtgtcctccgctccaaagtaagcaatcgtcttcacgagtggaagagtgagaagtggctgccaatccagtacgagggacatgaaagatctgatttggacagttggagaacggacagagtagttccattcaacaagtttttgtgttgggttaattacggcgggggaggcatcttattctgtgaggtgttcaaacaaaagccaaacattttttacctccgactacctataattgcgcctcgtttacatcaatgttcattgaggttccaggaggcgagccgcgctgtcggtgtaaccaaaggcagcatgggttgtgatgagctgaggtttgttgatgtagtctgtaaggatggtaacattattgatccactaggctatggtgacaatgagggtttcacgatcacctactacgctttgaggataacacagagtggtggcatggagtgggatatgcttttcttcatcagatgctatgaattgtggagtatcaaccctcaactcccgcatgaacttctgaagcatcctgttgtaagtatggaggacccaaatgtggtatattttctgatgtcggagcgtctggaacatgttgacaaggtttccgtagttactcttgatatgtgtaccaaaaagct

SEQ ID NO: 3788 - DNA, 721 bp, Triticum aestivum
  Clone ID: PAT_TA_3788
cctctcggccacacacgccgacacacagacaccacacacgcgcgtcgcattgcgggctttgcacaagcccggagccggaggcaagggtggatgctgccgcgcgtcctgacctctccccgcgaataatctggtctcatggcgaagcaacactatgcaaccagcagccttgtgataggctatgccttgtgctcgagcttgctggcgatcattaacaagtatgccgtcacaaagttcaattaccctggcctcctgacaacgctacagtacttgacatctgctgctggtgtttgggcccttggaaagctaggttttctctgccatgaccccttcaacctggagactgccaagaaatttgcaccggctgctattgtcttctacctcgccatatttacaaacacaaacctccttgttcatgccaatgtggacacgttcatagttttcagatccttgactccgcttttggttgctattgctgacacaaccttccggaagcaaccatgcccttccaagctcacattttcatcccttgttatcatattgggaggagcggttggctatgtgattacagattctgcattcagcctcacagcatactcttgggcgcttgcctatctggtgacaataacagctgagatggtgtacatcaagcatattgtgacgaatctgggtctaaacacatggggttttgtgctgtataacaaccttctttccttgatgatat

SEQ ID NO: 3789 - DNA, 1328 bp, Triticum aestivum
  Clone ID: PAT_TA_3789
gtcgccctctggcgcgtcagcgttccgcccgcctcagcagcagccccagtcggccttcttcctcaacgcggcgccggggcaggatttcggggacgaggcgggcaatgggtcacactcctacctgcagtccaagccgttccatggcctcatgcagctcccagacctccagggcaatggtgcgggagggcccgcctcttcgggccatggcctcttcaacctgggcttcttctccaacaatggcaatagctcggggtctagtcatgagcatgcaagccagggaatgatgagcaacgaccagttcagcggcggagctggcggggcggtggctctgaggtatcagcagcggcgattttcggcgggaactttgttggtggtgatcacatttcgcaggctgggatgtacaacgaccaggcgcccatgctgcctcagatgtctgcgaccgcactgctccagaaggcggcgcagatgggcgcgacctccagccccaacggcgcggcgtccatgttccggggcttcgtgggctcttcgccgcacgcgcgacaggggacaccgcagcagcagatggaccagaacgatgcgaacctgaacgagctgatgaactctctggctgctggcggcggcgtcaatgccgcggcgatgtttggcggcgctaacggcggtcccgccgggatgtttgatccgaggatgtgcgacatggatcagcacgaggtgaaattcagccagggaggaggtggtgttggtggcaacggcggtggtgctggcggcggcggcggcggcggcgacatgacgcgggactttcttggcgtgggcggaggcggcatcgtgcgcgggatatcgacaccgagaggagaccaccaccagagcagcagcgacatgagctccttggaggccgagatgaagtcggcttcgtccttcaacggaggccggatgccatgatcgacggatcgatcaagcttacacaagccgtaagctccgatctgtcgagtgagtctgagacttgaagcaacctggaattagcgcatgcatgcatgagaggagtaaggttagcgagttagcaactaagttgatcgcatgagtaaggttacatgcatgggataaggctacctagctaagctctccatggcctgaagacttggagtaccgtgaaagagaggcgtcttctgagactaattaagtaattagctagtgcgagtgaacgcttgcatgtgatgacgaccctagcttggtcgtcgaggagtttggagtctgtgttcttgttcttgtcgtctgttttccttccctgtaattggatgtttgttgggttaaatatagtccccgagatagaagaa

SEQ ID NO: 3790 - DNA, 398 bp, Triticum aestivum
  Clone ID: PAT_TA_3790
gtcggcgcgctcgacgaggacggcctcgtcgcgttgcggcggcgcaccggcatggtgttccagcatttcaacctgctgtccgcgaagacggtgttcgagaacgtcgcgctgccgctgaagatcgccggcgtgccgaaggccgagcgcacgcgcaaggccgaggcgctgctcgaactcgtcgggctcgccgcgaagcgcgacgcgtacccggcgagcctgtcgggcggccagaagcagcgcgtcggcatcgcccgcgcgctcgtgcacgatcccgaggtgctgctgtgcgacgaggcgacgtctgcgctcgatcccgagacgacgcagtcgatcctcgcgctgctcgccgacatcaaccgccggctcgggctgacgatcgtgctgatcacgcacgagat

SEQ ID NO: 3791 - DNA, 1226 bp, Triticum aestivum
  Clone ID: PAT_TA_3791
ttccgccccgggcgcgccggctcctcctccccgtcaagtctagggttagcacttcgccaacccaccccagagcgggaccgcatcgccttcctcctcgtccccgcgcctcccacccgccggccggaaggggtacacgagggcgaagcgcagcgaagatgccgcagcggcactcgaagaacaacaacgacctcgccttcttcacctacgaggagaagcggaagctcgggtacggcacccagcgggagcggctcggcaaggactccatcaagcccttcgatgcctgctgcctctgcctcaagccgctcatcgacccgctcgcctgccccaagggccacaccttctgcaaggagtgcatcctcgagtgcctcctcgcgcagaagaaggacatcaagcgcaagcttatagctcatgactcccagaaaaagcaagagaaggaagaggaggaggagaagctggtgctgcaaaagtccaaggaattggatgcttttgatcagcagaatcatggagcagtcccccagtactatgatcgcagcggttcccaagacaagaatggttttcatggagccaacagtgtgaagactacctccttcgaagaggaagccctacgcaccatgaaggcgttttggcttccgtcagctacacccgaagccactgtcaaggtagatgctccttctactgacacaatctgtcccgaggggcaggagaagctcaagctgaaatcactcttccctatttctttcaccgaggagaacgctcgtcagaagagcagtaagtcagtggagaaaagctacatctgccccagctgcaagtccaatctcacaaacacaatgtccctggtggcgatcagcacctgtggccatgtcttctgcaagaagtgctcggacaagttcatagcaacagataaggtctgcttaatgtgcagcaaaccgtgcaaagagaggaatttgattaatttagaaaaaggaggaacgggtttcgccgcacacgatgaccacctagaggcaaagaacttcaagcatttagggagtggttctgggctaggattggtgaagcctgctcctaaggcatagccttcaattatgtaactgttgttgtataatgctgtcagttatcgttgtggcacgaatatatgtaacctggaatttttaaatgttttgatatctttttgataagtatgatctggaacaaacgatactccaggtttttcatccaagtgaaaaaaaaaa

SEQ ID NO: 3792 - DNA, 387 bp, Triticum aestivum
  Clone ID: PAT_TA_3792
cccacgcgttcgtcacattcaatttatactggcttcttccatattgggagcggggtcttttgggatccccataccggactgggtgaataacataccggactgggtgacttttgggatccccgtaccggattggccgatatagtaagtaaggttgcagtgcctgaatttgagccaaagagtggggttaagattgaaacagatgagtaggctactaaccttttcagtgcctcagttgacgatactgttgttatttaagaccttttaaccaagcttgaagcattgtgcctagaaactacttttaagatttcaaatgattccctattttttactgcttttgattgtgttagagttttcaagaggttttacaagcttgatgctttgtttatt

SEQ ID NO: 3793 - DNA, 1345 bp, Triticum aestivum
  Clone ID: PAT_TA_3793
attcggcacgaggggaagcccaagcggaagctgccggcctcgccgtcgaggcgcgactctccgctggagccctaccatggccacgccgccccctcccccgctcaatgcctggccgtccgcgacgccctcctcgccttccatggcttccccgacgagttcgcgcccttccgcctcctccgcctcggcctctcgcctgaggacgagggcgaccagccggctcctcgtccgaccgtcctagacgggctcgtcaccaccctcctctcgcagaacaccaccgacgccatctcccgccgcgcattcgcctccctcaaggccgccttcccctcctgggatcaggtggtcgacgaggaggggatggggctggaggacgccatcaggtgtgggggcctggctgcgacgaaggcggcgaggatccgggcgatgctgaggggcgtgagggagaagaggggcgcgatttgcctcgagtacctgcgggagctgtccgtggatgaggtcaagagggagctctcgcagttcaaagggattgggccaaagactgtggcatgtgtcctgatgttctatcttcaaaaggatgactttccagtagatactcatgtactccgcattacaaaggctattggttgggttcctccaacagctactagggagaaagcatacattcatctgaataataagattcctgatgatctgaagtttgacttgaattgtctatttgttactcatgggaagctttgtcaatcgtgtacgataaagttaggagtccagaaacccaaggatgtcaaggctgtttgtcccttagcaagctactgttgtatcaaagaagaaattcaggaatagccaaggaaatggtgtttccagaagaggtcgtaacctcccaacaacccaacagcactaatggtaggaagatttatgggcagtggtgccttgccctgcatacatgtaatggcaatttcaggttcccgtcttgtattgttgttagggggcttccagctgtatgatttcaggctagataccatatttgtgaactcattctacctactggcagtaaggaagtttttaggggaagctgaaggatgcgatctatgacttgctgaaagtgtcatttgttagaagtggttagaagaatgccgattgccaaacgacctgctacctagtgtgccatatcggcaaattgtgccgttcagatggcaaccgcccagttgtgtacaatggtaccctcgactttccgctgcacatgacctgttgccccggtgaggtggcttgtgatttcagagcaagcgctttgctcacgacgcggaaaagatcatctaatgcaacctggatgagttctccacccacagctgaa

SEQ ID NO: 3794 - DNA, 980 bp, Triticum aestivum
  unsure (1)..(980): unsure at all n locations
  Clone ID: PAT_TA_3794
tgcaggnaattcggcacgaggctcttttccccccacgcgtccggttcgtcacgcccagaccccatcccaccgctgctacagtctacaatctactcggagaacgacggcgagcaccgcatgccgcatctccgccacagtagctccgtcgcagcatcagaagtcgcccgccgcgagctttatcgcagcaccccgtcgctctcggcctctcgcggcatcagacatcgcggcagcatgcgtgcggcggtgctgcagtggaccgctcgccggtggcgatgctgcgatgcagcgtttgcgcagaggcccggagctcggcgccgcaaggaagcttgaccggtaggtgcaatggagcttcaccggcggcacccgaagctgcgatgaaacttcaccagcgccacaatggagcttcaccggtaagccaggagctgcgatgcagcgggcagtgctgcaatggagccccgccgcggctggggctgcaacggagcttcgccggaacaccgcgcgccggtggctgcaatggagagcgtcgtctgcaatggagctccgtcacggttgcaatggagcttcgccgggatgccgacggtgcagcgtggagctttttttcgcgccaccgtgctgccatggagctgcagtggagcttccccgggggtcgtaggtgttccattgaagctttgttttccatcggctccggtgttgctgcgttggtgctccgccggtggctccggtgctgctgcgttggagctctgccgatggctccggtggtgtgatgtcgctggcgcagtcaccatggtgaggtgggattgatggcgagcatcatcgctgcagaggaggcgtggctggatttgagggcgagcggttgcgtgcgttttctgcgttgacccgatccaacagctacgcgtcgggcaatctaatggctggcgaggcggtttacgtttctgtattatcatccggatgatttgtagcactggcctttgcttttctgt

SEQ ID NO: 3795 - DNA, 1274 bp, Triticum aestivum
  Clone ID: PAT_TA_3795
atgcaagccttctctgatcttcactagtaaggtgcttccacgatggccgcccagaactacggtgaattgtacaacatcctcggctggggcgaaccctacttcaccgtgaacagggacggccacctgtgtgtcaagacccacggccacgagacgaagccagggcaagagatagacgtggtgtccgtagctgaagctgcaaaggagaagggcgtccaattcccgatgatcctccgcttccccgacgtgctcaagcaccgcctcgactcgctccacgtcgcattcgagaaggccatcaagcacaccgggtacacggcgccatatcagggcgtgtacccagtgaaggtgaaccagaacagggccatcatcaacgactttgttagctttggccaccgtcacagctacgggctggaggcgggctccaagccagaattgctcatcgcaatgagctaccttaccaaagccaagcctggagccttcctggtatgcaatgggtacaaggacgcggactacgtggcgctggcgctgtcggcgcgtgccatgggcctgaatgtcatcatcgtgttggagatggaggaggagttggacatcatcatcgagcacagcagcaagctcggggtagaaccggtgctgggcgtgcgtgccaagctgctcaccaagataccaggccacttcgggtcgacggccggcaagcacggcaagttcggcctgcctgcggacaagatctacgaggtggccaacaggctcaggcacctcgacaagctgcactggctcaagttgctgcacttccacatcggctccatgatcccgtccacggacatcgtgtccagggcagccaccgaggccgccggcatctactgcaccctggtgaagcagtatggcgcggggatggacgacgctggactgcggcggggggctcggcgtcgactacgacgggacccggtccggctccgacatgtcggtggcgtacgggctggaggagtacgcatccagcattgtgcaggcagtgcgggtcaagtgcgaggacaatggcgttgaccaccctgtgctgtgcaccgagagcggccgcgccatggtctcacaccactcgatgatcatccttgaggcgctctcagcaatccccgagccaaaggacgacgaggagaccacacccgaagagctgcaggccatgatcgatgatctctcctcgaagaagtggttgaagggtgacgacgacgcggcggtggccaagcccatgtcttcccacgctgcggagatcaaggagcacggcatcgaga

SEQ ID NO: 3796 - DNA, 937 bp, Triticum aestivum
  Clone ID: PAT_TA_3796
ccttctcccagttgcgtccggtttccccaagtcgctctcgccgatggatcgattccggcctctcaggcggatccaggtggagcccgagcgcgctgacccgccccctcccccgccggcggtggcaatcggcgaagcggcggaaatggttccggcgcccgcggccgggatgctcatgggtgccaaggtgcggcgccgcgcggccgtctaccgcgactgcatgggcgactacatcggcgtgcacaacgacccgtgcctggccaagatcctcgccaagcaaggggataacaaagttctgtttgcggacaaggtgttgaagttcactcaatcaggaaagatgaaaaggcgcatccttgtgatcacagactttgctctctaccttgtcgaccctgatgctgatatattgaagagaagaatagcacttgcagctgttgataagctatgtataagcaagctcagtgataacttcttcgcaatcattgtgccgaccgagtatgattgtttaatggccagcactagaaagaaggaaattgttgatgttatagttaaggctatccagagcacatctgagtatgaacctgaggtggcttcctctaacaggtttgagtaccatgctgctgccgaagtgattaaagaagttgaatttgaagaagctgatggacgcatcaaaactaggatcaccctcaaggagaagccatgattcagaatcatttcgctagctccctgtacaatgtatagctcttgtaatctcggtggattctcacattcactttctgccgcaaagttgaaagatccacactattcttttgttgtataccgcattctattttcttgcttttgtacgtggaagaagtgacctgccattttgaggacccatgattgaatctgtggaatcttgttgttatcatgacactttatactgctgtggatttttctcttt

SEQ ID NO: 3797 - DNA, 1150 bp, Triticum aestivum
  unsure (1)..(1150): unsure at all n locations
  Clone ID: PAT_TA_3797
ctacggcgctccagccgccaggagttcgtcgcgctcggccgcgtgctggcgctccacacgggggccgcggatcaggatgtcaacgacaagaatattgctgttcaattccagtatgtgacttggcagttgcaagcagctctaacaaatctaccgcatagttgttttcaaatatctgatgaagttcaagaagaggttgatttagtagcggggtcagcttaaaagagaaatggagaagaagggagcccttgatctaaatattttttcagaaattcatgatatcttagctcatcatgttgatcatgttggatcacaatctgaagaaccacactgcctgccagagacattcccgttggaaaacttgagaagtgatcacttggagttgcaacatgttgctttactaatttcagaaataagcgggatatctaaatctgacattaaaaaaataacgtctgagctaattgaagggcttgaaaatgctagagttgatgattctgcaaaaccaaccaatggtgatagcaaaacaagtgatgaagcaaaagactcacctgacagcgttaagaagcccgacactgtagctatgcctgaagatttccgttgcccaatatctcttgagctgatgagggatcctgtcattgtgtcaacagggcagacatatgagcgtgctttcattcaaaggtggattgatggtggaaaccgaacctgccccgccgccctcctgcccctccggcacccttcgctggccccgcaccacgctgcgagaagtttaatattgcaatggtgtgaggaaaaagggatcgaaccacctacaagatcgaaatatgaaggttcttccgtagaggtcggtgaggacagattggcaattgaagcattagttcgcaatctttcttgcagctcattggatgaacggaaatctgctgctgctgaaataagatccttggccaaaaaaagtacagacaaccgcatgcttctagcagagtccggtgctattcctgctctagtgaaactttgtcctcaaaagacccaaaaccangaacatcagttcatctcttttgaatctctcatatatgataaaacaagaactgatantggttggcggtgccaatgtccaatcatacagtgcttaggacggtacatggagnaagagaaacnn

SEQ ID NO: 3798 - DNA, 1894 bp, Triticum aestivum
  unsure (1)..(1894): unsure at all n locations
  Clone ID: PAT_TA_3798
ttttttttttttaaaagaacgagatgtattgtacacatgaaatttcatgaattacacagggaaattgctgcggctcatccaatcatgagttgatcaacggcttgaagtggatgacaagtttttcgtgatgcgtcgttgaggatgatggccacgatgggacgccccacggggatctctgctttcactgtacccatgcatactttcgaaaaccacaagttatctgacagaggactatccaaacttttacttatcaatgagcttgatgaaagcttgcttttagttggctcaagtgatggaaatgtccgtatatggagaaactatgctcaaaagggaggacagaaacttgtaactgctttctcatcagttcagggccatcgagctgcaggccgcagcgttgtgattgactggcaacagcaatctggttatctgtatgcatctggtgacatgtcttccatccttgtatgggatcttgacaaggagcaacttctcaacaccattccatcatctgctgatagtggcatttcagctctgtctgcatctcaggttagacctggtcaatttgctgccggttttattgacgcatccgtaaggatatttgatgttcgtacccctgacaggctagtttatatggcaagaccacatgccccaagaactgaaaaggtcgtcggtataggatttcagcctggatttgatccatacaagattgtaagcgcatctcaagctggagacattcagtttcttgatgttagaagggctgctgaaccctacctcactattgaagctcacaggggttcattaacagcactggctgttcaccggcatgccccagtcattgcaagtggctcagctaagcaaatgattaaagtgttcagtcttgaaggagaacagctaacgatcattcggtaccagccatcttttatgggcctacggttacgtggcctaaactgccgttcctgccgtccgtgccagtctctcctggctgctgcacctgctgtgatggctcgggcctcgatccacgcggacggctactcgcacgcggcgtgacgtttacatcctgtggcatgcaatgacgacacaatcagtaggccatgggattggccgactgctggatccgcagcaggttcagctacaagatacaagatgatacaaagcctggtcagtgacatggtggtgattgcagtgctgtggctttttggtccatattgcttgtgttgggcatctacatctctggtcggcatgtgcaatttgtaagatacaaatcaagattcattagcctcccttgcagaaggttgtgaaagtgaaaggcagttgtggtccagtcagtgaatccggaggcttccccaataatcatacctaggttaactgaaatgtaaatagccgtccccatttggattgttgtcctgtcagtcagttttcttcctttcccaaagtgtaaaaaggtttgccgatgcttcatatcataagtcgggtctggcggggtctgcaagtggttgtttatatgggccaggaagggagaatgcatgcacatgtctcctcacagatgttcttcaatagatagatgctcctttccagctaatatagcatttagaggtgagttgttactatggcttgctttaaccagtgttgtccaggtcattctttgtaagcattggactatcatcatccagtgttgtcgtcatagcagggcttcattgtccatttgtacatatgaactgcatttgtacagtagttaattctcttaagataagttgtaatgcatgtttgtccttgggtgtatctggcatattctgaatatttaagtgaaaaagaagcttgtctctgtgtntttnttttttttnttttttttttctcctcctttcgctttcttcccggtctgtccgtcgttctggtccgt

SEQ ID NO: 3799 - DNA, 708 bp, Triticum aestivum
  Clone ID: PAT_TA_3799
tgggtttccgccgtctgcctctccgcagccgttcttcaccacccccttctctgcggctttcgggctctgcccggtccggctccccggctgccttgtgcggccgcgccttctttccggcttcgggcctctgccgttagccggtcacaggcttccgggactgggctcgtcatctctctgttgtctcccgtccttggtgtggcagtgacgtctctcagggccagctctcggcttctgtacctcggcgccttcgctggcgtcccattgtcatctccctcgaccctcgctccggttccgttccaccgggccttggtcgcctgccacccgttggccccggggctttgggtgtcttccggccgtccgcctgcgcttatgtctgtggtggttggtcccctgcgttcgccgtctcggccttcgcgtaccaccgccctcatgccccccgaggctccacctccacgtccggaggggtccctcccccatctggccgccgccgcttcccgtcgagggcgggctgtgcctcaccagctcccacggtcgcacgtgctttcccctcggcccgcggcttgctaacccacgtcatgtctctcactccggcaaaggtgtcggtgacgcgtccatttcccgcaagccctgcgggtttcggggagatcgaaagtttacatctatcaggaaacaggttgaatggattgataccatggcagttaactccgc

SEQ ID NO: 3800 - DNA, 655 bp, Triticum aestivum
  Clone ID: PAT_TA_3800
aggtggacgtaaagattctagctgatatatcttcatgttttaccttgtttaccaatgtcccaaaattttgtttcgtcgttgctttgaattaattttcccttactttgactgagtatgacatttatttgaaatactaaattgtggtgtcgctacctctaaggaccacagcgttgtagcgcccttggctcaaggtgaccatcttcagcgcatcgtggtgtcgctgcccacacgatctctacagacaccacaaaaggctacaggaccgacgaggccggtggcctgaccactgaatcacgttgtcgtgcgggcgccttgatctagctgtccctgctccggctcgttttcccttttaccctgtgtttagtttcttcgtggtctccacactgatccatgtatctgctcgcgcccctttgtcttcctcccctggggttaagttctgcctgccctgcactctgatacatgtgtatattggctcccctctgtacctttctgttgctgccaatttttccctgacccgttttgtcggacgtgggatgccgcggtttgcagtttgccgttccatgcccgcctctcctctccgacccggtgtgatggagattgtaatactgtgtttagaatatgtcagtccatatgcaagatcttcttttcaacttgg

SEQ ID NO: 3801 - DNA, 634 bp, Triticum aestivum
  Clone ID: PAT_TA_3801
cacagcaactgttccgctctccgatatctcagctcccccctcccccccctcctccggcaatgcctccatcggcggccacccccgtgctcctcctgctgctgctcctcctgcaggggaggggaggccacggcgccatcggcatcagcagcctcgacatggacatggacatggacatgggggtggaggcggcggcgcacgggcggctgctgtgggcgagcggcggcgggcggaggtacatcagctacgacgcgctgcggggggacgctgtgccctgctcccggccgggggtgccctactacaactgccgcgtcagcaccaccgccaacccctactcccgcggctgcgagtccatcacccgctgccgcgacgacgacccttcctagtaggtaaccactctagtaattgattctcaaagctgctggatccagaaggcggccgctgctcgttttgtgtgtgttttgcttgctgggcagtactatttgctggatcatatatatcaataatgtaatgtgtccgtgtgtgtactgcgtagtacgaatgtaactaagatccgattccaactcccaagatattatcacacggaggaacctgattatatatttatatggagtgttgtattaaaaaaaaaaaaaaa

SEQ ID NO: 3802 - DNA, 814 bp, Triticum aestivum
  unsure (1)..(814): unsure at all n locations
  Clone ID: PAT_TA_3802
caagtctccgtctggagggggactttgctgaaattccaagcctgttactcgagaactggtgttacgagagcatttccctgaaaatgatgtccggcttctatcaggacatcacaaagtctgtcagtactgaagcttgccagtcactngaaaagaaggcgtgacatgtttgctggcctgaaactgaagcaagagatccttttgtgccttgttgatcagataatacatacaagcgagaatgtggacatcgatgaattgatcaaagatcttcatccaaaggttatactggggatacctttgttggaagggaccagcccagcttcatgctttccgcgtattgctgttggctatgacgctgtgtgctacagttacatatggagcgaggtgtttgctgctgatctattcgcgacgaaatttaaagacgacttgctaaatcagcatgcagggttgaggtttagaaataaggtattggctccaggaggctcgaaagatcctcttgagatcataactgactacttaggaagagaaccgtcgctgcagcctttcattcagagcagaacaaggaacgctttgtgaaagatcgtgtagcactagcccatgaagtttgattaccgttgagttacttttttttccgggatgaatgattaccgttggtttcagagtgacagtttgttacttgattgcagatctggttaatggtcaatgtaaatttgtgccaagctctcttggaatagttatttccgcgcactgacctactcaggatttcaactttgtggcgtaatactttttagtgtctatcactagttttttttccttc

SEQ ID NO: 3803 - DNA, 723 bp, Triticum aestivum
  Clone ID: PAT_TA_3803
gcccgctccgggtgaccgtcgcccccgcgggcgccaggccggtccccaacgccgccgccgtggcgctgctgaagctggtggagggcaagtgcctgacggtgcacgtctacaacaccgaccgctacggcaggtccgtcggggatctccacgtcggcggggtcttcgtgcaggagcaaatgctgaagaaaggcttcgcctgccccgaccccgccggccacaaacgcccggagcttgccaagtggcagagccaggcgcaggccgcccgtaagggcctgtgggcggcgtccaagccgcaggacccgtgggagtacaggaaggcgaaacgcaacggcagcgcggcatccatctccagcggccgcacgcagagagcgtccggacccatatgttgtaactgttgtgtgtatgtgctgtgaccatggacagctgattgattgatccgtggcctgccgcactgcagatccgtagcccagagcagcgctcgcgccactgtactttttataggttaggtgtggtgaaaagggatgctgctagctgagctagcgcggggtcgtgaagcagaggaggccggggcacattgagattggttggtgtgattgtgttgttgttgtacctggagattaatttgtgtgattgtgttgtacaacactgagattggttggtcttgtgttgttgttgtaacaccgcggaataaattgtgtgattgtgttgtaaaaaaaacctcgg

SEQ ID NO: 3804 - DNA, 554 bp, Triticum aestivum
  Clone ID: PAT_TA_3804
tcccctatccccgggtcccccctcgcgtccgggtttgtcttctgttgaaggacaagggggaatatgtgcacttttaaatgacgttgatcacgcagcagttatggttcttgatcgctggaatgtaaccatcaaagagaagaatgggccacaaggtcaatgcatcaagcaagtgaaatttatgactaattatctaggtattggatgtgatgccaaggttgcatatgatttccacacaactagggaggaaaggccagataaatttagcagtcagtttgtgaacaagctgatatatgctagagaaggcgctaaggatatgatggataggtcatgttctgatttaccatggcatgttagccttgaagttgatggaaagaacattgaaattccagaggatgcagaaggtgtgatcattctgaatatcgctagctacatgggtggtgttgatctttggcaaaacgacaatgattatgatgatgatttcagttcacaatcaatgcatgacaaaatgctggaggtggtctgtatatctgggacatggcatctaggcaaactgc

SEQ ID NO: 3805 - DNA, 980 bp, Triticum aestivum
  unsure (1)..(980): unsure at all n locations
  Clone ID: PAT_TA_3805
ganttgattgcccctcaagaacccaaaccggttngacctggnatttgattgcaacancccaacnccngtcgnttaaggaggtcacttgctccaaaaagatggcagggataaggagttgcttaacncaactntatgcaaaagacataacnccngatgagaagcaggaacttgntgaggcgcttcagagagagattcaagctgccttcagaacttgatgaaatccgacggacacctcgtactccacaggatgaaatgcgtgctngaatgagttantttcatgagacaatatggaagggtgnncccaggttcttacggagggtagatactgctcttaagaacattggcataaaagagagagtgccttacaatgcccctctcattcagttctcttcttggatgggtggtgatcgtgatgggaatccaagagttacaccagaggtcaccagggatgtatgtttgttagcaagaatgatggctgctaacttgtactatgcacagatagaggatctgatgtttgagttatctatgtggcgctgcagtgacgaactacgcgtaaaagctgatcaattacaccgtgcgtcaaagaaagacacaacaaaacactacatagagttctggaagcaagttcctccaagtgaaccctatcgtgtaatactgagcgatgtcagagataaactgtacaatacgcgtgagcgatcacgccatttattagccggacgcgtgggtgaaattcccgatgacgcaatcttcactgatgttgagcagttcttggagcctcttgaactctgttacaggtccctttgtgcctgtggtgatcacactattgcagatggcaatcttctcgactttttgcggcaagtgttaacatttggactatcccttgttagactagatatcaggcaagaatctgaaagacacactgatgttatggatgtcataactaaataccttggggtaggatcataccgtgaatggtcaga

SEQ ID NO: 3806 - DNA, 1239 bp, Triticum aestivum
  Clone ID: PAT_TA_3806
gtggcggcctcccgcgcggcgccgcggtgcctctgcccgtcccgcgcccccgccccgctcgagggcacgcgctcgggctggccgctcgccgcgtgcgcgccccgccgcccgccgcggcggcggtcccgcgccgccggcgccgcccacccgcgcccgccgcacagcgtgctctccgccctcttcttctgtaactccgccagcacaccatgtcgcaggacgagcctgacagaataaacagcagcgtatacagagaagaggctgccaagaccctaacagagtctctgagacgctgcctgatcgacgagaacgtcgtgcccaacacccggaaagctctgctgatgctgggagggcatttctccttctcaggcgacctcctcgccgaggaccggatgctggagcaggccggcttcgccggcgactcgcctgccgccacgcccgtcacctccgatgctacagtgcaggtaccgcgacgtgacgacgcatggttcaacggtttctgaagtctgaactcactcgactcaacgtactggtgttctcatctcttgccgtgaacaggagacggaagctgccgagaacgaggcgtggctggagcacgtgacggcggtgctcctcggcagcgggaggcggccgttcctggcggcgctgtccgggtgcctggcctctcccgacgccggcctggtggcggcgtgcctgacaacagcgggttggctgagccggtccctggcgtcgacgccgctcaaggacacgcacacggacatgcagctcgccgcgttctcgtgccctcgctccgcggctgaagcggtgcctggccggcggcgccgcccacctgcagccccggcacagggtgctcgccgccgtcacgctgcaaaacttcagcaaaatcccaggtaactactagtactataattatcacttatgagcgcctcatatcaaccacgaaaaaccctcgacgctatcaaatcattaagcacgaaaaccgcacgaagctatcaaataattaagcatttaagctcccgttcacgtcgccgacgacacgacgttggaggtgaactcctccattgactgaactgcgtgcagactgcagggtgctgctgatgcttctggcggacgggctgcgtggtcacctggccgacctcgccgagctgacccggacgggcggccaactgtacgccgagctccacgagtgacgacgacgacctcgggccagcacgcgagtcgccgggccgccggcgtctcgtg

SEQ ID NO: 3807 - DNA, 605 bp, Triticum aestivum
  Clone ID: PAT_TA_3807
gctgcggcggccggccgccgccacgactgccgcggaggagcgggaggccgacgcggacgcctcgctgggctctccggtggacgacgagcccccccaaggggggcggaggaggggcccgagagggagtgggtggactgggaggacctcatcctcgaggacaccgtgccgctcgtcggcttcgtgcggatgatactccactccggcaagtactcaagtggtgagcggttgagtcctgaacatgaaaaggcaattcttgaacgattgcttccataccatccacaatataagaagaaaattggatgtggtatcgactacatcacgctagggttgcatccagaattcgagaactcaaggtgtttgttcatagttaggacggacggcgagcaggtcgatttttctttctggaagtgcatcaagggcctcataagagaaaagtacccattgtacgcggacagtttcattctcagacatttccgccggaggcaggactactgaactagcgacccgtacggttgttttcgtgtaatatttctgcgattttgattttgtccacgtgccttaatatcatgtgatttagcattcgtccaaaaaaaaaaaaaaaaaaa

SEQ ID NO: 3808 - DNA, 430 bp, Triticum aestivum
  Clone ID: PAT_TA_3808
ccgaatcagatatgggccataattgagcccaaagcctcttaaagggccggacctgatctgggccgtaatttggcccagaacgtgggaggcttttaacgggccggatcttatatgggccattattaggcccggagcatggcaggccattaatggaccgtatcaattatgggccggcatttggcccaaaacatggtagccagttaatgggtcggcctactagggtcctcaaaatcttttgggcctatagctgggccggcccattaatgtcggcgaaatctcatgggcctttagctgggccggcccgttatgatccgcaagaattttgtgggcatttacctgggccggcccattatggcacacaaaaatcttgtgggcctttacctgggccggcctattatggcccacgaaatcttgtgggcctttagctggg

SEQ ID NO: 3809 - DNA, 611 bp, Triticum aestivum
  unsure (1)..(611): unsure at all n locations
  Clone ID: PAT_TA_3809
acacaagctagactgtctcctcagtagtatatcaaaacctcccagttagcaatggcaaagtgtttcgccgtcgcgctcctgctactggtggtgctcgcgtcctgcgaagggagggagctgaacgggaaggacagcgcactcgcagcgacacgcggtgccggtgctggtggtggcgtcggcgagtcgaagattttggggttgccaagaattgccgctgaccacgaccattaccggcccggtggtggtgctgcctgctcttcctgggatccctgctcacccatgatcatctctagttcatgtgctgggctgacaagctgaagctgacctttgtggttcagacttctagctaaaccgcccggaagaaaaacaccggcgttgtatgcattcctttcaattcgcgtcctacatttacttccttgatgggctacatgtatcatcaacgtaataaataccacttcaatcaannanaaaaaaactccaggggggcccgtaccaattccccnaangancctatacnccctaatggctcgttaaactctnacnggaaactgngtacaactaaccctganaatcccttccantgggtatacaaaggcccacatgcctcaatt

SEQ ID NO: 3810 - DNA, 943 bp, Triticum aestivum
  Clone ID: PAT_TA_3810
ccgcccgcctaacccaacccacccccccgcctgccgcgccgcccctggccggcccccggcggccggcgccgagcgcgcggggcgcggcgccgggcctcgccacgccttcccccccccccccgaaggcggcccggccagctccggcgacgaggccggggcgtgcgaggcgtccccgccgactctcgacgtcgcgatgctgcggaagaggctcttggaggatctgcaagccttccccgaggcggcggtgttggaggaacatcagctcaacgggccgctcgcccggctcggcgtccaggcccggccccgcgcccccgcccgccccgcccatggctcgcttcgccgacgattagatcagcatggccttcatccacggcaactggttggggttccccaccacagaggacttcccacccaccggggtggtctcgctagggtggctcgatgagcggaggcggcagctagaccttgaggtgcagccggagaagagggaggaacccgacaacatgcgactcctgctcgccaagatccgcgtcgacttgctcaccaagggctacgtcgagctccccgagctgtaccttccctacacgcccccgaaagtcgttgcccgcagcccgcccaagcacatcccaacagcagtggcgagtggatgaagcagctatgcataggatgctctttgtggtggtggattcatcctgtcctgcacctcgtatctgtcagtatctatctatgtgtggtgatgtaagtcatgcaagttactataattacttaagttatctatatctatccaagttgctggtactgtaatatgtagaagtgagaagttatctaagttgttattggtcctgttacaatgtgcttgtattgagccatgtattcaagtttactaactctatatgtgcttcactgcacctatgcgtattcaatcaaaaaaaaaaaaaaaaaa

SEQ ID NO: 3811 - DNA, 672 bp, Triticum aestivum
  Clone ID: PAT_TA_3811
ttgctcctgacaacttttaactgtgctataaaatagcttgctgttcagggccctctacatccccccgccgcaggggtccgcacgaggaagagtaggagcacttgaagaaatgcttaagaggagacagatggagaggttgcctgcgctgcacctggcagtggtgtccctgctcggcttctgctgcctcatccatgcttcgagggctgctatttcattcccacctggtaatcgtcccatgccatcagcggccccgagggagcagctgcaggagaccgagacaatcccagattccagtggagcagatggtcaggtcgtcgtagcgggagaggtcgaccgcggtgctgtcagcaagaggatggagatggagatgcaactggaggactacccggggtccggccccaacgaccaccactcgccgtggtggcggcaggagaggaggaattgagaacatggagcaaatttgcatgtgtgttcgtagtgttgcacagttgtgtatgtttctcaaactggaacgcttgttacttgcaagggcatgaagagcgtcgcttgttacttgcacgggcgtcgagagccgcctttttataagcactagcgacggaaagcgtcatcaaattagttgttgctcatttgttttatacttgtgagcttttgttgttatatatatatcttgga

SEQ ID NO: 3812 - DNA, 603 bp, Triticum aestivum
  Clone ID: PAT_TA_3812
acaaagcccggtcgcctggggcaggagaggtcgcagcctgcagaaactggaggcagcgagcatggcgacgccgtgggacagctcctcgagccgcctgtggggcgccctggggcaggcctccagcgtggcacagctggtcggcgtggacgcgctcgggctggtctccatggtggtgcaggccgccctggcggcgcggcgccaccgggacgcctgcgtgcagctcgcacagcacgtcgagctcgtcgggggcctgctcggggagctggagctcgacgagctgatgcggcgggaggccaccaggcggccgctggagcagctcggagccgcgttgcggcggtgctatgcgctcgctacggcgtgccaggactgcggctacctccgccgtctgctcctgggcggacggatggccgacgagctctgcgccccgcaccacgacgtcgactggttctgccgcctccgcccgctcacccccctcgttccctttgcggcgaattctcgccgtgccatggttaatagtattgaaatttggtgatttgaggaaaaacactgatttcgggcagttgtttataattcgattgagcaaaaaaaaaaaaaaaaaaaaaa

SEQ ID NO: 3813 - DNA, 966 bp, Triticum aestivum
  Clone ID: PAT_TA_3813
gtccatccttactggactcgctcctggatctccgtgtccccgaaatggtgatgcctccggccccggccgtcctcttcgagacggcgagctggtgggccttgtgttcgagttcctgggtgcagccacggggtcaaccgcagcctgcctcgagtggaccctcgcccatctcatcgacctccccccgcccctccgcaggctgcgccgcgagatcgacgccgaggccgacgccggcgggatgctctcaatctcaagcaagagcctccgcagcggcatgccctacctgaacgcggtggtcctggagtgcctccgcatgcacccgccggtgccggtcatcttgcgcagcgcccacggcgacggcgccacagcgatcggtggggcgaccgctgtgccgctggacggcttgagcgtgcagttcaatttagccgacattggaagagatgcgaagcggtggacccatcctgacaagttctggccggagcggttccttgccggaggcgaggcggaggacgtcggcccggcgccaggccccaaggagataaggatgatgccgttcggtgcgggacataggcactgccccggcgtgaacatgggaatgctgcacatcaagtgcttcttggccgcgctcgtgcacgacttcgactgggcaccgtccgcggcggaagactgcagcggcggtgtcgacatgacggagcaggccggcggcttcgtcaaactaatgaagaagccgctctccgcgcgtgtcactcgacgcacttgagttcttcgcatacccttggcaatcttgtgtccggtttccggccgggggtggcccgtttgttcgtgcgcggctcggtctccttgccggtggttgtttgtgtgtgcttgcttaccccacggcccgcctggtcggtggggtggttcttgcttccatcaattagtagccgttccgccctctcgttcttgttgttaaaaaaaaaaaaaaaaaaa

SEQ ID NO: 3814 - DNA, 666 bp, Triticum aestivum
  unsure (1)..(666): unsure at all n locations
  Clone ID: PAT_TA_3814
actgcgcgaaggcccagtagtcgacgccagtcgctccacgccaccaccgcagaggccatggatggagaagaagcgcaccacaggccctcctcctcctcctcgtccggccgccccttcctctccggtctctgcgccgccgcgctccgccgcaagcccatctccgcgcgcgcctctgccgccgcctccggcgagggcctcgtccggcagctcggcgtcctcgagctcgtgctcctcgggatcggcgcgtccatcggcgccggcatcttcgtcatcaccggaaccgtcgcccgcgacgccggcccaggtgttacaatcagttttgctctcgctggggctgcgtgtgtgctcaatgcattgtgctatgctgagctggcatctcgttttcctgccgtggtcggcggagcatacttgtacacatatgcagcgtttaatgaactcacggcttcttgggtttaatcagttgatgcttgattacatattggggcaccaacatgctcgtaactaacaagtatttaccaattcttggactgatccctcgtgaaaggatgtccaattggttggcatgagaaatttttggggngtgttcantaaatatgggcaanctctctanccgacgtatcatgccgngtaaagacacnatgaaacttntacaatgagaaacaccaa

SEQ ID NO: 3815 - DNA, 758 bp, Triticum aestivum
  Clone ID: PAT_TA_3815
ggcgggtgatcaggcatttgacctggtccccgttgtgttcagtgatggggcaaagtgtgaaatgctgttaagggactctgaggtactgaagcccattcctccattcctctttgaagatgcaccttatttttactatccaagtcaacgcgtgaggattgtccatccctccgtgtccaagtcaggaacatggttgtctggatcgtggagggccagccgagatgaaggtgttgtgtctcatgttgatgtggggctggtgcatgtgaactggataacctcggtggcaaatgtttggggtgaccgatcatcaagtccaccaaactttcaggactcaaagaatctcactttgctgtcatgcttcccttatgctaactggcagttgggtgattggtgcactctctctgctggtcatgatggaagtctcccaagtgaagaccgtaagttttctcgatattctcaaacttatgttgttgctaagacaaagagcacttttgacgttctatggcaaaatggaagcacatctcttgggctagaaccttatatcttggctcctgttagcacccccggtgatcatgatttttggccagggcaatttgtcctggagaaactggcagtagaggaagctgccgaacgtcagcggattgggatagtgagaaatgtggatgcacttgagcggactgcaaacgtaaaatggattgttccagtggatgatgacattgtcagatatggatgtgactccactgaggagacagtgagtgctt

SEQ ID NO: 3816 - DNA, 1344 bp, Triticum aestivum
  Clone ID: PAT_TA_3816
gtgcggcgctcaggcggcgggttcgactcgtacagagcaattccgccttctctctcctccctttccgacgaggcgacctgcccctttcccctctcgcgcaccttcctctcgccatggccttcttctcccaccaccacctccagcagccccaccccgcggcgccgccaccgcagcagcagcagcagcagccggcgcctctctccttcaggaacgcgctgccggtgccggtcgatggacagatcccggcgcctctcgccttcttcaacgcgccgcccgctttcccggaccaggccgggcagccacagatagtggacgcggcggggctgacggctgcggcgggtatggggtggaggcagccgagggagcaggagctgctgggggagaactcgcagatgtcgtctcatcgatttcctgcagacgggctcggcggtgtcgacgggcctggctctctctctggaggaccggcgccatggcggcggcggcgctggcgcagggaactcctcgggcgattcgccgctgctcctgctgccgatgctggacgacgacatctcccgtgaggtccagcgcctagatgctgatatggaccgattcatcagggcccagagtgagcgcatgaggcagtctatattggagaaagttcaggcaaagcagtttgaagcgctggcctctgttgaagacaagatcctccgaaaaatacgcgataaagagtcagaagtgcagaacatcaacaaaaggaacctggaactcgaggaccagattaaacaaatggcaggggaagttggtgcgtggcagcaacgagctaagtacaacgagagcatgatcagcgcactcaagtacaacctggagcaggtatgtgcccatcagagcaaggactttaaagaaggctgcggcgacagcgaggtagacgatacggcatcctgctgcaacggtggcgctgtcaatctgcagttgatgcccaaggagaacaatcaccccaaggatttgacggcctgcagggtctgtaaatcaagcgaggcgtgcatgctcttgctgccctgccggcatctttgcctgtgcaaagagtgcgagagcaagctgagcttctgccccctctgccagtcttccaagatacttggcatggagatatatatgtgatgtagaatataattttatgtactgcttgagtatcttatctttcgagatgctgatgtacttagacatcaatgtattgtcaactgtagtctcactgggtcgataagactgccatttctggtagaattactgcagcgaacttctgattacaagtgcatgatttgaacttctgaggctaattaagtagtcgtttgccgtgtggcagcccagggc

SEQ ID NO: 3817 - DNA, 2699 bp, Triticum aestivum
  Clone ID: PAT_TA_3817
ttgactcttgctgctcggatctttatggatattttgattttcttagctgtagagatgttgcgatggtgataataagtatcaatctgaaaaatccggcctgcaggatgccaagaaagggatgctttttattgatttccctccagttctgcaacttcaactgaagcggtttgaatatgatcatgcacgggatataatggttaagataaacgaccgttatgagttcccacttcagttggatcttgacagagatgacgggaaatatctctctccagaagctgataggagtgtgcgcaacctctatactcttcacagtgtgctagttcacagtggtggagttagtggtggacactactatgccttcatccgccctaccctttctaatcaatggtacaagttcgatgatgaacgagtgacaaaagaagacctgaaacgggcgttggaggagcagtatggtggcgaggaagagctcccccatactaatcctggactgaatatgaacccacttaaatttaccaagtattcaaatgcttacatgcttgtgtacatacgtgaaagtgacaaagagaaaattgtttgtgatttggaagagacagacatcaatgaagaccttaagactaggctaagaaaggaagacgaagacaaagagaacaagaaaaaagaaaaaaacggggctcacatgttcaccacatttaaggtggccagagatcatgatttggcagcacaaattggacgagacatgttttttgatcttgtggattatgaaaaaattcatcctatccgtgtacttaaagacatgccattcaaccaggttaaggaggagttctcgaaagaatttggtatccccgtccactcccagagattttggtggtggtctaagcggcagaaccatacttacaggcccactcggccattaacacaacaggaggaatcatatactgttggacagcttaaagatgcagcaattcgaatgaacagttctgaattgaggttgtacttggaggttgtacaggagaatcatttgactcttgcttcgaggacaaatgatgatattttgcttttcttcaagctctatgaccctgaaaaagaagaactaagatatgttgggaatcttctcttgaaagcatcaagtacgccatctgatatagtgccaaaattgaatgagatagcaggatttcagcctgatgaagacattgagttgtacggtgaaataaaatttgagccaaatattatgtgtgaaccagttgactgtgatgtttccttcagtttaaaccagattgcagatggagacatattgtgctaccaaaaacgttgttctctggaccaacaccgacatcccaatgtatcttctttctttgaatatgtccataatagacaggttgtgcacttcagattgcttgaaaagccaaaacaagatgacttctctctagaactatcaaaacgttccacatatgatgatgttgttgagaaagttgcacaacatcttggtatggatgatccttcaaaactccgccttactcagcacatccctcatttacagcaaccgaaacatcaatacatcaagtatagaagtattgatcatctttcggacatgttacttttacgtaaccccaatcagatgtctgacattttatattatgaaatactggacattcctttgccagaactgcaaggtctgataacattgagagttgcttttcaccaagctacacctaatgaggtgctgtttcacattatacgattgccaaagggtagcacttattctgatttgatcgacgacttaaaatcaaaggttcagctatctcgaagtgatgctgagcttaggctatttcaggtcaacaataacaagatatggaaggtgtacctgcctactgagaaaatagacgcagttcatgatccaaatgtacctcttcatgttgaggagattcccgaagaagagaaaagtgccggtccgcgagaccgtttggttcatgtcgtccacttcttcaaagataaccagcacattcaatactatggagtgccattcttcttccttattcgtgagggcgaggctttgtcagatatcaaagtacgcattcagaagaaatttgaggttccagacgagcagtttcttaagtggaaattcgcttatgttgcctacaatcgcccggattacctccaagattcagatattgtattgagccgattccagcagaaaaacatttatggaccatgggaacaatccctaggactggagcactcagacatgcccaccaaaagggccaatcagaatcgccattcttttgaaaagccggtgaagatctacaactaaagatggcgatattttcagttctgacctgacggtttctctaaacgaatgggcaagaacaccaatgttatttacgcacaccctgcagatgaagtggcggcaaaatccatgaccatgatgtgcttttgacccggtagttatacagatgtagaaccggctgttgagagggtgctgtgctgagttattatttgtttggaggggacgttgcatacagcggatgtattgtggcttgtcgaaaggaaagtaacacttggtttgttgtacagggatttatagaacttttttgcttagatcaatttcactttgtaagctgtatattttgcagcgaattccggcatctcggttgattctgtggtcgttgccttagctataaaatattctgtgcgactcgttc

SEQ ID NO: 3818 - DNA, 801 bp, Triticum aestivum
  Clone ID: PAT_TA_3818
cttactttaccggaaaccactgcttggtagacccattgtcatggatgtctttcaggattacattcttgttacctacagtccatttgatgtgcatatattccatgtgatgatctcgggagaattgtcacctaccagtagtccagttttacagctttcaacagttcgagaactttcaattatgagtccaaagagcccacctgtttcaatgcgcttgattcctgaaccaactgatgaaggtgtgctgaagcgggatacaaatgaatcttctaacctgtcgtcccaacaaccttcaagatgtctgatcttgcgggtgaatggggaactttctgtgctggacatggatgatggacatgagcaagcacttacaaattcagttgaactcttctgggtcgtcggttctcaagaagaagagaagagtaatcttatcaaagaggtgtcatggcttgactatggccatcaagggatgcaggtatggtacccatcacatggagcaaatccttttaggcaagaggattttctgcagttggatccagagcttgaatttgaccgtgaggtgtatcctcttggtctcctgccaaatgttggtgcagttgttggtgtttctcagaggacgtccttttcaaccgcagagttcccatgctttgagccttctccaaaagcgcaaacaatattgcattgtttactacggcatcttcttcagagagacaaacatgaagaagctttacgtttggcaaacttgtcagcagagaaacctcacttctctcactgtttagagtggcttctgtttacggtatttgaagc

SEQ ID NO: 3819 - DNA, 359 bp, Triticum aestivum
  Clone ID: PAT_TA_3819
ctatcttgttagtagcgtgatgtagcatttgcctctcgcgtgcggttgataccatctgtaagaaatatttatgctaatccttaacgggtagattgatagttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggatcaaagtttacttcccggtgcttgcaaagaaatagcttttttttggggtccccaaaattaaattaactggccggggtttaaaaacatattaacgggaaaaaccctggggttacc

SEQ ID NO: 3820 - DNA, 626 bp, Triticum aestivum
  Clone ID: PAT_TA_3820
ggaccagttctgcatcaagagttaggcgctctcatttcttaagtccttgcggagctggaagtggtgaatgtttagctcagattcttgtttaaatgatgatttctgcatgccgattcagtgttttgcatggtattgcaaatgaagaaatgttctgtgtcgtaccaattaatatgttaaaaggtgtttttagtcatgaattggtagcatgtggtgccttcattggtaagttcttgctagatatccaaggtaattgaggcattgcgctaattgatagttggttccattctacttgtggtggcgctgatactaatttttcttatttgcgtggaatttggatgttaagaatctacactgatcaatttaatccttgtattgatattaatttatggcatgctcctgcaagtacctgttgtgatgagtctgagggccagaatagtcttcttgagcataccaaactggctgtgtaatgttttgaatatggtcttgagtcattttgatgaattaggaagtggtgtgatgtctgtctgaatggagtcatatagtctatgagttggagttgtcagcatggcttcaggggcactggttcttataaacagctgacttatattttgtaaggtcagaaattg

SEQ ID NO: 3821 - DNA, 810 bp, Triticum aestivum
  Clone ID: PAT_TA_3821
agctaagaggtcggcacgagccacccggatcgcaaggatcaaaggcgaagggttttatggggcaagtgtacatgcaaagaggttggcatgacaaatgcggatgtatgtcttggttactttctatgttcagtttcatattcagcagtcacatctgttgatgggtatgaggtcccaaatgcatttttatgcactgtgatatcgctctcgtataatctacttagcccgttatgttccagacgtggtcgctctgactgtcgggttggtagtgatggtaagtttcgattacgcaattcttctgagttttcaacttgttttctgaaacattttgcaggtcgcggtcatgatcccggtctcctgtctcttgggtttccggaaaagtcgtgggcagatgcgcccggagcaggagcttatcccgcgctgcttctcctgtgaggtcggattgatcttgggctcacctggaagcagggagcgaattctttcgggatctagatcgtggcgcacgtggttggatctgctttcttaagttccgttttaccctgtgtttgatttactggggtattgcgactgaaatggtgcctcgcttgcttcttgttatgtactatgttctctgctttatagtagtttttttggcggtgtaaattgaaatgccaaaacggcttatatttgggaacagagagggtatctctgcttctcctcaagattatatagctagtttgtttaaatcttgtagagaatctatctcttttcactgttagctcggactccatcgtttttctatgttccaatgaatgatgaaacatgcagagctgg

SEQ ID NO: 3822 - DNA, 975 bp, Triticum aestivum
  Clone ID: PAT_TA_3822
gcacgagggaaccctagcgctcccttgccgcactcactctgctccccaggtccctccgctccagcccagaaaccccccccgccgccgccgccgccgccgccgcccaccggagccggagatgaagaagatcttcggcgccaagaagagcagggacccgccgcccaccatccaggacgccaccaaccaaataaacaagcggggcgagagcgtggacgagaagatcaagaagctggacgaggagctggcgcggtacaaggagcagatccgcaaggcccgcccgggcccctcgcaggaggccatcaaggcccgcgccatcaggctcctcaagcacaagcgcatgtacgaggagcagcgcaacatgctctacaaccagacctacaacctcgaccaggtcggcttcgccgccgacggcctcaaggacgcgcagcagaccatgggcgcgatgaaggccgccaacaaggagctcaaggggatgatgaagaccgtcaagatcgaggacatcgataatatgcaagatgaaatgacggatctgatggacgtgagcaacgagatacaagaatctcttggtaggagctacaacatccccgacgatgttgacgaggaagatctaatgggagaactggatgctctggaagctgatatggagtttgagtcagctgcagtcccatcgtaccttcagccagatgaggaatctgatcttaacttgcccgctgcaccgacttatcctgcagcagttcccgtaagcaggcaccaggaggacgagcttggactgccaccggtacctcgagcgtcgctccgtagttagaacctggaagtatttcccgtccttgttctcagtgttactacctcattgttaatgatgcgggagaagtctttgtgtttgcacttaaacaatccttgtaagccatttcttgatggtactgcctcttacggctaagctgtgcaatgtagctagtttccggctcaaaaaaaaaa

SEQ ID NO: 3823 - DNA, 433 bp, Triticum aestivum
  unsure (1)..(433): unsure at all n locations
  Clone ID: PAT_TA_3823
ttcgagcggccgcccgggcaggtccgggcaggtactgttttcggaaggtcatttgttctcaggccgattaaaggttcggggaagctagagaagttgttgttgaaacttttggaacctgacaacttcaggcctaaacagtgtatataacgctcttgttacatgtagccagcttttacggagtagtattttggtagtgtgcgctgtgcgggggcaaaagtgttcctgaggtggttggttatcattgttctggcggcaggtacctcggccgcgaccacgctagtatacttgcaactggaagctcgaagagtgactgaaatcagacatgtacacacttcatgtcccatcttttcnatggatgtgcatatacagattacagaaatccataatccaaagaaaacacaatctgtttactgacaaaaaaaaaaaaaaaaaa

SEQ ID NO: 3824 - DNA, 687 bp, Triticum aestivum
  Clone ID: PAT_TA_3824
catccaaaactattcaatcactgcagatggtactcgcggagaaagattcaaaaatatccggaatcgagccaccgtcaaccggtgaagcggcccggcttaaagctaccttggaggacattaaaggcgaccttactcatttaaaggaccaacatgagaaagaaagacaaagctgggaagccgaatgtgaatcccttagagaaaaattggaagcattggaaagtgcgcgctttagatctgagatagaatctgccaaatttagaaatcaattggaatcagagttgtcaacgcaaaatcaattgcttcaaaacaaagattcggatctaatttctgcgaaggaggagatcagtcgactagaaagtgagttttccgcgtacaagatccgtgcacatgcacttttgcaaaggaaggatgctgagttgagcgcagctcaaaattcagatgttcttaaagcacatgaagaagcaataagagaagctgaaaaggaggtggcagctgccttagaagaacgagatgaagcgatccaggaccttcaagttgctcaatgcaggcatagtgaagagattgaggcaagggatttgggtcttgcggagttggacaaaaaactgaagaatgtcatgaaaaaattagattatgttacctctcaatttctctcaaaaaaagaatcatgggagaaaaaattggcaagtg

SEQ ID NO: 3825 - DNA, 1757 bp, Triticum aestivum
  Clone ID: PAT_TA_3825
actcagcgccgcagaagcgccgcggccgcgcgggggagcggcgcgctgcgcggccgcgggcaaaccctaggcgtacggcgggcgccaccccccccggcggagggcagcctccgcaccgcttggtcggcttcgctcggctctgccgcctccaacccccccagtcggccaggtccaattgctacatctgtgagaacggtgcttgcggtgcaggcgtctacggccacttctgccatgactccaatgaccggcctgatgatctgacgcaggtctgcacattttaccagaacggtgtgtgctcttatggcagccgttgcagatatgaacatgttgaagtttcttctgaatacacccaaccatcaactactgcagcacttgcaccatccaactcttatctgtcatggtgtcctctttgtgagggggaaatagatgtgagcaaccagacacacaaaagtttatcggtatgctctgtgcatcagtctacctggagatttgatgatgaagattgcattccagaggatgggaacagcgtccggcttgtcatcagcgctaactgcacaaaaccaagcgctccacccacttgctcatctgcccatatgctcttttgccgcagctggaacttgtccctatgggaaagagtgccctcagatgcatggggatccatgcacatcctgtggaaaacagtgcttgcatccctaccggcccagcgaaggtggggctcatatcaagctctgcaagagaaacaacaaacgtcttgagaccttgaaaaaaagtgaagagatggaatgtagtgtgtgtttggaccgtgtgctttcaaagcccacagcagcggaaaagaggtttgggcttctacctgaatgtgaccatgccttctgtatcacatgcattaggaagtggcgcagcagctctcttacatcttctatggatatcgactctacagtcaaggcttgtccaatatgccgcaaagtctcgtactatgtcattcctagtgctacatggtactcctcgaaggaggaaaaacaggatataattgacggttacaaggccaagctcaagtcgattgattgtaggtactttgactttggaagggacacttgcccctttggtggtcgatgtttctacaagcatgcctacaccgatgggcgtttggaggagccggcaacggtggcagtgcttcattttcatgccgacaatggaagtatggagcatgcaagaaatatcgggttggcgtacttgctcagccggttacatctataggtaaagatgttggaagcagttgagaagagaagtaccttacttagggagccaccataactttctctccggctggtggttgctgccaacttatataatccacagaaacttcagtctgctgccgtaaatctccaaaaaggcagaactgtaaacctaacgacagcggagatgtcatgcctcagatcatcacgggttccttgtcatgaacaatcattgtgttgtctttgggctaggagttctcctgtcgaacatgagaacttcacgtcgttaccttgcccgtgtacgaaaggcactgtatatactcgtagtggtacatcctgtccgtttctcgtccatggagtaaataatttgttcaggctatacaggtagaacagtgcaacgcagatccttccatacgtgaatttatgctttggcccgcgggttgaaacctgcaaggtctcggtggtacttgcagtgcaggtcccatctagatatttacacgaattgtgcaaaacgaatttgacctg

SEQ ID NO: 3826 - DNA, 1390 bp, Triticum aestivum
  Clone ID: PAT_TA_3826
ccgttccacgcatcgggtgggactcggttatgagcatgagtgctgatctgcgagacttatttctgtacgaggttttcttatactataatcctctgcttcctggtggcacttatgatttggttatggggagtgaatttgtgggttttcgcacaatcatcagtaaattatgcgaaggtgtttgatctttcgcagacacatttatcacaccgagaaatatggaggtgtgctacttggctgactttagttgttccaacaagtatgacagcttacctatatctgtattcacatggtgaagtgtctcttgctgcatctcaaccagtggtcttttgtatgctatccttctgatgatcctcctttctccttttgatatgttttatttatcatcacgctttttctttctgaggaccatgtggcgtatagcacttccattacaagcaattacattccccgacttctttttggcggatatttttacatccatgtcaaaggtgtcttcagatttggatcgttcagggtgtcgcatggtccatcgtcaggtcgcgacaattgcttggtttgaagcagattcaatttgtggtagccactctgtagctattcctctagttctggtactcccttatttgtgtcgtttcttccagtgtcttcgacagtacaaggatacaagggagaaaacttgtcttctgaacgcactcaagtactcgacagcagtccccgtgatctttttatcagctctcaagtatcatgtatttcccgacgtatggattagcttttaccgccccctgtggcttatttccagcgttgggaattcattgtattccttctactgggatataaagcgagattgggatttgagcattttaaccaggattttcatgttcaaaaacccaaatgcatggagcaatcttctttacgggcgtagctgggtattttattgggtgttaggtagcaatctcattctccgatgtacatggacatacaagctatcggcgcatctgcggcacaactacctgacagtgtttgcgataacagctttggaagtggtgaggcggttccagtgggtctttttccgcgtcgagaatgagtggaacaagatgacagccaagcaaaattttgaaatgtcctctgatgtgctgccttcggaagcagataggctactggattctaacagccatacagtctgaccctacactctaaacagtcttatagcgcggtccttgcgaggttctttctcgtactatctctagagctcagagggccaattatacaggataggtttccacacaaaaatgaagttgttggcacgtgtgcccgtatgtaacactcttgaatccagacaatgatagtggtcccaaaaacaaataatgttatttggcacctttacagagactat

SEQ ID NO: 3827 - DNA, 503 bp, Triticum aestivum
  Clone ID: PAT_TA_3827
tcccgcgccatcaaacgcagcgcccccgctgacccctttgtcggcgtgcgcgagcaccacgagggtaaacgcgccgccgtcaaacggcttggtggtggtgctctttgcccctgaaaggggtggtgttcttcttctcgatgcctcggcttgccgatgcgcatcgagatcaagaggaacggcgtggccttgcggcggcgctacttttttcgtttctgtgaaggattcgttctttgccctgtctagggttcttgggggaggggatctctttttctttttctgtttttgtttctttgtaccaaaatcatctagccagtggcatctgataccattgatatatcctttggatcggggtaggctagatcatccggtaagcataccttctttgggtgcggctgagctcgatccaagcgccggccatgtgtgaagtaggggccggttataccagagagatcgacgatggcagaggtggcagggggccttcccgtgagcactgtgattgccct

SEQ ID NO: 3828 - DNA, 944 bp, Triticum aestivum
  Clone ID: PAT_TA_3828
ctcccgcctctccggaagcgccgtcgctgttggagatggccacccttctaaccagcagctcaactttcacgagagcagcggtcgtcacatttttccatggccttggcgaaacaggcctgcaaactgcattactgtatttcctgaaggcccaattccactataccaagaaccaatatgctaatttgttgcttattattggcattacaggaagtttctcacagctgaccgtgatgcctctcttagcgccgaagctgggtgagcagaagctacttgtcgtggcacttacagggagctgcgtgcatggcggcccgtgcagcattgcatggtcattctgggtcccttatcttgctgcaagctgtgtgattctaagcattttggtcggcccttgtataaggagcattgtatcaaaaaaagtagggccttctgagcagggaatggttcaaggctgtattacaggaatcagctcaactgcaagtgtcatatctcctctagtttttactccgctcacagcatggttcctatcagagaccacacctttcaacttcaaaggtttcagcctggcttgtgctggatttgctacgttggtggcactcataatgagcattaatatgaggccagcagaggttcagccagataccagatagaagaactactgaatacatgtcgatgtacatatggtagatgcctataatgctaatactcttactcagtatcaatagccgtggtcaattaaggtagctgttccatcctctgcagtagggacagcaaatagcagtgtaaagtatcaaaagtagaagcagatccacaggcttcagtttgtaaattgtattcggtaactgacactacaagtacaagggtcaattaaaggtagctgttccaattccggtgcagttgacaatagggcaagcaaatagcggggggtagtagcgatcgtagaggcagaa

SEQ ID NO: 3829 - DNA, 561 bp, Triticum aestivum
  unsure (1)..(561): unsure at all n locations
  Clone ID: PAT_TA_3829
cctaggcgcaccaccctaagccaccgcaggaccgctgcggctttgccaccggagttcgtcggaccaccgtgcggatcccggtccgtcgccgcaggcgagggcctccgacgccgatcgaagtgctgctgctgctgtttggtgcagtagccataaaggagattgtgggccagtgatttcttgtttagcctggttgatcctcgacaacacactcttcaacttgttcagtttatgcaatgcaacctgtgcgtaaaccgtttcaacttgttgatcaggacatgccagaagctaacatggggatgtcagagcagatgccacattttccacaacttgggcaccatatgccacctgctggccttatgctaaatacgccacgccctatgcaacctgcgtgatatacttatcaacaaatgtgggttcctgttctagttcaacccctgggttcaactcaacatcacaccaagttctgcntggttgccctcaattaactcatctgancctaaccctttggattggcaagagtacttttcacatgaagggaaaaagttctattacaataggggg

SEQ ID NO: 3830 - DNA, 375 bp, Triticum aestivum
  unsure (1)..(375): unsure at all n locations
  Clone ID: PAT_TA_3830
agggagagcatgaatggccgtaaagagacgctgtggattttggttcgagatgagaatctggatcttgtcctttccagcatcgggtcctagtaatttcttcgtgctatatgttcatatttggttagttcttctgctcaatttaggatgatttttgttttctcccgcaagtacatagacatctcgctctttgattcatagaattttcagaagacctcttgagcactctgtgaattgagaaggaaggtgggtaagcgtctttacctttcangggaggccacgtcattgtatttatatatgcagagtatgcgagagttttacaagatcaggattcatccagattggagtgcatgtataaactcttaacacatgcatctt

SEQ ID NO: 3831 - DNA, 898 bp, Triticum aestivum
  Clone ID: PAT_TA_3831
cgcggcccgatctcgcctcgcgccagctcctcttcctccaagcgcttctccctctcgccggctctctctcccgcctcctccccctccactcgctgcctcggcagcgcgtcggccattgcgtgctcctccccttccttgctctgcctctccccgcctcggccttccaccgcctggtcctccaggttctcggccccctgggctccctccgcctcgggctcctctgccccctgggccctctccgcctcgggctcggccgcgctcgcgttcatcttccacctgcagaccgacatggggttcttcatgcaaggcagcctcaagttcgtcctctatggcgaagaagaataatcagcaggtgcacatgaacaaagagaacaaaggagtagacgatcaagatgtacctgggctcatgttcagatcgatttgacgaccaacctggagcagttcttcatgcaaggcaacctcaagttcgtcctctatggcaaagaagaatcatcagcatgtgcacatgaacaaggagaacaaatgaaaagatgatcaagatgtacctgggttcaggttcaaatcgatttgatgaccaacctggagcaattcttcatgcaagggaggcacatgttcaacttctccctctcctggtgctatgttcaagtcaatggccatggcctctctatgtgttgttctacttggcgctagtttgctgcttgttctacttggtgctactgtgctagctttatagctggttgttctacttgaaatctggctcatagctcaattctgtaatttgccgcttctaattctgtaatctggcgccatattgtactagtactcagctactagttgtggatggtgggaagtgttgtggcgggaacaattctctgttggcaaagctgtaaaaaaaaaa

SEQ ID NO: 3832 - DNA, 723 bp, Triticum aestivum
  unsure (1)..(723): unsure at all n locations
  Clone ID: PAT_TA_3832
gccaaaggcgtgcccgcggcgctcaactcccacccgcgccaagcgccagcacctccttctcccctgcctgccattgggagcaccagcgtcggccggcagccgcccctgttcccccccaccagctgagggcgcgatcagatctttctagagagccggcgccgggatggccagactaatgggcggctctgctggcttccatgtgcagggggcacacatgcaggcgtctcgcccgccctctctctccttcagaacctgcgcccagctcgagatctccagattttgcgctatccctcgtttcatgggcgtgaaggctgtcagtgcttcccaacagcatattaggcacaggttcagctccatcagagcctctgccctcccatgcatgcaggatgacaccacgaggtactttgatttcgtggtcatcggcagtggtgtcgctggcctaaggtatgccctaaaagtctcgaagcacggctctgttgctatcatcaccaaagcagagcctcatgagagcaacaccaactacgcgcaaggcggcgtcagtgccgtcctgccccccgatctgtnnaaagcatatcaagacaaatnttgaagggttactctcaacaagagacnnaggtatatcanaaaggctaacttcaagngtaanacaaggtgtcattatatgggaaatgaggncactncaggaaggggntccaaaaaactcattccaatacggaaaattaa

SEQ ID NO: 3833 - DNA, 815 bp, Triticum aestivum
  Clone ID: PAT_TA_3833
ccacgcgtccgtgctcgagcataattacatcggcatcttactagaaggaactttgaaggcggagaaccaaaacagcatcttacctccaggagtgctgctgccatcaaacatggacctggagttacttggtctggagtcttcagctatgaaccgtatggacagttgctactcagcagacagctatcaggtggaagcccaagctagagttctcatcttcgaagtagggaggctgttcacggaggccaatgggcagaggaaccagccgggtggtagcttctctgctgaagccttgcagctcagcgtggaagaatccactggagaagaacaagtcatcattaccgtcgactctccgaacaagctgcccttgggtgattcatcagctggctcatcatctggcgtgacgcgaggcagctgatgggatcttgtgcgaatatagtagcgtgcttgatggagtagcaatcatgaaattgacctctctttttgagaaacttggctttattacttgctggtgtaactaaatcgccggtaaccataaatagagtgtacaaagttgggtatgtcatcatgccatttgacatcgctgggtgtcatacaagcaacgtaattacagataagagatgctgaaggtgatagtcatgaaattagctttatggaccgaaataggatttgggacgctctcagttttgtttaaaagagcgcgtcgctgcaaccattcaatcacgttatattcagctttttttgctacattggccaagagttggtgttcacagatggcaagtctattattggcatgagttaagaactttgcatttgcc

SEQ ID NO: 3834 - DNA, 1211 bp, Triticum aestivum
  unsure (1)..(1211): unsure at all n locations
  Clone ID: PAT_TA_3834
ttttttttttttttttttttttttgttttctgagaaatgcatgtctcgatgctcatcacataagccatcccacgaaaggtgattacagattgtcatcaagcacttgcaggttagcacacacaccctgggaattcccgatcaattagaaatggcatcaaataaatacatgatacaaaatgcagtggcggcgtaataaaacgtcagaccagcagagattacttcacaagcggtgaagtcagaatgtatatgtcgatctcatccaacgtcgggcggtcgcgcagcgtcaagctgtgttcatttgccagatgcaagagacaaatgaaatagaggtgtggcgagatttcagtcgttgaaacatctctgttactgcatggaagatcatgcagtaccttcgtcaggcacagagacggttctttgtcatctctttccagatcagcagtcttagcagatgtatgaatgtgattccagagcacttcctttaaggcatgaacatcgacttgtttcgataccttgtcatattgtacatcaatcttattgacctgtcttggtttggcaataagatttactggctcttccacatcactagccgcatccccttcatcaacatgatcattgcccaggttatcatcatcccaaggtctggatggcataaagtcatcgctgttgtcccttgaatcatcaagtggttttcttcttcttcgagccagacacaaaatatctggaagaagaaataatttaacaaggctttcaggttggtaatgacaatcctctggaagtttattgttgcagctacccttatttgcaggcagcaacaatgattttgggttcttgggaggtgcaaaaacatttgccttctcatgttccaatgctttggtgaaatcaatatcaggctcgtctttgcctttcttcttctttgccttttttgctacttccaaatcaccagaagaagtttgggcaggctnccagatnctnctaacttttcgatatttccaatgctcgggtnccagcccaagcatttgttttggaagagaatcccgcaccaagtgacaacaaatctgcaattttctcgagcctttcatctacatcaggaccgtctggaccctggaaactgtactcatagtcatcggtttcctcttcataatttgttgagttgacattcactgggttgcagtgttcatcatatgcactgtcctgatcatcacaaccaccaa

SEQ ID NO: 3835 - DNA, 663 bp, Triticum aestivum
  Clone ID: PAT_TA_3835
gcgatagtgttgccggggacagagtacctgatcggaggtgcctggatttgcaaggcaggctaacgatggatggatgcggagggaatggagttcctcctcgacgcggtggacagatttcccgtacgggaggaatttgctgatagccttgagcacccagatccagtgccactcctctatctgctgcaaaaggggagtgcagcagaagatggcgttgaggccaatggtgtgtctgggctggctcaagtggacgacaagggggtagctgcagaccgacaagatggtgaacatcgtccccgtgcagaatctcaggcgaggtctgcttagtcaactgacagggtgaatccgcaagcccccggctggacaaaaaggctgcggctcagaagcgcgccaccggactgagtgccatgcccatcgaggatgagcgctctcgagatttcgatacgcaaatatgcggagcagcctgacaagagcgtcgtgaggcctgagctggggctcagtttcgattcgttaggcgaggcgtagggcttcgccggcctgtcggcgtagctggccgggattacgttgtggctatggcggactcagcgccatttcggtatttgtgggcttggttgaagaagttctggttcccagttgattttatggactgctgatcaatgtaccttc

SEQ ID NO: 3836 - DNA, 962 bp, Triticum aestivum
  unsure (1)..(962): unsure at all n locations
  Clone ID: PAT_TA_3836
gcacgagggaaaaacccaaactcagcgagcctacccagaaagaggaaaatattcctcttcccttagctccaacgccgccggcttcctccggtcgcgccgccagtcaaacccgccatagatctcgactgaagcaggcttaccaggcaagcaggcgtcctcttccctcccttccctccgactgggtcggtgtggagagggaggtccacccgacgctgctcctttggttggttgcttgttccaaggttaaatggcaaacagagcaaggtgggtgatgaagttcgaaaaggggcttattgatatactacatgagaacaataattcgcactataggactccaaacggatggagaagtgagggttggaagaaaattgttaaagattttaatgataggcacccagatgcagggtttaccaaagttcaaattcaggaacatgagactcagctgaagaaagactataaattgataaaatccatcctccagcgtgatggtgtttcatgggaccagaatgcttctatgatcagaacaacagatgaaatatgggatgagataattgatgagtcaccaaaagcgcggaagtaccaaaaagcattgttgaaagggcaacacaacttaaccaatctgctaccatgataggggatattcctgaaggggttggcaatattgacgaggaagacaacaacaccagcacactgcgaagcatgtctagaagactttctgcactggttcctggaagcatcgatgagggtgagaacaatatcatcgcactgcagagaactctggagctaggatcacaaggtctggaagatgttgatcttctgcaaaatcacgatgaagaggcattggaaagaccacagcctgnggcagacccaaagccacaacaaagagccgatgagcccgcacagtcaagctcctgcatagaaccgcaaaaggacaagcgcaagaagcgtaaggcgtctgacat

SEQ ID NO: 3837 - DNA, 652 bp, Triticum aestivum
  unsure (1)..(652): unsure at all n locations
  Clone ID: PAT_TA_3837
atccaaangtnacntattggtaggaggttaaaattcnttaaggggngctcattaaaattaatgttggttggttanaaaaggtccaaaaatgnggaaatcaaaaattaaagggaaattgggccgtnnaaatggacaccatgcaaattcctcgcggccacccacctcgtcggcgccggccggcggtggtacttcctcgtggacatcaactacttcccggggttcgccaagatgccgggctacgagaccgctctcacggatttcttcgccgagatgattcagctcggcactgcaggcgccgccagccaagagaagctcgaatctgtgccgtgcaatggcctagatctcgaggaaactgggtctgctttggactcgacctgccccgtgcccatggcttagtttcgaaaacagggtgcggccaaggtccccgtactgccgatgataatagatgttttttttcgaggatttcaagcaactgattaagacatcgatgattgatgctatctatgaaggtttcaaatctactccctccgttgttcaaagagtgtacttccaactttgttggaaagtcaaacattttaatgtttgaccgtaattatacaataatacataaatatttttgccaaaaaaaaaaaaaaaaaaaaaaaaaaaaaaa

SEQ ID NO: 3838 - DNA, 1549 bp, Triticum aestivum
  Clone ID: PAT_TA_3838
agccggggcccgtcgcctccgacgaccgccggactccccagccccagagttcggctgcttcgtcgtacaactacacgtcgatggatagcatgcgtgagcctaaggttggattgtggggagctttggcaagaaaggccaaggggattctcgacgaggatgctgctgctcacaagttcgatgaccatgggaaagttcatagtgctactcgcaagcccaactcatcggatggagctcaggcccctcaatctcgttggtcattcgacagctatggagggacagaaaggagcgaaccgcggaagaggtcagaggcacttgccgcttctgtcaaccagtttggtggaagaatcagaaacgccttggaagaaggtctcattattgttgataataagacatcaaacatcatcgaggaaacaaagaagatacaaattagaagaaagcctaacagttccagtttgcatatgcagaatcctgctgcagatgcattcccccctccgagtttcactcagaataaagctgaggcagctcaggagacccagttaaaagcttctcgcgacgtaaggttgctaatgcgatggctgctaaagcaaaacttgtacttcgtgaactaaaaaccgttaaagcggacctagcctttgcgaagcagcgctgcactcagctagaagaagagaacaaaatgttgcgtgaaactaagcagaaaggggtcaaaattgaagaggatgatgacctgatccgcatgcaactggagacattactcgccgagaaatcaaggctggcacaggagaactccatgtatgcccgtgaaaatcgcttcctgcgtgaaatagtagattttcaccagttcgccgcccacaatatcgtctcctttggcgatggcaatatgaaagacagcaagctagaagaagataccaatcgcgcatacactgaaaacatgtttccggtggttgaagcttatttagcccaggaagaaatatctcctgtcccctcgagactggattctccgatcctcagcccaggcgagtcatcatccccagtatccatcatttctgtagataatgctgctaattcgccgaggaaccccttgaagccaaatgagttggtgcctgacaaagattgatgtctgccgcttctactctgcttgttggggcttgcagtgggtttggttgtgagtagtgtgcatacaattttgtccattctcttgtccatatctgtttgcagttgtaataattattagcaggtttctgcttttgtgtaagataaagagtatacgggctgacattttattcttgtgttggtgaagttggctagtgttcagctgttcatgtataggcaaagtgtgtacagtactacagtacagtttggttttcatgcttgtagggttggtgaaatggattggtgtgaatagggaaattactctgatgaagagtgggtgtatactgagactgatcaaggttcgtgtctttgtcatgtgcttgggccctctgtaaggttacctccggtgcctttattttactagataattgactgtgccttgtaacagggtataaaaaaa

SEQ ID NO: 3839 - DNA, 1489 bp, Triticum aestivum
  unsure (1)..(1489): unsure at all n locations
  Clone ID: PAT_TA_3839
ggtcttcctgcgtctctcttgtacctgggacgtcctcggagcagctagctgcatctctacaaaccatccaagtaggcagcagttgtttggaggagagatggcgccggcggcattgacggcgttggacgcgagggcgccacgggcggagggcctggcgacggtgctggccatcggcacggcggcaccggacaactgcgtgtaccaggccgactacccggactactacttccgggtcaccaacagcgaccacctccccgagctcaagcagaagttcaagcagatatgtgaggggtccatgatccggaagaggcacatgcacatgaccgagaagctgcttgagcaaaaccccagcatgtgcgagttcaacgccccgtcactggacgtgcgccagggcatcctcctcaccgaggtccccaagctcgggatggctgcggcgcagaaggcaatcaaggagtggggccaaccgttgtcgaagatcacacaccttgtgttctgcacccggcaatccgtgggcttgccgggtgccgactaccatctcataaagatgcttggcctcaaccccgtcggtgaggcgcgtcatgttgtacctacaaggctgcttcgccggcgctacagcgatccgtgtggcaaaggacattgccgagaacaaccatggnagcacgcgtcctcatcgtctgctcggagatcacagccgccaccttccgtggcccctcagccacggggtcccaccttgataatctcgtctcccaggcgctcttcggtgacggcgccgccgcgatggttgttggtgctgaccccaaggagcccatggagaagccaattttccagttggtctcaacaagccagaccatcctgcccgagtcggatggtctcatcgaagtaaacctcttggaggttgggctcaccatccacatcgacaaggacgtgcctaggatcatctcaaaaaatattgagcatgcgttgaccaacgcctttgcgccactcggcatcgatgactggaactccatcttctgggtggcgcaccccggtgggccggcaattcttgacatgatcgaggccaaggtcaacctgaacaaaaagcggatgagtgccagcaggcacgtcctgtccgaatacggcaacattgccggcgccactgtcctcttcattctggatgagatgcgtaagcgctctgccgaggagaaccatgccactactggcgagggcatggactggggcgtcctcttcggatttggccccggcatcaccctcgagaccgtcgtcatccggagcatgcctatcaacaccaccacatgatccatactagtggagagcatgtgtggtggcagaaacgtttctttcctgaataagtcaccttatcagcattttcattgttgaataagttaccttctcttgaagtgtattaggctctcgttgctaatcaagttgtattgtgctatactatttgtgattgttatttaataattttcatgcaaaaaaaagggggggn

SEQ ID NO: 3840 - DNA, 907 bp, Triticum aestivum
  unsure (1)..(907): unsure at all n locations
  Clone ID: PAT_TA_3840
caacaccgcctccagctgacaccaccctaggctctggggagtacaccgggtcgccgacagctgcttnagtgatggcagcgggcggggctggtgttcttcttggcgcacgtgcgttacctctccaagatccatgagcttggtgataggttgctcatcctatgatgctcgcttgctcaccctgctcggtgcaagaaattcaggaagttgggcaaagtagggtcgttctggaggccatcactgttgcgcatcgccgaccgggccaaaatcttgtcagattatgcgtggacgctagcaacctcgaagcatgctaccatcttggaaattatctgatcgtatttctggggagccgggaggtaggagcaacgctgatgatgaccgtgacggtgggtgacaccgccgggaggcaatgcactccctgtgtgtcgttcaattcattggcattggtgccaccaaggacgatcacaacaaatgatatttttcctttgattttctttcctgacggtggtggattggttgctccttggtgcgtggatttttaaatgtaggctgctggtgaggaaacaaagttggtgaaaatatcaaagctggacaaaaataatagaaacattaagcacagagcctatcttttttctcaagtaatgcttcccagccccgattgccatggacattgtgattatgggatgttggaacatttggatgcaaagaaatgggaaaatcttcaaggctgttcccccaggaattcatgcctggaagcagggtctataccaagatctttctctggtcaaatatcgcactaaagagaagaatgttgccgctcattgagacaatggttgaattcccttctttcataagagctcgtagataatttttatctatattagagaaaactgagagttggctagatttc

SEQ ID NO: 3841 - DNA, 988 bp, Triticum aestivum
  Clone ID: PAT_TA_3841
gaaacagaaaggaaacccggaaaagaaaacagagcaggactccactccacactccactctcctcccccctcctcactctttcttggatcgtaaggaaacggaagaaatacatccgcgatcgtggaggggacattttgatcggtgttggtttcccaaggccgagacgagggtacgtggtggtcgtcatggatcggggcgtggaccggaggacggggagggaccagcagcggaggcgaccgagccctttctcccgctctttgctcctcttctcgcagtaatcggggaaggtggtggtggtggtgccggtgccatctgaatttctgtggagctcgccatgaagcggcccggcggcggaaacccctccccaccccaccagatccaaccccaatgatatggactacggcgtggtcgggatggaggcggacggggacgcggaggaggagatgatggcgtgcggcggtggcggcggcggctgcgggggaggggagaagaagcggcggctgagcgcggagcaggtgcgcgccctggagcggagcttcgaggtggagaacaagctgcccacgcgtccgaaggcgcggctggcgcgcgacctcggcctgcagccgcgccaggtcgccgtctggttccagaaccgccgggcgcgctggaagaccaagcagctcgagcgcgactacaacgcgctgcgccactcgtacgacgcgctccgcgtcgaccacgacgccctccgccgcgacaaggaagccctcctcgccgagatcaaggatctgaaggggaagctgggggacgaagaggccgcggccagcttcacgtcagtgaaggaggagccggcggcgtccgacggcccaccgcccgcgggcatggggtcatccgacagcgactccagcggggtgctgaacgacacggacgcgaccggcgccacgccaacagaggaggcgccagctccggagatggggacgctgctcggcgggcccggggcggccggcgcggc

SEQ ID NO: 3842 - DNA, 566 bp, Triticum aestivum
  Clone ID: PAT_TA_3842
ccggcgcgacgacggcggggcacgggcaggtgttcctgcacggcaatttcctgaaggtggaggaggacgagacggggttcctggacgacgaggagccgtgcggggggttcttcgccgacgagccgccgctggcgtggtggacggagccgacggatccctggaaatgaggcgcggcagagagcgagagactcggtgggagacgacggacacctcgcgcggggaataaaagattagtgaagaaagcaggggcttttctgaaatttttgtaaatctcgtttttatctagtcctttcctgtcaaaccctcgccgtcgctaggcagccagcatcagcaatagtactactactactactagtgccatttccgcccctgctctttcagctatttcctttttcctcccataaacccttgccttttagctaaaaacttaaatgtttaagttaaaaaaaaaaaaaaaaaaaaaaaaaaaaaaaaaacaaaaagaaaaaaacaaaaataaaaaataaaagaaacaggataaaccggaagctctagaggtttaaagctaatctgcatgtgaatgaaac

SEQ ID NO: 3843 - DNA, 2270 bp, Triticum aestivum
  unsure (1)..(2270): unsure at all n locations
  Clone ID: PAT_TA_3843
cggacgcgtgggcggacgcgtgggagaaaggaaaccccgaaaagaaaacagagcgggactccactccacactccactctcctnccccctcctcactctttcttggatcgtaaggaaacggaagaaatacatccgcgatcgcgtccgcggaaaggaaacccggaaaagaaaacagagcaggactccactccacactccactctcctccccctcctcactctttttggatcgtaaggaaacgcggaagaaaaatccatacgcgatcgtggaggggaggacattttgatcggtgttggtttcccaaggcggagacgagggtacatggtggccgtcatggatcgaggcgtggacgggaggacggggaggggccagcagtggaggcgcgcgagccctttctcccgctctttgctcctcttctcgcagtaatcggggaaggtggtggtggtggtggtggtgccggtgccatctgaatttcttggaactcgccatgaagcggcccggcggcggaaacccctcctccctccaccagatggccagccccaatgatatggactacggcgtggtcgggatggatgcggacggggacgcggaggatgagagcatgtcgtgcgggctgggcggcgattcggcacgagggcaaaccgaaaaagaaacagagaagagagggagacagagtcctcactcccacactctcactcttgtcttccagtccctcccagcgcctttcttggatcgcgaggaaaccactcgggaaaattttgcaattgtagagaaccgtatcgaccgtcgacgagggtgcatggtgttggccatgggtcacggcagggaacagagacgagcagggaggcagcaatggaggcgctcgtccccccgctcattgatcctgctctcgctgtaagatagtcccgcggtgccctctctgaatttcactccatcgaactcgacatgaagcggccacgcggcggcagtccgtcctccctcgctgcgatgaccaatccggatgatgatggttacggcgtggtcgggatggaggcggcggacgcggacgccgacgcggacgaggagatgatggcgtgcggcggcggcggcggggagaagaagcggcgccttagcgccgagcaggtgcgcgcgctggagcggagcttcgaggtggagaacaagctggagccggagcgcaaggcgcggctggcgcgcgacctcggcctgcagccgcgccaggtcgccgtctggttccagaaccgccgcgcacgctggaagaccaagcagctggaacgcgactacgccgcgctccgcgcctcctacgacgcgctgcggcacgaccacgacgcgctccgccgcgacaaggacgcgctcgccgccgcgatgcatgagctgacggagaagctgggggcccacgacgccggcccgaggcacacgacggtgaaggaggagccggccgcgtcggacggcccgccgcccgcgggcatggggtcatccgacagcgactcgagcggggtgttgaacgacacggacgcgaccggcgccacaccaacagaggaggcgccggctccggagatggggacgcggctcggcgggcccggggcggccggcgcggcggcggcggggcacgggcagatgttcctgcacgggaatttcctgaaggtggaggaggacgagacggggttcctggacgacgaggagccgtgcggggggttcttcgccgacgagccgccgctggcgtggtggacggagccgacggatccctggaaatgaggcgcggcagagagagagactcggtgggagacgacacctcgcgcggggaataaaagattagtgaagaaagcaggggcttttctgaaatttttgtaaatctcgtttttatctagtcctttcctgtcaaaccctcgccgtcgctgcgcagcatcagcaatagtactactactactactagtgccatttcaacgacggcagctcagccttcttctccgaggagcacgtctccaacctcaacttcggctggtgcagcagtggcgccgagggttttgatctccagagttactgtaaaaagtaagaaggtgtcactgtccatgcagcgacagcgcgtacttactttctactggctagctaccttagcctagctagcggacaagaagggcagggagggaggtcagcaatggcggaatttgatgagaagggtgaattgcctgatgaatggacctcccaccatgcatggagggaggaagtaaatgttactactcgtagtacagtacaaaaataacggtctctaggttt

SEQ ID NO: 3844 - DNA, 711 bp, Triticum aestivum
  unsure (1)..(711): unsure at all n locations
  Clone ID: PAT_TA_3844
nnnnggtttcgagcgcccgcccgggncaggtacataaaggcatcgcagaagacggtgcaggatatccccgcagctgagacgccagccgctgccactgccactgccactgccactgcttaattcgttacaggctagagcatttagaaggtggcaaaacttgttcctgtagaagcgtagcgttgaactgttgagacgattggttgatctgccatctccactctttcataggttctcatgctttccagggttttaggcatagttgaaagggttttcatgtgaccccggattgccacgtcggccatgctttgtcgtcgaagctaaagatgatgtagccgtcaaaaacatttgttttgcatttttacgtttttgcaatgcctcgtttccatcagaaggaacaagtgcgtcgcctcgacattagtttggttgggtggatcatgtaataaaagtttattcttgctcccggcggaggcggcggcggcttcagcggcggaggcggtggcggctacggcggccagcgccgcgagggcggcggcggcggctacggcggcggcggcggtggctacggaggtggccgcagcggcggcggcggtggctacggcagccgtgagggcggcggcggctaccgcggcggcggcggcggctaccgcggcagccgcggcggctccggcggcggcaactggagggagtgaatggtggggcccctcgctggcc

SEQ ID NO: 3845 - DNA, 539 bp, Triticum aestivum
  Clone ID: PAT_TA_3845
ggctgcaggaattcggcacgagggctacgtcccctatcacgagcttgacggccaccagagagtgtgcccgcacgcgccctgcttctgcacggagcccggttgcggcttctgcggccctccagtggcgctccttggccacctcactgcggtgcactcagtgccagtgcatctgtgcgggagcatcactagagccgcgacacgcggtcaagctccgggcgaatggtccgccgccaccgagcagcgcagcgggcagcattttgttggacttgaaggcggtgacgaacagcaacaggcccggcgaggtggccgtggaggagctgccgtctttcttgatggtgccgcctacatatctggttggatctgaggcgtccgaggtgtccctcgacgttcgcattgacagggtgtgatctggggcataatttcttcatggaaaatacactggtgtaatgtaattgctgctagatgccactcctgatggaagatatgcactgaacttgccgagtggaggtgttatcttttcaaagtcgacgcggccgcga

SEQ ID NO: 3846 - DNA, 578 bp, Triticum aestivum
  Clone ID: PAT_TA_3846
cttgggaatccggaagctattctagagaaatcgggaatcccctgctcgtcggccccgcagtctccctccgtcctcccgcgacctcctacccccatccgcccaaggaagcgagattgctactccggccccaagtgaagatccatccggccgtagttccttcttttgttgttgacagcaatggatatagatgatgtgatctgcaacttgcgtgttgttggcatgccaaccaagagtgctatatacacatggggatataaccagagtggccagactgcacgcaagggcaaggagcgccacctgaggatccccaagagcctacctcccaaactattcacctgtagggatggcgagaacctccgctggattggttttgcatgggcccgggcgcacgctgctccagtagtggctgacggatcactcttcacctgggttgggagatgggacagaggagagtgcaaaggaacctaaaaaggtcaatgcactggcgactgagtttgtgaaatcggtgtcctgtggtgcacactgtacagctgctattgctgaacctcgagaaaatgatggctcaatatcgagaagca

SEQ ID NO: 3847 - DNA, 1656 bp, Triticum aestivum
  Clone ID: PAT_TA_3847
ttcggcacgaggccctgcccgatcgtcccagccttttcctccggcctccccacacttaccctcgaccgccgaccccctcggcacccgtacaaatccttgccgccctcccacgaaaccctaaccagaacgccctccatctctcgagggaggcggcggcgggcggcgggcggcaagaggagtaaggagacgagaaggagcagcagcgggagagggccgcggcctgcgcggcattggcggcgatgtccgcatctatgtgccggaagcgggcgtcctccttctccgaggaacgctcccacgcggaggcgtcgtcctcaccgccctccaagcgcgcacgcttccgcgcagacggaggcagccccaagccgcggggcgtcgtcgactccgacctggtggccgtgatccgcgcgcggttcccttccgtgaggcctgaggtgatgccaccctgctcgaatccattcgaaagcggatatggttattatttccttgtttggattgattgcgagaggaaacgtttcgtgtgatgtaaatctgttctttcacttgaactaagtagtggctctcgctgatgtggctgtgcaaggagcaagaatccccacgcgctgttgtcgcactcaggttgttactgccgagccagtgtctgcatgctttccagccccctgggagtgggtgctaagctcccatcgataagttcattgaaaaggctctggaagaatgtgaaaacgatttggattcagcaatgaagtatttgcttcctctacacttagaacccacagaatataatgtggatcccgtgtatcaatctcccaatgaaatgtctactgaggttcaagtgcccaatgaaggtattgtagaatgtaataatgaagttcctgcacccataggaagtgttcccggtgcagagaaccttcaatcaggtatcacccaatgggttgagattcttatgaatgagatggcaagtgcctctagttcagatgatgcaaaggctcgtgcgtcaagagtactggaggcttatggcaagtccacgtcctcttgtatccgtacagaagcaatgcagaaatatcagaaggaaattttgttgtacaaggaacaatttgaagccgtcattaaagaaaatactattcttaagaaagccgtggcaatacaacatgaacgccaaaaggagcatgaagagagaaaccaggagcttcaacaactaaagcagttggttatgcagtaccgggaacaaattaggaatcttgagataaacaactacgccttgtccatgcacctcagacaatctcagcagggtaactcgattccagggcactttcatcgggacattttgtgaaaccagaagccaatacaaggtttccatatagcatgaggacaagttgcaggtcttgttgcgagaggctatgttcaacatatatcacctatactcaacatattataggcaagtgataccatagctttgatatatggtgatgtatacctttgtacctctgtatagtgtgctgattgccctcccggccgggagggacggaaagcagcccagcacgagtcgtgctgttgtttaagaacagacataatgtgataaagtttaaaagaaaggagaaaaacacatttgatttttacacagatgtgcgtttttcattcaaaaaaaaaaaaaaaaaaaaa

SEQ ID NO: 3848 - DNA, 1312 bp, Triticum aestivum
  unsure (1)..(1312): unsure at all n locations
  Clone ID: PAT_TA_3848
ctggggccgtatgcggcgccagcgcgaacttgaccccaaacagttccgtgccaccctcctccactggtcaatccccatcccctgttccgttcatacatctacctccgccgccgccatgccgccggccggcagcctcaccgccgaccagctcggctacccccatcccctgttccgttcatacacctacctcctccgccgccgccatgccgccggccggcagcctcaccgccgaccagctcagcttcttcgagaagaacggctacctggtgctggagtcgttctccagcgcggaggaggttcaggcgatgcggggccgcatggccgagctcgtcgagggcttcgacggcgctgactccagtgtcttctccaccaaggatcatcggcagttgaaggacgactacttctttaagagtgcggagaatatatctttcttcttcgaggaaaaggcatttggagatgatggatgcttgagacagccaaaggaactttcaattaataaagttggacatgcactacatgaacatgaccccgtgttcaaaaagtttgctttctcggagaatatttctagcctgttctcttctttagggtacaagagacctgcagttattcaatctatgtacatctttaagcaaccgggcattggtggcgaggtggtgccacaccaggataatacgttcctttataccgagcctctatcctgtacaggattgtggcttgcacttgaagatgcaacaataaccaatggttgcctatgggcaattcccggatcacataaaaatggtctaaaaaggcgaatgatcagagatgaaaatggtactcattttgatcgaccctccccgctttatgaccagaaagagtttgtaccactggaaatgaaatcaggtgactttgttgttattcacggcgatcttggacatcagagaatggtccaaaggtacaactggtcaacacgaggaaaactgcgcctgatccgctctatgtgtcttagttcagccagttactaataaacctgatatcttcagcaagcagtttcagttgcttatcatcggtgaaccagtttctaagaaccccgctatcgccatcttgcattctcagttgctcttccacagtgcagcaaagtttgggctcgccacagaccattgctggtgtcctgagttgtctttcacatgtgtacatgtaaatactgaatacttgctgttgtgttgtcatgatatcagttactatctgcaatcctgaaataaatccaatttcctcctcaaaaaaaaaaaaaaaaaaaaaaaaaaaaaaaanaaaaaaaaaaaaaaaaaaaaan

SEQ ID NO: 3849 - DNA, 1567 bp, Triticum aestivum
  unsure (1)..(1567): unsure at all n locations
  Clone ID: PAT_TA_3849
cgctgttcccttcccagcatctatcgccggccagcggtcctcacgcgctacagatcccccgccttctttagaaaggaagactcgaggcagaggcgagccatcacactcctcttcgcgctgggcccatggatctgccgctccgcctcgcgacgactctctccgtcccgttctcatcaccaccatttccttgttctactcccagcttctagcatagctcaagtgttccatcttctccagtactatatatatcgtcagaaatgaacaccgaagggaacgggcagagtgttctaagcacattacccaaggaactacctttagacttcttgaggactatcacaaaccagttctcagaggaccgtgttcttggtacaggtgcatttggaacagtttatacgggagttctgccagatggacaacacattgctgtgaagaggcttgccgaaaatgctcccctcccccgtgacaaagcaattaccaatgaggttcagaatatcatggctctcaaacatgacaacatagtaaagctggttgggttttgccatgaaggacagaagaaagtagtactgaacaatgggaggtatattgttgcagatgtttttgaaagcctactctgctatgagtatttacctaagggaagccttcagaagaaccattttgacagatccaatagcatggcttgggacacacgcttcaaaataatcaaggggatctgcaatggtttacttttccttcataggattcccattatccatatggacctcaagcccgaaaatatattgttggatgacaacatgaacccaagaattgcggattttggactttccaggctctttggccaagaacaaacacgggcgaacacacagaccgttgtgggatcatatggatacatagctccagagtatctgtacagaggtgaaatctccacccagtcagacatgtatagtttaggcctactaatcatcgagactaccaccggcgagaagaatcaacccaaacagaacgaaccatcagcaagggattttattgaaaacgtacgtcaaaattggacagacgggcgcatagcatccagatactcaatgttaaaggcaaatgacctccaggaaataaaagtatgcattaaaattggtctagagtgtgtgcagattgatcggaagaagagaccttccattgaaaatattgttaagaggctcgaaggacgctgtgcaaactgaatggcaaaccaggtctccgatgctcccatgcaagcatgaaactaggatcttctctggacgaaacaacggcaccagggaaagaaaagaacttcctctgttattaatataatgaattgatttcggaaatagtaagctgtgctgttacgttattgtccaattcgctagtgtttctaggggtgctgttcctccattagctgtggttgtccttggtttctttccccgtagtgccgcgtggtggccccccttgggcagggtctgttagccgttttccactcctcgggtccctccaactggcaaaagaagctctccncggttgtcctgccaggnanngtaacgcttggcgtgtctccccacgg

SEQ ID NO: 3850 - DNA, 1051 bp, Triticum aestivum
  Clone ID: PAT_TA_3850
gccgccgcatcccgtcccgcccaggctgctcacgctgcccggcgtgctcaccattggccgcgtcgccgccgtcccgtccctctcgaccactcgtccgatggacggtccttgggcagcaactgccacaactggcatcttccttgctgcagcgatcactgattggctagatggttatattgcgagaaagatgcatttgggaacaccttttggtgcatttcttgatcctgtggccgacaagcttatggtagctgcgacactagtgttgctgtgcaccaaacctttggaaacttcactgctcacgaatggaccatggcttctgacagttccttccattgccatcattgggagagagatcacaatgtcagctgttagagagtgggctgcgtctcagaatacccaagttcttgaggctgtggcagtaaacaatttagggaagtggaagacagcgacacagatgacagcattgactctgctccttgccagcagagacccgagtctacatgtacaaggtgctctagtcccccctggtgttgcgttgctctatgcatctgctggacttgccatatggtccctagtggtgtacatcagaaatatatggcggatacttctaaaatagtgttagcacatagtgtaatagaagaaacaggagcaaaggcgacggtcttccattcaagatgctgcaattttttggaagattgttgagttgattgatggggcctagatcttgttgagatcctcgtgtgacccgtgccattggtgcttggcggattagccgccaaagcttgttgagcatgcgaggatctctttagaagcaaaatatatagctcgtagcctgtgatgccagggtgatctactttcacggaaggtagccacagcttcgagtgttggacaccgtgtgtaatgagctgcaagactggagacgatgcagacgattgtaaccgtaaacaagcgcagaccaggcggctggcctgtgcgtgtggagttcctgccactgtaattttacccatatcatattgccagggagcacaaaattattctttcaatgtgtttc

SEQ ID NO: 3851 - DNA, 870 bp, Triticum aestivum
  unsure (1)..(870): unsure at all n locations
  Clone ID: PAT_TA_3851
tgtctcggctgcagtggacttcttttccacatttctggaaaatcctcaccagcagtctacagatcagggtaaactgcactgccagttattctttctgctgtttggtgaaggaccccggttccgtattgcgcagcagtgggctagagacaatgctcttaatgtcaattggcagcatcctgaagctgtccttctcgaactactgcatgattattccaagctctgcgattgttcgtttcatctactccagtattatgttgagatcccttttcttgatgcccttttggacgacctgaaggagctcagtccttttgctcgtaccctgtctgatgctaagaaaaggtgggagccatatgaggccaaatatgcgagtgctggcttggtcttccgaagaggtgatggcaagattatattggaatctttggtgggtggtgaactgttgctcctcaattacaattacaagttctgtacaaggattcagatgagacaagcaggttatgatggtcaatggtttgaaaggcttagcaagtagagcagtggctaaaactgatgtaaacgactcaattttggtactagcgcagtgtactgattccagctgactttggtatcactgtttatggttcaaactttgtactgaactatttcttctaggacaagctctgaaggaaagcctatatgaacccctgagcttcaggttgctccaactgttgttgtttgaaaaaaaaaaaaaaaaaactcgagactagttcctcgtgccgaattcctgcagcccgggggatccactagttctagagcggccgccaccgcggtggagctccagcttttgttccctttagtagggttnatttcgagctagggagcaaaaanncnnnc

SEQ ID NO: 3852 - DNA, 734 bp, Triticum aestivum
  Clone ID: PAT_TA_3852
ccgaaagctcccgcccctccccccaaaaaaaaaaacaaccccaccccagcgccatggccgccgcctcctccgccgccgccgccgcccccgccgacacgtacgacatcccgtgggtggagaagtaccgccccagccgcgtcgccgatgtcgtcggcaacgccgacgccgtcagccgcctcgaggtcatcgcccgcgacggcaacatgcccaacctcatcctctccgggcctccggggaccgggaagacgacgagcatcctggcgctcgcccacgagatgctcgggcccagctaccgcgagggagtgctcgagctcaacgcctcggacgacagggggcttgatgtggtgcggaacaagatcaagatgttcgcgcagaagaaggtcacactgccacccggacggcacaagatcgtcatactggacgaagctgacagcatgacaacaggagcacagcaagcactgagaagaaccatggagatttattccaacaccacaagatttgctcttgcatgcaatacttcatctaaaatcattgaacccatccaaagtcgctgcgctattgtccggttctcgaggctttcagatcaggagatccttggccgccttatggtcgtggtggcagctgagaaggtcccttatgtgccagaacgtcttgaagccatcatttttactgctgatggtgacatgaggcaagctttgaacaatttgcaagctacagtcagcgggttccgtttt

SEQ ID NO: 3853 - DNA, 458 bp, Triticum aestivum
  unsure (1)..(458): unsure at all n locations
  Clone ID: PAT_TA_3853
tccgtcttgcatgcctcacacctaggcacctactatccacctagccaagcttggaactccacgtcggtccaatggcggccccctccacgcccacggcgacggtgctcctcctggtgctcctcgcgtgcggcggcgccacggcgcaggtgttcccgcggccgctgttcccgcgcgcgccgtggaacttcacgttcccgaacgggcccggcgacgcggcaggggccagcggcgccggcaccggcgcgacgggcggcggcggcggcgggccgtcngtgccggccatgttcgtgttcggcgactcgctgacggacaacggcaacaacaacgacctcacgtcgctggccaaggccaactacctgccctacggcatcgacttcgccggcgggcccaccggccgcttctccaacggctacaccatggtcgacgccatagctgagcttctggggctgcccctgctg

SEQ ID NO: 3854 - DNA, 673 bp, Triticum aestivum
  Clone ID: PAT_TA_3854
cccctcctcctcccccccgccctctccccgcccccatcccgccccccccccgcgcccacccccgccgtcccccccccccgctcctcctcccgccgcgccggcgccccgcccccatcccgccgcccccgcccccgctcccccgcctcccctccccggtgcccggggcgggcccgcagcggcgccccgcctcctccccgccgccccctcccccccgccgcccccgctcccaggcccccgcgggtgcggcgaccagggcaggtagccgccggcggctcgcggcggccggctggtcccggggggccggaggtgctcggcgggcggcggcgtccggccggcgccgccggccaggcggcgccgccggcccgcgcgctgcgggggcgcccgcgctgctcgcgcgccggcgctgcgcccctgcgccctgtgcgccactcgtcctctcgcgcctctcctgctctcccggcgcacggccaggccccgcgcccgcctcgcccgcccgcccccccgccccatctccggctcctcgccgtcgcccacctcccgctgtgcgtctccagcgcgagttcgagtcctccgctaggccgtcggccccagccaggccatgtctgagacgacgtttggaagggtgtccgatttcatcgcaccttttgcaatgtttcctaagacggatgagcct

SEQ ID NO: 3855 - DNA, 887 bp, Triticum aestivum
  Clone ID: PAT_TA_3855
agctgttccttcacagacaacatcaggtggatttggtcttggaatgtcgagctcaatgggcatggttcctggacagcagacacatgctatgtcctcttcatcgttgcctccacagagcaacagtgctgtattgcctccagattcaagagctttggtgctatctggaaatggcccggccagtgccgcacgagcaagcactgaaatcttctctgctcttactcagccaaagccaagtacatccacacctgcacttccgaccacatcaagctttatgtccaagccgactggctcccagaactttgctaatctaacacagcctggttctctccaaggtactccaacagtgagttacggcaccagccaacctcagcagacgcagcccatcacaaagccaagtgttccatctccaggtgtttctgccggggtttctaattcctcttctcaatggccaaaagttaatcaatctgatatccagaagtacacgaaagtctttcgggatgttgatagggacagagatggcaaaataactggtgcagaagctcgcactctgtttctcagttggaaacttccaagagatgtactgaagcaagtgtgggacttgtctgaccaagataatgacggcatgctttctctgagagagttttgcattgctctttatttaatggagaggaaccgagctggaactcctctgcctccatcgctccctgactctcttaaatttgatgagacactgttacgagcaacaggcttgccttctacagcttacaatgccccatcatggcagcctaatcaaggattaccacataggggccctggcgcacctgggttgcctactggtggtgtacggccacccttgcctcaaatgcattcacagactgatggagcta

SEQ ID NO: 3856 - DNA, 790 bp, Triticum aestivum
  Clone ID: PAT_TA_3856
attagtctcaccgaaacctgagtctatttctcaacaaatgatttctcttggatttcaatcaggggaatggcacattcaatttcaaaccctcaccgtccttaggcaagcaaatcgtcattacgcctctctttttcttcattaactactacctatcaatgccaagcaagtagtagctcaagttgacaatcttcgcagttataactctaaagaagcattgactttacttactgaagtcatacaaacacaagatctttcaattgtttcaggagaagtattaagacctattgtagctgctcttatggcaaaatcagtaagttaaaaaggatttttaaaggcacaagcattaaaaggagctaatgctcttcctttgagatggaatgaggctgctttagattagctttgccaacatacacaggctgcaaatggaaccatttctgaactagctattcgtcttgttggagaaatgctagaaaataataagacttggcaatctgacggtcgtttccttaagtctctctcaagcaatctcaatggcaaaagagctgttgttcagaagaaagcgagagaaattttgaagactttgaaggaccgtgagggagaagaacaactataacaaaaaataaactcttctactgaattgttagaggaagaatcaaatacgttgcgtcgtgagttgaaggagaaagaacagaaagcaaaaggtcccagcctcaaggatttcctcaaagccaaaaagcaggaaggttgatcataaaaagttagtatcttaaaacaaaaaaaaaaaaaaaaa

SEQ ID NO: 3857 - DNA, 726 bp, Triticum aestivum
  Clone ID: PAT_TA_3857
tttgtgccccgtccggccagacggcgctcctcccgtctctgtcctccatgccggggtccgttgcggcttttccttctgcgtgggccgcagggggtgtcaggggggctctgtgggctgcctgaggtggtccgctcgtctggcctgcgtcgctctgtgcggggcgtgggtctgcggcagccttgctgggacagtgcgggctccgccgatttccgccagccacgacctcttctagttgatgctccgcctccttgctttttgcattacccattcgcaaatgtaatgaccgatatctccaacttgtgtctgtctgagatgtttttgaggcctggaagaaacttaaaggaaacttgacttggatggagatagtagatgcaagatgaaagcaagaaagatggcgcatgagcaagagttacctatttggatggctggtagattagaagatcaggatgttctctcatattgttgtcagccataatctgttttgtcagagttacagatctacagattttgctgctatttggatgtctggtatatagctattatctctgtacgtgtgtggatgaaaaatgaaggactatttgtgtccagccctgaaccttaattgctgctattttattttgtagttttgtcagagttacatatctacagattttgctgctatttggatgcctagtagattacaagatctacatatctctatttgtatcaaaaaaaaaaaaaaaaaaa

SEQ ID NO: 3858 - DNA, 904 bp, Triticum aestivum
  Clone ID: PAT_TA_3858
tgcggtgccttcactcagcatgttcttcttgggcgacatggacgtggtggatgccccttgtctggagagactttttcagtataacaccaacaagaaccgctcttccaggatcaagattggccaagcacctaaacttcgagttctgggataccttgagccaggagggcaggaattgatcatcgtggctgggagcaaggagagcattgttcctagtgtgcagattttggccatggaggtgcagttcggtgtgcgcagtgttgtcaagaaagtgcctggctttctcagatgcttccccaacctggagacgctccacgtgcagtctcaccacatatctgaagagcccaccaggaaggtcaatgtcaagttctggctgcagggcggtcccatcaaatgcgtcgtggagagcatgaggaaggtgttcttgtacgagttctgagggtcgagaagcgaggttactttcctcaagtttgtcgcggagagggctcgggtgctggagcagatggtggtcgtggtgtccagcaaatctttctctccaggggatgatgtgggtgccaagctgaagcctctgaccaatgcaaaatgagcgagtaaagcttgcaaacttgagctcttcaagagcccaccggctcaatgcggtgtggcacccttctgtcacaggctagcaaatgatttctcgttcccggacccttttaacgtcaaagagtactgtgaagaaagaaccgctgagttaactatagtacaagactactggtacctagctagactttgtgctgctggacttggcattggcagcagctcaaaaacctgcatttcgtgcgatttatcatggcaggccatttttgtatagattgcacatttgccaagtcttatgaggccggatgcttgagggagtaactaatataat

SEQ ID NO: 3859 - DNA, 961 bp, Triticum aestivum
  Clone ID: PAT_TA_3859
cccacgcgtccgcgagactgttcaggaggatcatattgcaactcagcaccgggcggcgtcgcttgataggcagactatgcatgtcgtagctggtgaaggaatcgaagaagtgcaggctgcgtttgttgcagctagtgaaggaaggcaagatgtgcaggctgtgtttgctgcagctagtgaaggaagccaagaggctgctgattgcggacatgctttggaagccaccacatcgtccttggttacggaaaaagaacctcttcttgcagctagtgaaggaagccaagatgtgcaagttgtgcttgctgcagctcgtgaaggaagccaagatgtgcaggctgctagtgaaggaagccaagatgtgaaggttgtgcttgttgcagctactgaaggaagtcaagatgtgaaagaagctgctgactctggaaatggtgtggaagctacagcatcgtctttggttactgaaaaagcacctcttgatatggctgaatcgacctactcagcatgcattcccacattggcgaggaggaccagcttgacactcagcgttctgaagcctcgcttctttgacagactgtgcatgtcatagctggtgaaggaatccaagatgtgcaggctgcgtttgttgcaactagtgaaggaaggcaagatgtgcaggctgtgtttgctgcagctagtgaaggaagagagtgggctgccgattgcggacatgctttggaagccatcacatcgtccttggttacggaaaaagaacctcttgttgcagctagtgaaggaagccaagatgtgcaagctgtgcttgttgcagctcgtgaaggaagccaagatgtgcaggctgcgtttgttgcagttagtgaaggaagtcaagatgtgaaggttgtgcttgttgtagctactggaggaagtcaaaaaagcttctgactctggaaatggtttggaagctacagcatttgccttggtttct

SEQ ID NO: 3860 - DNA, 798 bp, Triticum aestivum
  Clone ID: PAT_TA_3860
ccagtctcttatttcagctgaggccatacctgtactacagatgcttatgaagacctgtcctcccagttttcatgacagagctgatagcttactgcattgcctgcctggttgcttgaccgtgaccatcttacgtgggaataacttttcactgactgtggagcgtggtcgcggccgaggttgcctgcaaataggaaatggtcctccaaggcaaaccaaggttaaccaagagcatctgcccggtatggaacgagggattcacttggttattcgacatccccccaaaagggcagaagctgtacatcttgtgcaaaagcaaaaatacatttggaaagtcaaccctcggaagagtaaccatccagatcgacaaagtggtcaccgagggagtttacagtgggttcttcagcctcagccatgacggcggtaaggatggctcaagaacactagagatagagattgtctggtcaaatagaccggccaacgacaatatgtagcatggctaatttcacatggtgccaatattattgtcggggcgcttagatgtaaatcagccccagaaacatccacattcatcgcagtgtagaaaatgacatgggttacagacatctgcctcaacattatttcgaggtcgttcttggtttagcccctgtagctgcatacggattttggaccggctattttgtttgtacaggtttatttcctgtattttggaccggctattttgtttgtacaggtttatttcctgtaattataatttagagtagcctggtgtgggtttgaagaaaaaaaaaaaaaaaaaaa

SEQ ID NO: 3861 - DNA, 1037 bp, Triticum aestivum
  unsure (1)..(1037): unsure at all n locations
  Clone ID: PAT_TA_3861
ggtacaaatgccggtacgagccatatcgctgttctcagtcagtactcggtagagacagatcggcaagtccttgcaagcgcttcgctgaacctcctctagtcctcttcctcccagaactgccgcattaggtttcgatccactggtcgcgatggtcgttgatccagttctcaagggatttgacctcaacatcgcggcagtagatgagtcaagccctttggaaggaatcggccttggcctgtatgcgactgagttcatccacaagtacctcagattcaatcccacggaccaggagctgatggagcggctcgaggccaaggtgagggatggaggcgcgagatctgaccctctgattgataaattcatacccaccatagaggtcgagtacggctacccccatcctcagcaacttccaggtgtgacgatggacggcacgatcaagcattttttctgccgtccgagggcgttcgagagtggacggaggaaacatcggaagataaaggcggagcgcaacgatcgtaccgcatggcacaagaccggcaaaagcatggcattgaaggccaacggccggctgacgggctggaagaacattcctggtgctctacaccaacaccaggaagaccaactgggtgatgcatgagtatcgcctcagcgacgtcgaggacgaggaaggcggggagctggtcctgtgcaaaatcttctaccagacgggggagcccaagagaagaagtgtgttgaggacccaagagaacaagtgccccacgtgtgggtgtgggtgtggtggcatggacgtttagccatcccaaaagaaccccccaaaaaaactaaaacttaccgtctaaaagaaacttgtcgcacttgaactagaagttgccatccctgccgtagttatgggcccgtcttttggtagcacgaaagaacgcggatcttctncgacaacttgtgtccnacgatgctgtacttgtagttcttaaaaccttgcagctcttctnctcgtaatgacatgacttgaaataaaaaaaaaaaaaaaaaaaaaaaaa

SEQ ID NO: 3862 - DNA, 647 bp, Triticum aestivum
  Clone ID: PAT_TA_3862
cggcacgagggattgtcctgaagcaaaatatcccaattgaggtgcatgcctcgcaggtttataccacgacaatgtttgagaattttggtgaagccctgtatgaacgtgggctgtatgatctcgtggaagtcaggccacacttggagtacattgctaggcacatcaagtttcagtcgagggaaaagtggtgcaagaatgagtttgtgatctccgtgagcgagtcggctgatgagttcgggtgcgagtgtgggacattcgagcactatggaatgctttgcagccatgcacttaaggtcgtgatacacctgaaactgcatgagctccctgcgaagcatgtgctcaggcgatggactagagatgcaagagatatactaccgccggagtatctgcgcgcgctgccagaaggatcatgggccgctgaagtattcttctcgtcgacgcaacactttgtacctgctggcgctcgatgccggtaagttaggcgacagcaatgtggaagcgtgtgcacttgctatggagaaaatgcgagatgtcaaagtgttggtcgggccagttgccgccgtgacggatgggcttggtttatctgatagagagctcgcagcagatttagccggctctgccgttggtaacaagtagcaccttggccg

SEQ ID NO: 3863 - DNA, 716 bp, Triticum aestivum
  unsure (1)..(716): unsure at all n locations
  Clone ID: PAT_TA_3863
tttttctggtgttcgacttttctgatttattgaagccctggcacttgaaagctggagtagtacgcacagaaagagtattctgtgtctgtcgtcctacaataaggctcccctgaactcatggctcgcatgtgcacgtgcactcacggcgggctcatacggacacttgcgttcgcgataagataacataagcctgtcgtagttaaatataaccgagacgcacacagaagctcttcgcagttcaccggatgaaatagttgggtgttctggataggtggactcccggtcgaacccgactccggctaccgcatgaccccacgccctcccgacagccccccccttctgggagccgcatatatcccttcagcttcgtggatcttttagatgctcttcgcagttcaccggatgaaatggctgggtgctctggataggtggactcccggttgtgcccagctgcggcaactgccacaccccactgccaccggacggcgcccccatccaggaatacacaagttgccccacgccaaccaagatctttcaaatcttctctagcattgtcatcgcaaaaggactttcatcagtggctcgctgacaatctcccccaaacccggagttttcgtcgtgctcggttactcttcctctttgcacatgtgcaattgagtcactcaccttgctagattatgtcagatctataatcnatatttaagccctccgaaagt

SEQ ID NO: 3864 - DNA, 949 bp, Triticum aestivum
  Clone ID: PAT_TA_3864
aggcacctgctatttttcccagtctagggtgcgcgtgagcacgagcccaaatcggtgcccaaaccctagccgcacggccagatcgtcggcgtctcccgtagccccaccccaccccacccgccgtcttcccctctcgacgcggcctcgcttctcacgtgccggttcggtaaccctagcccgcccccgccgcccggcgtgccgggcagcaggcttcggcgccgcgtgggccgttggggcaagctgcagttgcgaggtgcgtgtcggcgtcaagttcaagcgagcagtggggcagtgtcaggcggagcggcagcatcagtgaagctcaagttcaagctaaaggtctgcttacgggtccgtcggtcggcttcttcctctccggggcggtgtttcccttggggagccgccggggtgccgctctgcttcgtcgagctcgcctccgccccacggccgggtacccaaagtaacgattgtataattccacggattttgtgttttaaaacggcccctgggatcatttggtcgcggggtcgcagccgatagcgtcgtcgcgcctcatccgcttcaagatactccagtgttttaacatatgtctttttttatcagatattcacgtggtaggaattcctttcataaaaagttcattgctttgtgctcccggagtctgtaataagtagactggctcagtggtatttggcaccctgcttctcagcgttgcagccgcttgtggatggtggtttttttttttctttccttgtttttagcttggagttcatgctggtgacatttctccttcgggttgagatgtgctgggcgtgttgcttcctagagtctctagtccgtctcggtagcttgtgaaccttgggtttctttaatggaaatcggaagggggagacccttcttttataaacaaaaggttcattgcttcaaaaaaaaaaaaaaaaaaaaaaaa

SEQ ID NO: 3865 - DNA, 812 bp, Triticum aestivum
  unsure (1)..(812): unsure at all n locations
  Clone ID: PAT_TA_3865
cattactattttgtgatttggttgtgataaccaacgggaggaagaagatcgcctccagcatgctgagacctcaaggcaactcaagagcagatcgccaatggaagctacaccatcctgctccagccggatctggacgccggcgcgccatgattcaccaagggcaccgtcgtgaggttcgtgcagcacactggaggttcgcgaccgcgggagggccagctcgtccttgctactgctccgcgtcggctccatagccgccccgcgcgatgcgagcttggcttgcatgcggctggtggccgcgctacgtttccggttgtctccctgaaaccacgtccttgcctcctcgaatcttggtatgttctccccgactgctagatgcagttgcaggtcaaaacattgtgatatgagttatgagttgcagtagtactacatgaagattataaattagtactaatgcataactaagtaatgatatctagcttgagcagctcaactacgacgcactgggatacacgctaggttgtctgccctctgacgctgatccccgcctctagttccggcagctcctttgggctagacctcttcctcttccgttccgggcctggggtggctttgcggtatcaggcatgtggtcctccccggactcttgtcgtttactgcctgccccacccctgcccggttgctgatttggttgacagttttatttaggccttcctcattccgttctagtgtggcgtcaccattgcccttgtcggtctgtttgccctaagcttgccanatgggacctttaaaaaggntaatatttttancaaagg

SEQ ID NO: 3866 - DNA, 730 bp, Triticum aestivum
  unsure (1)..(730): unsure at all n locations
  Clone ID: PAT_TA_3866
actttcttatactgctctgttttaggagaacgaaataaagcgaaaaagaaatttctatgaaggatctctagggagatttggcacatgaagttaaggtttggtacattcgatctccaaaagatatggtgagacatctgaattatgtttcatcttcacagactaatatgacattttacctggctattttccccatttgttgctgtagctaatagtgttgatatatatcccattgtagtgcattcatttgtaaataaggattttatgacctttgtttgtgttcctgtcgttatcattaagcttgcctcatgtaattgttagcactgcaatcagatataatattaaatatttgttgcaatcagatagtatattatccttcgagtgatcatagatgttcaaaatgatgtttgttaccaccatgagttgtactttgcaatcttaggatatacgacatctgtttactgcagtatattgctaccaaagcccctatctatatcacatttaaaaagtattctctcatggctttgtaagattttcctttatgcaaattagattgcttattaatagcattcatatttcaaatattcattgatatgaataaccatgtatagaccacgaaatgtagttgatacacacgagccatacaacgttagatatgattcttacctaaatccnagggaatggctgtattaagttattcatgatccgaaaaaaaaaaaaaaaaaaaaaaaaa

SEQ ID NO: 3867 - DNA, 387 bp, Triticum aestivum
  Clone ID: PAT_TA_3867
catacatgatcttagtgcataaactgtatcaagatatctgttggtacttggtactggtagcaatagagactctcccctcccctcctcatagctatttcttcagttatgtttcgaatgcgtaatgtcgtcgtagccactatctgttcaaaaaactagcgcttcttgatgcacaaattaataccttattggtatgcatcgaccgatggtcgtgtgtttgatatggggatcgtgtgttgttggtcggcgatcgaactacatgattttggatcaacaagtaaaccaacactagtcttgtatgtatgtccatgttgctagaaaaaaaacaatataaaaaaaaaatataacaataacaaataaaaaatataaaaccaaaagaatcaatactac

SEQ ID NO: 3868 - DNA, 1232 bp, Triticum aestivum
  Clone ID: PAT_TA_3868
cccacgcgtccgcccacgcgtccgcgtaaacccttggattgcctccatctccacaccagtgcggctccagtccgtccgagaccggcatggccaccacggccgccgccgccgccgcggtcccagacgctattccagccgcggcgcccgcggccccgtccgcgcaaccgcatcccgttccagacaaatgtacgaattataaaaaccatttgcaagagtggactcaaaggaatgatcagaagttgccagcttataatactgagtcgaaacgtgaccatcgtcgacttgagttcagaagcaccgttgaggtgggtggcgagcggtttcaatcagctcgcaatcatagccgccgcaaggaatgcagagcaggatgctgccagaggtagcctatgaaaccttggtgacaaagacagtaataagtgatgatgatcatacagacgcgcttgggctgattgatcagggcgtggtgttctgcaaatcaattctccatgaatttgctgttaagacaaaagctgaacagcccacttactccgcagatcatccagaaggggtatcacccatgcccctgtttgtttcatctgtgttgtttgctgggaacacttatactggtgaagctgcaacatgtaagaaggacgcagagcagaaggctgctcgtgttgcagtcaaatctattttagctacaaagaacacttgtatgcatcaaattgtcagatcaaagaaagagcttatcattgccatcacatcttctgggttcaacaaagaaagaggagttgtaagccaggaaaactgcaatgctccaacaaatgcaattactccaataaaatttgtgcctgctggtgaagctgctggtctaactgcggatcaaggagcgaccaacgttcctgaagatgatccatgtgcacaagctgtatctggctcggaaaagtgcaagaagcacagaagggtttgacgagaagactctcacccatcttatcatgagggttcgttgtcgtggagggtcggctggttgggtcgcccggtgttgggcctctgtgtgggacatggcttgggtccttcgcgggatggcgtggtggaaggccgccgcgttccgcatcctcccgccgtttgcttcgctgggtagctgggcctcgggtctcgatctcaggtttctagcgatgtcgcgtcccccggtccgctgctacgggacttgtcgttcgtcgtaccgtttcccacacccgttcctgtcaaaaaaaaaa

SEQ ID NO: 3869 - DNA, 1059 bp, Triticum aestivum
  Clone ID: PAT_TA_3869
attcggcacgagggagagcgagaggctgtggctgactgggtgtggctggagaggagaggagaggacagacatgagcggcggagcggcagcgggggcggcggcggcggtgagcaggttcatcaagtgcgtggccgtgggcgacggcgccgtgggcaagacctgcatgctcatctgctacacctgcaacaagttccccaccgactacatccccaccgtgttcgacaacttcagcgccaatgtctccgtggacggcagcatcgtcaacctcggcctctgggacaccgcaggtcaggaggattacagcaggctgaggcctctgagctacaggggagccgatgtcttcatcctctccttctccctcaccagcagagcaagctatgagaatgtgcacaagaagtggatgccggagcttcgccggtacgcccccggcattcctgtactacttgttggaaccaagttggatctccgagaagatagagcttatcttgctgatcatgcagctgattccatcataacaactgagcagggtgaggagcttcggagacaaataggtgcggtggcatacatagaatgcagctccaagacacaaaggaacattaaggctgttttcgacaccgcaatcaaggcagttcttcaacctcaaaggcacaaggaggtagccagaaaggaaattcggactcgctctagtcggtcagtaaggcgctacttctgcgggagtgtttgcttagcatagtcgagaacaacattgtggggtctttcctcgacatgatgctcagatggcgcgtggttgttctcgaaatgggatagacagtgatggtagaagcatctcattgctagcacctagacggaactcctagttctctcgtgcactgtggtgtggactgtggagcaccctgaatccttgatgatgtaagataggcatcaagttttgcctctgtaataaggcatgctcttgtggatgatcaaatttgaaatctcccactccttgggcaggcttgaaaatcttcagggtaatatgcacaaacaagataatctcgttgtctaacaaggtttcccctt

SEQ ID NO: 3870 - DNA, 768 bp, Triticum aestivum
  Clone ID: PAT_TA_3870
cgccgccgcgcgccttcttcctcaacgccggcgtgcctcttccaccacgaccggcgggcctcctcccccacgaccggcgggcctcctcccccacgaccggcgttcttcctccccaacgggcaccaccctccgccccaaccacctccccaccaccaggtgcgttgccgctaggttcccgcttccccgacgccggaggcccgggatccggctaccaccatgcggcaccgcgaccacctgcctccaccccggtctcctaggctccccgcgccgccatgtgcccctcacgtcctgtagccactgctcgacgtcgccccttccgcaccgcgtgcgagcacttctccaaaatccgccccaaggtcgtggcgtgcactgctccctttcctcaaccgcccttgccgtcagcggaggccgctgcctcgatttctccgatgaaacaacccgagtcttgcagctctcctctgcagccatcgctggttgcccccaatcgccagggtgattgaactgcagtgcacgggataatcgaaccgccgacgaggctcgtgtcaatcctcccagtgacctctgcccacacctgctgctgctacaccgacctgctccctcttcaaccctgaactgtccgatttttttgtgatgctaattcttttatgaacaatttcagtgagctagtcacatgaattattttgatttggggctaattactggatgttgcaaaaaacaaaagtacggaacatgtgtgttagttcagaagacaaaaaaaaaaaaaaaaaa

SEQ ID NO: 3871 - DNA, 743 bp, Triticum aestivum
  unsure (1)..(743): unsure at all n locations
  Clone ID: PAT_TA_3871
gcctccagaatcccctcctcgacccacgcgtccgcacgatcgtgcttctggacaggggttcgttgtagctacttcaggcatggtgcacatacatgtggttggggtgggcggcaagcaaccttctgtccttactgaatgcgtcatctaccttctggtggtcgtcaatcgatggtgtacaccgcgtccacgcgtgtggcacatttaatgctgtcgagaagctacacatatttggcattcgcggccgagccgctcaccatcatggagttggatcacactagacctcaatggcatgctctgccatgtggcctccttgatgctggtcgtcgagcactgattcgactagactatcgcgcacatattgatcacatttgataaacaagctatgatcgttggagagtacccctcagatatataggtgctttgatctgaaggattggtttgtgatacgtcattgattcatcgttgacacaaatatgaaagcacactagaaagataaacataggagatcatagctgaagggtgggtttccaacgacggtggtgtgctgcctttcttctagtgccgacaagatggctagtttgtcgccccgtaaccctggtggtgggctcccatgactgcctcctgggttacctaccacttaggtagcatctcatctncctctactcactcactcgctgactgagctgcagcgtttgtaaacaatagtgtgtctactgttgaggttcatggggattcccatcttg

SEQ ID NO: 3872 - DNA, 1242 bp, Triticum aestivum
  unsure (1)..(1242): unsure at all n locations
  Clone ID: PAT_TA_3872
cccccgcccccaccctcctctctcctctccctccctcccccctcctagaccccttctccttctaggtctccttgcctgtgcaggctccagcacctacactcaaggaccgacgacgacgatgcggcttagctgcaacggctgccgcgtgctgcggaaggcctccgccgccgcgcgccgccgtccgcccccgccggcggcggatgaatccgccccggcccgcaggccatcgccacccccttcctcgccgacttcgaccgggcccgccggggtcaatgaacctcatcaacgccggcacggacgacagcctccgccccggcatcttccgctgcctccgccacggggtctgcggctcgatcctcaaccacgcctgcggcccggtcggcctgcccttgtacgactccgggcggacgggccaggccgacgtcgaggccgtcctcagcggcaagcccatcgtccaggtctccctccgaggatgccgccgccgaccggacaccgccgctcaaggcgtacgacatccgccacgtctccacctcgccagccgccgacgggaggctccacaaggtcgccaagccgggtcgcacccgcttcaagcgcgcgtcctccgcctcgtcccaccacaacccgtccagcgactccaacaacaagcccaagcccaagccgcagcctcagacgcgggcgcccacggcggaggaggagctggatcgtcaacaccgcaaggagtatggaggagggcgcggcccagcgtgctccgagccacgaatcctccgacagccgacacgaggaccccgtggagccacactgccagcaagaggcgtccgcgcccgcggggggcgtccgcggacacggaggccgaggcggggtcgcacgtcagccgggcggagcaggagcaggagcagagcacagagccggccgcagagcacgcggaggaggtcgaaaaggaggaggacgaagaactagggctcgagctcacgcttggattcgctcccgtcgcagcacggccggccggatttcacctgagcgtccggaccgcggcggagccggcttttgtcgggctccggttcctctgaaatagggggaaattttaagcacatttaccttgtgaaaacatagagagctatttgatggactcttttacctttaattggaaaaaaaaattaggtctgttagttcgttttcccgcaagccaagctttgtccgttcagacatgagctccgcanggccaagatttttccaataaaaaaa

SEQ ID NO: 3873 - DNA, 1411 bp, Triticum aestivum
  unsure (1)..(1411): unsure at all n locations
  Clone ID: PAT_TA_3873
gatccaatcccgctcgttgtttccttcgccactctctctcccccgctctctctacctcaccctccgtcctcctccccgtctcgcggcacggccagaggaggccgctcgctcgggtctagcgcctcagcctcgggccgccggcggttgtgtcccagcgacgcggcagattcctcgagcagttttgcttttgtagggtatctccattatagaaaggatagtgagaatggcaaatttggtcaccaactgtggtttcagtccatctcctgctgttaaggcacactgcaactcaccaagttatggccacaatttcatccgattacaaaattcgaaatcttcaacttcaagtctgaacctcaaatcatcttccaagaggtcaaataagttatatgttacttgtgctagtactgctgtacaaggacagacacaaacacctcttactggtagtcagcaagcatctgggcaatcatcctctaaacccaaaaaagttatggttattggtggagatgggtactgtggctgggcaactgcacttcatctgtccaacaaaggttatgaggttgctattgttgataatcttgttcgacgcctttttgaccatcaacttggcctggattcacttactcccatagcttccattcaaaatcgcattcgccgatggaaatctcttacggggttggcaattcgcctcttccttggtgatttttgtgtctggccattccgtgccgttgcgttcaagtctctcgtgcctggttctgctgccccctttgccgaacaaagatcagcaccattttctatgattgatcgttcacgagcagtatatacacaaaacaacaatgttattggaacacttaacgtattgtttgccatgaaggagtttagtgaagagtgtcattttgttaaactaggaactatgggtgaatacggaactccaaatattgacattgaagagggattcctcactattactcataatggaagaactgataccttaccttacccaaagcaagcaagctccttctatcatctaagtaaagtgcacgactctcacaacatagcatttacttgcaaggcttggggtataagggccacagatcttaaccaaggcgtcgtctatggaatcagaacagatgaaactgctatgcatgaagagctgtccaatanggtggactatgatggaatctttggaacagcactaaataagntctgnggtcaggcagctgtaggtcacccgcttacaggtttatgggaaaaaggcggncagaacccggnggatacccttggaacatcaagggacacctgggccaaagccgtggggggcttagcnaatttggaaaaccccagcccaaacccaaggcngaggtttcanangtcnttnacccngntcnncggggcnanntnntcnggncnaccg

SEQ ID NO: 3874 - DNA, 794 bp, Triticum aestivum
  unsure (1)..(794): unsure at all n locations
  Clone ID: PAT_TA_3874
gggacgcacctcctcggcttcttcctcttcctcggcctcaccctctggcacctcgcccagtacttcccccaggtcgcccacctcatcggccacctctcctggcccatctccaaggtcgcagagaacgtctccagcaacataggcgatgtcctctccggggcggcgtcgttcatgcaggcgagcccggggctggcgatggcggcggcggcgggggcggggccgacgacgcggtggcccttcttcgtgttcctggcgggggccatgttctgcctgatgagcagctgcgcgtgccacctgctgtcctgccactcgcaccgcctcaacctcttcctcatccgcctcgactacaccggcatcgccgtcatgatcgtcgtctccttcttcccgcccatctactacatcttccagtgcgagccgcgctggcagctcgcctacctctccgccatctcgctcgccggcgccgccaccgtctacgccctcatgtcgccgcgcctcagcgacgccaagtaccgcgcccaccgcgcgctgctcttcgtcgggatgggcctgtcgggcgtcgtgccggccgtgcacgccgccgcggtcaactggcacgagccgcgccggaactcacgctggcgtacganggcgcatggccgcctcgtactcgtcggaacgccttctactnaccgcgtgcccgaacngtggaggccgggatgttcactgtcgggaaagcatagatattacctgctgtatcgcggcgcgctccgcatacgngcgcatntctcctaggtcgcgacaatggtgccaacaan

SEQ ID NO: 3875 - DNA, 590 bp, Triticum aestivum
  unsure (1)..(590): unsure at all n locations
  Clone ID: PAT_TA_3875
agggtacgaagtcgcagcgaccctaaattcccctccacaacggcggcgacggcgccgggccggatccctcaaccaagctgggcgagtacgcacaccggaggtgatgttccatctctccgatggctcgtgcccgccgtgccgccgatggcccagtttgaagccgaccagatcggagctcgtggagtgctaagatccgcgccgcagtgtgctcgtcacggcctcccatctcaggctccggcagcggctggttcgtcaccgcctctacagcatcagcccgcgtcctcctcgacctcgtcggctgcaactcgttggctcgatcatcggctgctaccggtgccgccccctctgcagtctaccccctacatcctgttacaatgtcaggtactctcgcgctcccagtcacgaggttgagcacccgtgcacaacgatcgattccgcagtcactctattgtactgaaactatgaatcttgaccactgttcctcccatcgtcgttattcgcgttcattctccgtggcgttgctggcctgcgagctcttacctaatcaantttgcaacaatgcttgtgatcntnagtaatnttaaaaaaaa

SEQ ID NO: 3876 - DNA, 796 bp, Triticum aestivum
  Clone ID: PAT_TA_3876
gcggcgcggcggcgtcgtgggtggtggggcggatgggcacggacgcgcacctgtacgacgacccggaggacgcggccatcccggcgctgctcgactcccgcttcgacgtcgacgtcgcccacctcttcccccaggtggtgaagaacgtggcggcgcagtcgctcgaggtcaagaagctcgtctacctctacctcctccactacgccgagacgcggcaaaatgaagctctcctttctattaacatattccagaaggatttatcagacataaacccgttggtaagggcttgggcccttcgcactatggctggcatcagattacacgttgtcgctccactcgtgttagtggctgtgaagaaatgtgcaagggatccatccccatatgttaggaaatgcgcggcatatgcactttgtaagctctacgacttgcttccagaggaaaacacaaccttggaggagattgtggacgttttgcttggtgacagttcctttggagtagtgggagctgctacagttgcatttaagtcggtttgtccaaattgtttagcgctgatagcaaagcatttccgacggctctgtgaaacactccctgatattgaagaatggtatcagattactctaattgagattctcttgcggtgtgtgatagcaaaacatggattggtcaaggattctgtaatgtttgctgcagaattgtctttggagacccaggctggcagggattcagttcctgttagtaatatatccagcacccaggcggaaactattgttaacggaggttctggcactatgccaaa

SEQ ID NO: 3877 - DNA, 789 bp, Triticum aestivum
  Clone ID: PAT_TA_3877
caaacgacgccacccttgtgcttccaccgccgaccgtgctgcgggaagccgcgcctcctccggaacaagcccgtctgctggaccgtcgtatcgcgcgccgtcgcagccggccacgcgtgggaggagcgcgctgtcgcaatcgttatgaggggagccgcgcccgggcaagagctgccattcgcgcttcttgctgaccgcaggccgccggtgtattcggagtcgagtgcgtcaatccgcgttcgacatcatttttgaggagggcatgcagacacatgtttgtgtccttgccttgagcagcctgatgaccgtgggagcgtggcagtgccatgcgccagaggaggagcacttcttgcggtaggtgcgagccgggccgcgccgttcttcattctgccggcaccggcggcacgcgcctgacgttggccgcctccgccgccgatgggaaggacgccactgctggtgtccacgccgccgggaggctctcctcgcctctgtgattcttgcgcgtgtagccgccttctcgagatggcctttctcgctcaacggagagcagagcgctgataacctgtgatgaatcaaaagtaatgacaaatgaactcgtatctttattactgggatgatgtacatatatatcctctgaagggcggcatccaaccggtgcaacggttcggagagacaggagcgaagggacgtgatggttagcagataactaaccgcctccctaatgtaacgtggagattatccacattatttaattacagaataattaattcctaaaaaaaaaaaaaaaaa

SEQ ID NO: 3878 - DNA, 730 bp, Triticum aestivum
  Clone ID: PAT_TA_3878
ccacccgcctccctgctccttctccatcctccttctcttctccctgtgccctctctgacacagccgccggtttccgcaggacctccatggagatcgcccgatttgctacaaatcgctatggccgcctccccaacaactcgccgttggatccgagcatgcccgatctggagcacctctcctgatctccctcgcgcccgaccccgcctagatccggagcctcgccgccggaccccctcctctgcgccccattccagccgctgtcggccatggcaggagccacgccgccgcatactgaaacggacgctccgctgtcaccatcctgccttgcgccgtcgtcgtctgcacttcgttgtccccatcatcaacgccatcaacaccggcctggacgccgccgatcgctgcagcatcggcaagccaacctaaaaaatgagcacactccggccacctcctcgtccctcgtcgcggccatagccaggcaacaaggacgacaacggcgccagggcgccgcgtgccggacgagttcacgctgcttcggcaggagggattgtgcacggtggtgtgcgtgtgggggggccggttgcttttgtttttttaatctaaggggtgtatgtgttatttttttgctaagttaattccttacaatctggccccacttgtaagaaagtgattaaacgagtgaaatcattcaatcagtgctttttgcaaaaaaaaaaaaaaaaaaaaaaaaaaa

SEQ ID NO: 3879 - DNA, 1123 bp, Triticum aestivum
  Clone ID: PAT_TA_3879
gtcccctcactcactcgctcagcgccccccggccggcccatcgatcgtagtcggtggtctctctccgaccaattagatgcaacaacggcgggcccgcaccgggtcgtggggccggcggcgtcggctgtcgtggcgcgggtgcccacctgcctcgtcaagaagctcctttacttcgtcgtcgtcagcatcgacttctagaagaggcacaacaagccccccgagatcatccagagggggcctcctgccgggcagctgaccgatcatactgggcagatgacttttgatcatggtgagaagacccgccgttaatggagccccttctccccggacggcagcacccgcgtcctctacacggggtcgctgctagagcgcgcctctagcgcgctgtggcggcggccggatcgcaagagctccgccgcgcccactccggaccgcgcctccaaccgggccttcccggcggctcctcaactggctccctgccgagcccccgcatcgcggagaagcaacggaactggaagcagagcttcgaagccacgaccacatccccggccaaaaaccagacccccgcggcgaacatttacacgctccccgacctctcccccctcgcggcctcccacaacatcgcccgctcccagcggggccggaagctcttcacctccaagaggcacgtggccaggtggtacgacgccatctccagccgcccctcgtggcagcaggtggtcaacatccagcacgagcgccccggcaccttcgagtggtcggcgatctccatcgtcgtcggtcatcggtcggtagcatgcacgctccttccacccggcttcacaccgtgttgtctccgtccgtcaagggccctctcggtctacgttctgttcgttcgttgtcgtgttggtctaaaatactgtgaagccctaaagcgcgcggtgtctctcgtaatgtcttccattattgcaacaccattgtccttccaagttcacaaggggttgtatcagttgctttcagttcagcaaataaattgttcccaatcgagccttcttgctcgtttgtcttaaaaaaaaaagggcccggcaacaaatcgcaaagagcggtcgctttcgcgcccgcatgtaaattgttcccaatcgag

SEQ ID NO: 3880 - DNA, 1324 bp, Triticum aestivum
  Clone ID: PAT_TA_3880
gaggaattcggcacgagggtcgggtcggggaggaaagcccggctccagcgcctctccgcctccgacctccgagctcctccgcctccgacctccaccgccggcgaacgaagcgacgtccctcgcagccctccccccggtgcttaggatccacgctccgcccctccagtgacagcgacggtgacagaccgcggccgccaccctcctccttccccggaccacctctccgcctcgaagctcgtgtccgatccggtaacggcgacggcgacggcggcaggcacctacttcgaccaagatccaagaacctgagcaccggcttcacttgttttaaccaatcagcatcctagagcccgccgtaaccaatcaagaataaatgcatctaatgtgaaacttccccctccggtgttggatgtgtgcaacgacgatgttctgctcaaggagagcctccggcgtcttgttggggatgcgctgaccctctctacgaggccatcttccggcagcatccatcccatcttgcggcggtgcggcgccttcgatccaggcgaggaggtagtggccttcttcaaagatggcgtaccggatgtgccgtgccggggcccgtagatgcatggtgacggcatatgcccagctggtgtcggcccctctctcctcggagccagtgtgatattgttcctggtgcagcattctacggtgaggtcctcgtcttcttcggcttcgttctcttttgatcatctccagtttccgtggcgtgtgagtagtttggtgttgtccatcgtttatgtatcttaccgccgtgttgttctttcttttgcctgagggcgtatgcttgtaatcctggcagttgatggctttgttaattcaaaaggtcaggctaggttcgagccctgtcctcgggattcggcccttcttcgaagatggtgtacctgatgtgtcgtgtcgaggcccgtaggtgcatggtgacagcatatgccccgctggtgtcggcccctctctcctccgagccagtgtgatattgttcttggtgcagcattcttggagaaggtccttggtgtcttcggcttcgttctcttttgatcatcttcagtttccgtagcgtgtgaggagtagtttggtgttgtccatcgtttatgtatcttaccgccgtgttgttctttcttttgcatgagggcgtttgcttgtaatctgccagttgatggctttgttaattcaaaatcgggctaggctcgagccccatctcaggctcggctgatgccttttgtctaaaaaatgttaaacaacaattagcacaccagaatttatcctcagtgttatgttatttagtgtcagc

SEQ ID NO: 3881 - DNA, 697 bp, Triticum aestivum
  Clone ID: PAT_TA_3881
tttttttgtttttgagaaatcatattcctctctttatttaattcatgagcaacagaattagcctccctaaaacggtgcacaaacagggtttttgcagtttgcactatgcggggcgtcttggtagccaaccatccaagatcaatcgacgaaaccggttgttcatcggtaccccgaaagaaacctcttcaacaacaaccgattgtgacatatttcatacgccacatgaatgaattatgtgaaaataaatcacacgtgcaaatctgcctatagataaatgatccaagcatagtacaaagtaggcaaaaatacacgacaatgacatgaatgtgatgtaaaaaaatcgtaacatagatcccaggcacccaaccaccgtgtgccaaccacaacaaaacctagtcccctccgtcaaaagaaacatggcctcctcgacaaacgagaaacgactgacacgatcgatgagctgatcgacgacatgcaacctaacgtacagcactgcactgcctccaccctggcctcgcccggcgagaagagccccgcggccacaagcccggcaatggcgcccaggccagccaccgccgtggctctgagcccggtggcgccggattccgactgcttggccggcggcgcgagcacggtcgccggggtcttgggcgtggcggctggggtggacggggacgtcggggtggtggagggggtg

SEQ ID NO: 3882 - DNA, 922 bp, Triticum aestivum
  unsure (1)..(922): unsure at all n locations
  Clone ID: PAT_TA_3882
aatacaacctgacgcgttggggccgcggccacccgccgccttgggtcctccggggctacgggtccctctgtttggtcccgggccgtggggatcctgcattcgcacctttactcgcggcagggcaagttccgaccgcgggggccacaggccttctatcgtgtccagccgggcctccangcggggatatttcattccgcatcgtgaacaaggagtgggcgtactcacacaagaagggcttcaagtgcacatttgcgcgtgggattcttcacctgtatttcaacctcaagcgccaccgcttccggtggagagagaccgcaccgctggggggacctgccctatgagggggcatgctggccctccatacgaggatatttctttccgcatcgtgaacaaggagtgggagtactcacacaagaagggcttcaagtgcacatttgagcgtgggattcttcatctgtatttcaacttcaagcgataccgctacaggcgatagatacccacacagcagaaagaactgaaccattgattgggctattagaagttggttctctgtttctcgcttatagtgtgttcttacaggctagctcccgcatcacagaagtcatccgggtcagcatgctcgaattagttcctgtaccaaaatatgaacataccaaacaattggatagtttgtatcaagtttttgtggcacttgctaccttgatttcaatggagataacggtgtagcacaaattcaaagcatctgtatatgtatgctatgcattcttatgcccttcatgcgggatggatatttttgaaatcaacaaaagagacagatatattatgtgtagtttgagctaattattgttagaagaaacataggctcgcacaaatttcaggctgttagccaggtatacatcttcaaagggatagaaaaataaag

SEQ ID NO: 3883 - DNA, 963 bp, Triticum aestivum
  Clone ID: PAT_TA_3883
gcgcctggggttggcgcgccaactagttgctgcctggttacagctggaacagaaatatatgtgcatctggtgccggtgcccgtctttcctgagcgcgcggcaagatatccaagtgagaaggtgttttgtgcgcagtgattaacttcttgatgcattcatttgaagagaatattattgattgggagctgagttctcttcaatctccggtgattacctctgttccggcttgtaccttgccctcgtcctcttcctgagggtggcaagcccagttcgtttcggcccgtgcttcttgggggcgctcccaccaaccgttgcatggcgtgcatccgcctgctagctactccctggtcacagccggatctggaatttattgcctgctgggtgcctgtgcccgcctaaccactgtccgcgccctggtttccacgtgggcatgtgttggctgcgcactgttgttcttcacgcattcttttgaacagtatattagtgattgggagttgagatctcttcaatctccggtgattatctctgttccagctttcgtaccttttcgttgtcatcttacatatggtggaaggccaaaacctttcatcccagttacaatggggcttcgccagggtttgttgcttggcagcaacaggatgttacgattcttttgtcgaagccgatcttgaatttgttgcctggtggttctttttgtcgcagatagctacctgcacgcttgttggactacaacaatttttggcataaaacagttgttaatctcaaacttttgtgaaccatgatgtgttgtttgcagtagttggatgtactgggggttgctctacttttgcaacttttggtccccatggttgtaaattagccaagttaatcctggacattgatattgtatttcggtctgtccagacaaataatcgtcaatgttaactgagtttttttcttcaaaaaaaaaaaaaaaaaaactcg

SEQ ID NO: 3884 - DNA, 851 bp, Triticum aestivum
  Clone ID: PAT_TA_3884
aggagcattccacaatcatctatgagagtagttctggcggcggctccaattctgctgctacggatggtggggctgtgtcgccgacaccattggttaggctggggtggaacaagcaggacccaaggtatatggcaacaatcatcatggatagccccaaggtggtcgtgcttgacattcgctacccaacactgcctgtcgttgaactccaccgccatcatgctcctgtcaatgcaatggcatgggcgcctcactcttcttgccacatttgcacagctggggatgactcgcaagcactgatatgggacctctcctccatgggcacggggaacaatagcggaggcaatggaaatggaatggcaatgctgctgcagctgcagcagcagagggtggtcttgaccctatattggcttacactgcaggggcggaggtggagcagctgcagtggtcagctacccagcctgactgggttgccattgtattcgccaataaactgcagattctcagggtctgatttcttcattctagctttatcaatggtggggcagaaagaggcaaagaagcccatcatggatgatgagagttcaggcaatgggaggatggtaattttgcttttgcttcagtgatgtatgttgcagacagctgatatgtgtgctgagttgctgatagaaatgatggttcactaggtagaagctggaattgacaatgaactgagttattaagagtaattagacttataggattagtgttggtgatactgaactaaattgctgttatttaaattgctcgactctagtactgctgttaacttgcttattgctgcaattgtcacaattttctgtggaaaaaaaaaa

SEQ ID NO: 3885 - DNA, 758 bp, Triticum aestivum
  Clone ID: PAT_TA_3885
cgccgcccctcgtggccgccgccgccgcccctcctcgtccctctgtctccctcgcttactcgcgccgccgccgcctcccccatccctgtgtccccgcctccgccgcgccagggccctcccgttgatccttgtgccatcgggccccgctgttccttgctcgccgccggctgccggggtgggggtctgaggcggcggcgcggtggctctcgctggggaccgagactgcccctccggtgcagggccccccgtgcccgcccgggaggcggctcgcgcgccagccctggtcgcgcctgccgcgcgcccagcccgctggatatgcataccaacaaaatcaagcggatatcctgacgagtgtgctcgtggtggtcgctcagatcccagccgtgcgtggcggcgggcgtcctcgtcgagatagtgtcgttgtatacatcaacttcatttccaacccatccacaggtgtaccagctcctctctgtatattgtttgattttttcatgttcaattcaactttcgctaaaagaacttcaaaatcgagcagggattgcttgatttgtagccaatgatttaattgttcatactattttggtgtctagaaatagtagtaaaactactaatatcgtattaggggctacaacgcagcatgtattgtttgtttgaattaatttattttcattgtaatagagaggaagcagtgagttttgctggggttttttcctgaaggaaccgtggtttctttcaggccatctccatggtaacac

SEQ ID NO: 3886 - DNA, 344 bp, Triticum aestivum
  Clone ID: PAT_TA_3886
cggcacgaggctcccgcctgccattacaaacccacccaccattttcgtacaccacgcgagatcagggcacccaggccagcctcccccagctccaccaaggaaccaagaagcccgagggcagccatggccggcgcgtccgccaccagcacccgcaagggcggcatcaaggcctactggaagcaccgcgggtacgaccgcctggacgcggccgccgcgcagcgccgcccggccctcgccacggccgagctcggcgccgggggcggggcgggggcggcggcgaccgcgggccggcggcgcgggtggcgcgtgcgtcgccgcggcctcgggcggcgggtcctgcgcgc

SEQ ID NO: 3887 - DNA, 986 bp, Triticum aestivum
  Clone ID: PAT_TA_3887
cgccatctgtgggcgcctggtctcctccctgagcacgaagggcacgtacacggtccgcgagggcgacccggtgaccgagatgctcttcatcatccgcggcaagctggagagctccaccacggacggcggccggacgggcttcttcaactccatcatcctcaagtccggcgacttctgcggcgaagagctgctcggatgtgccctcgtccccaggccgaccgtcaacctgccatcatccaccaggacggtgaaggcgctcgtagaggtggaggcgttcgcgctccatgccgaggatctccggttcgcgatcaaaaaaaacaggcggcaacacagcaggaagctacagcacaccttccggtactactcccaccactggaggacctgggcggcctgcttcatccaagctacctggcgccgccacaagcggcggaggctggccagggacctcatgatgagggagtccttctcctccatgcggtcgtatgaggatggcaacggcggtggctccttcgccgagcacggtatgtcggtgaagatcatggccgcggccaggaaaggtctgatagccacagggagctgcctaagttccggaagccctcggagccggacttctcagtggagcacgacgactaggagaaagggttgccatattattgttcgccacgacggcgatcgctggtcgcagactgaggcgtcctttgcgatgatctgtaaatatgaagctgagtttggggctcaagctcaccggtgactgactgctcatctcagggaaatgctcaagctagatttggggcagggtagactggttggcttctggggttgggtttgggaacggtaggacagttgctgtctgtaggttagctttaggatgctcatattgtacatccagatgtaattatgtttgagttattcttgtgacctcaaaggggcacactgctgcttgtattgactgggcgatcagattgtgtgcattggtttgttcttta

SEQ ID NO: 3888 - DNA, 476 bp, Triticum aestivum
  Clone ID: PAT_TA_3888
acagcgccggaactcgagccaccggcggggagatggaggccgacgggaggaaggacggcgagacgccggcggcggcagcgcagaggggcgcgtcgtcgttgggcgtgtccgtgcaggagggcctgcagcacgccaaggccagcgtggtcggcgcggtgcagcaggcgatggcggggagcgaggaggaggcggcgcaggcggacctgcgcgcggccaaggcgcaggtggaggccaccgacgaggccgaggccaagaagaagcacctcgccggtggttgatggaggtgactgcgtgcgagattgctaggctgtatgcattgcatttgggttaggttctggacttctagccatttttctcgatctgctgtttgtttttgtaataatattcccagatgaactttgttacgatgttaagacgtgtggtttgtttatctctgtgagactggttttgcacgcgtaaaaaaaaaaaaaaaaaaa

SEQ ID NO: 3889 - DNA, 793 bp, Triticum aestivum
  Clone ID: PAT_TA_3889
tgggcggcaccaagaagaaggcgagaagaagctcaccctggacgagttcctgcccatcttcagcgcatgcaagaaggacaaggaccagggcgtgtacgaggacttcctcgagtgcctgaagctgtacgacaaggctgagaacggcaccatgctcggcgctgagctctcccacaccctcctctccctcggcgagcgcctggaagacaaagaggtcgatgaggtccttaaggactgcctggaccccgaagacgatgagggcatggtccaatacgttccattcctcaagaagctgatggcggcttaaatcaacattctaaaggaagacacctttctccagaggatgtgcggtaagatccctctgaaggacggcaccagggcgaccggtggcgaataaacactggccacaccacacggcccaccctgggccctctgcaaccggccgcacgccgaacaacaccaagaacaacatcaacgcaactcaaggactgttttaccatctgcattatcgggatcgacattcaaaaaaaaagtttatatttcttccaactaattattgttattttttatttataaattatttttcatcaaacatctgtgagattgtcccacctccctcgcctcgctttgtgggtgccaacggtttcgatcaatttgtgatacgcaagagcttgccattttttgaccgtcaggtcggcagccacgtcgccaaaattaaaaagaactgaaaagaagaaaacgtcaatgtggggacacaataaagtgtacaaaaccctccctttaaaaaaaaaaaaaa

SEQ ID NO: 3890 - DNA, 1533 bp, Triticum aestivum
  Clone ID: PAT_TA_3890
cctcctcgttcccgtagcttcgccgtgccgcaacgaggagacgaggcctcgcaggggaagctcgccatcatgatctccgcggagaggagccagtcgcagagcccgcggtcgcccggggcggcggccggggcgccgttcctgtcgatctgcgtcacggatcccgtcaagatgggcaccggcgttcagtcctacatctcctaccgcgtcatcaccaagactaacctacctgaattcgagggagcagagaaaattgttatccggcgctatagtgattttgagtggctgcacgatcggctagctgagaagtacaaaggcatttttatacctcctcttccagagaagaatgctgttgagaaattccggtttagcaaagaattcattgaattgaggcgccaagctctggacctattcatcaacagactagcttcacaccctgaacttaagcaaagcgaagatttgaggacatttttgcaggcagatgaagagaaaatggatagagcaaggtcttttgagactggtatatttaagaagccgggagatttcatacagatgtttaaggatgtacagtcaaaagtcagcgatgttgttttgggaaaagaaaagccagtggaagagtctactcctgaatatgagaagcttaaacattacatatttgagctagaaaatcatctagcagaggcccagaaacaagcatttcgccttgtaaaaaggcacagagaacttgggcaatctttggcggactttgggaaagcgattaagcttttaggcgcctgcgaaggggattcgttggagaaggtgttttctgaagttggttcgaagtcagaaatgttgtcaataaagctgcaaagagaggcagacaaccttctccttaattttgaagaacctttgaaagaatatgtgcgggcctgtgcattcaataaaggcaactagcttgatccgagccaatgctttcaggcagcactttgacttggaccaggagaggaagtataaaagagcttaaccgttgaaaagatgaagttcatgaaccctgagaagttttccgagtcggaaactgagttcagcgagttgaaagcagccagtgtagggggctacgaagacggtacgatgcacatagttaagtgtaatgaacgaggtgcctgcaccagtccacgggcggtattcggctgtgagtgccctggctttccctgagggcaagcaaagttagctaaagatattgctgatgcatggcgcagcgtcctcccaaagctacaggcgtgttccagttcataatcaaaactgtgtttgcccgtctgtgtttgagatagtggttggccctttgagttttaggctgattttttccagcccaatttgccagtggttcatgtatacttaaaagtgacggttgacaatgctccagttgttatattgacatattttctttaccgtgtgcgggggtactctgtaactcaaaatttcaaccaatgagtataactgttaacggttttcgtcacttcataaaaaaaaaaaaaagacagtggggttgtttagaccttt

SEQ ID NO: 3891 - DNA, 1040 bp, Triticum aestivum
  Clone ID: PAT_TA_3891
cccgctcacgtgcgggcacgacatggacgtgccggcacgtgagcgggctggcggcgctgctccgcgcggcgcaccaggactggagcccggcggccatccggtcggcgctgatgaccaccgcatacgccgcgtaccccaacggcgacggcctgctcgacgtggccaccgagcgcgcggccacgccgctggacatgggggccgggcacgtcgaccccagcaaggcggtggacccggggctggtgtacgacctcaccgccgccgactacctggacttcctctgcgccatcgagtacgagccggcgcagatcgcggcgctcaccaagcactcgtcggaccactgcagccccaaccgcacgtactccgtggcggcgctcaactacccgtcgttctcggccacgttccccgcggcgggcggcacggagaagcacacccgcacgctgaccaacgtcgggaagcccggcaccctcaagccggcccgcggcgcgccgggggtgaacatcctcgcggcgtggtcccggtccgtccgcccatcggggatcgccggcgacgaccggcgcaccagcttcaacatcatatcgggcacgtccatgtcgtgcccgcacgtgagcgggctggcggcgctgctccggtcggcgcaccaggactggagcccggcggccatccggtcggcgctgatgaccacggcgtacgcggcgtaccccaacggcgacggcctgctcgacgtggccaccgagcgcgcggccacgccgctggacatgggggccggccacgtcgaccccagcaaggcggtggacccggggctggtgtacgacctcgccgccgccgactacctggacttcctctgcgccatcgagtacgagccggcgcagatcgccgcgctcaccaagcactcgtcggaccactgcagccccaaccgcacgtactccgtggcggcgctcaactacccgtcgttctcggccacgttccccgcggcggggcggcacgggagaagcacgcccgcacgctgacgaacgtcgggaagcccggcacgtacaaggtga

SEQ ID NO: 3892 - DNA, 1596 bp, Triticum aestivum
  Clone ID: PAT_TA_3892
cgcggcggcccccccccagcctccccccgccggccgcctctcgcgcggcggctccgccccggccgccccacccccggcgccccccgcccctcctcctcgcgcgcggcggatcccggccggccgccggatccgcagcgtccacggccgctccacctcgggcagtgcggatcacggccggcgacccgatggaggcgtagcggctaccggcgcagtctgacactctgccatgcgctccctccatgtctcctcctgcgcctccggtggccagacgcctcttccactccggccgagatgtttgaagaaggggctagagacaaactgtccaatttgttgtgacttcctattcacatcaagcaaggaagttagagctgttctttctggtcactccatgcattcaacttccttgcaggcatacacttgcagtcactacacttgtactatctacggcaaatccttcggggatatggcgttctattgtatgagaattctccacggacaatacaattctgattcctgacgcctgagtgagattttacttgtggtcttgttatttaaactcattcctaagatgcaacatgaagactgttttggtatttggggaatgcgcgatcggtcgtgctgctcgtctcctataatcacagtgcgggtccgactggcatgccctttcacttcagtgggctaatacttgaataccatgtgacgagatcggttgcctcgccggcccctgccattctctccgtctatgctgtgtttgttgcgtcgagtagtgacggagagcaagcgaggcgagagagcgagtcacatcgcgcttttacctgttattatataacgcacattgattagttcggttgtatctgggcatgcttttagacttaaagtcgatcttgatttcctcttgccacctgtatgagggcatccattcgaaacacatatctaatcttctacgtgtgggatcctttttctgttcttaatttgttgttggggcgagcttgttactctctacatggatttcaagctggatgagagctacacgccgagcaagatctccatctggactggcgacggcttccacaatctcaaggcccagaaattaggattcaagatttgcctcattgaaaaccggtcaggagttcatgttcacaatcaagcagtgaccccttctactacttgagggattcagcaaagaccatcaacggtacagtcaaagttgaacatgaaaacaaggcgctctgccagtgtgcgtgcatgatccaatagcatgtgtttaatagtagccactatgatgtgaaatactagcagcttcctccatttatgccagtatttgatatacttaccaaagtttaagggcgccaatcttaagaagacatcccggtttgtgagaaaatttcttacgcgtattagacaaaagatgtatctaattttccttaggttgcattgcaacacatcagtttctgctattggttcttttaccataaaatttgtaaggccccttatgtttgatttattgtataaatcatttgagacatgccctgcatgcatgattactcactatatttatgttcatctgatattatgttaataatcatttacatcatt

SEQ ID NO: 3893 - DNA, 660 bp, Triticum aestivum
  Clone ID: PAT_TA_3893
ctccgctctgcggccgcgcgagagctaccgaaatgagccagagccagagcccgagcccggtggtgaagctggggacgtggggcggcgatgacggggtcgcccacgacatcacggtggcgccgcaacggctggagagcatcaccatccgctggggcaaggtcctcgactccgtcggcttcacctacatggacaaggacaagcagctgcacaccgccgggccctggggcggcgccggaggggaaaaggaagacccggacacgatcaccctggggccgtcggagtacataactcaagtcgactggtcggtgggtccgttcaagctcaaggagatcgagcactgcatcacctccatcaagtttgtgaccaaccaggccacctacggcccgttcgggcacgcggtggacagcacgcactacagcctgcccgtgctcaacaacggcagcgtcctcggcatgttcggccgcgccggagactacctccacgccatcggcttctatgtcccccccttctaatttacaactacccatgtctgctatcagtgctgtggctgccacctatagggtgtgctgccccccgccgtttgtttttttgccgcgttgggctcgcatctcgagttcccatgttcattggtcccatccattgttcagcatgtaaattgga

SEQ ID NO: 3894 - DNA, 899 bp, Triticum aestivum
  unsure (1)..(899): unsure at all n locations
  Clone ID: PAT_TA_3894
ggggaggcacggactacgaagccaagtgagctgagtgagctgtgagcagctagctagtgagcggcgacgatgagggtacccgccttctcgctgtgcttgctcttggccctcgtcgcggcaaatgttgctagcctcgccgtcgctgggagggcgccggagctgaaacatgagcccagcctagagccgaagcctacgccacagcctgaccccaaaccagacccgcagaccgaccctaaactcgcgccgacacctaagcccgaccctaaactcgcgccaaaacctgacccgaaaccagacccgcagccagacccaaaaccggcgccaaaacctgacccaacacccaagcccgaccctaaaccggcgccaaaacctgacccgacgcccaagcccgaccccaaaccagacccgcagcccgaccctcaaaccggggcccaaaagcctgcatcccaagcccacgcccgacccaaacgcctcgccccccagggccccacgcccgaagccaggacccgaaaccccagccgcccgaacagtcgtcctcgcagccgaagcagccgccacgttcgccgtcaggctacttcaactgacgggagggaggctcgtcagcagccgcttggtaatggaggtctagcctgcctgcatttgcatgggtgttggtgatcatggcgtctatgttgacgtttattaacgttaggaatgtgttgcctccgtctctctacgtgttgtctccagattgttcgtgtgagccatcttgcctcagtgtatctcccgtgtgatcagtgcgtgtgatgtaccatgaataaacagaggaacatgcatcgtgcatgtatctgaacgtacattgcttcagtacttcacttattttcggttgtgctctcattccnatcnnacaccactcctta

SEQ ID NO: 3895 - DNA, 1319 bp, Triticum aestivum
  Clone ID: PAT_TA_3895
ggaagcggatgaagaaactgagacagaaagaacagagactgaaagacctcaaggacgagggtaccacggtccagttacctgaagcggtggatggtgcgccgagctctcctgggattcagagtctcgaggctacttcaggccctggcctccacgagcaagaagattcacagtatcttcaattgtcagcaccagtgccttcagaggacaatgattacaatggagaagatgccaattgtggttcgggacaagaaatggatactggtgccgttttcagggaacaagccatggcaacaagcaatctcgacaggatagaaaaccttcccccaaatagtactgtctcgggttcttctgcgactgcgtcgaagcatccatcttcatcgtcagtaaggcactcacgtcacagggagccaaatgccggtgcaacgacaaacaaaagcaagacctgggcatggaaggtgcgaactggtgttgaagaacggtgcccaaaaggcgagccagatgtagatgctaaccaagagacggctcctctcaacacggacaagaactcgcaagtgctgataggatccataagcgttgcgatcgaaggcggtggcagctgctcggaggattccaaggattaccacccagctcctcctgaatctgatttgaacactctgaacgatccagtggccgaggcgatgcagccaatcagccatgatgagaacggatgcgaagacgctaacgcagcagaggatcactctccctctagtgtcgtgacagatgaaagcggctgcgacgcagaggcggcagagggcggaagcctacgacgcggctccgtttcttccggtcaggaagcggcggccttcctttctcaaagatggaaggaagtcatggctggggatcatgtgaagcttgttctgtgctgaggaaattgactggagttgcagaggttccatcggaggactgatttgatgaatacacggaaggcattcgatcattgggtcctgcttactatatgagctgagccgagccgacccatgtagcagagcattatggagttgcgaagcatccattcctcgactttgggcggttaatttgagtactagacttggttggttggttggttgatttttagatggtaacggagcacgctctttgctggctggccagtaaaatgcctatgcctgcacggcgcagttaaatttgagtgctatactagtacttgataggcaactagcagaagtgttgtgtgttgtgtgggcagagttatcatgcatgataaactgagagggaaagtaatcaggtgatgagaagattggtatgtagaatttcttccttct

SEQ ID NO: 3896 - DNA, 882 bp, Triticum aestivum
  unsure (1)..(882): unsure at all n locations
  Clone ID: PAT_TA_3896
cggcacgaggcaagggtccataagtattaattcgtcgtttaaccgcctcgatcagccccggttggcgcgagtcagcggtcgcacgtcgccgcggccagccgaagcacgctctttcttcggctttgtcggcgtacacacatggcccagcccaaagccgtgcgcgccgccgccgccgccgccgtgccggacatcgccgcgcagctcgacctcgcctccgcgtgcatcaacggcgccgagtcgatgatggcggcgccggcntgccggggggaggccgccgctggtggtggtcggccaccgtgggaaggggatgaacgcgctggcgtccccggacgagcggctgcgcgaggtgaaggagaactcggtgcggtccttcaacgacgccgcgcgcgtcgccggcgtcggctacgtcgagttcgacgtccaggtgaccaaagatggctgcccggtcgtcttccacgacaatttcatcttcaccgaacaagatggcaaaatctgcgggaagcgcgtcactgatcttccactggtcgagttcctctcctacggccctcagaaggaccaggacaaggtcgggaggccattgctgcggaagctcaaggacggcaggacactgaggtgggacgtgcgttccgacgaacccctctgcacgctgcgggaggcgttcgagggcgtcgacacgcgcgtcggcttcaatgtcgagctcaagtttgacgacgatctcgtgtaccaggaggaggagctcgtcggcgtcctgcaagccatcctcaaggttgtttttgagcatgccaaggacaggcccgtcattttctccagcttccagcccgacgccgcgcagcttatgcgaagattgcaagaccagtaccctgtttacttcctgacggttgg

SEQ ID NO: 3897 - DNA, 2086 bp, Triticum aestivum
  Clone ID: PAT_TA_3897
ccaccccgcccgtgatgcggaggcaggcagtccagacgcgcgcaccaccataaaaccctaatcccctcgcagccgccagagcccccggagcgaacccgccgccatggccgacgacgcggcatcggccccgccgacggcgcagctggccgccgcctccatctcctcgtcgccctcctccgacctcgagccaccgacggaccccacccggatcagcgccatgctagacgtcggcgacgccatggccgggcagcgcgtggtcgggggccacttgggcgagaccggccgccaccaaggcaagggcgcgttcgccttcctcgggttcgaccacagggtccggccaggggaacctccagggccagctgcgagaaggacgtcacagacgcccgcaaatccccaagcacacgtgggaagggccgagcttttcaagggcggcatatgtcagccttggcgacatcaagaacgtcaattctaacactttgttagcggatttgggaagaagtgttggccgtccggttagattgatatatatacgcatgctgatatcatttgatatgtctcgtgtcttggcttgttgtgattcttaaaaaaagtatcaggcttgttttaagattagaacgttgaagtattattggtccttagcatcttctttttgtaatcgttgtttgtggtcctttttggattcacagtccgataataaccaccagcgactgtgagggtgcaggtgagatgttccaagtcactgccttattcagccaggctgaaaaggtggagaaggagcttaaggagaaccctgcaccatcagaagctgacgttgaggctgctaagcttgttgttaaagagaaaggagatgcagttgctcaattgaaagcagcaaaagctagcaagcaagagataactgctgctgtttccgtgcttacaaaagctaaagagaatgtgttaagggtggaagagcgctctaagttgaaacctggacttccactcaaggatgatgggaaaattgcgtttgagaatgacttcttcaagcgtcaagcttttctgaccgtttcaggccaacttcaggtcgaaacttatgcttgtgctcccagtcatgtgtatacctttggaccgacattccgggcagagaactcacatacatcaagacatttggcagagttttggatggttgaaccagaaattgcatttgcaaacttgcaggatgatatgaactgtgctgaaaggtatgtacagtacctgtgcaaatggttactcaagcattgccgagaagacatggaattcatggttaaacatgtggacaagaccgcaattgagcgtctggagcttgtttcctctactccgtttgaacgcatttcatatacaaaggctgtggagatcttagaaggtgtagataagaagtttgagaacaaggtcgagtgggatgatttagcgtctgagcatgagaggtatttgactgaggtgatatttaagaggccagttattgtgtataactacccaaaaggaataaaggcattttacatgaggctcaatgatgaccagaagacagtagctgcaatggatgttcttgttcccaaggttggtgaattaatcggtggaagccaaagggaggagcgtcttgatattcttaagcaaaggatactggacgcagatcttcctctggagccgtatgagtggtacctggacctccgacgctttggctcagtgaagcacagcgggttcggcctggggttcgagaggatgatccttttcgccaccggcctggagaacatcagagatgtcatcccgttcccacgataccccgggagggccgatctttgaagggttgcagatttctgccttgaaatataagaacgtcaattacactttcgttagcgtttttggaatagtgttggccgtccggttagattgatatatatacgcatgctgatatcatttgatatgcctcgtgtcttggcttgttgtgattctaaaaagaagtatcaggcttgttttatgattagaatattgaagtattattggtccttagcatcttcttttttgtaaatttaattttgatgccctgtttgtatcttatgccgcaaactttcgaact

SEQ ID NO: 3898 - DNA, 609 bp, Triticum aestivum
  Clone ID: PAT_TA_3898
ggcgtcgcaccctggtattcctctctcactcccgtccctttcccacctccacccgcatcatcgtcggtgacggctcttctctccccgccccccgccgcggtggcctctccctcccttcctctggtgctcctgttcgcttatatgatgttcttgtctcaccgcatctcattaccaatttagtttctgttcgtgctctcactcgccacaacccggttacagttgaatttgacgcctttggtttctctgtcaaggacctctagaccaagacggtgctgctccgatgtaatagcccggacgacctgtacccgctccgggcgtcgcctgctgcccccactccggttgcgctctccgtcggtctcgacctgtggcatgcacgccttgggcaccccggcgtttcagctatacagcagcttcttcccagtttccctttcagttgtaataaaacagagaaacactcatgttcctcctgtaggcttggcaagcacacgcgcctcccgttctctgaatctttttcagtttctagtttcccttttgaactactccattgtgacgtctggacatctccaataaagagcaattctggttttgagtaaaaaaaaaaaaaaaaaa

SEQ ID NO: 3899 - DNA, 403 bp, Triticum aestivum
  unsure (1)..(403): unsure at all n locations
  Clone ID: PAT_TA_3899
attcagttcgcgcgataggtaatcagttcgccgccgcggacaatcccagggtttccgccgccaaatcaccggcgagatgttggaggagctgctcatcttcacgcgcggcggcctcatcctgtggtcgctggccggcgccgccgctgcgctgaagggctccccgatcgacgcactcatccggtccttcctcctcgagggccgctcagcctccgccggggccggcgccggcttcacccacggtccgcacgcgctcaggtggacctacgacaacgcgcttgggctcgtcttcgtcgccgtctacaggcgggtgctccacctgctgtacgtcgacgacctcctggccgccgtcagcgcggaattcgcgcggatctacaacccgagccgcgtgtnctacgacgagttc

SEQ ID NO: 3900 - DNA, 1178 bp, Triticum aestivum
  Clone ID: PAT_TA_3900
ttcggcacgagggtttacacactggtggcaatgccttccctaaccgttcatcttctatgctatgcaacaacagaatctcggcaccacacagtcccttcatgtatggcaaacaaaatgccaagcatgctgcttataaccatgaatcttctttgcaccctcatattaagtctgtgatcttcaaagcgccggatatcaaagcgcaagacttggaaccaaatgctgattttataccacttgatctagatgattataagtctgacagtgatgcagtcccttcagatctactgggacctgcaggcttatatttagcattgccaggcagcatcatcccggtccggcatgccccggcgcccctcgcggccgagcacaatgaggttgacatgtatcctgcacctgtgctgagccaaagcttccattctctatgcgaaacaagtcaaaacagtgccattgctcatttcatgaaagagaggcaatcaagcatgcagggcagggggtgcaaacgcatgtcaaccctccagtttgatggacactcacatctcccatccccaaggagttccactatagcaatgacacctgtcatttagctttggtgctgatgaaatttcggttacctctgataaagcattgaacagacctgcacttgctgaactcgaacaaaacagagaagcagttaccaaagaaagaaagcaacaggtcagttactcggttcagggcacacaaagcaagagtggagatgattcgaaaaagaggagtaagctgatgagcctttccttcgcagaaagagttgctagtctacgtgtcaagagctgcttcggcaatagccagtcactgctgatgcagtcaagcaagctgtcctgcacacttctgcccgatgaggaatgaagatagcttcacagaatcagtgtttctaactcagtggtgggcaggtagtaacttcagttgttacatcaggtggtgatgataatgcgcaacgctttccctttaagtgggtgttctagaggagtttttttttgagcagtagcccaggatgacttgacatttacgatgatcaggcagatgtaaatatgtgtcatcgttcaccgcattttgttttttgttccagctcaacaatattcagggatgagtgctggttttgcactatgtagagagatctgagtaaaagtttttactaaaaaaaa

SEQ ID NO: 3901 - DNA, 636 bp, Triticum aestivum
  unsure (1)..(636): unsure at all n locations
  Clone ID: PAT_TA_3901
tgatgatgtgtggaatccagaagcatatagtctgatgtgcagtgcatttcagggtctccaaggaagccgtgttatgatcacgacacggagggaagatgttgcggctcttgctctagtgagccgtcgcctacaactccagccattgggtagggacgagtcattcaagctattctgctcaagggctttccacaacaccctagaccgcaagtgccctccggagcttgagaaggtggctggtgatgtagttaagaggtgtcatggcctgccattgaccattgtatcttctgggcagcctattgtccacgaagcagccgacacagcacgcttggaatcacatgtacaatcatctccgggagcgaactacaggcaaataaccatgtccaagctatacttaatctgagctaccatgacttgccaggtgatctcaggaactgctccctgtactgcagcttgttccctgaagactatgcaatgtcacggggagaaccttgtgcggttgtgggttgctgaagggttcgccatgaagaaagataacagcacgccgggggaagtggctgaggggaatcccatggaactcatcggtcggaatatgtcggaagttgtggagagggatgagctcttcagggttagaatgtn

SEQ ID NO: 3902 - DNA, 394 bp, Triticum aestivum
  Clone ID: PAT_TA_3902
cagtcaaattatgcttcacatttgacaacttattcttttgctcacccgtgaaagctagtccacaacagaggtgcaatttacaaaatcaactacttcaggttccttcttttacagcatcttttcaggttcatatcaaatagagaactccacctgcacaactctgctgcgcaaaaaaagggcttcactgtacataccatacactgtatttgacagcagatgccatgtttactcaccatcactgaacgccgagatggtgttcaaacacaaacataatcttgaccacacgttggggatggcattgacaaggcatgcagttattgtggattttctaacatggctaggcagccatgacaaacttgggtgaagaatatgtacagctcagcccacgcgtccg

SEQ ID NO: 3903 - DNA, 2643 bp, Triticum aestivum
  Clone ID: PAT_TA_3903
cgggatacaacataaaagatcaaactactttcggctccctcttttacattctttacgtctctgtacaccacttgcacaactccattatgcaaaagagcttcactatacatacgatataatacctctgtaccaaaatgtaagatgcttttgtaggctaaactagcctagaaaaatgtcttataattttatacggagggagtattcgacagcagatgccatgtttactcaccatcactgaacgccgagaaggtgttcaaacacaaacataatctttgaccacacctcggggatggcattgacaaggcatgcagttattgtggattttctaacatagctacgcagccatgacaaacttggggaacggatgaacaatatgtacagctcagatcagatggcatccttgtagacaagaggcttgttgacccatctgatgcggcagccgcaggcttgcagcagctggagcagatcaggggataacacggtcttcaaaccactgagtatcttcagcttcttcagcctcccgcaagcggctctcaaagccatctcgaacccttgctatggaaacccatgagaggtgcaccatcgtcacggcctggaggcacctcagggagctaagcaggtggcacaagcctaggccagtaacttggcagtatgatatggtaagctgtctaaggtttagcgcatatcgggcaagagcccataggccagaatcatcgacagaatagcagcgcttcaagtcaagttctaccaggctcttacagccaatgacaacagaagaaattccgatgcctgtaatgcggaccaggcatctcagttcaaggtttgtgagctcctccagagcgcccaggtggctcaaaccactatcagttatcttgttgcagtaacaaaggttcagcagcttaattttcttgcagccgttggctaaggctgccagcccatcgtcggtgatagaactgcagcgatagaggtcaagttcaatgagctttccacactttgaactaataaaaccaaggcctttgtccgaaatacttgagctcaggcctaatttcaatatcagtagttcagagcactttgccaaatgatgcaacgcttcgtcattcactccacaatcagtgagatctatctcctttagattggggcaacagctcgcaattctctctagtcctttctcgtttattgaagagcaggactccaaccggaggcattcaagcagcttacagttgtcagctattgaatcaagggaattgtttgtgactagattgcagcatgtgagatcaattgtccttaggtagctacagcaagctacaagcgaagagatgccttcatctgtaacaccgttgcatttgcttagtccaatctcaaccaagttggtacaaccttcaccaatcgctgaaagaagagaggatgacacttcaaagccgtcaagtctcaacacggtcaaggttgccttcagtgttactaacttggatagaaaatcctgtccaatctcatgcaaactatctgcggcatatagcttctggagaaaactgtgaccatctatcagtgaagctaacccctgggaagtcacatgatcacatcttgacacatcaacactctgcaatgaattacttcctctgctaagcaattccaggccttcatcgtctatacatgagcaagcaaccatggccaactcctcaagcttctcaagtgtcgatattgatctgagggactccttgctcacctttaggtatgagatgttaaggctgcggagctcacggcacttcttcacaagcagatcgacaccgatgtcagagatttcacggcaccacttgaagctcagattctccagtctggggcaccccacggctaccttggcgagtcccatgtcagtgacgcccaggcacttttccagattcagctccctcagcccggaggccgcggccagcgcggcagcctccctatccccagcaccgacgcagtgcgacagatcgactgcctcgagcctggggcaggcggccaccagggcttccagcccgcgccaccccactccgctggcccgcgccaggcagacctgtcggacggtgccgaggtccgcgccggccaaagcggctgcaagagacgcgtcgtcgagcgaggcgcaggccgagagatcgagccgctcgagcgcagggaaggcgcggagcaggcgagggagcggctcccggcggagcacccgcagagcccggcggtgcgcggcctcggcgcgcgcgaaggcgcggctgacgaggcggcaagccttgcggtcccgccgctccagcacgcggtcgagaacctggcccagcagatccacggacagcgccccgacgccaccgccgccggtcccgccgccgtacctctgcgcctcctcctcgctcatcgcggggtcgatcggccccgtcgactcgagcggctgacgattccaccaggcaggcaggcagctcggcgccgagagggacgccaggcgagggccggcctgtcggaacgcgtggagcttaggtcgggatgaagaggaaggagaagacggcgaggtaggggtggccgccggggatcgggaggcgcggtgaggcggcggcggccctgcggggtcggtatggggcgcagcgccggacgcgtgggcggacgcgtgggcggacgcgtgggcgcacg

SEQ ID NO: 3904 - DNA, 671 bp, Triticum aestivum
  unsure (1)..(671): unsure at all n locations
  Clone ID: PAT_TA_3904
tccctcncnaggcgccctttgggtccgtccccttgcacccgctccccttcgctgttcctctcttgcggcctgcctcactactgctgctctcgccgccgagctcgcccgctgccgctgccgccgcatcatcttctcctccttgggaaccctagagcgtctactctcctggctgttcgtatcttggctcgccacaaaaaatgggcacgggtgggtaggacgaggccatggctagggtttcaggctgggcatcgccttcgtcgccggcgcggctccggtggactccggtggctcctctccgtctccttttccgtccccacgcgcggctccgcttcccgccggccatggggtgcagccttacaggggcgcatcgggctgggcatcctctgtttctgagtgcatggggcggtttgaggcgcccgcgtggccctacaactcccgccctgcaccgctgggggtgacgatgcctccgtccatgctgagagatgtgttgttgctgctgctgtaggttgacattgtgtgctcttggtgctgtagatttgattatctatagctttttaggctgttgctgctacctctgttgtatgctttgtatgttgctgttgttattgattatttgtttctaatagtctaattggagcacacaccgatggctctgttttcaatttgcagat

SEQ ID NO: 3905 - DNA, 958 bp, Triticum aestivum
  unsure (1)..(958): unsure at all n locations
  Clone ID: PAT_TA_3905
tcaaagcccagcgcgcactatttcttctccgcccagctcacccccccgctcgttcgcatcactttataaacctatctcccacactcacactcttcactgctagcttagctcgtactggaacggccagtgccagtgttctttaagtacgcagtacacgagctcgtagctctcctgggggctggaatggcgtcggagtgggaaatggccatgggcgtggagctcggcatgggaatgggctcgtaccacaacgcctccaacgtccacgccgcgcccatgggccaccaggccggcggctacgccgcggctgctcaccatttctacgggattcagcccatgcgcgacgccaacatgcgcgtggatgagcttctggacttccccaccgcgggcgcccacgacttcttccccgccgcgccggagaacgcgctccaccaccatcaacacctcggcgccggcgtgggcgagctgtcggcaacaacccgtccgccacgtcgtccgatcaccagacgtccatgctctccttcgccgacgagttctacatacctagcgaggaagccgcggagctcgaatggctatccaagttcgtggacgactcctactcggacatgccgaattactcatcggccgcgcatgcggcaatggcggcggctaacgcggcgaacaacggcggtggcagctcggctggtcaagacagctgcgtcacagcggtgccaggccgcggagcgcgaaacaagcgnngcgccnagcgccgcggccgccgccgatggaatnctcangcggaaccgccttgangcaacggcctcgtctctgttantgtcgncttccgtccnaangaaggaanactaacggtccaacnggggggcccngaaaaaaaatgaccctttccntccgngtggctgttgaagggggttcggcttcccactccctcgnaaaacccaattggaanggncctnggccaatg

SEQ ID NO: 3906 - DNA, 832 bp, Triticum aestivum
  Clone ID: PAT_TA_3906
gccgctactcgacttttattcgtactgatcactgaaaattttacgactgtgtcccagtggtttcgacaggcactgcaggtcaggtaatgcaacgacaagagctaaccgctcgccaaagtacagccggctaatcttcgcgggttttttcgcccccgtgcctccggggccgcgtcgcgcactgccgggcagctcatgccacgtcccggccctgccgatccccagcgtccagccggctctcctctgcgcgtgttagcgtgccaccgccgctgccggtgctgcctcctcctccggcgccgtgttgttggttccgcagccagggcatatgtagcgcttctggagctcctcagcgagtgtgccgcccccgctccccgcgccgcctcctcctgctccggcgccatgttgttggttccgcagccagggcatatgtagcgcttctggagctcctcagcgagtgaattgtgcacgttctccagttcagccacgcgcttgcgtcgagtcaaggaaacatataataatagttgcgcaaacgaagtgatttctagacaggtgaaaaggatatcctccgatctcctgcaactttttcgtctctttcatcacagcctccataagagctctctttgctcggacatcagccagttcatgacgcagcttttcaagttcaagcaggtccttctgatactcttcctccaatacatgcacctcagcattcatcttgttcatctgatcagccgaatctgtcaacataccttctgagtccatagtttcattcatgtcactcacattttgaccctctgctgacttgccttgcttaccatctgctgcggacgcgtgg

SEQ ID NO: 3907 - DNA, 580 bp, Triticum aestivum
  Clone ID: PAT_TA_3907
tagtccattgttcattcgatttcacaggccatggagttggtgaagttgtccctccttcgtcaacttggttagaggtccaagttcgagggacctgacgagaaagaggacaaggaccaccgggaaccaagacctccatatagccatggcaatagccgcaccttccccttccacaaggtgtagtaggtgttcatggaaaaagacagaaatttttaggagatgaggagttactgaaacattggctgcagtgcaaggcctcaatgtggccaaatcaactcaatggtatgttgtgctgggcactcaatcattatgtgaagagttgtgagtttgcactgctactatttgaagaaactgtaaattttgagactttagttgctagggacggaaagctggatgtctggtgtatgtttagtacaggtagaaattttctaccctaccacttgttgtcgtacatgctggttctagttcatgtgttggatgcctcagacctagttacataatgatacgtctccaacgtatctacttttccaaacacttttgcccttgttttaaaaaaaaaaaaaaaaaaaaaaaaaaaaaaaaa

SEQ ID NO: 3908 - DNA, 492 bp, Triticum aestivum
  Clone ID: PAT_TA_3908
tcccccgtcactcctcctacgtcctctgcaggagaagaagtgttatctctgggctcggactatgttgacagccatcttggccagcaagaggatgctcacctgcttcgtcttcctcaccagtcggctcttattaaccaatgatgatgtatcttcaagggcagactgtgaacaagtactacaaagaggatatctctaaatcaagtcgcacgcccactagagaaaaccacaggttggtttgcacaaggtgctgtagttttcaagatatatcatgtgctcaaatgtttgaaccaaaggcttatgttgtgtgccgaaagaatcctgagaaattttagatggctcaagctcaaggcatcactcaaaacagagtaagagaataagctgggaatggtgcagtggtatgaaattaaaaagaaactgaatataaagttgaagaggtggagccaagcatgttggcctgcagtcatgctctagtttatttacagacatcaaaaa

SEQ ID NO: 3909 - DNA, 763 bp, Triticum aestivum
  unsure (1)..(763): unsure at all n locations
  Clone ID: PAT_TA_3909
cttaagttccaatcatcacgtgaagccacaaatattgagtatcttttagtagcagccggccaaagccatatgtacctgattaatgaggatccgtaccttctctgccatgaacatggctctgttctggattcgtcggagattgggctgctcgatttaacatctccgtcggctgctgggagttgggaaatcctgaatccgatggcgaggactcagattcaacatccaaattagggtatccaatgcatttccatacagagactcgcatctttcttcatcgctctcgatcagcgtctctgcaaccggagctactatgaagttacggtgggaggagccaccatgatagatactcgcatcccgtcgagagctccaattgttgttcttcatgtggccaacagaagattggtttttgggagaaacggagcatgatttgttgaatcggaaagggcttggatgaatcatggaggagtactgatgtagattagggaaggcacggagcaagatgaatcatggaggataattgatgtagattagggaaggcacggagcganagattgtttgaagatcttggtgcatagggtatgtgtccncctattcttttttgttgacancaagggnccgcctattctttttattagnctataaaaaaaaacctattctttttattgtgggacgactatgncttttttcaatcatgagaatcgtagaaacagaattgagagaattatttgtgattcctggtgcaaacgggaaccatgtggtttat

SEQ ID NO: 3910 - DNA, 1791 bp, Triticum aestivum
  Clone ID: PAT_TA_3910
cccctaggggctttttttttttttttttgtttttttttttttttttttggtgatccaaaataacattaaaagcttaactcagtcatggacatagttcgataatttaaaaccaagagaagcactgaatagaactagagctactgcccaacagtcaaagtactactagatacgacccatcttacaaacaaggacacctatacgataactcatgacgcggtagcattcagttcatgcagctctgaatctctgattgcgctccatcgcctcaatggtcactgctgtgggggctgctgctgttgctgctgtggtggctgctgctgtggaggttgctgctgctgagatggctgctgttgctgctcgtaactgccataaccagagtatccatagttttgcatgctaggatcttgcgcattgggtgcaccatagtatgcatcaggaaccctgttgatatccatagtagctgttgccattaccctggtttgcatcctgctggggaggctgtttgttttggctacggccccatgaaagacgaacattggaactaccaatctgagacccattcagcgcactgatggcctgctcagcgcacgccctgctggtaaattggacaaatccacctgctggtaaattggacaaatccacaacgcttgcctacaggaatcttcacaaaaaccaacttcgccatatggagtaaaaacttggaatctaacccgcccacaaagattgtagtattgttgggatcattcgccgcctcatttacttgagagctctggtacccattagttgaatatgtctgctgagtacccatattcttcttgttagctgcaggcccaatcctcatttgtcttgtagacaatggcactccattcatctcagtcatagcacgtgtctgctcatttagatctccaaaacgtacaaaaccatatcctttggagcgaccagtggccctgtcagtaacaacattagcacctttaactgatgggtaggtggctttgaatatctcttccaacatggcgtcagtaacatcagcagccaaatcaccaacaaatattgtgtgatcagaaccatcgtcaccccgcttgtcaccagcactacaagaagcccagtttagcttgaaaacttgttcaacattaggcatcatctgcccattaaaggtcccaagagcatattccgcagcagctcgagattgaaattcaataaaaccataaccctcgggctgcccagtatgtttgttgcggataattttcactgaggtgacctgctgcggccccacaggcgcaaaggcgttgtagaggtaggtctcatccatccagtactggagatctccgatccacagcgacctgatatcctcgcctccgggaggcggcccgccagccatctgcgctccgtactgcggcggcggcggcgcgtaatgctgcggcggcggcgcgtactgctgaggaggctgaggcgcgtactgcggcggcgggggcgcgtactgcggaggcatatgctgctgcggatggccccacatcgccggcgggggtccctgctggtagtactgcggcggcgcctggtagtactgcggcggcgggggggcctgctgcagaggaggcggcggagccccagaggcctgcggctgaggcgcgtgctggccgttcattggcggctggtatgttggctgcatcgcgacgtatcgccgcctccccggttccggcggcggctgatgcggatgcgaaaccctaaagcccgggcgggcgcggggaaaaacagagggaggggcaggggtagatgcggtcggacgcggggtcg

SEQ ID NO: 3911 - DNA, 604 bp, Triticum aestivum
  Clone ID: PAT_TA_3911
gccgccccccccgccccggagccccgccccgggccgggcctccgcgcccggcgccccccgccggccggcccccacgggacgccgccaccgtcgcctctttggctgcccccccccccgccgccgcctggcctctcgccgcccgccgcctccagccctctgtccggcttcgggccccctccgaccggcttcggccctcccgcgagtggcttccgccccccggctgggtcccgccccccctcggcgcgccgcccgccggcgcccttctaccggggcggggccgccgggccaagcgccaccctcgcgccttacggcatcgggtgccgccacgtcgcctctttggctgcctccactcttgtgtccgccgttgttcttgccgtcctcgtcgcgtcgcccgatctgatgtaaattatgtgtgtgaatttgaattagctatagagagatcacgcgcgttcttgccgtcctcgtcgcgtcgccggtcgggtgtcaccctgtcgcccgacaactccatagtaacgtgcagcagcgttgtaaaatactacaatcagaacaatattgtaatacgatatactagtacagtgggcataccgattacattgctcagatc

SEQ ID NO: 3912 - DNA, 842 bp, Triticum aestivum
  Clone ID: PAT_TA_3912
ccacgcgtccgcgatgccgatgccgatgcccccgcccctcccgcccctcccccgcctgctcctcctcctgtttctcgcccctctcctcgcaacgcccaccacgatcccgctctaccgccacctcccgccgctcccgcccgccgccgcgcagcaccacccgctctcccgcctcgcccaggcctccctcgcgcgcgcctcccgcctcagagccggccacggtcaccaccaaggccaaggccaagcctcctcccccgtgcgcgccgcgctgtacccgcactcctacggcggatacgccttctccctctccctcggcacgccgccgcagccgctgccggtgctgctcgacacgggcagccacctcacctgggtgccctgcacctccaactaccagtgccagaactgctccctcgccgccgccggctccttccccgtcttccaccccaagagctcctcctcctccctcgtcgtctcctgcagcagcccctcctgcctctggatccactccaggtcccacctctccgactgcgcccgcagctccgccccctgcaggcccagcaccgccaactgctccgccaccgccaagaacgtctgcccgccctacctcgtcgtctacggctccggctccaccgcggggctcctcgtctccgacacgctgcgcatgtcgccacggggcgccgccaggcgcaacttcgccgtgggctgcagcctcgcgtccgtgcaccagccgccgtcggggctcgcggggttcggccgcggcgcgccgtccgtgccggcgcagctcggggtcaccaagttctcctactgcctcctctcccgccacttcgacgacgacgccaccgtca

SEQ ID NO: 3913 - DNA, 719 bp, Triticum aestivum
  Clone ID: PAT_TA_3913
gcggggttgaagtgcaaaattccctggctaagtcatttatatgagtgtgacttggggcgttgggtggttatgaagatttcaataacatctattcaataatcaaatgtaatgcatatgcgactcgtgagtagacaagcataatgtgggattgaataatgcttgccttttctgacttctgttacttctatttgtttttgtttatctagtattgaaatgattaggtgagaataaatggaggcaaaatttactttttttggtttgggccattgcttgaactgaaccttcatcagtgatttcagacttgcacattattgtgcatgctagatctccagacaccatctaatagatcctgctctgttctgtttaggtctgtgttcttggttatgttttgcttgctagttttcttagctttctggttccttccttttggtttgtctcgtaagcctgctagttttttgtagatagctttttcgttgcttgtagcgttttcgggtttgtccttcacgtcattttgatgctgtcaatgcaaaatagcatggattttgacgtgtgttctagaaaaagaacttgcattttattttactcattttgtgtggaaaactcgcttgttcgggacttaaaaatcacttgcatagtgatggattggttattaagttggtgaggtagtgctccatgtacaagttgtatagcctcttggatgatgatgcatggatgatacg

SEQ ID NO: 3914 - DNA, 1884 bp, Triticum aestivum
  Clone ID: PAT_TA_3914
ggcacgaggagttcttaacccatgggagaggaatgaaaaccacacactgtgcctcaactctgcaaaggccattggatgtactgttgttaacattggcacccagtttttagtggaaggaaggcctcatttagttcttggattaatatctcaaatcataaagattcaacttttggctgatcttaatcttaagaagacaccccagcttgtggaattgtttgatgacagtaaggatatagatgaggtgttgagcttgtcaacagaaaagatggtgcctcgacagatgctccacctgcagaaaacgggaaccacgccaccccaggtgctcaacctgcagaaaacgggaacgacgccacatgatcctgatggttatattttcctccgtagccctgtccatcaattagctttatatacaagggttggtaccaaaagttgctgctgctaccagaagtgaatttttctcagaattttcaggtagcataataggtacacacaatcatacagatagatcgtagccgccgtttgttcattaagttaaattttgctgaatagcaagtactatacgggagaaagagagacatatacagacacatacatatagtaggccgccggttggttgatgttctagtatccagagaagaaagggccttccgaatgtggatcaacagccttggggtcgagtcatacctgaataatgtttttgaagatgttcgcaatggatgggtacttcttgaagtacttgacaaagtttctcctggatctgtcaattggaagttggaatcaaaacctccaattaaattgccatttaggaaactggagaactgcaatcaagttgtcaaaattgggaaggagttaaagttttcattagtaaatttagctgggaatgatattgttcagggaaataagaaattgatagttgcacttctgtggcaattgatgagatttaatatccttcaattgctaaacagactgagatcccactccaaaggatcccaaggaaagcaaattactgatgcagatatactgaactgggcaaacagcaaagtgaaagcatcaggaagaacatctcgaatggaaagcttcaaggataagagcttatcaaatggagtgttcttcctcgaacttcttagtgcagttcagccaagggttgtgaactggaaagtagttacaaagggagaagctgacgaggaaaagaagctaaatgctacctacatcattagtgttgcaagaaagctcggatgttctgtgtttctactgccagaggacatcatagaggtgaaccagaagatgatcctaactcttacagctagcatcatgtattggagcctgctgagacaaccacagcctgaaatatcagaagcatcagagccatccagcatggcttcggacgcaacttccgacattggctcggaggatggtgcctcaacagcggcaccgtccgagagcgaagaggcaaactcactgtccgacagtctatccaccctgaccacagacgacgccacctcaaatgctccacctgcagaaaacgggaacggcgccaccccagatgctccacctgcagaaaacgggaacgacgccaccccagatgctcaacctgcagaaaacgggaacgccgccaccccagatgccccacctgcagaaaatgggaacgatgccacatgatcctgatggttatatgttcgtccgtagcgctgtccatcattagcttcatatacaagggttggtacccaaagttgctgctgctaccagaagtgaaattttctcctgcttttcaggtactagcataatagctcggtgccgaattccctgcagatcgtagccaccgtttgttcattaaattaaattttgctgaatactagtaagtactaaaaaaaaaaaaaaaaaact

SEQ ID NO: 3915 - DNA, 1000 bp, Triticum aestivum
  Clone ID: PAT_TA_3915
ttccgccaccccgtcccgctcccctttcttcctccaacccgagccgccgccccccgccctcccctcggcgctgtcttctatctcacctcccgtgatctctgccgtcccacctcccccgattcatcttcagatcgaggcttccggaggctgcatcgagagtagcaccgccacgcccaactccgctcccttccggtgctaatccatgctcagcagatctggtcgcgaaaaggacggcgccccaccgcccctgctggatccgccgagccagcggccggatctatcgagatgcgccgggatcccgagccttgttcctccccaccttctcctccgtcgacagtaggcagcagagcaaggcgcgggcgactgctccggccagaggagggcgtgaggtgcgacgcggcctcactggggcgtgactccgtcagccagcaccggcgcccaacctgggatccaccgaaccccaggcgcggcctacggcgggcgtgcggttttgagttcaacaggagagctcgcacgagattgagcgctgctcccgtcttccagcgaacccaaaagagagcagaggaggagatgacccagggcggtgctccgccggtcggcaccgaccgcggggggccctcctccggcgtcggcctcgggctgcccgtcgcctgcgtgggcggcggccagcccgccgtcgccacggcaccacgccctcctacgtctccaccatcagagacgccgccaggaaccaggtcgcaatgaactccaccaacaccgtcttctgttcgccacagttgagtattggagatcgtgtgtgattgaaacatcatttacattgatcttggcgaggacaacacatggcttgctggtcttaagcatattttgtctcatgcggccctttctcttattttgtcttgggctgtctgggttctccctgctgccggtgtcggtctttttgtcgtcggctggtggcctctgcgttgctcttgttggttcaattgtgtcttaatgaacctta

SEQ ID NO: 3916 - DNA, 1259 bp, Triticum aestivum
  unsure (1)..(1259): unsure at all n locations
  Clone ID: PAT_TA_3916
ctcttattctgattagcctatcattaaagttggaaacaccagaattgacgcttgcgcatgagtgcgtacaggttgtccttgggattttcttctttgcaaactcgattgattgttgatacggtttcctaggctattgttctttgtacaatacatgaagcaatctgctcatgtgtgtgacttagtctgattattaggctttaaaatttctgctggtttatcttataattcatggtagcatttgatttttttatcaattaccatgtctcagttgtagaacaggacagtaagagtctaataaaactcttgcacaacaaagattgccatcctttagttacccagacctttgttttcgtggtataaaacccactgctgtcaaactttttctttttgaaacggactgctatcaactttagtactctcgaaaatcatataactattttgaaatttcctatgacataggccaagacaagcatcgtaaggatccagttagaatgatgactgatatcctgttagagcatcttgggcttcacaaggccatctgagactcgggctcaatgagaacacgatgaggtacatagagaactccagaaacactatagtgaaggatctaaactatgacaggctgagcagaatgcagaaagacttttgcttatccgagactcgggatcgatgaggcatttgacatgataaacaagtgccaaaggttacttgtatgatctgagatacatgagctccttctcagaccagcttcataatgtgatagcacatggctttcctcctgcccgtgccgtggatacattgacaaacgtgacccttatgaatattgaagtggtggcacataaccttgagagcagaagcaatcatctgttgaagaggctgcatgccataaaaagacactctttaggcgcaacagcatgaggtgtttgcaccaattgatttcttcacaccaaggccatggcgttgatcatctatggacatcccagatcatctattctaactctggcaagtacgagatgatatatgatgccaccagctcctgtgatgtaccgtgcaaactactgtgtgatctccctctccttttgtgaacacgtccccttcggcacgtctattcgtacttttgcactcaatatttatgtgtatgaacattgcatcctttaatttcccctgtatatgaacattacatccttcnaaatgtggtgtactatattttggtacccatggatgatgtcttgcttcgattccataaaaaaaaaaaaaaa

SEQ ID NO: 3917 - DNA, 880 bp, Triticum aestivum
  Clone ID: PAT_TA_3917
ctaacggttgcgttctttcaattcaggaatgtatagagagcatgggctatgaccttgcttggcttaaggagttagatggtgtctattttgagatttggcggcgggtcactcagggaatgagtttcaaagatgctctggcagaggtttgtcatctcaaccgggttcccgttacatcaacctagaatggaacgtgccctggagtttgatgaagcgatggaggagatggaagaagagttccgtatctgcacggcagccattaccccagaagttaaagaggataaagctcgggagttgattgcaggggcggttaaagagctgcttgatgatacgccgaagtcctatgagcagtatatcataaagaagatgcacattgcccgagttgttggaatccttcctgacaagaggattgaagattctcaagaatgagataaccgtcaaacaagtgtttgttaaaaagctgcttgataagccgaagtcctatgagcagtatatcagaaaagaagatacacattgcccgagctgttggaatccttcctccacatgattgaagcaacagtgttaagattgtgaagaatgagataatggtcaaacaagtgttgattgttgtcagattatgaaattggaccatcaatggtgacccctacttccaagttttcaagttggtcgtctactccaatagcttagcatgaaatttatagattttttttggtgaatccaagtttcacactgaggtgtaggacaaccagtattatcaaggggtgtacaagcaaaacaactttggtttgaactctaaaacaagatcataaaccaaattgttcagaacacaatttcacccaaaagagaatttaactctagagatttaaaaaaaaaaaaaaaaaaa

SEQ ID NO: 3918 - DNA, 534 bp, Triticum aestivum
  unsure (1)..(534): unsure at all n locations
  Clone ID: PAT_TA_3918
cgactcttctcctccggcgtcagtgcctaccccaagtatcccctcctcaccgacccaaacgagcagagctccccgcccgcgatcccccgccgccggcagccatgtccaaccccgaatcgagcccccaagccgccgcgtcgtccacctcgcctccctcccacgccggccacatccacaccccgctctgccgctcctgcggcgcgcccgccgcggcgcccgccccagccccctggacgggggattccccgccgcccgcctaccgccccatccgcatgccggccatcaacgcgcccaccaacaccgctgccatcgtcctctccccggtcccgcagcccctgccggtgccgcccgccttgccgcccttcgccttctaaggcccccgccaagcgaatcgcgtcccccgacgacatcgcgcgcttcaaggactcaaccacgggcgccactcccgcggattcctcgcctcgctcgcgcctggcgccgtcgcgcaggtccctccatcnccccgctgtccggcctcntaattattcggntntt

SEQ ID NO: 3919 - DNA, 725 bp, Triticum aestivum
  unsure (1)..(725): unsure at all n locations
  Clone ID: PAT_TA_3919
ggtcttcccttcagtgcgttaaacaagttaggagtgccagggttgggcgcggtaactaccggacaagtctatgatcgacattttaaggacagggacacgggcacctttaaagactttcatcttgcatatgtcgaattctgcaagtatttcaacactgtgttgcctggccaagattttgatactccggaccgtggtgatctagaggcattccataaaaaatgggcagtggcggacgagcccggaaggaggaagatgttcatcgagtatatgcaggaaaacgtccacgaggccaaagttgacgacagcctcttcatcatggccggcctggctgcgccagcggcagccatcatcgccaagaagagcggcgagagcatcccgcaggtcaagaagttcaaggtgcatctaatccccaacgtcatctttgtgccggtgtgcacgctggttgccatcatgggtgccactgcagttcagatgagcaagaagagcaaagacaacaacaagcctacgagctgatccgtcttgtcctgtcgcagttaaataagatgatgtataacaagaaactggaaccatatatcatcaaatgattgtataaatatctagatcaatcatgggtaatataagtccttgggtctctgcaaagaanaacaattgaaaacagttgnaattgaattgttccaagtaaancattcnattcttggtctanaaaaatnaagtcgacgtaatng

SEQ ID NO: 3920 - DNA, 538 bp, Triticum aestivum
  Clone ID: PAT_TA_3920
cccagggtcctcccccgaccatggcaaccctagcgtcgcgccgccgccgccgcagttccccggccaccactgcaacctcgccatctcctcgcccccctcgtcatccccggccaaattctcacccctgcaacctcgccatctcctcgccccctcctcatccaaggcagctttctgttcggcgataactttgggggcatacgggttgtgtggacctctggcggctgagatcaccagggcctcgtcctcgtccccggcagctcggattcgtcgtttgcaaggtcggcacccacgcctacgtcacatacagcaagaatgtctgccgattggagtgacgataacactacgatcttgaccgagctctttgtccaacaagtgcgtgctggcaataggccagacaagcacttgactcaaaatgcttatgaggaagttgcgaaggattttaaagtcagaacaggcctggagtacaccaggctccaactaaagaacaagtgggataagttgaagactgattacagcaatttcagaaaactcaaattga

SEQ ID NO: 3921 - DNA, 943 bp, Triticum aestivum
  Clone ID: PAT_TA_3921
caagggccaacgcgcccgcgtcacatatcaggcagccgcccgccgcccccccagcgacgccagcgcccctccgcgccaaccaccaccccatccatcccccccccagcactccctttacacttcgagcggccgccgcgggcaggccggcgtggtggtgtgcctccgcagttcatccacccaccagcgccatccatcaccagcaccaacacccagcgctaccatcacctcctgccgctagcgccaccatcacctcctgccgctagcgccaccaccacctcgcgcgccctgcaatccatctccctgctgctcctccacctttcttcttgtcctaactctactgctgctcttcttctttttccctagcctctttgctgctcttccttctccaaatccccaaactgcttctcctcttccttacacgcctacctgctgttcttcttctcctatcttgcgtgcaccacctactggatgctccttgcgctccaagcgtccccctgcctgtctccttaacttgctgctgcttcctccttcctcccttctgctggctgcttgcactttctctgaaatcccgaatccttcctgcctcttcttgctccttctcacttctgttcaaactgctgctgcttgccctcatccctctctgctgcttctctctcccggatgccactgctgctacctgttcctaagctcgcctgctgctgctgctgttcttcttcttatctccaagtcactgctgatccttcccacgcccaagttgctgctcctctctcttgcaacacctattgctgttcttcttcttctcctaacctgctgttcttcttcttctcctaaccttgctgctgtacttttctgaaccatcttgctactgttattccctctcttgatctcaaatttctgtaattttgagaagtttattgttcagtactttgtaatattcagcatt

SEQ ID NO: 3922 - DNA, 593 bp, Triticum aestivum
  Clone ID: PAT_TA_3922
gaattcggcacgagaaaagtcgtacgggcccaagctctggccatggcctccgccggcgagcacacggtgcccctgctcgaccgcccaccccccgaggcagcggaggcatacaccaccgacgggtctcttgatttcgacgggaacccggcgctgaagaatcggacgggtggatggcgcgcatgccgcgcagtcctcggtaatttgtttcttgttccgattgagatttcaacggtaatttggttccggccgcatcttgtgcgtgcaggtgccgacttctgctactgcctggccttccacggcatctcctacaacctcgtcacctacctcacggccgtcctgggccagagcaacgtcgtcgccgcgaggagcgtctccagctggaagggcacctgctaccttactcccctcgccggcgccgtcgtcgccgactcctactggggaaggtaccgcaccatggtcgtctcctgctccgtcggtgtcgcaggcgggcccttcccaccactctccgcctccccaccgctgctcctctcggtcccagagtctgaatctccatgtcatgtcccagtggagcaattcagaatatcgttctgact

SEQ ID NO: 3923 - DNA, 988 bp, Triticum aestivum
  unsure (1)..(988): unsure at all n locations
  Clone ID: PAT_TA_3923
ccccgccgtccccgggcgatggctggccctgtcgccagtggtagaggcagccgagctgggtgcgacaagcggtagccttggggggtcacggcggtctgcggcaactccgggtaatggctggcggtgttccccttcgtcgccatgcaaggagaggaggggctcatgcactgcatctgcggcgccggcggtgatccccatcgtcgccgtttcgacaggagcccccttcggctccggcggcaatccccttggtcgccgtgcgagaggagtctccttcggctccggcggcgatccaacaagggacatccatggtggggttggcacccgcgccctgctcgcgccggcccgcgcctgcccgccttccatcctcggcctccggccccgtcgggtccgccacgcacaaccatgaagcgcagggtctggcgtggcttcctgcatcgacggccgtcggccgctcggcctccagcgcccgccgccggcggcgctgtctgccctcgcccacgggcgctcgcgaacaggagctgcggctgctcctgtggtatgcatgctatcgccgccttttgtgattgcttctgtttttccccctacagcagctgcggcggctcccgtgtggtgattggtctaagtggctatggggaccgaggccccgatgcgtccaggcgatggttggcaacgcgctcggagggtggcgcgccgtcgccgccatgtggcctgggtccgtgctcgtggaagacgacatccacaaggcccgggtgtctgtggcgctgcgcctttcggccccgaccacgcagcgtcaggaaatatgttttgaaggtgagcaatgcttggatccctatgtggctccctctaaatgcttcctgaccatcctatgcgtgaatgcctacaattaccaaccacccatgcatgaatgcctcaaattattagcatacaattttttgtncnctaagaatcatgtcaatgatttcacaacttttacagtatgtttttacaa

SEQ ID NO: 3924 - DNA, 560 bp, Triticum aestivum
  Clone ID: PAT_TA_3924
cgtccggcctgtccccctccctcctccttcctggacccaaggccagatcagatcagctcaggccgcctccgcttcccgaccccagttccaatttcgattcccaccgatacgcccgcccctcgggaccgaggaggaggaggaggatggcgatcgtgtacgcgctcgtggcgcggggcacggtcgtgctggccgagttcgccgccgtctcgggcaacgccggcgccgtcgcccgtcgcctcctcgagaagctcccctccgaggccgaggcgcgcctcggcgccgcgcaggaccgctacatcttccacgtcctccgctcccccgccgacggctctcaccttcctctgaatggccaacgacaccttcggacggagagttcccttcatttatctcgaggacatccagatgaggttcatgaagaactatggcagggtcgcccattccgcgctggcctatgccatgaacgacgagtttgccagggtgctccaccagcaaatggagttcttctccagtaaccccagcgccgacacgctcaaccgcctccggggcgaagtcagcgagat

SEQ ID NO: 3925 - DNA, 732 bp, Triticum aestivum
  unsure (1)..(732): unsure at all n locations
  Clone ID: PAT_TA_3925
tatagcatggatacaagtacaacgacaaggggagttcacactcgagttcttggaacaaattacagataatttttccgcgcggcccgtcatcggtcgtggtgggtatggagtggtttacaagggagtactggaaaatggggaagagatcgctctcaaaaagcttcatcacgtgcccgggcttgatgacacgcaatttatgaatgagtttaatcaccttatgagggcccaacatccaaatattacccggttggttggctactgctatgatacaggacatcaacgcattaagctcggcggtgactatgtgtttgcccttgtggatgaaagagttctctgctttgaatacttgcagggtggaagccttgacaagcatatttccgatgaatcctgcggactcgattggcacacacgtttcaaaattattaanngagtctgtgatggattagattaccttcataatggatgcaaagatcctatttaccaccttgacttgaaacctgcgaacatattgctggacaaggacatggtcccaaaaattggagattttggtctgtcaagactctttccttcaacaaaaacttatgtcacaatcaaaattataggaacaccgtaagttgattcatcatgataaacaatcaagtttctttttaaaatacatnaagagaataattgtgtattacatatacacaccatgcagtggatacatgccancanaanacatagagagatatn

SEQ ID NO: 3926 - DNA, 663 bp, Triticum aestivum
  Clone ID: PAT_TA_3926
gatccgccagctcgaaattaaccctactaaagggaacaaaagctggagctccaccgcggtggcggccgctctagaactagtggatcccccgggctgcaggaattcggcaccagagcgagccaacccccacatcacagccgcagcctcctccttcctgatccaccggccagccgcccctggtctccctcgcccttcaagcccgtccaaaccagtgggccccacgcctccctccgcgctatccaggaatagcgctcgcccgcctccatgctcgttttggttcgggagaggatctcccgaccgtgcctcccacgttgccgcctgctcgccggacgaccagcgctgctgccggcgaccaccaccaggaacagcgccgccccgccttccttccattcttctccttttccttcgtcgctcatctcgtttctgacctcacagagacctccaagggagcccgccatggtgtccagggggctttaagcaccagcagctgccggttcggatccgtcctcctcgaccctgccatcaccttccttcgctgccctggcccgttcccggccggttctcgccgacgactcaccgcctggacccgctcgtctctgtcgccgcggcagctctgaacctcgcgcctcgctgcagtgtttgttcttcagagacgagagcaga

SEQ ID NO: 3927 - DNA, 563 bp, Triticum aestivum
  Clone ID: PAT_TA_3927
tgggatgacatgggcagtgcaaaggatgaatcccaaaatgggctggatggatcatacaaggagttgtaccaaagagaaaatcctcatggtgatgcagatgaacacatgctggagatgatcgggagtgaatgggagggtctgaacagggaatgcttctctgggacaaagtcaacactatcgcatagcttcatcacagcatcactaaactttgcgaggatggtccgcgtcatgtatggctacgacgatgagcaaaagctccccgtccttgaggattacacaaggatgttgctcttctaaatcatgcattctatcacattgtatatatgtcttaatgtagtgcatcagttatttggtaaggttgccatctaggatgttgactagcatcctgcaccattaccatatgtgtttcaagtataaagacgataaatatacccgaagacaacctacaactacataaagaaaaggcatgcagcctctgttgcatttgttctcgcaggcaccggcccctgcgaaatactttgtatatgaaattgtgaatgtatgaaaagattgttggtttgtgc

SEQ ID NO: 3928 - DNA, 1234 bp, Triticum aestivum
  unsure (1)..(1234): unsure at all n locations
  Clone ID: PAT_TA_3928
cggtcgtccccccgtcccctggtcccaatcctagtttcctttcgattgcatcggcagggtagtgaggaaccccgaaccctagcgtccgatcccaaagcgagggcctccttttttgcggggtgattggattggagcagatgtcgtcggatcctcggaaccctaatcctcctcctcctccacctcccggttcttcgtcatccgcgcttccggcggggggcagctatttcccgctccctttccacctgcagcagcagcagccggtggcgacctaccagtaccagcagctgcagcaagcgcagcagctcttccagcgggacgcgcagaccatcacccccgaggcgctcgagagcgtcaaggccgccctcgccaccagcgacgtcctcgacccctctgctgccagggcctccgcctcctcctccgacgctgccgccaagaagaagacaatccctcgtcgtgcagccggacagtcctgggaggatcctaccctcaccgagtggcccgaaaatgactacaggttgttttgtggagatctaggtaacgaagttaatgacgatgttctctcaaaagccttttcgcggttcccctccttcaatatggcaaaggttgttagagataagaggactggcaaaacaaaaggttatggattcgtcagtttttcaaaccctacagaccttgctgcagcaataaaagaaatgaatggaaagtatgttgggaatcgccctattaaattgcgtaagagcaattggaaggagaggacagatgtcgaggctctacaaagacaaaagaatcatattcagaagaaacctaaaacacaaaagaagggtattcttcacaagtaaagctctattgggttgtaccgggctgagccctgtagaacaagacttgctcctttggataaaggacatctgaaaagtatagtggctgggcaccggtcaatgcgtgcaaggatgatactatacctattgaattgtaacgcttactaagcaatgttccatctgggtgacaggcatatttttacatttgcaagagttacaacgagtatttataatcagcgttgttttgttgcaacgatgtcattgtattgcaacatagaggttaggcactgttccttttttgaaagaattttcagacctgcaaattcgaacctttgatcaaccaaacaaatgtggaatataagattatacccccggnccgaantcccggaacaactccntgccgaattcggacgagggag

SEQ ID NO: 3929 - DNA, 659 bp, Triticum aestivum
  Clone ID: PAT_TA_3929
ggagcggcggaaggagggaagggggacaggggggggagcgacagagcagaggcgaaggggggggagggggagatggggttcatgctgcgggtgaggctggcctccttcttcgcgggcgcggccgccgcggcggccggcggcagctacttcctctacaaggactacaagctcgcccacgactccacggccctcaaggtgaaaggtctccacgaccatgtggacgcccgttacaaggctctcgacaagcgacttgcagctctggaagcccagaaaagcaccgactcctctccggctgtggacgcgccatcgggctagtcgtccgtctgtggacgcgccattgggctagtcgtccgtctgtccatcacgaggcttgacaagtggatgattcaaagtttgtttacttttaacatgcgcgcgctatctgcttctcctttgaaggtcaaggggcctgtgactgacagcgaaataatctagccaatggtttttattttgttgtttgggcaagaagaaccttgttttttgttgaatgatgatgggcatacatcagatcctttgcacaccatctcaaacctaaaaaaacaaccctagacctctcccctgccttttacattgaacaaatcgttattagcccctcactcgccggggagggaaaaaaaaaa

SEQ ID NO: 3930 - DNA, 1171 bp, Triticum aestivum
  Clone ID: PAT_TA_3930
gaattcggcacgagggctgcggctgcaacgcacacacaaaaatccctcccgtgccccgtggccatggcgctggtctcgctctcgctctcgcccccgtgcgcgcccgccgcctcctcgtcttccagccacctcctcacgccgccgtcgctcgccggcggcagcggtagcatcaggaggggagggccacggggcaacgccggcctcgctctgacgctgccggccgggcgtcggggtcgggagtggagggcgccggtgtcgtccttctcctccttcctgccgtccttcttcacggggagcaagaagaaggaggaggaggacgccaagaaggcggcgacgctcaaggaggagctgctggcggccatcgcgccgctcgaccgcggcgccgaggccacgcccgaggacaaggaccgcgtcgaccagatcgcgcagcagctggaggaggtgaacccgaccaaggagccgctcaagtccgagctcctcaacggcaagtgggagctcctctacaccacctccacatccattctccagccacagaggccaaagtttctgaggccatacgggatgatttaccaagcgatcaacaccgacacgttacgagctcaaaacatggagacactgccttactttaatcaggttactgccaacttggtgcctctcaactctagaaaagtggcagttaggtttgattacttcaaaatatttagcctgatccaaatcaaagcacctggaagtggcaaaggtgaactagagatcacatatcttgatgaagacctcagggtttccatgaggcgacaaggggaacttgttccgtgctgaagatggccgacccattataccgagttccgttgtaataatagtagttaaatgcctacaagaatcaggtgtcaactatctagctaaatgctagtgtctacgagaatcaggtgtcaactatccagaatgttctttttcccgtcctgaggcgatacagggtgtgtaaatattgttgtttgagcttagtctatacagcacatagcacatttgaactggcagcactcacatgtgtccatgacgaaatgggtatatgtgtgtgtgtgtgtgtgtgtgtgtgtgtgtgtgtttggtcctaaactcctattcttcttcgctgttgaagctcagtaaatgcgtttggattgcaactcctaaaacc

SEQ ID NO: 3931 - DNA, 2061 bp, Triticum aestivum
  unsure (1)..(2061): unsure at all n locations
  Clone ID: PAT_TA_3931
cccgggccacgcgcccccgctctcccaaaagttcttcttgttccgcaaaccacacgaagaaaaaaaagcaaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgccgttggtctcccaagtgacgacgacatgggcaacagtgaagttggccacaatgctcttggagctggccgaatctttgctcaaggtgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggtttcgtagagacaattgagaaagatcttgctcagcttcgtgagcagggtgttgatgcacggattgcatctggtggtggaaggatgtatgttaccatggaccgctacgagaatgactggagtgtggtcaagcgaggtgggagcccaggtacttggagaagcaccaccaaagtccaaaatgcacttgaagctgtgaaaaagtctaagtggaaaatgccgaaggccaatggatacgtatttgccgccctttgtgatagttgatgagagtggcaaatcggttggtcctatagtagacagtgatggcatgtcgtgacttgctattgcttgaacggatcgcatggatatgcttgcgaaagccttgaattccctggagcaagatagtggtctcgttcttgtcacagctattaattgcgctgggaggctttaatatgatggtgagttgaagcttccaacgcaagtaccttgtttccccaccgttgattgagaggacacctggtgaatacttggtgaagcatggtgtccgcaccttcgcttgcagtgacacagttaagtttggccatgtcacatttttctggtgatggaaaccgttcgggatactttgacgagaccatggaaggagtatgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggcagcatccagattcttacatcgcacacgcttcagccagtccctgttgctatcggaggccctggtctccacccaggagtgagattccgctccgacatccagacacccgggctcgccaacgtcgccgccaccgtgatgaacctccatggcttccaggctcctgctgattacgagacgaccctcatcgaagtcattgacaagtaaaaaaaaaaacactgcgccctctgaagccaaaattgctgcagccgattttgtcgctatagttttggggtgggtcaaggaatgatcgcatcattgaataatttgagatttgccagcacgcttgctcgaactcatatgtaacattgagaaaggtggattttacttgcagttagctctattttgtaatttggggtattgccatgctggtttgcttaacataccgatagcgatttttgctcagccacggctcgtcgacgcggccgcgaccgntnccactannctgaaaacccnttcacngtaacaaggcccc

SEQ ID NO: 3932 - DNA, 610 bp, Triticum aestivum
  unsure (1)..(610): unsure at all n locations
  Clone ID: PAT_TA_3932
aatgaaagtagcctttgcctgacttcgagacagcctccccgcggcggaggtatgggagatgtatcgaggtctccgtattagccaggttgttcctcaattgcttcccgatatcttcaaaaaggccgagcttgttgaaggagatggcggtgttgggacagttttgcatctcaccttttctcatggggttgctccattagaatatcaaaaggaaaagttcatcaagagggaccatgaaaactatgtcaaggaggcctgaatagtagaaggaggccttctggatcatggatttcagaaatatttgatgagaattgagattatagggcaaaccgacaaaacatctacaataaggtcaaccatcgaatatgaagttgatgacgacaagtcaggcaacacatcctttgtcagtaccagtgcactagcttgcctcgctgaggcaatcacagagtatatcaaggcacagaaaagcgctgagcaagctcgtgaagaaacgccgtaagaacaaagcaacccccacccccaagtgtaaaacaagttcagagcaattntctttatatcttgttattcactgtattactttttatatttcttggataattatacgatattgttg

SEQ ID NO: 3933 - DNA, 399 bp, Triticum aestivum
  Clone ID: PAT_TA_3933
tcgcccacgcgtccgcccacgcgtccgcccacgcgtccgcattcactcactctcacgcgcgctctctctctcctggagccgccgcctgcacagcgccacagtcgccggccgagcacgccgccgtcgacactgtccaaggggaggacaacgcggctacactgctaacaccctgcatcgcaaccgtgcacggaggccccggcgcgtcggagagcgagccacgtggagggatctgggctggggaagcaccgccggccgtgctgtggttgaagccgccggggaacggtgcgctgctcccgtcggccgcagtctgcacaatcccgtcggcttgcagtccgagcctgctgaccaagctaatgggagatgcacactagctagctgatcaagcattgagcgtcacaa

SEQ ID NO: 3934 - DNA, 955 bp, Triticum aestivum
  Clone ID: PAT_TA_3934
gaattcggcacgagctcacactgacgtcctcgcggtagacacaaatggcggcggtcgcgaccatcctctgcggcggcgccgtcgccggccaccagcggtcacgccgccgcgcagccccgtcgctccatgtcagaggcggctccgcctcggacgccgcccaccttgtctgcggtaggaagctccgcccggcgctgttccccgcttcctccttcggcgccctgcccctgtcttctccggggagtaggaagctcctccggacgtcggcttccgcggccaccccctcatccgactcccagggccaagcaaagcccatcgggtttttggagaggtacccggctcttgtcactggtttcttcttcttcatgtggtattttttgaatgtgatatttaacatcctcaacaagaagatctttgattacttcccctatccatactttgtgtcggtgacccatctttctgttggagtcttgtactgccttatcagctggagcaccggtctcctaaagcgtgcgccgatgaattcgacgcttctgaagctgctgctgccagttgcaatttgccatgccatcggtcatgtaacgagcactgtgtcttttgctgctgtatcggtctcatttgcccacaccattaaagctctcgagccgttcttcaatgccgctgcttcacagtttattctcgggcagcaagttcccttcacattgtggttatctctggctccagttgtgataggtgtatcaatcgcatctctcactgaactctcattcaactggactggtttcatcaatgccatgatttctaatatctcattcacctaccgtagcatttattcgaagaaagctatgactgacatggatagcaccaatctgtatgcctatatctctataattgctctcatcgtctgcattcctccagcactcattattgaaggacctcaactagtgcaccagggtttaag

SEQ ID NO: 3935 - DNA, 692 bp, Triticum aestivum
  Clone ID: PAT_TA_3935
cccccccgcccccgagcacccagctcctgcaaaccccaacctactcctcctctgcccccgcggcagggagagaccagccgaggcgccggccggcgcctagccagcgttagggcgtaggcaggcggccgcccgccgagcgtccagcacggcgcccgccgaccaccgcctgcccccccccggcgcgcgcggccggcggccgggggcgcggggggcggcggcggcggccgccgggccgccgccgccggcgccggggccgccggtggggagcacagcgtcgcgcaggccgcagcgcggcccccgcccctcgccttcccgctggcgctgccgcggccgcgcgcccgcagccagcacggcggcgtggccactcccgcggggggcgcgcgcggcgctgaggtccgcgggccgcacaaagcgcacgcgcgcctggccgggctcctaccccacccccgtcgccgccccgcgcccccaccagccggcgcgcctccaccaccgcggcctgctcccgcgcccctcggccgcccggccgcaggccgcccgcgcgccgctctcgcccacgcccctctggctggggtcctacgccacccccgtcgccgccgcgcgcgcctacgacacggccgtcttctacctgcgcggcaggtcggcgcgcctcaacttccccgacgagatctccgcgctggcgctgtcgtcgcccg

SEQ ID NO: 3936 - DNA, 2242 bp, Triticum aestivum
  Clone ID: PAT_TA_3936
tcggcccgacccattctccacgcgccgcgccttcccattctcatcaccccgcggcgcagcagcatccgccttccattctcctctccctcctcccacctcgccgccgcctccccgtggtcttgtctctcgccagatcgccatggcattgcacgcccccgtcctcgtgctgaaggactcgttgaagagggaatccggcgccaaggttcagcatggcaacatccaggccgcgaaggctgtgtcagacatcattcgcacaacgttgggtcctaggtccatgttgaagatgcttctggatgccagtggaggtatcgtggtcactaatgacggcaatgctatattacgggagctagacattgcacatcctgctgctaagtctatgattgagctaagccgcacacaggatgaagaagtgggagatgggacaacatctgtaattgttctagctggtgagatgctccatgttgcagaaacatttattgaaaagaactaccatcccactgtcatttgccgagcatacagcagagctcttgatgatgccattgctgtccttgacaaaattgcaatgctctgttgatgttaaagacggcgaagcaatactagggttgttggagagctccttgggtacattgctcacggtgcaattaagacacctaattgaggacgtggccatagaggccacgaaatcagtatcaataaatttatgaaagtaaacaagattcctggcggtcagttggaggattcaaaggttcttaaaggggtcatgttcgatatagttgttgtggctcctggaaaaatgagaaggaagataggaaatccacgcatcatcctcttcgattgccctggttgagtacaaaaagggagaaaatcagacaaatgctgagttgatgagtgaagaagattggaaggttctgctagatatggaggaagaatacataaagaacctctgtgtgcaaattttgaaatttaagcctgacctcgttatcacagagaaaggacacagtggcctggccatgcattattcaagaaaggcggccgtttgtgctagctgtaggctttggaagaaagataacagctagattcctaaagcctacggtggaggtcagataaacagagcagaggtaaagccagtgtcacagttatagttaacaggccagaggagcttcaagaatcagatgtggggacacgagctggtctctttgaggttaagaagatcggtgatgaattcttttccttcattattgaatgcaaagatcctaaagcatgcactgttctattgaggggagcaagcaaggacatcttgaacgaggtggagaggaaccttcaggatgccatgtctgttgcaaggaacattttgaaaaacccgaaacttctacctggaggtggtgcttctgaattgactgtatcggcaacactaaagcaaaagagttcttcggttgaaggtgttgaaaagtggccttatgaagctgctgctttagcattcgaagcaatcccaagaactttgcttcaaaattgtggtttgaatgttattaggacgatgacacaactccagggaaagcatgcgaatggtgaaaatccttgggttggtgttgatggaaggactggtgatattgttgacatgaaagagcggaagatctgggattcttacagcgtgaaggcacagacgttcaagacagcaatcgagtctgcttgcatgcttcctaaggattgacgacattgtcagtggaatcaaagaagaagcaggctcctggctctcggtgctcctaagcaaccccagattgaaacgggtgaagatgcggacactgaacagatgatcccggagtagaactacttgtgctgctggagtgagcctgcaccggcgatgttatctaccgaagctagaaaagtgcgcccgcggagcagaatgttttattaacacgtgaatggcgtcgcctggttgcatttcttgaatgtttgatggtggccaggcctccagggtcgtctagtattagtttggattgtagctttttcatatgttcttatgatgaggagtgtgcgggtttcagttgtgtatctgtatcagcgttttggaatctgactgttgcatggatggttgctgtccgtttttgtttttggactttgtactgaacggatatcagaacctgaatttaacagcaaaactagctttctgacgccacaaggcaggccttccagaaccacccccttcagccaacaatccgtcagtacctcggccgcgaccacgcta

SEQ ID NO: 3937 - DNA, 721 bp, Triticum aestivum
  unsure (1)..(721): unsure at all n locations
  Clone ID: PAT_TA_3937
nntgcattgactgtgaaaacaatctatgaatcgttagccaagagactnnnnnnaaagctnnngatggagacagctaattatgagattaagaaagaacttgttaagcagggtggccgattannngctgttaaccttgaatccagagctggcttgcttgcagctaggcagggtttggctcgtgcagcatctagatatgttggccttaggagtttcatgagtttacttggaccaataatgtggggcacactcttggctgatattgtgatccaaatgctcgggacagattatgctaggatcgtgcaggcaatctacgcttttgctcagattcggcttactcggtcgtgttacctagaatctcatgaagaatgaccagagcagaatcatcaccggacaagcctaactgggcactctgatcttgtctaccattacagctccatagtgtacattctgatcgcgcagatcattcccggtcgcagtactccacggtagactctgcagctttttgcagagcatagataacagagcaattggctgatggtaggtagcaaggacagataagaagagcagcattttcaccgctttgaatttcagaaggcccatagctgcttcatatgtgggaatntgattgtgaagcttaggaaaaacagcatagtgtcaggattgaaactgtgtattagtagtacttgacaaatagctcacgatagacatttgggccacctac

SEQ ID NO: 3938 - DNA, 1228 bp, Triticum aestivum
  unsure (1)..(1228): unsure at all n locations
  Clone ID: PAT_TA_3938
cgtgggttaattcctctctttcacccaattctctcaattccccactaatccctcctcctcataaacttctctatttggttaaatctcctacaacagcagcagtaaagcaagcgtccagtttcatgggtgtgttggggggttttctgtaccacatgaattgaaggggattcttgagaaccgagacgattggcctgtgcaatccctacatatcaaataagctgtcaaggatttctgaagattttgaaccctgcggatattcccctccaaacctcccccgcctggctaggcctaaggacctgtctgtatctccgtaattcaccaatcgtacctccacccggcggcagcggcagcggcagcggcggcggtggcatggcgaagagcggcaagtcggccgaggcggcgacctccacggcccctcctccaagcccctccccagccataaaggctaaggcgaagccccggctggaaatcgaggggtaccccgtggagggcatctccatcggcgggcacgagacgtgcgtcatcttcccgacgctgagcctcgccttcgacataggccggtgcccgcagcgcgccgtggcgcaggacttcctcttcatctcgcacgcccacctcgaccacatcgggggcctccccatgtacgtggccacgcgggggctctacaggctgcgcccgcccaccatcttcgtccccaagtacctcagggagctcgtggagcggctgttcgacgtgcaccgcgccatggaccagtccgagctcaaccacgccctcgtcccactcgacattggcgaggagtatgagctcaggagggatctcaaggtcagggccttcaagacctaccataccatacccagccaggggtacgtgatatactcaagtgaagcaaaagctcaagaaggattatcttgggcctccccggggagcgagatcaaaaggttngaagctgtcaaggcgtggagattaactaatacagtggccaacaccccgaggttgctttcaactgggggatacgatgtccagtttcatccttggatnctggacaatgcagacgtattggaagggaaattccttggtgatgggaganacttttccttggatgactccgtccccgattggaccatgccaagggatatgggacatacactngttttgaattgcgaacaccctgagantttgnaaacagaccatctaacaatcactttcgggtcctatacaacagaggaaatgn

SEQ ID NO: 3939 - DNA, 575 bp, Triticum aestivum
  Clone ID: PAT_TA_3939
agtgctcagctcgccggaagttgggattgggccgtatgtggaggtggcgttctaccataagccttccaggacattgctggtgacggatgctgtgatttttgttcctcggcagccacccgattgcatcagcaaagagtccttgttggcagctgccaagaatggcttggcagtgaagatattgagcaaagggagagaggttcctgatgatcccgttgaggacaacaagctgacccggcagacaggatgggagaggatggtacttcaaatactgtttctcggcccctcaaatcttctcgagccaaatgcgagtttcgctcaaatgtcacagaaactgatcgtttcaccaattgtcaagacactcgtcttcagcaaagttccggagaaggtgagggactgggtggacaggatcgcggcggactggccgttccgacggatcatcccggcgcacttcgccgccccaatcaacgcgagccggtccgacttcctggccgccttcgccttcctcgacgagttcctcccggaccgccccgccgcgtcgctcggcctgcccctcatcttcgcctcgctcatgggca

SEQ ID NO: 3940 - DNA, 638 bp, Triticum aestivum
  Clone ID: PAT_TA_3940
ccgaaccgttcttgcaccaccgcgacggcgctgctcggcgacgctctgcggcaggccatcatgccgcggggtgcgtacgaggcgctgcgggacgaggagcgcgcgctgccgctagcagcggcggctgccgcctgcgtcgccttcgctaccgttgccgcggtggggatcagcctcgggatcgtgtttcccgccgagcccgcggaccggcccttctgccgggagcgccgcatgctggaggcgctcccggcagctgctagcagccgggaggaggagcccgaggcgtatcggtaccgaggcggggctttctacatgaccacggccgaggccgccgacttctactggatggtcgtcttggtgccatccgctgtcctcttcgccgcatccgccgcttacctcgtatcaggaatatctgttgcatatgctgctccaaggaggcatccgttcatttgcactgtcgagaataacttctgcgcttctagaagaggtggtatgcgttgcctggctatagtgaatgcagctttcgccctcatatttggtctcatggcaatagtctttggatcaatgcttctggcccttggaagtagttgctcgattcctctcttctggtgctacgaaattgcagcatggggtttagttat

SEQ ID NO: 3941 - DNA, 679 bp, Triticum aestivum
  unsure (1)..(679): unsure at all n locations
  Clone ID: PAT_TA_3941
ccggtcccgctcccccgctccaccccccacgcgcgatcgctcgctcgctgcacaacgcccgcccacgccgccgtctccctctccctctccgcctccctccgtccaaccgcagcccgctccacctcatggcgtcgctctccctctccctccgcgcctccgcctcctcggccgcagccggatcccgcgccgccgccccaatcaaggcgtcgtgtgtgaggagcaaggttacctgcagcttaccatccatcagagctacctcctcacctgctagaagcattgagcccgtaagagccaccgccacacaggcgccccctgccacccctcaatcttctagcagagagaagacaaaggtcggcatcaatggttttgggcggattgggaggttagttctgcgaattgcaattgatagagatgacattgaagttgtggctgtcaatgatccgtttatcacatgcttaagtctgggcccacacgcggacctttcattccacccacggcccttccggaggagccatccctggtctggaatgggtcgaccgtggcagattcatgcgaaggggaccccactgacatcccttggggtccctctggtgccccttggggtaacttggagctgaatatgttgttgaatcatctggngttttacacagttgagaaagcttancacatttganggggg

SEQ ID NO: 3942 - DNA, 1051 bp, Triticum aestivum
  unsure (1)..(1051): unsure at all n locations
  Clone ID: PAT_TA_3942
gcacgaggcttcttcataaattccactaccactgaactgtttgcttaccaagggaggctgaattatcagaaaggagctgcaaccaaggaggatgcaccggacagtgtgtacaacactgcaaggcggttggctgtgcaaaatagaaccagcccagcgtccaacatgacatggcaatttgatgttgacggtcgttcgagctatctgatccggttccatttttgtgacatagtgagcaaggcagcatattccctctactttgatatttatgtggatggcgggttagcgttagaaaatcttgacctctctgaaaaagtttttggtaccttggctgtgccatactacacggaatttgtcttgaagtcaagcaatccttctggtaagctaagtgtcggcattgggccttccagcttgaacaatgtggcactagatggcatcttgaacggcctggagatcatgaagatgaacatcagtactggcactatttatgttgtgtggccaccagcaacgccaaaaaggaaactggctatcatattgggccctgttctcggaggtgttggtgctgttagcattgctattattctctgctttgtcctcagaagaaagaagaaggagaagaagccgcggcgggcaccgacaagtcgaccttcaagttcttggtcaccacttaccctcaatggccttagcttccttaccgtaggtacccgaacaaccagccggaccactcatacatctgggacaaacagtgatgtaagctaccgaattccttttgctttgctgcaagtggcaacaaaacactttgacgaagcagatggttgtcggagttggggggtttgggaaggtatacaaagcagttctgcaggacagcaccaaagtcgcantcaagcggggcaaccaagaagtcccaccaagggctcaaagaattccggacagagatcgagctgctgtcggggctggcgacaccgtcacctcgtgtcgctcanccggntanttgcgatgancagaacnaagatggtcttggtgtatgagtacatgggagaaaagcacnctgaan

SEQ ID NO: 3943 - DNA, 652 bp, Triticum aestivum
  Clone ID: PAT_TA_3943
gtggatcccccgggctgcacgctcacgaccacacggcggacggcaaacgaccaccggcacgccgcgacatcgcgagcacgccgcggaggacaaggcccgatgacattcgtctcctccggccgctgagctcgcccttccgacgacgcgccggattggccggtacgtcgaggtcgtgcgggacgacccaccagactcctgcctgcacgcgctcgcctcggccgtctttgctcttcttcccggcctagctgttgttcctcctccgaggctccgtctcttcgttaaccaagcaagcagcagcaccagcggtgcagctagctagctagtacgctggtgtgtctagctagctagtacgcctagcagctcaggaagacggcgaggatcaagagcagcaacagcgcacgcgacaagcagcagagggcacgccatggcaagcagcaatagcggccggcgtctgcagttgaccaccaatggatctaggatgggtcgggtggcgctattttttgtgtttccatttactccctttactgagaggtactctcggtaaacctacctgccgcgtggctacatcgccgtctccgccggccccgctcctctcgcctttgggccgtgtgaccgcttttggcgcccggcaaagactttgccgaatgtccga

SEQ ID NO: 3944 - DNA, 793 bp, Triticum aestivum
  Clone ID: PAT_TA_3944
atgatgatgaccggaataacatagagagattgacactggctgtcctttcttacatgccaattgctgttctgtatgtccatgatctatctgaagactgtgggactaaggtggctgatcagtacatcacgtacaagcatataaaggagcggtttggcgaccgtctttggatcgacgtcgtgtccaaatgtgatcttctggacagggccacgccctccaggttcgacgatgccgctgatgatggcgtcgatgatgaattaaggagatacagagagtttggaccggaagacgccatccgggtgtccgtgcagagccaaaccggaacacaagagctgaagcaacgggtgcatcatctgctaacctctcagatggcccggatcaaagctgccgggggcgacaacgatgaagccgtcagtgaagttagatgaaaagggatcgcgtgttggacaatatcgttatagcttagctgttcttgtggagctgatctggtcagccttatctcatgcaacatgcatggcgcgtcacccacgatggaggcatcagtcagccaggttccctccctggagcatcgatcagcttgaacgttttcttcacgagcttctgctccagcgccgtccttcggtgggagcgcgcggtcaggctggctgctgctttggaagtagacctcttcaaacttcttcacccacttgtatgtacgacatttatataaacaaaacggccgttcatatgtatgtatgtactccctctttaaagaaatataagagcatttattcaaaaaaaaaaaaaaaaaaaaaaa

SEQ ID NO: 3945 - DNA, 710 bp, Triticum aestivum
  Clone ID: PAT_TA_3945
gcacgagggagagctcaggaggaggaggaggaggaggaacagagctaataggcgatggattcccatgcgatggccggcgacgaccgccggagcaccgacctcaacaagcacgctgtggacaagcaatctcctcagcaactcgcgggcagctgcaaggcaggcgctccgtgcgtcgtctacttgaagaaaggcacgtgcgcggaggggagcatgcggcatgacgcccacggccatgcgccacacctcgctgcaaaccatgctcactgagcgtaccgtatagcagcagcagcagcagagacgatactaccgtacaatactactacgtgctacgtactatctacgtatttccgtttcgtcatggcttccgccgccgccgctgctgctgctagtatactaaaaagaaagtttgtaataatgaacgactgtccatgcggttcttgtaattgcggggtacggacttccgggctcctcaagttcgccgtccgcctcgcgtagattcctgccagctcctcggggcggcgaggttagggtttcctactcatgcgtacgcgcagacgagattacttggtgtcagattcaaggcttcatccacgactgtggcttcttcagaggtcttgctgtaatgcttatcgtatttgaggtgctttgtatttctgatgaaccttttaataaagatgttttttacataaaaaaaaaaaaaaaaaaaaaaa

SEQ ID NO: 3946 - DNA, 3410 bp, Triticum aestivum
  Clone ID: PAT_TA_3946
gaagctcttgaaaataatgctgccgtgcttgaagaagaagaaaacacatttgctgagaatcctactgctaatccaacacaaaagcaaggtcctatgcagtttacttttgaatctgaggtcgatcgcatattttcatctccacaagaatcatccttgttgtatgtgatctcgggaaaacatattggactggcgaagctcctgactggttataggccacccgcccgccctcgcctccctattaccacaaaaactgatgggaagaagtttatcaagttaaagccaaacgaaactgttcttcaggtccactggcagacaactttgagaggtcccgttgccggaatattgacaaaccaaagggtactaatcgcctctgctgatcttgatatactttcaagcagctcaaccaaatatgatcgtggtctcccatcatatcggtcaatgttgtgggttggaccagcgctcatcttctcaagtgcaactgcaataagtatgcttggatgggacaacaaagttcgatcaatcctttccactagcttccctcgttctgtgttgcttggtgccttgaacgaccgtctgctgcttgtgaatccaacagatataaatccaagacagaaaaagggtgtggaaataagaagctgtctagttggtcttcttgaacctcttcttattggttttgctaccatgcagcaacactttacacaaaaaatcgatctttcagaagtgctataccaaataacatcgaggtttgatagtctgcgtgttactccgaagtccctggacatattatctaagggaccccctgtctgtggagaccttgctgtatcattatctcaagcaggacctcagtttacacaaatcatgcgctgcaattacgccatcaaagctctccggttctctgctgctttatcgattttgaaagacgagtttctgcgttccagagattatcctcagtgccctcccacttctcatctgttccagcgtttccgagagttgggctacgcatgcattaagtatggtcagtttgacagtgcgaaagaaacatttgaggctattgcagatcatgaaagcatgctggatctgtttatatgtcacctgaaccctagtgccctgcgacgccttgcacaaaagttggaggaatctggtacagatcctgagctgagacgttatctagaaagaatactgagagttcgttcaactggatggacgcaaggtgtctttgccaattttgctgctgaaagtatggtgcctaaaggcccggaatgggcaggagggaactgggagatcaaaacacctaccagcatgaagagtattcctcagtgggagcttgcaggagaggtgatgccctacatgagaacaactgatgctgccatcccatctgttattgcagatcatatcggtgtttacttgggtgtgatgaagggccggggtaatgtagtggaagtaagcgaaaagagcttggttaaagctatggcggcggccagtagtgagaatgggcaaccggcatcttctgaattggcactgaaaaacaaagcaaatgctgctggtgattcagttggtgatagtctggccaggcagctaggggttcaaattgcttctgcagatgaacaggccaaagcagcggaggagtttaaaaagactctgtatggtgttgttgatgctggaagcagtgatgaggacgagtcaacgtcgaagactaaaaggatacaaatcaggatacgtgataagcctgctgcacctgctgttgatgttaacaaactgaaagaggccacgaaacagctaggtttgatggctcctccgatcagtaggacaaggtcgtctggaacaccacaagaattcagtcagccagcaggcccagcaccatctgctgctccagcaatgccgagtggcgcagtcgatttctttggaacaaatactttggtggcgccaccacaagcgccgaccggcggcacgggtcctgtaatcggaggcctgggagtgacagctggacctattcctgaggacttcttccagaacaccgttccatcacagcaacttgcgaatcgactgcctcctccaggagcaatcctgcaaagaatggccaatcctgagtctgggatgaacgtcggcagaccggtacctactcaaaacatgatgggcaatgttggtcttccagatggtggggtgccgccacaggggccacagcaaggccagttccctcagcaacaaggccagttccctcagcagcaaggcattcctatgaacccaattggcctacctgatggtggtgtacctccacagagccaggctcttccttcacagccacagggctttcaacctgctgctcctactccttcgcaaccaattgatctcagtgctctcgagggtccaggagcggcaaagcaagctgctcagcccccagcgcctaaagccgtgcgtcctggccaggtaccccgtggcgctcctgctgcagaatgctacaggatgggtcttgcacatcttgagcagaatcagctcacggatgcactaaattgtttggatgaagcattcttggccctcgccaaggaccaatcacgtgaagccgacatcaaagcgcaggctaccatttgtgcgcagtacaagatcgccgtttcattgctacaggaaatcgctcggctgcaaagagtccagggagctggcacgctgagcgccaaggaggagatgggcaggctgtctcggcatctggcgtccctgcccatccaggccaagcaccggatcaactgcatccggaccgccatcaagcgcaacatggaggtccagaacttcgcctatgccaagcagatgctggacctgctctactccaaggcgccgccgaccaaacaggatgagctcaagagcctcatcgacatgtgcgtccagcgggggctgaccaacaagtccatcgacccgtttgaggacccctcgcagttctgtgctgtcaccctcagccgcctctccaccatcggccacgacgtttgcgacctctgcggcgccaagttctccgccctctcggccccaggctgcgtcatctgcggcatgggcagcatcaagcggtccgacgccctcgccggcgctggccctgtcgcctcgccctttggctaagttttgcgcgtgacgggttctgttctgtttgttgcccgagcctctgtttcttgtatgtattagtgtgcagtcaacattctttgttttgtgctgggttgttgttgcagttgtggtagtagccttggagataccattttgttgtgattaatttctctatatgattctacagaacatacatagggcttgtcctagcagatagcgatccatgtacctagaagctctacccacggcatttgcaatattttcgctgttcttttgttttttaaagttaaaaatatttgcaatgttttgggtagaagctcactcacggcatt

SEQ ID NO: 3947 - DNA, 1120 bp, Triticum aestivum
  Clone ID: PAT_TA_3947
gaagccgagttggtggaactgggccaagaagcggagaagtgggcgatattggccaatagattggtccgaggtaatgtaggccatcttatcatactcgtgagaacttccatgctgcttcatttatcaaaaccttaaatctttccatgtttcagcaatcgttgacaatagggttgcagggagggattacagatacgatgatgcagttcaactaaggcagttatgcaagatatcaggagtaaaggtctcatttgacgcagaaaatgcacgcgattctttctatagggcaacaacaggctttgttctggacgattgcagcagaacagcagaagacatggggacagcacaaatcaatggagagaatccaagagattttcttgctggtctttctatgaatattgggttggacaagttccgtgctgccacacttgtttgtgcatcagttgctgctcgcactcgtgcgtgtctcttgcaatgctgggctctagagattcagggaaaacgagcggaggcattagatgagcttgtaaagatctgtagaattcatcgtgtattccctccagaagaaaattctgcagaaatggaaatggtcgctggtggacttaaaaagaatttggaagttgcagagagggttcaccttctctctctatacaggggcgcatgtactaccggtgtcaaaaccgctgcagaagctcttggcctgctgctgcggcggctgcgcggttcttcccagctgcgctcggtgggccggcggctgcttcgccggaagtcggatgcactgatgtgcgaggcagcaaagcggagaccagagcacctggcaggagccgcaacctatactgctgcggacacgccaacgctgcgaccggcgacgaaggcctctgcaggacgacgtcgatgtgtccacactccataatgatagctcagtctcacacggttccaactcccagtatatctccaggagagcttgccggaccaatgagaacatgagcagtaaaagggtccattatttttgtagttccagcttggcgttgtcatgcctcggtaacggttggaggcttcaggccgttgaaatattcacaattgaagcctttggcatcctcggttttctgaagttgcagaatat

SEQ ID NO: 3948 - DNA, 638 bp, Triticum aestivum
  Clone ID: PAT_TA_3948
ctaacgcaccgtgtcgaccgctccaccacacgtaggaggaagggagccggagaagcccagccagcctcctcgccgccagcgagctgccgtgcaatgccgcaataggaatcacgaatgtcccgaaggtgccaccctccgtctgcctcgcggtataatccaatcgaatccatccgtttgtgggacttgggaattccgttcgtcttcagatcaggtggggtttgtcgcccggcccccggctgggggtgcggctcttgggctcgcgcgggctgaggcgattctccggccactttggctcccctgcgtcggcccccgctcttctgcgcggttctcgcgcctggtcggttgcccgctggctccatgccgctcctccgtctcccgttgtccgtcgcgcggtggacacccggtctcgggcttctctggccttcctctccgaggccccacctttccctggtcagacctccgtatttgccctggctgtctgctgggatcccgggagagtggactgctgcgtccctccgttgggaatgcgggtggcatgtgcgactcggcacctttgcataggtgctctatgctcgccaccttccttcccggctgcctgtggcatacacttgcacgtgtattctaatctagtttattat

SEQ ID NO: 3949 - DNA, 526 bp, Triticum aestivum
  unsure (1)..(526): unsure at all n locations
  Clone ID: PAT_TA_3949
aaagctaatcattcacttggccgccacaaccatggatttccttatgtctcctggccgttctctcatgcctcctagccggaatggcctttggacgagggtacactaagcgagcccgtgctcaggcgaccacccaccacgtcagcgatccagctgttgctcaccgagcgctcatcgagaacgccgatcaggtctttaaccggccacggacgagcgtccccggctccctccgccgtctgggcgcaatggcgaacggaacgacaacatagccacggtgatgttacggcccgcatttgccagtgccccggtgcaacccgaccgccgagttcccctcacgcctccnggtccttaaccccaatggatgangaaggcactccnggcctcctcgnggggcttntcccgcctatgcgccggcggcngcggcgaggtnggcatccntttagcatcacanggtgtgttccgctagccanaccaagtgctcgggnaattttcacccggcanaggtnacnagggganggggnacgggatc

SEQ ID NO: 3950 - DNA, 895 bp, Triticum aestivum
  Clone ID: PAT_TA_3950
gcggacgtcgcgtcgggggctccgccgatcgcctgcgcgacctgccgtcgttcctcaccatcgcgtccgacgaccacccctactcctttgtgctcgccgcgttccgtgagctgctcgacgtgctggaccgcgaggactcgcccaccgtgctcgccaacacgttccattgccttggagcccgacgcggtggcgacgctgcaccagcacggcatcaacgtcgtccccataggccccgtcctctccttcctggacgcctcggcagcggcggcggccaacgacagcaacgacctgttcaagcaggacggcgaggggtacctggagtggctggacgcgcaggaagcggggtcggtcgtctacatctccttcgggagcctgtcgacgatgagcaagcggcagatcgctgaggtgtcgcgcggcatggcggagagcggccggccgttcctgtgggtgctgaggaaggacaaccgcggcgaggtcgacggcgacgacttgtgcaccggcggcggcatggtggtggagtggtgcgaccaggggaaggtgctgtcgcacccggcggtggggtgcttcgtgacgcactgcgggtggaactcgacgctggagagcgtggcgtgcggcgtgccgatcgtgggagtgccgcagtggacggaccagggcaccaatgcgtggctggtggagcggcagctcggcaccggggtcagggccgccgtgagcgagaaggacggcgtgctggaggccgacgagctgcagagatgcgtcggcttcgccacgtcggatgtggtgcgcgccaaggccggagctgtggagggagaaggctgcgggcggcggctgccgtgggcggctcgtccgagaggaacctcagggcgttcgtctgccagccggcaggtcgccctcgcca

SEQ ID NO: 3951 - DNA, 648 bp, Triticum aestivum
  unsure (1)..(648): unsure at all n locations
  Clone ID: PAT_TA_3951
cccagccccgcctgcccccagccccacgcgccccgcccccgggcccctccgccgtccgccgcccgcgccctcctccatcccccgcgcgccgcgcgccctccccccctcccccaccgccccgcgcctccccctccccccgccgcccacgtcccgccgcgccagagcacgccgccagtgaaaccccaagaacgatgtggatgtgaatgaaaagggacagtttcacttcatgtagctactacaccaggagaattgtatccttgcgctgaggaaaatgttatgccgaccgtggccaagtgccctgaactcacctatgcctggtaatcgtggtgtgagctgaaggtaaaaggcaaagcctaaaggtaggcaatcatcattagctaggtagtcgattatacagtactagttgacacgttgcgccaaatggcgcagagacccgctaaagtcatgttgtcgatgaaaatagttccattttgcaaggacatattcgatattggtagtagaaagctcatgtgttaaaccatgctatattgaaaatatggttatgtgcttgaaaagtgcttgaaatatcatattgctcaaaccgtggtgcaatggngcaagaatgcaaatcangtcaatganagaattcaggttattaaaaaaaaaaaa

SEQ ID NO: 3952 - DNA, 803 bp, Triticum aestivum
  Clone ID: PAT_TA_3952
tgtgcccacagaactccagatgttgatgattacccagacaaccagttcacattcagtgtcaagcacttggctccaatatcactgacatgccttatgcctccatcatacctgagccatcatcctccatacttctttctcggtgtacagtggttggatactgtgaaggtctcaaccctttgtcacatgcttgaatcgatttgggcacatcagtctgcacaggaagtttttttgagtgggtgcagggctttacgctctctcatcttggttttgatggcgggataatcatgcttgaaggtctcaaccctttgtcacatgcttgaatcgatttgggcacatcagtctgcacaggaagttgtttttgagtgggtgcagggctttacgctctctcattttggttttgatagtgggataatcgtacgcatgtctgatagtacgacggctcctgtggatgctcgggttgttggagagattctgtctgtagaggatgttgttcaacggttgatcaactacgatgaagagcaatgccttgaaacattaattcggggcctccatatctgcgcaatttgtttcagtgagcacccagataattcagatgctccatttgattcttggatactctccctgctgctcatttcacaactacatcttcattgtaacttaaatttgttgttttgaaacagtaagggagaacactactgatacagtatatattggacactgaattgctgctccatggagccagggcaccatgatttatgcacaaatcaaacataattttggtacctgcccgggcggccgctcga

SEQ ID NO: 3953 - DNA, 1604 bp, Triticum aestivum
  Clone ID: PAT_TA_3953
tagcgtggtcgcggccgaggtctgtcaattccgttgtctgacgtatgggctgatgctgctttccggactgacgttgtaaagtacgcatttactggtttgatgagagatctacgaggcattgctatggccacaaacagccgcaggaacttacggcctcctatttgactggttgtatccgtctcgcatgcctcttctgttgaggagccatctccctgctgactgatgaaccagaggtcaccacacccttacttaagttcatgtctgaatttgttttgaataaggctcaacgattgacatttgattcttcatcaccaaatgggatccttctgttccgggagattagtaagctgattgtggcttatggttcacggattttattgcttccaaatggcactaatatttatagaagtaaatacaaaggcatatggtatttcattgactgttctttcaagggcccttatgtgggaactatgtcaattttggtgtctccgggctgcggggtgccagtgcactcgcggttgcccttgatatatctttaaagatgactctgtcaattccgttggctgacatattgacatttaaaaagctttcaaaagcatactatggatatatggaagttcttttcaacaaccatatcactatcaattctgtcctcaatttggacacaagcacatttgtgcatattgtcacctcgcttgaatctggcttgaaaggattagatacaggaatatcaacacagtgcgcttctgccattgatagcttggctgctttctattttaacaatataacagctggtgataatccaccatcaccagctgcactgaatcttgctcgacatattggggagctccccagtttatttcctcagatactgaagtcactttttgaaatcattatcttcgaggatgcgggtaaccagtggagtctcagtagaccaatacttagtttgataatgatcagtgaacagatgtttagtgatctgagagcacagatattagcatcacagcctttagatcagcaacaacgcctctcacagtgtttcgataagctcatgactgatgtcacaaggagcttggaaccaaagaacagagacagattcactcaaaatctcacaacattcagacatgatttccgagcgaagtgacagtcgttcagaattacctgcaagtttgaaggaggcgcttctgcattgctgtaaataccaacttgtttgcatcataggaatcaccattcgttggaaaaagaaacttgtgctcagaaaacccagtttagtttgcattggctgaaagatatagggctctgttgctgcatgctgtggtgaaaatcagttataagtctcttagcttgttgtccgtatcagaatggtgaatggtggggattgacttgttttacctctgcatccctttgcttgtacagcaacattcatcgtgattgctgtttccccaagttgttagggggacaacagccatcacttacctaattcattggtttaaaagttagaatggaaatgatgtaaatggccatgttggcttgctaaaatgtggaattggtagtctgtgagagaggggaaatcttgccccatgtacatcaataccgtcttttaa

SEQ ID NO: 3954 - DNA, 806 bp, Triticum aestivum
  Clone ID: PAT_TA_3954
ggacaaactgcaaaacaaaaccgcgtctcccggcttccccaccgttccgcgtgcactgtcagtctccccgcgatccgatcggcaggaaagggaatgtcgtcgtcgtcggcggcggcggaacagcatcgccaccatgccgtaggcggccgcgagctagtgccgctcgcggctctcataaaggaggagtcccgcaccgagcggcacgccgtcactcggagcaggatctgcgcgcgtgaggatggaggagtaggaggggaagttggggaggcggagacgcggcggccactgctacggtatgggtgcgccgcgcagtccaagaagggggaggacttcttcctgctcaggaccgactgcgcgcgcccctctacttcctcgtcctcttccaccacctcgcatccccccaccttcgcggttttcgccgttcttgacgggcataacggcgatgccgctgcaatatatacaagggacaatctgctcaaccatgtcctgagcgcgatgccacagggtctttcgcgggaggagtggttgcattctctgccccgtgcgcttgtcgcgggattcgtcaagaccgacaaggaattccaaaccaaaggccaaacttcgggcacaactgccacatttgcgataatcgatggctggactatcactgttgcttcagttggcgattctcgctgtattttggatgctcagggtggggctgtttctttgcttacagttgatcaccgactagaagaaaatgtcgaggagagggagcgtgtcacagcgagtggaggtgaagttggaaggcttagtgtggttggtggagc

SEQ ID NO: 3955 - DNA, 1144 bp, Triticum aestivum
  Clone ID: PAT_TA_3955
atttcgacgccactggagctccctctcctccactctggtcaccatccactccctcttagccccacgactccatcccaaccttcaattcgtcttgggagccatcgtaggtaaaatccccctttcacccaacggccgtctcccgctgcgaagctcggcgccggtgaccctgtgccctccgctgatcgtgccacccaccggacgaaccagcacggcctcctgagcaagatggtggcctcagttcaccgtgggttgccgccattcgccggtgagcatcgccggagccccgcttcgtttggacaaaggaaagaggcggggtggaccgtggtcaaagctgaccagtgggccaggtgggacccactacggctcgcgggtaacccacgctgtgtggataagtggggatgggttccattgaagttgctttcccatggaaaaaacgtattccagcgaatacgcctttggcgtcgcagccctcccgcaagatcgagcgattgggcttagcccaatagcaccaggcggctataccgcgcccaaggcgcgcttctactcagcccatcagagtaatctttgtcttctggtgcccttccgccagatctctttttgttcctgtgtgctcggtccacatgtaaccctggtggctctgggtgctgcccactcctccaaccaggcgccctcaagcccgcgggccgcgccccgggggcccgccctggctcgcgggcccctcggataccttccatccctacttccaccactataacttctcagatattccccttacgttagagggcacaccaaaaatactttttagccgccgcaagtttctgttctcgtgagatcccatcttggggccttttccggcactccgccggagggggattcaatcatggagtgcctctacatcaaccttgctgcccttccgatgaagcgtgagtagtttaccacggacctaagggttcatagctagtagctagatggcttcttctctctctttgatcttcaatacattgttctccttgatgttcttggagatctattcgatgtaatcatcagttgcggtgcgtttgttgagattagatgaattgtggatttatgatcagattatctatgaatattatttgagtcttctctgaaaaaaaaaaaaaaaaaa

SEQ ID NO: 3956 - DNA, 626 bp, Triticum aestivum
  Clone ID: PAT_TA_3956
tcgtaactgccagccattagcaagtgcagcttcgccccctccagcgcctcctgctgctgctgccgcgggcgccgtccccacaggcagccctaggactggtctctctcctgctcgtctgccctcttctcctcctcctcgtcgcgcgccgcctcgcgacgccgtcgacggccgccgccaccgcgagagccagggaagagctgctcagcaggctgccgtcgcccccgcagcaggctccccgtcgtcggccacctgcacctcgtcgggcccctcccgcacgtctccctccgcgacctcgccgccgagcacggccgcgatggactcatgctcctccgcctcggagccgtcccgacgctcatcgtgtcctcgccgagcgccgcgcaggccgtgctgcgcacccacgaccacgtcttcgcgtcccgggcctactcccccgtcaccgacatcctcttctacggctccacggacgtcgccttctgcccctaccgcgagcactggcggcaggtcaagaagatcgccaccacgcacctcctcaccaacaagaaggtccgctcctaccgccatgcgcgcgagaacgaggtgaggttggtggtagccaagatccgggaggccgccgcagcaggcaccgc

SEQ ID NO: 3957 - DNA, 1099 bp, Triticum aestivum
  unsure (1)..(1099): unsure at all n locations
  Clone ID: PAT_TA_3957
ggcgacaatccggccaacgcagccatgcgcccgcttatccgaaccgcctgcctccgcgctcgtgtgcgcgccatggccacgcttcccgccaccgccgccttctcctccacacgcgccccttccccatgcccctctccttcgcgcgcccgtcgcctgctcttcgccgcccgcttcctcccctccgcgccgccgccgccggcaggggcacgggcgctccggacgtccgcggcggccgcggaggccgccgtcgaggtgggtggcgtcaagatcgcgcgagaggatgtcgtcaaggaggatgacccgacgaacaatgtgccagacaccatttattcaaaaattggtcttcagctgcacaggagggataaccaccctctagggattctcaagaatactatctacgattactttgacaaaagttttcctggccagtttgtcaagttcgatgacctctgccctcttgtttctactaagcagaactttgatgatgtcttggtccctgccgaccatgtaagccggagttacaatgacacatactatgtcgattctcaaacagtcttgaggtgtcataccagcgctcatcaagcagagctgctaagagaagggcatacacactttcttgtaattggagatgtttatcgtagggattctattgattcaactcattaccctgtcttccatcagatggaaggctttcgtgtcttctctccagatgactggtcaggctccggaatggatgggacagcatatgcagctacagacctcaagaaaacgctggaaggcttggcaacacatttatttggtgctgtggagatgcgctgggttgatacttacttcccattcaccaacccatcctttgaactcgaaatatatttcccaagggtgactgggttgaatttttggattctggggtcactgagcaaggaaattttnaaaaagcaatgggtagacaaatnaagttnccatgggccttccggactaagcttttgaacgactaacaatggcctctttggatatcccaaatattccacngtcctggcaaatgattaanggtcaaatccaattctcctaaaaggaaacttggggcnaattnaaaccatcn

SEQ ID NO: 3958 - DNA, 414 bp, Triticum aestivum
  Clone ID: PAT_TA_3958
agccttccgcggacgcgtgggccagaacacattcgtgaggttgaccgtgtggcctacgaaccaatcattatatcgtttggcccgtatcaccatggaggccaacactttcaatacatggagaagaaaaaatgggaacatttagacagggtactaaaactgaactgtaatagaactctgcatgattacattaaagcaatcgccgaagtagagaagcaagcaaggaaatgctactcggagcagataataatggaaaggaaaaagtttgtgcagatgcttttgttggatgggtgcttcatacttgtgaatattgatgaaaatgtcggcaccaggatgtcaaattccagaactttgaaccaaggatccacccaaacagaagttgatggaaacgtgacgggagaagagctggaacagatt

SEQ ID NO: 3959 - DNA, 814 bp, Triticum aestivum
  Clone ID: PAT_TA_3959
ttgcatgtactcgaatgaacaaactctcctactctgcctgccctgcgtccgcgacgggagcccgaccgcacccacgactgccaagccccacgggagcccggcgactacggcggctcacgccggccggctcgctgccctcctcctgacctctcgtccgcctgccttcctcgttccggtctgccgtaacttttgccgcgactgaacaacgcgaccgacggcggtgctccctctcggcgcagctcgtacctcggagttaggatgaagtctaagacgaacaggggcatgcagaaggcaggaagagtagatcatctccaaggaggaggaccaaactggattcttgttgccggaggagttttactaagcactctctccgtcaaacttggatgcaaattaaagcaaatgtttgatacgaaggagcagaatggcttttccaaagccgaaagtaggcctggaggatgtgaattgcactcaaacctatgcaggtttcgtggccaaactagctgctactattgtatttcagggcattcagatggtgggagtggaagtcaagcatcctcctgcaagtccatcaaaatcagctgaaccctcgcttccacttgtgaaaataccagtgcaagaatcaagcaaggacaacagtggcgtcatgtggatatcatcacctgaccgccttgaagatcctcgtaaaccatttcagtactcaaacagttctggctccccacgtgtttcagagtcaggatctgacatttatagcaagagagaggtcatacagaagctgaggcagcacctgaaaagacgtgatgagatgatcatggag

SEQ ID NO: 3960 - DNA, 849 bp, Triticum aestivum
  unsure (1)..(849): unsure at all n locations
  Clone ID: PAT_TA_3960
gtacagtctcgtgcataaggctcagtcaagggatgattcttacacagaagaattggataaagtttttgagaagcatatggctgcagcgaaagatcttcttgatggagaaaaccttgcaagatttttgtctgagttgcattcggacatcagtaacctgagagcaatgctccgtgctatttatattagctggacatgcaacagaatctttctctgaattcgttgttgggcatggggagttgtggtcatctcagatgctatcgtatgctgtacagaagtctggagcatcttgtagttggatggatacaagagaagttctagttgtaaaacctaagtggtcctgacatggtagatcctgattatgagggaatctgagaagcgactcgagaaatgggttttcacgccaacctgctgagataatagttgctactggctttatcgncgagtccagctgaaaacatccctactactcttgaaaagggatggaagcgatttctcagcagcaataattggttctcttggtagggcccgccaagtcacaatctggcccgatgttgttggggtttttaggcccgtcccggaaggtcaggaggttggngatcttaagcacattatatatcagnngcctgggaaatgcatntttggnaaaatgtgtgattccccgaccatatacctgngatgaaagacatttccattgcatangaacatgttaatttttgnccggactgggattgcagcnnctgtacaaaagctatttgagcttgggnaaanattgctatataaaaaagggcctgtacntnaagactgaaggtgggtccngcccnaaggcctnttngggtnaaaaggnggntn

SEQ ID NO: 3961 - DNA, 724 bp, Triticum aestivum
  unsure (1)..(724): unsure at all n locations
  Clone ID: PAT_TA_3961
cacgcgtccggtgccccccgcgtgcagtccggtggtgctatgcatgtagtgctcaggtgagccgcactgcagctcggtttggtgggcgccactgtcctccgacgggcatgtgtgcagtgcagtccggcggcgagggtagccatctcctctcacgcgtccagctgctcctggtggtggtccgcggacggggagccgcccagcttgctatcgttgcaggtcagttgggcgttggtgcagtacgcaagcacttgagaggacgattggcacgcacttcagtttcagccgtgcgacgctgcagtatggatgcacgcggcaggaggttcgttgctgcagtttgcttggtgttggcaggaggttcttcagctggcccatgtagtttacctggtgcagttcggccggttgatggttgcggttaaaaggaaaattgggtggggtccactttctttgggatgaaaaaataagtgcaaatgtggttcactaattattttctcagggttcagttaactatattttgtgtgatgagagccgctccgacgtctgatgtagttaactgaaccctgagaaaagttatatggactcgtttgaaaattgtttaccaaagaagttcatttagaattgtgttgcggctcatttctctcngaccatgcggtttgcttcttcgcaccgggtatagctcgccaatgtggaaatccaaaactccaaacagaaaaaaaaaaaaaaaaaa

SEQ ID NO: 3962 - DNA, 597 bp, Triticum aestivum
  unsure (1)..(597): unsure at all n locations
  Clone ID: PAT_TA_3962
tgtgtgcaaccgcctatctctcccaagccaagccaccggcgccgattgctgtcgtgctcaccccccccccccccctcctccccgcgtcacacgctgccgtgaagctctttcccatggttgctgctacgagccgccatggctggtggtgggagcttcctctttcgcggtcgtcgtgtgctccgacgaggggccgtgctacggggcgcggccgtgtccaagagatgagatngcgcccgcggcgggaggtgtgctgcatccgatcactcaaggaagctggaaccgtcgacaaagcgtgctgcaaccgggcggcgaagaanagctgcaaaggaggggagcaacggctggtggttggcagattacnccctcatggggttgcaaacccatggggntatttttgctggatcccccgcggcaagcactacatcaaaactgccggcgatgaaacgacnactgcgtgctgcatcaangaatntttgctggaacggccgacaaaaaattgatcaaaacgaccgtgtggaatcgacacaagcaatcgtttgctggaacggcctttgtttnaaaacggaaattttnncttcgnagggntcatngaaattg

SEQ ID NO: 3963 - DNA, 774 bp, Triticum aestivum
  Clone ID: PAT_TA_3963
gctccagtctcctctccactgccccgccccgtctcggtctcactccgcggcaacctgccaacaaaatctccggaccccaaacagcggacggaatcccagtagagcccttctcccctcctcgtcctccgccgcccccctctccgcgcgcgccaccatgtcgtcggcgtgggccgacgcggcgctgctcctcgcctccccgtccccctcctgctcccccctcgccgggccgcgctacgggcgcctccgcaagggctttccttgtaccactcgttctaaagctggattccaaatcaatcattaccaagcaaggagcttaaaggttgaagcaaagatggattctggttgatggcgagacacaactcgctccaagttaaattcgaaaccccgaagggggtcaaacttctggcggcaagatactgcaattcgcaagcctcacctagtcccctgtaacagttgatcagcaacttgaaaacctgacagcagagaaaattgcccaaaaggaaaaggcagcaaaagttcccgaggacctcctttacaagcgaattgcagaagtcaaagagaaggaaaggcagaataccctggaagagatcatctactgctggattttgttcaagttcatggaaaatgacatacaaatgacacctgcattatcatcatcaggtggccctgtacgcgatgtctcctcgttgcctaaccaggagtataagctgcaaagcatacactctcaagacgctcttgagatgatacagaaccatctcaaccttatcatggggg

SEQ ID NO: 3964 - DNA, 495 bp, Triticum aestivum
  Clone ID: PAT_TA_3964
ggcacctcaggtagcaggaccatatgcttatacaccacaagtagcaccaaaaagccagataccggaagtgccggattgtactgtcgcgccaatttctgggcccgggcaaccacctgcacctgatggaatttagagtgaccttgaactgggtatggactgtgtcgacaacctgcacatgggccatccttctggaattttctgaaaataccaacatgatgagcagcagatagtacccatattgctgttatatgtctcgatcaatgtgcggctggcataaatactagaagtatttgtaaatgctgataacactgggccctcccgtttatgtcagaaaagtatatcgtcagtacgcgtctaactccaattccctctgtacatactaatcacaactttgtatagaaaaatgtactaatcataatagcattaggtttgcagccatttgaaaacatagttctatggcaaactttacctttctttttgttttattggtgttat

SEQ ID NO: 3965 - DNA, 1420 bp, Triticum aestivum
  Clone ID: PAT_TA_3965
ctcgtgccgaattcggcacgaggcgccccttcccctgtcctcctccaccttgcctgggctccgcctcctccgcccctcgctctcttctgcgccaacggccactccctcgttgctggaccccgccctgcttcgcctccgccagcctcttcctccttgccgtcgacggcagcggtgtgaactggagcagcggccgcgactagatgtgatgagttgactgggctggttccacgctgaggaacggaccccctcgacaccatcctctgcggcgctactctgctgcctccgtttgtcacagttaaggggtgtgatctcttctgtattccgctttccaggagttcttgccttcaacgctgaggtgagccgcgaaggtggggctcgaagaagtatggccctgatgcgctagcttaggggttcatctgtacgggagcacatcattggagagaaagatcgtgatcaaaggaaataggtttcaagctttcagcctcatgcgcctgttttcctttttccttttgatggggccgttcatgtgaggtgaagcaagcaagcacctccccgtgttttctatgtcagagcgctctgctcggcagaggccggcccttgtggaacccggggattcttgtttgttgtgcatgcgcttactttccctactgagttcggctgttcgggtgctcgcctgtggattggtcatgttttacttagataatccattgatggttgatctggttaagtacatatgctatcccttgtttgtttatattgctagctgggacccgcgtccggtttatttgcttgattattggccgcgtttacttagataactcattgatggttgatcttgttagctacagatgctaccccttgttctgaacaagctttaattttggtggactaatcccggtgtgtcgggggggctggtcatcaacaaaaagccgaccacataatcctgtattttatttctgggtcgtttcaaaatttctgctctacacagaatcttaagaagtttgggtatgcacacaggtcctaataataatgagctttttagtgcaatgcatgtggcctgattacttcttctctttcctttttttatgttgtacgttcttggaggtcgccttttctttcttctgttgatcaagttttcttcttctttcttctgcttatcagggtttcttcctttccttttttctggaaattgcatttattgtgtgacctatgtactttcattattcttgcttcattggtcgtgttgatattctaggtttggcccgacattgtgttttcttttgcctcatgccattcatattttgtggttgcgtgtggacatgatttgcgcgcttatttcaattgttagccgtgtatcatggtgtgctttgcctgcttttttatgcttgtgtgaattgaccatggtctgttcttgttgggg

SEQ ID NO: 3966 - DNA, 450 bp, Triticum aestivum
  Clone ID: PAT_TA_3966
ccctcctccccttctccgaatactccaaaccaccaaatcaaaccgagagcaatcgaaatcccaaatcccacctctcgaatttagcacaggcattgcccaaatcgcgcggttctgatgccgaaggcgcacgaggaggaggtgccggcggcgggggcggacagcgaggagctcgagccgctcttcgactactcccgcgtgcagcccaccatcgacttctgcttcgacgattccgacctcgagaagtcggacatcggcggccactgcaacaagcgccccaaggtgcccgccgacaacgcgaacgctgtcgaggggggtaaggctaatgagaagggcgacgccggcataaagaaggccacggtggtgaatttggatgatgaggattggctggctccgccgccgctgaagcctctgcttagcactgaagtatgcaaggataaaacgatgcacgag

SEQ ID NO: 3967 - DNA, 465 bp, Triticum aestivum
  Clone ID: PAT_TA_3967
cgatacatatcgagtttttcactatagtcgagtcacctcaattcacatccaaacatcatcatgtacaagttattgttattggttgctgccgctctcgctttggtcgctgttgtttcttctcaagcaatttacacctaccctgttcatacgtacgcaccggtgtacacctatccatcgtaccactacacttacccactttcttacaatccatacatcactttacttcgtcgatgaatacattttctctaccaactttaaaactatctggagttattctgccaattttatgaaaacgacaacgtaaaatgtatttattttgtacatttataatttgctattttttcactgttaattcttcaatatttatgtaatcatgtaataccttttaaattatttttttaaaacccgtttaatgtaatatacatatatcataatttattaaaaaaaaaaaaaaaaaaaaaaaaa

SEQ ID NO: 3968 - DNA, 342 bp, Triticum aestivum
  Clone ID: PAT_TA_3968
gcttgcaggaacaatggcggcccacggtcttctctctgggaggcagctgcttgggaggcctctgcagtcttccatctccaggtcgtcttcctcccggaagtccgccttcgtcgtcagggcatcgtccagcccccctgccaagcaaaatgacaacatgcagctgtggttcgcgtccgagcagtccctcacctacctggacggcacgctgcccggtgactgtggcttcgaccccttggggctgtccgacccggagggcaccggcgggttcatcgagcccatgtggctggcctacggcgagatcttcaacggccggacggcgataatgggcgtggtgggcatgat

SEQ ID NO: 3969 - DNA, 559 bp, Triticum aestivum
  unsure (1)..(559): unsure at all n locations
  Clone ID: PAT_TA_3969
gcacgaggaactccctcctctaggcctccccgaccaccaattcgagctcaaggagccctcctgtcctccaatgcctatcatggccgccgcctgtgtcctctaaaatccgagcaatcccggcctcccctcttcctctaaccaccaccaggaacccgcagcaccacccgagagcctccccgcaactcctccctcttctccatgaccgtagcaccttcccccggggccggaccgacgccgccgtccgccatgctcaaggttctcgtcgctcccagtggtctttggagtccgtggagggggtgaatggatgcaccgcgcctcggggagcactccggtggtccgagctccaccggaggaggctggagccggctgggcgcgcgccggagccgcgcggcttggcctggcctctgtcccgaccgacaggaggaagaagaagcgggagaagagagaagataaggcgggccccgcacgtcagtgtcctagtcggctcgctgacgtggatacgtgaagnnnncnnngccagaatgcgcnnncagttaatgaaaacgtactctacttcttc

SEQ ID NO: 3970 - DNA, 401 bp, Triticum aestivum
  Clone ID: PAT_TA_3970
cggacgcgtgggattttctaccggtcatctccttccaaatcgagccgcgggggctgaggtccaacaaatccccaaccctaatggcttcccaatggcgacggcggtgtagatcctgtacctagatgggcgaccttggctactggaggaagctttccatttctgcccctagatgtacctagctgggcgaccttggctactggaggaatcttggtcgtcttgtcgccggtggtcgggctgcacgggtggacctctcctgtgctgcgccgcgacgctgtccgagccaatctccagcacataagcctcgatgagcaagaagcaccaacaccgaagatgctcatgtccaagtggccagattacgaggagagagcaagacttgcttgatgccaaaacccctgtaactg

SEQ ID NO: 3971 - DNA, 590 bp, Triticum aestivum
  Clone ID: PAT_TA_3971
gactagttctagatcgcgaacggccgccctttttttttttttttaaccaaacatgatacttgtagttccatcacttgattgacatgggaacaagcaaggcaaaaacggtgtcagtacatgatgttacatagataagcatcatcttgacattagtacagcggccaagactccaaaggcaagtaccaaatgacaacactcgactcttttcagcattacattagcaatgtcaacacggatgtgattgccattgaacagtgccatattatgagataaagctgtccgcgcacactgctcatctttgaagacgatgtaggcatgtacattgtcgaccaagtcattgatcttgcctttgatgacggctcccttccgcggaatcttggtgtcgccgaggggcacagagcggatcctgacggagtcgacctcgccgaaggcggcgaactccttggtgagcgccttgcgcttggtccgcagcggcaggttccccacgaagaccgtcctgagcagcttgcccttcgtcgtcgaacgcctcgtcctccgactccccgccggaggccgccgctttcgaacgtcgtgggagcgcctttcctctt

SEQ ID NO: 3972 - DNA, 1224 bp, Triticum aestivum
  Clone ID: PAT_TA_3972
ttggggggttttttttttggggggcagtacatgatgttacatagataagcatcatcttgacatttgtataggggccaagtctttaaaggcaagtaccaaaggacaacactcgactcttttcagcattacattagcaatgtcaacctcgtatttttttccctcgctgaaccaaaggccatcagggactcgtctcatccaaaaccctcaacactcatattacaaagtgaagcgaacaatccatgacaggggtggctacttcctcgccttcttgctccggtgcgtgttctcgggcgtcgagccgtcctgcttgcgcttcttgttcagctgcttcgccttccttgctgccacggcgggccgcttggccttgcgggcactctcgctttgtcccgtctcgctaggcctgccttgctgcttcccttggttgatggggcgccgggccaccttcaccttcttcacgacgcccggttcggtcgacttcaggccttggtaagacaggcttgccggcgccttgcctgtgttactgtcgctgccttcgcgagacttgctgcctgggcgtgaaaggtgtcttctgttttggagtgccgcgctttttcccagaatccgccttccggcgtcgcgtcggctgcctttgcatgggtgagcctcaaaaagcgggctctgatctgaaggccacgttttctcactacagagttcgcagctttccctgctttgaatattacatgggcgagcccctttcctcggcttgaagctgggtcgctggaagctctttcagatcctacttcccccgttggttcactgcgaccgcagcagagccggtagagctcctcagcctttacaccgaatcgatggctacccacaaaccctgtcctctttctgtcagtaagaggtcctcctcctcttggcgttttacgaggccgacccgcacttcgaacagggggttacctgccatcgctcaccgccttttgtcaagaaaaagtcctccgcctcttcgcctcatccgtgatgccgatgtaggcttgtaccgtgtcggccaggccatggacagtgccattttatgcggctcccctccccgcacactacgggtcaccgttgggcacggagcgggcacgtacattgtcgacctagtcgttggtcttgcctttgatgacggctcccttccgcgggatctgggggtccccgtgcgccacagagcggatcctgagcggggcgccccctcgtgccgaa

SEQ ID NO: 3973 - DNA, 825 bp, Triticum aestivum
  unsure (1)..(825): unsure at all n locations
  Clone ID: PAT_TA_3973
ntcggatttccactgtgggaatttacntccaaatgtatcctggcgggggcgccgccgagcgggtcccccgtacgtgctgaagtcagagaaggccgacgtatacagattgccgtatttatcaagtggtgcacctggatttgcattacttgaagctgcccaggaaggccaattttcaagaggtattaagcatacatttcggctggattttcatccaacagcggggacaaaccaatattgctggcatggggggagtcggacaagtacctaccgctctcgatagccgaggagttcaagaaaaacaatccatcagtggtgaaactgaaccccatcgaaggagctggtcacatgccgcaagaggactggccagagaaggtggtggcggccctgaattccttcctgtattagtctatccgttctacgaggtcatcatacaggcgtggacaaacggttgatcagtcagtatctacatacgtcacccatatatccactccgcccggatggacgcaccgtgtgcaactggaaggattcatcccaacccgcgcgtgtctgtaacagcgtagtgcgcctattcgctacagccgacatcatacaaggttaacgcggtggttgatcagttggtatatatatgaaactgtacagttcagatgcacattgtgtagatgaagggcggttgaggacaacttgcgtgtatatacaagagttgattacacgcacatggtacatttactcgcactgtaagtgaaagggttgaagatcatgcgagtaaatgtatgtatgcgacggacggcatgacttcagttacccagcaaaaaaaaaaaaaaaaaa

SEQ ID NO: 3974 - DNA, 724 bp, Triticum aestivum
  unsure (1)..(724): unsure at all n locations
  Clone ID: PAT_TA_3974
attgactgattctcaaaatcaagaagcaaatccgggtcataatgaaatggacaccatggatacttgcggctttcctttgttcagccatgacttgcaaaatgatcctagcagtgctgatggcagcttacaaacactactgagtgcctcccaggacaaggctgaggtgagcaccatgaagaggagtagatcagtggccgatatagagagctcctccaacggggaagtagcagtgcttgaggaacttgaagatgtcatgtttcagctgacaaagaagacacgtgtatgcctccgtgacgctttctacaggctggctgaaagctcggaagtgcagtgcactgctgtaaatggagggacactgacgtgctcaaacgagcaaagttttcagcaatcagagggcaccgaatctagcacctcgacatcagaccgtgcagaacgggagacgaacgcgatagacagaaccgtggcaatcctcgcgttcaagccggcttcctcagctgcatgggaatgaatgctgcaccaatgatccaatgtcatccatgcctggctggatcatcaaaggtgaaggaggaggcttagcgtttggaagtacttccatccgctgcctcgccattttgcttcatgcagagatgtaaatgtactacataggttgctaggacattttgttttgagcttgcaagtagagagagccagcatggtacagagctgnatcatgtataatgacttg

SEQ ID NO: 3975 - DNA, 621 bp, Triticum aestivum
  unsure (1)..(621): unsure at all n locations
  Clone ID: PAT_TA_3975
cttcgccattcatctcgtcctcaccacccagcgccgttccgcctcgatcttcctcctcctctacctcaccttcaagcgctgctcctcctcctcttctgcatccacctcaccacccagccacttcccggctgccaaaggtggcgcgggaaattctggcagcatcggtgtgtgtgtttgctgttgcggctggggcggcggcggcctgctcatcggctcacgggggccggagcggagtaccggtgcagtggtggtggagcccctcccggtgggtggctgggagcgacggcgggctgcagggctggcgtgcagtggcggctcggttgctcgccagatctggcggccggccagcacgctcgggggctggttggacctatggcggaggcgaaggaggaggtctggtggtgctgctcctcctgccggtggcggaaggattctggggcggcttgggtggaatcaccaaagttttctcttccgtgaactcctctctgtaccaatcgttggccaatccctgtatgattcaatatggcaaaatttgctccacctatcctaattaaggctggggacaaacaatgggtncaacaaaatttttttttgtaaaaaaaaaaaaaaaaaaaaanccng

SEQ ID NO: 3976 - DNA, 1344 bp, Triticum aestivum
  unsure (1)..(1344): unsure at all n locations
  Clone ID: PAT_TA_3976
aggaattcggccgcggccattcggcgttaccgatgcgaccccacgtaccggttcctgcacgaccgtacggccgacctgttcgccagcctgcctcgtggaggacatgcgcaagctcgccaacgacgacgtccgggagctctcgctcgcggcgaagtggtgcccgtcgctaggctcgtcgtacgaccgctccactctcctctgcgaggccgtcgcgcgacgcctcttccccaggggctcgtcgccagagctcgcggatgatctccccgacgaaccttacgcttatcgtgcgcgcgagcgcctccgtaggacggcgctcgtgccgctccgccgcgcgctacagctccccgaggtcttcatgtcggcgcgggcgtgggagtccgtcgtgtacacgcgcgtggcctccgtggccatgaagaactaccaggccgtcttcctcaagcacgacgccgagcgcttcaacgcttacctcgccgatgtcaagtccggcaagaagcggatcgccgcgggcgcgctgctcccgcaccagatcatcgagtccctcggcgaggatggggacgacggcggagtggccgacctgcagtggcagcgcatggtcgacgacatgcgcgccctcggcaagctcaccagctgcgtggccgtgtgcgacgtgtccggcagcatgtccggcctgcccatggacgtctgcatcgcgcttggcctcctcgtgtccgagctcaccgacgacccgtggcgcggccgcgtgatcaccttcagcgagcaaccgaacatccacatgatcaagggcgacaccctttccgaaaagactgacttcgtccggaacatggattggggtatgaacaccgacttccaggcggtgttcgacaagatcctcgaggtggccgtgggcgccggcctgccgccggagaggatggtgcggcgggtgttcgtgttcagcgacatggagttcgaccaggcgtcggcgcacccgtgggagacagactacgaggcgatcgtgaggaagttctcggaagccggctacggcgccgccgtgccggagatagtgttctggaacctggcggactccaaggccgtgccggtgatgtccggccagaagggggtggcgctcgtcagcgggttctccaagaacttgctcaagctgttcctcgacggcggcggcatcgttcaccccgagggccgtcatggagaaggccatcgccggcccggagtacgaccagctcgccgtgttcgattgatgccgacggccgccgcgccagtgctgccgtctgtatgaagctgtaggactaaaaagcggcgcaatctcatcaactgtattgcattgcatatgnaaatcacaagttcacacnc

SEQ ID NO: 3977 - DNA, 343 bp, Triticum aestivum
  Clone ID: PAT_TA_3977
gcggttcactgcagcaatgtaggtacaattcaagctaatttgctgacaatcttgctcacagccaagaaaattttagttctgattctttgaaaaaaatcaagttcttggcacaattaatattgcatgatctgtgttggctacaatttattcatgcttgctttgaattcttggttcatgggaataatttataattttatctctgtactacacatgtaatataacttgtacaaggagaagaagcttgtcaagttttacctctatactagacatgtaatataacttgtagaagaagagtactagacattactccctcttcccaaaaaaaaaaaaaaaaaaaaaaaaa

SEQ ID NO: 3978 - DNA, 1227 bp, Triticum aestivum
  unsure (1)..(1227): unsure at all n locations
  Clone ID: PAT_TA_3978
gcggcccgcgcctccctcctccgcccacgcgtccgcccacgcgtccgcctccacccacccggctttcgtttcttggaagcgagaggagggacggggagggagagggggcggagggcgccggtgagctttgccagggaagctgcttgcgtggggctttgcacggccgggccccgcccacgcatccctcttgctcactcactcccaccaacgctcgcctctcacctactctctctctctcttatctccttccaagatccctttttccctttcgtctttgctaggaccattctttgatctttccttggctccaaatactcccgttccagctgcgcagatcccacctcggttccctcccgtcggagtaatcttagctcgaatttgacttgtttcttgctcttcttttttgtggctgctcagttggtgcgcgtctccgcttcaatccgagaacaacccccgctcggcaacaagtgtcccccttcttctccgggcttcgattcgatcgaatcccacccaatatttttctaaccctttctgaagtggtttcgatcgactagctttctccgatcgtctcgagaacgccgctgagttagtggttgatgcggctgtggtcgtagatgcggcagcatctcatctctcttgcagcccttggctccgggtctggttggctcgcgtcgtttattcgcctcggcgcaccgtgcagtcgcagcgccctacggctcgtttctttgcctctcatcaatgaatgcacgcgccgctgccatgagactctccctcgcctccatctcccaacaactcgcgccctcgctgctcggattcttcgccgcctccaggcccctacgccgcgcggcctcccggcccgcatcctcggccggcgacggcatgccccgcgggccggcctccaaggcggagcgcccggccgccaacctgcagtcctcggatacgaccggcgagccgtcggtgctcgaccccccggagctggccagcgactgctttctcgccaagctgccgccggcggagctgcgcagcatggccgccgtcagcccgtccacgcgggaaaggtgcaggaccgctcaccgctgggagcgccgcgtgtccgacaagtggggttctgtcctgggtaccgccgcgagggacgagtggaggtcgtacctgtcatcgtcaacccgcgcccggcggcggcgcgatcggggtgcgggtctgctggcagccggcgccccgtnnnggtgc

SEQ ID NO: 3979 - DNA, 760 bp, Triticum aestivum
  Clone ID: PAT_TA_3979
ccacgcgtccgcccacgcgtccgagaggtgtaaagtgtttggggctagcgtgcgggagtttcggccccagcttggggcctgcgatagtgatcgggcatttcgtgagctaactgagctaaccacctgttcagagagagatgtggaggctcaaggtgtccgagggtggcggcccgtggctgcggtcggtgaacaacttcctcggcagggcagtgtgggagttcgaccccgactacggcacgccggaggagcgcgccgaggtgaagagggtgcgccgggagttcaccgaccgccgtttcgagaaaaaggagtcgcaggatcttctcatgcgcatgcagtatgcaaaagtaaagcatcttcaggtggaccttccagccatcaagcttgcagacagtgcacaagtcacagaagagactttactaacatcattgaggcgatgccttagccagcattctgctctacaagcacacgatgggcattgggccggggacttcagtggaattttgttcattatgcccatcttgatatttgctctacatgttactggatcactcaatactgtcctatcaacagaacatcgacatgagatttgtcgctatatttacaaccatcagaatgaagatggtggttggggcacgcaagtgctgggtccgagcaccatgtttggatcatgcttaaactatgttaccttaaggcttcttggcgaggtggaaaatgatgccttaaccaagggacgtgcttggattctattgcgcggaagtgc

SEQ ID NO: 3980 - DNA, 616 bp, Triticum aestivum
  unsure (1)..(616): unsure at all n locations
  Clone ID: PAT_TA_3980
ggtggatccaccgtaccttatcctttgtccgcaaactgccatacactgcaaggggtgtctattctatttcatcgataggggaaaatcagccatgctccccacgggggctgcttcgtttcagccttcaagacgaaactttcggcatcactccgttgcttaacaacctctaccctacagttgaagatgaagatattgttatccatgagcttggtggggaactatgcgctactttcttctgcaagagtatgcaacgagtattgatctcgatgacaagagatatattggtcccggaatgggaatgtcactatgtaatgaatgtttcagaccagtgcttgccaatggcctcacttagcaatggcgggattcttctacggagaggccattgtctctcccgttattacatgaaggatcatggtgtaaaagaaaatgacatgttcgatatcgatgagctaaggttccttgggcctagtgaagacacattgggacatgcatgggaaaatttattttggttcgacctaccctattacacgccaagtcttgttccagttactcctaaggcgagcttacatcccttaagacagtcactcaagtgttananaatgcttganaanaattt

SEQ ID NO: 3981 - DNA, 505 bp, Triticum aestivum
  unsure (1)..(505): unsure at all n locations
  Clone ID: PAT_TA_3981
tnaaatggcgtgcctattatgntcgttatctgacatcttngaattgtcanacaagattacaaggtggtcttctttaaatgtgattggtatgatgttcatcacaaagctggtattataagagatgagtttggattcactcatgtgaacttctcccgaaaaatacatacaggggagaagttagaggatgaaccttttgtattttcttcccaagtggaccaggtcttctatatccaaaatccgagaagtgagaattggaataccatggtgaaattcaaacctcgtgatatttttgacatgggtggagaaccatcttcagatgaaacagagtagtctttgtgtttttagcttgttatctgcagctaagatataggttgagcaattgtcatccatgctcctaggtataattaacataattatacctaggagcatggatggatcttcttcggaatgtatgttactttgtgatgaacgagcctatggtcttttttnttaatgtgtatgttcc

SEQ ID NO: 3982 - DNA, 897 bp, Triticum aestivum
  Clone ID: PAT_TA_3982
cacccacgcgtccgagatcgatctgaggagggctcgactgaacccagcacctctgtctcgtcttcgctcgccggccgccaccatggcccaatccccaccccaaaccctacccttcctcctcctccccctcatcctcctctcgattgcccccgccgccagcgcggtctcgttcgccggcctagacgccttcctcacgtcggccgccgcgcgcgacccctccgccgccaacgacaccttcggctctctccccgccggcctccgccgcgcgctctccgccccgtccccgatcctcccgtctcgcctcctctccctctccgccgccgtccccgtcaacgtccgcctcgcgggctcctccttcccgcccacctccgccagcctcctcccttcctttgtctcgtccgccgtgtcctcctcccacttcctctccagccgccccccgcaccgcctcgccgtctcccacagcgtccacctcgatgtcgccgccgcccgccgcggcctccgacctcgtggcccgcgccgcgaccgccgtccaagcccacctcaatgcagcccccgcgcccttccgactccaacgccctctcctccgtgccttacaaaatcgtcgacgatatcgtcgccgaggactaccgagcgcacgccggctcggcttcctccccggccgtctacatctacttgctcgacctcggcccgcagccgcgttcgtatgcctacgccgcggcctgctcctctgccggtggccattcgcctgccttctcccgctgcctcgcccctctctggaccggcgaggagcgctacatctggatcgacctctgcgctggcccggtggactacgggccggcgctctccggcgaaggcgtacggcctcgtggtgagtttcatcctcttgctgctctccac

SEQ ID NO: 3983 - DNA, 718 bp, Triticum aestivum
  Clone ID: PAT_TA_3983
ggaattcggcacgaggcgccgataaaccctagctagcttctccccggacccgccggcctctccccgacgccggtgcgccggccgccagatatccaggttgattggctgcagttctgcagaggcaccatgcctgctggtgacaacccacactcgatatcagagaaaaaggcagcactgagggagtcacctaagcaatctaagaatgatgttaatcagcaagccagagcttctacatttcctaaagacaaagttgctgggaccgttggcatcaagaggccgcaacctaacgcccccctgagcctaaccaccaaccagcacgcgccaggaaatcccggggcaaatggccatctcgtgtatgtgcgcaggaagcttgagacagaccaaagcaaaggaggcgcttctgctggtgcagagagtgccaattctgtgagctcaaagaaacctgctactggtggaccgcaggagcaaagtttgaagcttcagaacagtgcgactcatgcccaatcagctcctgtttccgcgtctcctgctgcagctgctgctaccaccaatgcgtctcatactccatcagctcctgtttccgcgtctcctgctgcagctgctgctaccaccaatgcgtctcatactccatcagctcctgtttctgcgcctcctgctgctgcagctgcccctgctgccccccctgcgcgcccgccggctcacctttctctcgcgaaac

SEQ ID NO: 3984 - DNA, 655 bp, Triticum aestivum
  Clone ID: PAT_TA_3984
tccattgagacacgaagattgccactgggattatgcaaaagctcggtgcgcctttccagaattctgtgaatacaggtacacgtttggtgacgtgcatctaggaatgagctgcaggctgaaatattcatcaactaagctccttcggcagtatctctgaagccattgcttgcttgtttgagtgagtaactcttgattaccacgtcctgtgaatcataccgggcgttcctctttcgcttggcgatggccaggacaagtcaggggcttagcccccatccaaaacagttatgacattttcaggattttgcggtgttgcttgtaacaccaaaatcttgagccacgtggaagccactcgcagcagaattgacttgatcgtgctgtttgggcagccaattgctcacacactaagagtccaagaaggtactccgtacttccatagtactccctctctgaatatctagggcttattttgattggttaagacaagggtttgaccaaaaatggccccatcagtatgttatctatccaacgcaaaattagtgccattagacatgtaaatttttgttagccaatcgctaaacatttattggctgttgaattggtaagagccgggtgcttccatggagccatgagtggtttataaaaaaaaaaaaaaaaa

SEQ ID NO: 3985 - DNA, 904 bp, Triticum aestivum
  Clone ID: PAT_TA_3985
cctgatacacatcatgaagtaggtaactggtgtggtacttatattcagatttgacaggaatagaaactgaacctattaaatagttatgataggctagatgggttataactcttcataaattcatttccgaattattgtttgaacaacgctgggttggagccccggtggtgctaacatctgctgctggacggcgaccaatgggacaagtccctaggtaagacgaaaacaagtgttgcatcagcacatttgatgcacaacagccatcgtaagttcctctcccttctctaattagtattgatatttcattgttattagagcagagcagccaccaaaagttcctcttttgatgcatcattgaaaacatctctctctctctctctctctaattgattcacacatttatcagttcacgcggcgcacggtgtgtccatttcatttggattttgaaacacaatgaatggaaaagtagaggctgggcggactacaaaatgggcagcagagtggttgttgaactttatctgtcctccattaatcctttgctgtgtgtacatatagaagtgctgaagactgttgggtgactgattcgacgcaaagttcaatggctccttctgtgctatctggagctggattggtcatcacacagtcgatgcagagttcgaagcaccgcgtagtatgagcagaggtactgtaccgtggtttctgattgtttatctgaactacaattggactatgtacagctaatagcggcggctctgtttcagattgctggtagttctgaaagtacagtgaaccaaggtgtaggttcagaacttgagatcggtttgacctcgggtgtttattctgtgtctgatcatgtacgcatgtcataaaattaagatctggggttaaaaaaaaaaaaaaaaaa

SEQ ID NO: 3986 - DNA, 1057 bp, Triticum aestivum
  Clone ID: PAT_TA_3986
ctacccacgcctgcggcctgcctcaggccgtccagccaaaccctagcaacaccgccgccgctattacccccaaggccccaaggccaggcgcggcaccgccactcccgcgcctccctcccctatggcacgtcctccctcccaggcctcggctgtcttctccgtcggcggcgagggcgccgcactcttcctctccgtcgccggcgagggcgccgcgccctaaactccgaggtgcatttaaactccggttttgcatcatgaaatagtgagggagcgaaaaagctatgtcatgaagctcttcgtgctcgtagcatgggcactgttgttattgtctcatggatctggaagcgtcaggtccgccggcctcccggcgcgcggtacagatatgctgtcgcttcttgatttcaagcgcgcaatcaccgacgatccgaaagggctcttgagctcatggaacaccagcgttcacttctgcaactggcagggtgtgaagtgcagcctcgcagagcatgagcgcgttgcagagctggacctgtcggagcagagttttgtcggggaaatctctccttccctcggaaacatgtcatatcttacttatcttaacctttccagaagcaagttctctggtcagataccacatcttggccggctgcgagagctggagtttcttgacctgagtcacaactcgctacaagggattattccagtgacgctcgcaaactgctccaacttgagggtgttagacctctcaagaaacttattggtgggtgaaattccagcagaaatatccctactctccaatctgacacgcttgtggctttcttataatgatcttaccggggtcattccaccaggccttggcaatatcacttctctagaacatattattctgatgtataaccggttagagggaggcattcctgatgagtttgggaagttgtccaaaatgtcaaacttactccttggtgaaaacaagctatcaggtagagtcccagaggccatttttaatatgtctctgctaaatcaaatggcactggagttgaatatgctagttggtactcta

SEQ ID NO: 3987 - DNA, 733 bp, Triticum aestivum
  Clone ID: PAT_TA_3987
ctcacctcacttctcgctcaggcagcggcgattccgaatcggccggcggcgcgggtgaagtatgtgctggccctctccctctctttctctctcgggttgttgggtctcccgctgtcccgttctctcgctggcgggtgaatggcggctggtggctgtagctcctgctccgatttctctctgaccggatgtctctctgaactgattccccttgctccgattttcccctgactcaaattcatctgggaccgacggcaagcccacgaccagggtggatagcagctctcccttcggcgatttccccctcaggtccctagctgttcgatttattttaacgtcttctgtcgtcacagcccatcttcagtttacattgtaatggtgtcatcaatttcagcaagacggcctcaacaactttatatgctacgtaataatgctccatggagataagtcccgtgcattggttcatgtgctttcaaagaataatcgcatcgtttatgtcctaaatgccgatgatgatggaaaacttattaatgctcctcgtgaagaatatgtgcttgattggttcatagtggacagtgcgaaggggggaagcttagattttgttcttactgcttctccaaagacttgctcccctatccattcaagtgttttttatatgccaaattaatcattaattccataacatttctatgtgagaatctttactgagttcagtaaaaaaaaaaaaaaaaaaaaa

SEQ ID NO: 3988 - DNA, 804 bp, Triticum aestivum
  Clone ID: PAT_TA_3988
ccgaggtttagggttccggcccccggagcagctccccacccgccgcccaccccggccagagggcacgggcagaggcttagggttccggccgccggagtaaatcccaccacacgcacacggaggagcagagccccagccagagacaagatgagcgggagcgcgttcaacgcgttcaagtcgcgggtgccggtggcgtggagcccgaagctgtacatcacgctggtgcgcgggctcccggggacgcccaagctccaccgccgcaccctggaggccatccccctccgccgctgccaccgcaccgtcgagcaccgcaccacgccctccctcctcggaatgctcacccaggtcaagcgcctcgtcgtcgtcgagaccgagcgagatgtaccacgcgcggaagcaggccgacgagcagcgccgcgccctcaggcccccgctcgtcgtggcgcacgcccccccgcccatgccggtcgccgccgcgccggtagggcgcgcgcccattcagtcgcctccggtgttcgacgcaccgccttggctgggttggcgtcctcctttataatagaaatgctttagcgatctttggcaacttgaattgatgggaataagcggcggggttcccgccctccttcttttttgctacgctgtggtgttctgtagcgtctggccttgtcgggtctgtgggtggtgcgtcctgcgttggttcctgtttactacttttattgaaatgtaaggcctaagtcaaatcagttggcgttgcataatgttttgaatgctgaacttaaaaaaaaaaaaaaaaaaaaaaaaaaa

SEQ ID NO: 3989 - DNA, 572 bp, Triticum aestivum
  Clone ID: PAT_TA_3989
cgggtcgacacatggactaaaatccttgcggccaaaaagcataaactcaaacgcccccccgaaagctacccaaaccgcaggttgttaccctgattagaggaggaagcacttgacgcggccgaccggccacctcgtggccgcgacagagaggcctgtcggccctccacttaagccgcaccccgtaccaaggtacggggaaacgcgccggacttgcgagatatattggaggataaggcaaggcaatcaagatcgatctacggatcgcgtgggcgccccatgatacgcgacgacaaccgtcacgccggacacaacaaatccggccgggccgaacacagtagacaaagctcttttgagctccgtcatgatatagcccagtacagaggcgccgcacacccactatgcttcacagatgaagtaatggatcatcaaatccccgaagggtttaaacccgtgaatattgaatcttatgatggcacaacagaccccgcggtttggatcgaagactatctcctccacatccacatggcccgcggtgacgatctccacgccatcaaatatctcccactcaaact

SEQ ID NO: 3990 - DNA, 1473 bp, Triticum aestivum
  unsure (1)..(1473): unsure at all n locations
  Clone ID: PAT_TA_3990
cccaagccatgccccgacgccgctcaactaaggcacgggaaaatgcgcccgacctgcgagacatactggaggataaggcaagacaaacaaaatcgatctacggatcgcacaggcgccctacggcatgtgacaatgatcttcactccggatgcaacaaattcggccgggccgaacacaacagacaaagcgcttccgagctacgtcgtgatatagcccagtacagaggcgccgcacacccgctatgcttcacgaatgaagtaatggatcatcaaatcccagagggtttcaaacccgtaaacatcgaatcatacgatggcacaacagaccccgcggtatggatcgaggattatctccttcacatccacatggcacgcggcgatgatctacacgccatcaaatacctcccgctcaagctcaaaggaccggcccgacattggatcaacagcttgccagcagacgtcaatcggttcttgggaggacctggaaagccgcattcctcgacaacttccagggcacttacgtgcgaccaccggacgccgacgacttaagccacataattcagcagccagaagaatcggccagacaattctggacacggttcctaacaaagaaaaaccagttagtcgactgtccggacgcagaggccctagcagccttcaagcataacatccgcgatgagtggcttgcccggcacctgggacaggaaaagccgaaatctatggcagccctcacgacactcatgacccgcttttgcgcgggagaagacagctggctagctcgcagcaacaacttatcaaagaaccctggtaattcggataccaaggacaaaagtggcaggacacgtcagaataagcaaaaacgccgcattaacagcgacaacaatgaagacacggcagtcaatgccggattcaaaggctataaatccggtcagcggaaaaagccattcaaaaagaatactcagggcccgtccagtttggaccgaatactcgatcgcttgtgccagatacatggcacccccgaaaggccagccaatcacactaacagggattgttgggtgttcaagcaggcaggcaagttaagggccgaaaacagcgacaaggggctgcacagcgacgacgaggaggggacccgagccgccgaacaatagtggacagaagggtttcccccacaagtgaggacggtgaacatgatatacgcaacccacattcccagacgggagcagaagcgtgcgctacggacgtatacgcgatggaccatcgccccaaattcaaccgtggcctcctgcctgtcactttgatcgaagggacatcccactacatccgtcatggcggctcaccgcatggtntcgaccaacatcgacggattatctcacaagatcatatggacagcgcagtanctgaactcttacaggataantcgnaaatggcataattctcacgataagccaaaaacaccttaaggtatacagttaan

SEQ ID NO: 3991 - DNA, 1445 bp, Triticum aestivum
  Clone ID: PAT_TA_3991
cgctatgcgagctctgctctctcgcatcccggtctctaccgctgccttctcccccgcctcctcccaaaccctagccccgacccctagcctcgcccccctccgcctccgccggcgcttcgtcgccatggccggcgccgccgcggaggagttcgagaaggggcgcgtcttccccaacggcgtcgctgtcatcaccctccaccgccccaaggcccctcaacgccatgaacctcgaaatggaccttaggtacaaggcatttcttgatgactgggaaacaaatccaaatgtgaagtgcattcttggggaaagctgttctccgcgcgctttctcagctgggatggatattaagggtgttgcagcggaaattcaaaaggacaagagcacatcatttgtgcaaaaggtcttcacagctgagtactctttgatttgcaagatacatgagtatgcaaaaccttatatatgcttgatggatggtgtcaccatggggtttggaattggattgtctggacatggccgctaccgcattattaccgagagaacactcctggccatgccagaaaatggtattggcttgttcccagatgttggctttgcttacatcggtgcaaaagcgccaggagggggcgcagtcggagcttaccttgggatgacaggaaaaagaatatcttcacctgctgatgctctgttcataggtctcggaacccattatgtaccttccggggacttgggttcactcaaggaatccctcctgagtgctaacttcactgctgatcctcacaaagatgttgagtcactcctgactgggtacaagaaggaacttgagtcggtgccccaattagaaaagcttttaccggatatcgtttcttcttttggtcctgataaatcagctactgaatctgtggaagagctaaagaagcgtagtcaaagtggtgatgccacagtgtcagaatgggccaatgatgctttagcaggacttaagaaaggtgctccgttttctctttgtttaacacagaaacatttctctcgagttgcatcgtcatatgggaacaatgaaaattatctatctaagttggctggtgttatgaaattggagtaccgcattgccttgagatcgtcggttcgaagtgattttgctgaaggcgtacgcgctgtcttagttgacaaggaccagaatccaaaatggagtccagcaactctggaagacgtaaacatggatgaggtcgaatcagtgtttgaaccattagctgccgatgctgagttgaatgtgtgattttctgtagcagcccagaatgctgtgaccacctgaacaccctttgtccttccgatgatgtaataggaaattattacaaacatacatacggctatccattgagccaataaatttgcctggagtgcatagtctgaaaacaaagtttgattatcagcatttgatgcagcggtttatttg

SEQ ID NO: 3992 - DNA, 554 bp, Triticum aestivum
  unsure (1)..(554): unsure at all n locations
  Clone ID: PAT_TA_3992
agacgagatggagggagatccaccgcgactcagctggtcaggcggcgcgcccagatccggccttgctctggccgtcgccgatgagctgcgcccagttcagccatggcgcgaccgagcaggcgaggagggagactagctaggagtttcccccctctctatccctctcctgcccgccgcccccctgcagccgcccccgcgccggcgccggatccacatccacagccacggcgccggcacccatggagtgaccgtgtgcttcttctccatggacatggagctcccacaacacaccatggaaggcctggagctccttctcacggcaggtgcaccgcgtacaggagggaagaccaacgctcctccggatctgcttcttcccgggtcgccgttgctccacggaaggcggaaagtcatagaagatggctcattagcttcaaacagatcagtggttactgaatcagtctcaaaatcttgttcctncgcagaagtgaaagatgaagatgttgcaattgcagttgtgattgatgcagctgaacttaaatgggaagagcagtcat

SEQ ID NO: 3993 - DNA, 1233 bp, Triticum aestivum
  Clone ID: PAT_TA_3993
cggacggcacgggccgcgatgcccacggaggggccggccctcccccgcgcacggcgcaggccaaagggtcgaggtttcgaggcagcgagacgggcagggaaaatgctctggttctcgagaaaagaggaaccgaaagagaagagaaatacgctccaaaataatagcagaagcagaagagatcaaaatagcgttcaatgagaagaggatacagacctgtgagacgaataacaaccatagctccgaactagagaagattttcatcgaaagccaggagtaattccgcgcgagcgcagacaagcagtactcgtagtcaatcggggagcgcaacccacatgaaatcgccaccatcgagaagcggggcacgtaacacaagccccagatgccatcgatcgcgcccaggaaggtgcgcaaatcgcggcacccccaccgacctctgccccgaagcggccggtcctgctcaaagtcgcacctgccaaggcccccgcccaagaggcggccaaggagcagaccgaagcagccgaggaaggccccttagaaggagcaaaacaccaggcccttgactaagcatagaaggccaagctgcctgccgaaaacaccgagacacccgcctacgccgcagccgtctagtttgtagagatccgccccagaatggcaacggatcaatctgttttgaatttacagattaatatcacagaaaccaactgcacctcttaactaatcttctcatgttttcaaagaccggaatgaagacagtcctgtagcgatcttttttgtagagatgcgcgtcgggatggctttgtatcgatcacctctgaacattcagcttagtatcacagcaaacaactgcactcttcaatgttttctcctggttccagacattttggatgggtgaatacaatatcatcagaaaccaaaaaaaacaaaaaatagaactttaaccctacaaaatggaaataaaggaacaaagcaggccaccctccttggtgccttgtttcacctagggctgacgtcgggcgccgtctgcggcacgacggtgctgaacatgtcggaatcatccgctgtggtcgagttcttgaacctccagccgccgcgccccgcccccccggtggcaccgccatgcctcgctccccgccgccacctctagcctcgatcgtcttcttctgctgtgtcctggctgcggtagctccgcagggggcgtgccccggtggccgctgatggggtgtttcctggtgt

SEQ ID NO: 3994 - DNA, 972 bp, Triticum aestivum
  unsure (1)..(972): unsure at all n locations
  Clone ID: PAT_TA_3994
cacttcagcagatttgttgaatgaatcatttaagtaagaacaatgctctgccagagtagataacaaaaagctgacgagaacaagacctatacacaaccagtcagatattttgtgacatactggtcagtaccacattacataacacaacactggaaatacaaaatacacttatacaatacagaacactggaaatactaagtctgacagctttcataacgcctgagcacaatcaaacttcctcacttccctccattgagatccacagcttgtcttgaaccagacgggaccaagcaactgtgatttccagctcagagtcgccaaggtgacacacatcctgagttatattgcaattctgggccttgatggatacttcacctttgatagccccagactgcgagttagcatatatgacaacttcaagcgttccacataattttacagagacaacatgccttgacagattaaggtaaccctttgaacaactagtcattgctccatcttgaagcacaacttgccgaaataaagggtgagtactgttaggcaacctgcctttccgaggcctgcctttccgaggcagagagaagcaaacaactctgccaccgtttttgaaaagacttggtgtctcttcaggaacacggagacggatacccacgatagtagcctggactgattcatgaagttcctctgagcttaacaccattgtgcataagcctccgacaacaggggtatatagagtacatgacactttaccgctgtaataccagacacgagtcatcaacgcaatatcttcagactctgttccagccttcactttgagcttgatttcncacatgaacaggttcctcacatacaattgcacgagacgggccagtcaagtgcaaaaaaggatcctcttgattgagtatttggcagttattccttcgacgggaaaagagtatgttgcgattgtgatccacatctcttctgcagcta

SEQ ID NO: 3995 - DNA, 853 bp, Triticum aestivum
  unsure (1)..(853): unsure at all n locations
  Clone ID: PAT_TA_3995
cgaccccgcgtccggtctagtatcgcggacagccgcagccgcaagagtgttctcgtctcatctgagtccgttccgccgcctccgcctccgcctccgcctccggctgctggtcgccggggaattcgagaatcgtatcctcgtgcccgcaaaccgtaggtaccattgcccgcagagcaggccttccctactcctctaaggctgcattacctctacgaaatgccatggccttcctagtctcctagctagggtttgctctgcctcccgccgtcgccgatgttcgaggagatggccgccgattccagcatgggcatggggatgggcttccaccagggggcctcctccttgcaccaccaccaccataacatgctctccttccaatccaatcccgattccgctcccgcccccgcccccgcgccccctgcccctcccgtcttcctcccctcccccaacgctcccgtgctccagggggcgccgcccaagtacaagttcgtcaccggctcaccctccgactggaccccctatgagctctccatattccaggagggcctcgccaggtatgctcgtgagcccaccattatgaaatacatcaagattgctgctatgctgcccactaagaccatcagggacgtcgcgttgagatgccggtggactgctggaaaggagagtaggaggaggaaacctgatgaattctatgctgggaaaaggataagggacttgaaggagaaaatgattgtttctacctcactagctaactttcagatggcacctccaaataatttagtccccttctcnatgtcgatgcatcatccaggtnanaatagcctggctgcaaatgaagataatgcaactcacn

SEQ ID NO: 3996 - DNA, 536 bp, Triticum aestivum
  Clone ID: PAT_TA_3996
acacccaagcgacgaacctcgcttgcatccgatcagctacgcttggaaagccatggacgccaagacgcctcatccgctgcctctgagcgcggcccaaaagcagatccgggatgatgtcccactggtctgcgcatgggcgctcgtcaacgccttcgccatcgccggcggccaagcatccctctacatagctggctacacccacctcccgtgcatccagatccagtcatcatccattctgccctgcctctggatcgggatgctgtgctgcgccgcaacccagtcggccgcggcggcgctggcgctgctgctcccatgccaccgccgccgggcccgccgtgccctcgcctacctcgcgctcgcggtcaccgtcctcttccatggcatgtccgccgtccacttccggatctccctcgccgcctactcaggaggatacgtcttcggctggatcttttacaccgtggtcatttgctacatggtggtgcgcgacctgacctgcctgtctgacctccttcgaggtgatgggtggtgcaagcagt

SEQ ID NO: 3997 - DNA, 731 bp, Triticum aestivum
  Clone ID: PAT_TA_3997
ccacgcgtccgcgccgtcccctggcctctccccgcggcagatcgtcctccccggccccgcccccttgtcgccccgcccccccgcgccgcttcgctcgcccgctcgcagcagcctagctgactagccagtagcacccgtcgccgagaagtatctctcccttccgctcccctctcccctactggtccgcctccgccgtctcgtagtttctccccccagcagatcttccacccggacccctccgccatatcgatctgcttctcctccccaccgccatggctgggtagtgccgccgcagtcgtgtgaattgctgtggccggtcgtatttgctctccgttgagcgaccaataccgcgtctcctaattcctctccgagctggtgctccccggccgctgcctccactaagtgcgcttcactttcctattactcgtggatttgagtgccgtggtgtgatggcagacgttcaagatggtcattatgattcgtccactgacagcttgcgcgttgagcctatttatgaatcatttctttgtccactcacaaaacaaattatgcgggatcctgtcactttagagagtggtgctacatttgaacgagaagccattttgaagtggttcaaggaatctgatagcagtgggaggagccttgtctgccctattactaggaaggagctcagcagcactgagttgaatccaagcattgctctgagaaacactattgatgaatggatgcat

SEQ ID NO: 3998 - DNA, 615 bp, Triticum aestivum
  Clone ID: PAT_TA_3998
gactcctgcaccacatcctcccccctgcgtcactctcgtcctccggacggccccgccccgccccccctacatgcccccccggagctccggctcacccccgcgcgcgctgaccccgccgcagcccacagggtgcacccttggcttttccttgacatgccaaatgaggcacgacgccgggctcgccatgaagggccccacctgcacgtcgtccgtctagccatcacccgacgggccctatgcaggccggccgacgcgtcagggatccaggccgtgcaccgtgcctggtgcttcgcctttccgaccaagcctcgcgtggccatagacgtaattcgcccgccttcattgggcgtcccccgggttaagcgttcggttcacgctttccggtggccctcgttcctgatcaactgcgcgcagcccacgtgcccgcgtgaaggcgctcgagccgtgcatctttctctcgcactccctcgcctccgcacgtgcctcccgcccatcgccacatagcttcctccggtgagctcttgctcagccacggcccgagcgaccgggatgaaagtcccaaggcatatgcttgacgttcatgtgacatggagaatgagaggctgtgccggacta

SEQ ID NO: 3999 - DNA, 1049 bp, Triticum aestivum
  unsure (1)..(1049): unsure at all n locations
  Clone ID: PAT_TA_3999
gcacgcacacacatcacctaactaaaatccccacctagccaccgccaccgccacctccgtgcgctcggccgatacggtcgcgccgctgcccctcccacccccggtgttgaattcagaagctcctgtcaaatctgctgtgcctccccaccatccgcagcttgaggtgccgctgggctatctgctcacctggcgggcgtcgcgcccgctggttcgccctcgtcgccgcctctcccagctccggccatttcttcagtaacttacatccagcagcccatggtatcgacctcaaccaccggcgacccccgtcttgccccgcctctaagtccagcagctgcagcttacaggttgaggaacttgtctacgacccgcagagagaagacatatttgtcaaagaacatacatgtaaaactggagtttctcccacactaagcagaggccctaattaaacaacttgatgcagcaactggcatttcctcaagcaagcgaaaatgtggaaacaccctcagagattgtagcacaaagatggcgacgaggaacttctaatttagatgacttttcgtatgtgatattaggtagtatagcatctgggaggatcaatcgcttgggtctggaggatcagttaagcacatgaaaaaggagacgacaaatggggattgacaagctcttctcagttgctggccccctgcttgaccgcatagcgtcctcatggtgctggcttggtgactgaagatttggtctttttgataatattatatagtggtcgagtggtcaaacacttgcctcttagaaacattggccatcatattttgtaataggccacgacttgtatgatgatacatgtatctccttgatggttgtagttaacttgagtgaagaaaacttgtgaatcttctatatatgttgaatgaatagaagagtccaattgcttgtgtaaaaaaagcatagatcgcaattgaatattaggaatgtaaattcattcaaaatatggtgcagttgcatttctgttgaaatgtagaaccctcacagcaaatgtgtcggcagaagtnttg

SEQ ID NO: 4000 - DNA, 1386 bp, Triticum aestivum
  unsure (1)..(1386): unsure at all n locations
  Clone ID: PAT_TA_4000
ttcccggtggnactcgggcttcatcgagcgggccgcgcgatcgtcgtgcttcgtcggtcctggctccggtggcgggatgatgggcgctggcgcttttggcggcgcgggcgatcagcacatgggcagcgctttcggggaggggtacttggatcaccgtaggaaggaaggcggggacaaggccgagccggagctcgccgggagcggcggcgtgccgagctcggaggcagccggcggagactgctcgtccaaagggtccgactccaagaagaggagaaggcccagcgaggtgatgggaggtgatcaggttcagtcttccaacgtggccgctgactccgcaaacgagagcgcccagagcaaagataaaggcgaggagagcagcccggcgacggggacgacgaccggcggcaagtccaaggggaagggtgccaaggagagctccgagaaggaggactacatccatgtccgagcccggcgcgggcaggcaaccaacagccacagcctcgctgaaaggctgagaagggagaagatcagtgagaggatgaagcttctacaggaccttgttcccggctgcagcaaggtcaccgggaaggcggtgatgctcgacgagatcatcaactatgttcagtccctgcaaagacaagtcgagttcttatcgatgaagctggcgacagtaaacccgaggcttgacctcaacatagaagggcttctctcaaaggatcttcttcgcttccctggggtgtcctcctcgtcgatgggattctccccggagatgatgcacccgcagctgcagctgtcgcagccggggctgatgcagggaggcgccgccgccatggcgaactcggacgtgttcagaagaatcatgcaagcgcaactaggagcaaaagatggatcccattcacagatggcccacgcattgaatgggcccgttcagcgatcacgttgcgcagatggcgtacccgtccatgggctcctcgcactcgcactcgcaggacctcagcatcaggccgtcccaggacgcctaccaaatgtgattgatgccatcgccagccagcctcctgaagagccacccggcccgagtttgtttgtccagctagctggcctaggcctagccatcaatcatctgaccgccaacgggacgggcagcagagcagaggccacatgcacgagcaatatgaccactgaagctgctgccgcccgtgcgtgcgtgcgtgcagtgcacagctggagcctttaactgcgccgtgcgtgcgtggccgtgtgtaaatcgatccatggatggatcgggcgtgttcttgttgtattcggggctggaactggaaaagggggccgagcccccccgcgtgaaatgaaacctgtggcgtgggaatggatgggaaaaaaaaaaaa

SEQ ID NO: 4001 - DNA, 1516 bp, Triticum aestivum
  unsure (1)..(1516): unsure at all n locations
  Clone ID: PAT_TA_4001
gcggagccccgggtaactcaaccgccgcggccgcccgcccgcccccgcctcccctgtcgccgtcctcctccggggtagcagcccccctcaccgcgagatctgtccggtttccctggtccgagccggcaccaccgcctggtgctgattgcccggggtgaatcggggaagtgccaatggtaaaaggtcgtccaggcacggcgcggcagaccagcatctcctcgtgtgcgcgcgggagatcggcctaacacagcgtatgtgcgggtcctggaatgaacgggcattttgtgcacatttagatcagctcaggtgcttcccagaagttccgaaggctggcaggatcaaggagaagatgccgcatgaacgcagcgttgagagaacttgcttcaagaaggttgagatcagcacttcaccttgtagaagttttgcaactgcgatcgacactagcacagctccgcggatgtataagttccagggaaacgcatcgcagattccatatttaaatgggagttcttcaagactcccttccaggcagatgctcatcggaggctcgcctgcaagagcctgtcgacgatccatggaattatgcacgtcgtgtaccagtaatcgggcaaatacggttgacctctggtgcgcgaggcggcatagatgtctttgaggccatcagtcgccatggacgaggattccagtcaggtgatagttcaatggaaccgcatagtggagataccatatatataggaggcatattgccctccctgcctggaggatccgggaacgcctgggagataaataaagagcgcccgaccttatagtttgatccgttccggcatgtgggaattgaattctggcagtgcttgcccaggatactggaaatctggggtgtcctaagcggatgcaagtgggcggtggtggttggccgcggtgggcggagcgcatcttccagaatgaaatggccattcgtcaatatcgtaatccgccctgctgctcctcagaggtttcccggcctgagcctgtcgacgatccacagcatcatggacgccgtgtaccagtcatcgagcaaagatggttgacctccggtgcgcgaggcggcgtatatgtcttgaggcatcgatcgctgtggacgcggaggccagtcaggtcatagttcaagggaaccgcatagtggagataccatctatataggaagcatattgccctccctgcctggaggatccggagacgcctgtgagataaataaagagcgcctcaccatatagtttgatccgttccggcatgtttgaattgaattctgccagtgttggcccatcttactgtcatctggggaatcatctgctgttgtaagtcgtaaccggttggttggttgttgtcgcaagtctgtatctttgtgctttggattcacagagttgatggtgtctggcctcgcatccgtcgtcctccaatcccgggccgggcggccccccaattcccttatcccctagccccctacggcgcggtaacnggtacaatacctnnnaccctt

SEQ ID NO: 4002 - DNA, 751 bp, Triticum aestivum
  Clone ID: PAT_TA_4002
agcgcgggaggaggagcccgagtggatgagactgcgatgcaggaagcctcgccaccatcgtcggcgtcgtcctcctagagcagggatggcagatccatgctatttctgagtggtgaagtcatcttctccaccggattttgtgcagggcgtcacctctggcaaggtcagggaccaacgcctgtccttctccgggatcccgaagtaccactacaaatgtgaccactggttgtttgtataaatgcttaagggggactgctcaaggaagggcatgtgtgtttcagagatagatatggaaattgggcgctggaccaacaggagaagaggaaggagtggaatcaactgatgtgcattacatttctgtctctatggaactcagttatatactggggcaaattatgtttcagtgatacaaatgactgatgttggtttgggtatatgtggtctagaaggtcgtcaagtagttatggcctcagattttgttatggagcacttttgctttgttaagaaatcgcttattcgcagaggcactggaaccatcagttcttcagatacaatatcagtacaatggacatatggaatgtgggattcttgatacatcaccattattaaagtctatgacatcaacaatgtccacctggtactccactcactactggttcttgcctctttgaccatccattaggttcaaaaacaacatatgtatgacataaaaaccgtccttggaaggaattgggctgatagaaaagaggct

SEQ ID NO: 4003 - DNA, 769 bp, Triticum aestivum
  unsure (1)..(769): unsure at all n locations
  Clone ID: PAT_TA_4003
gggtcgaccggtgagaaattctcatcatagtcaaccccttgaacttgtctataacccttagcgacaagccgagctatatagatggttacattaccatccgcgtctgtcttcttcttaaagatccatttattttctatggctcgccgatcatcgggcaagtcagtcaaagtccatactttgttttcatacatgtatcctatcttggattgcatggcttccagccatttgtcggaatctgggcccgccatcgcttcttcatagttcgaaggttcaccattgtctaacaacatgatttccaagacagggttgtcgtaccactctggtgcggaacgtgtcctcgtggacctacgaagttcagtagtaacttgatatgaagtttcatgatcatcatcattagcttccccactaattggtgtangaatcactggaactgatttctgtgatgaactactttccaataagggagaaggtgcagttacctcatcaagttctactttcctcccactcacttctttcgagagaaactccttctctagaaaggatccattcttagcaacaaatattttgccttcggatctgtgatagaaggtgtacccaacaatttcctttgggtatcctatgaagacgcacttctccgatttgggttcgagcatatcaggttgaagctttttcacataagcatggaagccccaaactttaagaaacgagaactttggtttcttgccaaaccacagttcatatagggtttaatgcgttttctgagactaac

SEQ ID NO: 4004 - DNA, 2096 bp, Triticum aestivum
  Clone ID: PAT_TA_4004
agtcacaggaacagatttctgtgatgaactactttccaataagggagtaggtacagttacctcatcaggttcaacttccctccaattcacttctttagggagaaaccccttccccaaaaaggatccaatccttggaaaaaaaatccttcccttcggatcggaggcaaaaggtatacccaaaagttccctttgggtaccctataaaaacacatttttctaacttgggttcaagcttttcaggttgaggttttttgacataagcatcgcaaccccaaactttcagaaacgacagcttaggtttctttccaaactataattcatacggtgtcgtctcaacggatttcgacggggccctaattaaagtgaatgcggcagtctctaaagcatagccccaaaaagaaagcggtaaatcggtaagagacatcatagatcgcaccatatctaacagagtgcgattacgacgttcggacacaccattacgctgaggtgttccaggcggcgtgagttgtgaaacgattccacattttcttaagtgtgccccaaactcgtgactcaaatattctcctccacgatcagatcgtagaaactttattttcctgtcacgttgattttccacctcactctgaaattccttgaacttttcaaaggtttcagacttgtgtttcattaagtagatatacccatatctactcaaatcatctatgagggtgagaacataacgatacccaccgcgagcctcaacattcattggaccgcaaacatcagtatgcatgatttccaacaaatcggttgctcgctccatagttccggagaacggagtcttggtcatctttcccatgaggcatggttcgcaagtatcaagtgattcataatcgagtgactccaaaagtctatccgcatggagtttcttcatgcgtttgacaccaatgtgaccaaggcggcagtgccacaagtatgtgggactatcattatcaactttacatcttttggtattcacactatgaatatgtgtaacatcacgttcgagattcattaagaataaaccattgaccagcggggcatgaccataaaacatatctctcatataaatagaacaaccattattctcggatttttaaatgagtagccatctcggctattaaacgagattcctgattacaatgttcatgctcaaagctggcactaaaataacaattattgtaggtttaaaactaatcccgtaggtaaatgtagaggtagcgtgccgacggcgatcacatcacccttgcatcccttccccaaacgttacgacacctcaactttcgtctcttgccatacctcatttcgtatcgtctcgtcgcaatggatttgggcggtgccccatttaacgtgaacgcagcatctctaatgcataacccaaagagatagcagtaatcccgtaagagacatcagagttcgctccatcgctagaacgtacggttacgccgttcggtcacgttcgcttgagttgtgaactagcccacatttgatcattctcttcctttcacggactcaaatctcctcaccccgatctcattgcagacttgattttcctgtcacgttgattctcaacctcaatctgaattccttgaacttttcaaaggtctctgattgtgtttcattaagtagactacccatatctactcaagtcatcagtgagggtgagaacataacgatagccaccgcgagcctcaacactcattggaccgcacacatcagtatgtatgatttccaataagttggttgctccctccattggtcctgaaaacggagtcttggcatttacccataggatggtccactgtcaaatgattcataatgaccttggaaccattcccgacgcgcatcgtcaccccgtcgacttctgtcgtcttctcgcagccgtacggtcagtctcagcttgcttcattttgaaatccaccaaatatttaatggttgtcttgagtactgcttgtgattgtgctgtttgcttcctctacatatcaacttcatatctaagtgcagaagcagaatctctttctaccaatagtttagcctatagagcatcaatagttggcaattcatgatggccgtggacc

SEQ ID NO: 4005 - DNA, 454 bp, Triticum aestivum
  Clone ID: PAT_TA_4005
attggctctaagggagcaagggtgttcggcgcctggaggagctttcatgttcaaggatctcgccctcgccgtcgagaccaacggggtcgtcgccgagtacatctggatgacatgaagcatttggcaccgacgctcacctctttgacaagccatgctttctgggtttgcttgcagttcaggtatgagttgaggaagcggtttttattatacttgctaaaacatcgtgggaatgaagctaaaggcaactttcctgatattgtgaaagaatttcttaagcgcatcatctagatattgatagttttgtaatagatgtttagttggaacatcgcttagtttgttacatggacatgttgttaatttttctttttcttatcaatttacattgcaaaaatggacttcaattattcaataattatgtttgtgttatattgtttgtaaaaaaaaaaaaaaaaaa

SEQ ID NO: 4006 - DNA, 734 bp, Triticum aestivum
  Clone ID: PAT_TA_4006
gcaggcaattcggcacgaggcttgtccccgcctcctctctcctttccccaacccaaaccaggagcgccctccctcccccagccgcccgccccctccccacccaggtgagcctcgattcgccctcgatccggcgccgtttcgcccgatttccaccggctttcgccgcgccgtcggcggatctgacccgattttgcgtttgcggcgcaggaaaccagccatgaagggggccaaatccaagggcgccgtcaaggccgacaccaagttggcggtgaagagcaagggggcggagaagccggccgccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccattgccgcctacaacaagggcgagagtgctgctgctgctgccccaaagaaggcggcggccaaggaggtagaggaggacgatgaggaggaatccgacaagtccaagtcggagatcaatgatgacgatgacgatgagggtagcgacgaggacgaggacgatgacgagtgaagcggacaatgcgggagctgctgtgcgagaa

SEQ ID NO: 4007 - DNA, 852 bp, Triticum aestivum
  Clone ID: PAT_TA_4007
caacgccaaggccggcggccgcaaggtggtgttcgggtcgcagctcaggatccaggtcccgtccggcagggccgcggagctggtgtcctccccgatagagttcggcgtcaagaaccgggactcctttctgtccccggccaggaggttcctgccggaggtcgtcatctctcccaccgcccgggtgttcgccgccggcgtcgccccgggggaaatggccatgtctgaggactacacgtgcgtcatctcccgcggccccaacccgacgacccggcacatcttcgacgactgcatagtcgagagctgcggggacgggcccgcggacggcggcccgggctgcgcccgcttccccccgagcggtttcttgagctcttcccatgcatcccgcaggcaactttgggcatgcccattgatatctttccatccatcggggttggcaaagcattctgcagcgacgagtgccggtaccgggaaatgcttcttcgacgaagcggtggacaacctgcgctagctagctaaacgggggagggacggtgcatttcacaagagaatttcagcggaggagaaggcatgacgatggccctgaataaccgagatgagatttatctttcattttttgtttcttctcgactttgcaagactggatgatgttttttggtcatggagaacagaatgattttagccttttgccgcggattaaaagacattttgcccacttttgcaagaggttgcgctgtcggggactgatgttcgacgttctagttaaatgaaatgaaatttgatgccaaaaaaaaaaaaaaaaaaactcgagactagacctgcccgggcggccgctcgaaatcacttagtgaattc

SEQ ID NO: 4008 - DNA, 1014 bp, Triticum aestivum
  Clone ID: PAT_TA_4008
gacggcacgactcggcggtccgctgcttcggcttcttggttcccccgtcgccttcctcttccttcggccgccgtcttcatccgtcttggcgtgtggttgctctcgaatatcaggcatcattttttcaatgggatccttgtcgactcgtactgatgacccggctccgttcttggtcccaggggcgcgctcaatcattccttgccgcctgacactggctccttttgtcgccccgtcaatttcctctactctatcccgcccaagtgaacctagcttaaccacgcgttctggacgattgcccggtgttggggcctcaatctcggactcactgttgccctcttgtctgcgcgcgtgtggatctgattctatggtcggactcctggcatgagatgcggcagatcccttcacaagttcgcgctctacgaaaccacatcgaatttttatcttgtcggaagagacaagagcacgactctttggagggtgctaaagattgaccggttggagtctactgatttgggtatccaggaggatcctactagttacactgagaatgaatgccaagaactactatggcggattcatgagggaaataggctgaccggcgggctgaaatttgtcacaaaatgctacggaataattggctttatgaagtggagggggccttacttcgtccggctggtgtctactgatttgggtatccaggaggatcctactagttatactgagaatgaatgccaagaactactatggcggattcacgagggaaataggttgactggcgggctgaaatttgtcacaaaatgctatggaataattggttttatgaagtttcttggtccttattacatggttataattaccaggagaagaaaagttggcacaatctgtggccatgatatttattcaattggcaagagcgaaatgatcgcaattccatgtcctatagtctgccccaatgtggctaattctagggatgagaacagatataaacgactcctttgctctgtcgatcttacg

SEQ ID NO: 4009 - DNA, 1178 bp, Triticum aestivum
  unsure (1)..(1178): unsure at all n locations
  Clone ID: PAT_TA_4009
cataattccatcccaattctttcaaattttgcgcaatcctcccgcgcgtccccaaatcttcccattctcctccctccctcccttccacccaggcgcaggcagcgggcgcgcggccgacctgccccccagccagccgcgtcgccgccactgcgactggcggcggcgcccgcgctccgatggtcgggatgtaccagaagcagctcctcgacgcccccttcgccctaaacggccactgcgccgaccagccacgccacgcgccggccgccgccgccgccgccgcttccccctcgccgtatccgcccaacccctcctcctcctcgggcgctgccccctcgccgcacgcgcaggcggatggcgccggccagccgcgtcggctgttccacgcgctcgtcggggggatcctgcagcgcggggccggaggcggcaacggcgcggctggggatctgggggcgctggtgtcgtgggcgcgggaggtcgccgtggatccctgcgcgaagcggccggcggacaggccgaggaagcggcaggtgctggccttgcggcgcgcgcgctacctcaagatggaggacgtggcggaccaagcagagctccccagcttctccaagaaaaggaagtacagaactaagaaccagtcagaaagaccaaggaaagggccaaccccaacaaggaaatccgagcgccgccccggcggcatggtactcatgacatcagtgcttctcacgcaaaggaagaagattggagttggtgagcagtttcaggctgagatacctgactggactgggccaccttcagacgcagagctttcttggtgcaggaatcaccccttccccgcgttgctgcacttcccgtttgatcatcacttttatctgctgtttgaagcaaccttctctgagcatgtgatgcactctctgtcgtggttttcggattttttggcaactctggattctccttttcagcggtaggattaggttttgtttcggccgactgtagctcagatggatgtttcaagggatcagctccctgtgatgtgttggttgtacttcgtgactgaggttcctttgaagattcatcaccagctgatttgtcctgaatgtttgggtgagattcctcanaagcagcttgtttcgcaattgaactgtcattaacatccggatgggaacggtctactggatcgggat

SEQ ID NO: 4010 - DNA, 584 bp, Triticum aestivum
  unsure (1)..(584): unsure at all n locations
  Clone ID: PAT_TA_4010
ccccccggctcgactcctctccctctcgcccacgaagtcaccgccgccgccgcccacgccggccgcttccggcgagctccggcgctgcgcagcacagccccgagctccccatgctccgcgcctccctcccctccggccagattctcatctcccggcctctaccgcccgctcgcaaccacacccccgtggctagggttccgggcagtgcttcgccggcgcgtctccggcggccccagatgcagatggagcacgccatgggagttccccatccaccatggtcgctgtcgtcaagggcttcttcaaggagatgtgaaggacgccatcgacctgcagctactcaaggtttcactcgcccgttctcctcagacaaacggctaccggcactcttgtgaggggttccggcctgcctggagaccgcagggcccctccctcagggacgcttttcggaggctcctgggtcgggtgggcgccagtccaggggggtgcccatgtcgtgtgatttgaaatgaaacgcccactgggagaggtctgcagctgctgctttcgtgnnnctggtcatgnnnnnncgcatgccctgnnnnccc

SEQ ID NO: 4011 - DNA, 475 bp, Triticum aestivum
  Clone ID: PAT_TA_4011
acagcaccaccaccttcttctcgctcgccgcgcacccacacaccccagcgctactcaaccatgtcggtctccacgggaaaattcccggcggtcccggcggccggcggagaagacggcagcgacgcggcggccggagggtcgccgtgcggccgcccaacaagattcgccggcgccggcgaggaggcgacagaggaggcgcgcgccaggcgggaggcggagaaggcagagctggagaggaagatcgcgagcaccaaggaggagatcgccgccctggagacggcgctcgccgaggcggacgccgccgccggcccccagcccaccaagccgtagctttagctaaccgccggggcgcgttcgtcggtgatctcccgccgtgcgcttcgccggcccgggccgttttaattaattgacttcgttggaactcagtggtagctgatggattgtaatgcatcgattggcggtggctttgcgtggt

SEQ ID NO: 4012 - DNA, 650 bp, Triticum aestivum
  Clone ID: PAT_TA_4012
cgtccgcggacgcgtgggcggacgcgtgggcgctgtcaatctgcttggtggcagtgaaaaatctactccggaaggcgtgctaaaggtaatgaatgcacataatttgaccatttatcatgtaaaaagtcatcttcagaagtacagaactgcccgatatagaccagaattatctgaaggtacatcagaaaggttggaagcctcaaaagaggagttgccatctatagaccttaaagggaaccacgcgtccgctgaagcattgcgtctccagttagaacttcaaaagcggctccatgaacagcttgaggtgcaaagaagtctgcagctgagaatcgaggagcaagggaagtgccttcagattatgatcgagcagcaatgcaatcctgctgcagacaaggcgctggatgcttcaacctcggcagaaggaccaaagttatcttctgaccccccagaatcttctaccgtgaaggatgttccaaacaacagtcaaaatggaacaaccgagcaagcaggtgataaggaatgaagatctaaccatgctcgcctgaagttgtgaaccccactagccatgaatttgactggttgctgccaaactagaatcaagtcggtcttttatctttctgggagaaaggggtgagcatttctatgaacta

SEQ ID NO: 4013 - DNA, 1622 bp, Triticum aestivum
  Clone ID: PAT_TA_4013
ctcgcccgacgcccggaacgggacttccatctctcgatctgagccgcgtaaaaccctagccgtctccaaatcagtcacccgccaccgccgccacctccatggacacttccctggctgccgccgctgtcaccgcagaggcctccgcccccgccgccgcatcaacggaaccttccgcggctcctgatgcctcccccgcagcctcctcctcctccgctgccggcgccggcgccgaagacctcgcggggggcgtggcggcattgagcctggacgagcggttcgacttgctgatgagcataggcgaggagtgcattcagcccgacgagcttaagcggttgctgcagaacaagcccgtccctatctgctacgacgggttcgagccctccggccgcatgcacattgcccagggttgttgtgaagacaattaatgttaacaagatgatcagagcgggatgcaaagtgaaaatctggatagcagactggattagcacacgctaaacaacaacaatgggatggcgatcgtgaaaaaaatccagactggcgggcgctacatgattggaatatggaaagcagctggtatgaaccttaatgggacttgaattcttatggtttccgcaaaactgtagtatgaatgcggtttaatactttccgcgtagaatggacatttgcatgatatattatatctaattaatcatgtagtgttatgcaagtaaacggtagcgatggagcatggagtaagtgactgctgcaggtttctactattctgtcaaggagtgtgcgcagttatccaccgtttggactggatgttggtcctcgtgtttggagaggtggaaggggtaattggtccccaagtagttgatcaagcactaatcctagaagatcaagtcacttctaccaacacatcatgtgcgcacgggtttcacaggaggccaggaggtgaggtcatagagtgatccaacatcggctatctttatggaagatgatgaggctcaggtaaatttgaagataaagcaagctttctgtcccccgaaaattgttgataaaaatccgtgcctggagtacatccagtacatcgttttcccttggtttgacaagtttgaggttgtccgcaaagaaaacaatggcggtaacaagacatttttaaccatggatgaacttgttgctgattatgaagcgggtgatttgcatcctgccgacgttaaacctgctttggcgaaagcgatcaatgaaatattgaagcctgttcgtgaccacttcaacagcagcagtgaagccaaaattctcctcaatactgttaagaagtacagggtaagcaattgaggagcaaataccttcctggtaattacatggacacccaacagacaatggaagcatacacattttggttggcagagtttcgtgggcacaatttttggcaatactaatacctctattgctgatatgcatcagaaactgtcgtgattatgttgatcagtgtacaatatctttgcgtgtcaccttcaattgagaagttataagacgcttggcgtgacattgtagctaacatttaaggtaaacgcattaaatcaggcgactgattttgtcaaaaaaaacggcacgaaaaaaaaaagtcgacgccgccgcga

SEQ ID NO: 4014 - DNA, 828 bp, Triticum aestivum
  Clone ID: PAT_TA_4014
cggacgcgtgggtttgtggcgtatccatggtgtggattattatggcatgtctgagacaaatgagccaaaaggtctaaggcatgtgaaagcagactcaaggacatatgatgggcctagctcaaatacagctgaatgggaggagaaacttgattcattctggcaagacaggattcaaggtcaggatccattagaaatattgaaagcaaaggacaagattgatgcagctgctagtgaagtgttggatccacatgtcaggaaaataagggatgagaagtatggatggaaatatggctgtggagctaaggggtgcacaaagcttttccatgcttctgagttcgtcacgaagcatctcaaactcaagcatactgattttgtggtggagctgacttcaaaagtgagagaggatatttattttgagaactacatgaatgatcccaaggcgcctgggggaacaccgatcatgcaacaatctgctccaagggaaaagggcagacagcggccaccgattgagagtcggctgagagatgaacgtggccgtagatttgacagaaatattgattcatcaaaccctgatggatccagtgaaaaccctgatgatccaatgtatgattcttatggtgatccggctgtacatggtgcctttcctccagatgttccagctcctccaatgctgatgcctgtgcctggtgctggcccacttgggccgtttattcctgcaccaccggaagttgcaatgcgtatgttgagggagcagggtgggccaccacctttcgagccgaatgctggtccacgtcctaagaaagcaggaagggctgggtggtcccccat

SEQ ID NO: 4015 - DNA, 1042 bp, Triticum aestivum
  unsure (1)..(1042): unsure at all n locations
  Clone ID: PAT_TA_4015
ggcggcgatccgtcggtggcgagggggacggcgaagaggaggacgagcatggccgacgggaaggacctgggcgccgcggcggccgcggaacccgaccacgatgaagggcagccggatctggaagaggaaggtgagctcgaagccgccgccgccggcggcggcgaggaagaagaggacgtcgacgtcgacggcctcgctagcttcctcgaattcgagatcctctccggatccagcgaggaagatcctctcgaccagctggaggagggcgaggaggagaaggagacgagggtgaatgatgaagcgaagaacggtaagaggaagcaagattcgctgtcggacggagacggcagcggcagcgaggacgagcatcagaagagggcgaggaaggagaagggaaaaggaaaggttttggcagaggggccgcctcagattgacacgggcatgttcaccaacgtccccccggagctgttcctgcagatcttcaagttcctctcctcggaggacctcatctcgtgtgcccttgtgtgccgcttcatgaacgccgccgcatctgacgagaccctttggcgccgcttgtattgtatgaggtggggcctgtcctctaatgctacctctaacgcgaaactcagggagtgcgcttggaagagcctctacattcaagcaagacagagaagatatggttgaattccgtgagatatacccctacagaattcaaagagtactatatccagatgcaggctgcaaaaaggagtccaggaccccttccctcaagaatttaacgacgacaagattgttccttgataagacagtactgatcaagtgtctaatttngaaaaccgcaagagcctttaccgatgatgcatccaagggattcttgttcctggaantactttgctactataagcaattgggtgatgcttaatctgtnaanaaactggncctgtaatgtctgcnatatnctgnccttaattntcctgggacaaactaacgggtacttgtctgtacnatatctgggcacgntttgancgaatttatgtctgan

SEQ ID NO: 4016 - DNA, 937 bp, Triticum aestivum
  Clone ID: PAT_TA_4016
ggttagggttagggttagggaggaggcggaggcggctgctttattcccgatcccgatctcaatcccgatgccgatccccatgaccaccggaggaaaaaagattagggaggaggcggaggcggaggcggaggcggctgctttattcccgacgcggatcccgatcggcatggccagcagaggcggaggagcgccatgggcggacggtgccttccccgattgggtgatgctggaccgcctcggccgcaccaagtcctacgacggcatatgcgctgttcgtgaggccgtcaaccagaacaagaccgccgctgcagttcacatggccagcggccgctcctgctacgtgtccttcgccctcgccgatcctccagaaggggtctcctacttcgacctccactggccggagaaaagaagcctcagccacccggcccgcctgtccctacgtccgggcaactgacgaggacctcgtcctcttccacatctccatcccgagccagactcgctacgacaacatcgcgtcagatctgttcgtctacacggccgccggtccttccccctcggtgcagcagctccctcggtacaccaaggacaggaaaaggccgttcctgatggataaattcgccacaggcatcctgcagctcgcgccggactgctacattgttgccgaccttaatgtctaccccaaaaaaagcgacactggcaatcatcccatgcttgttgaactctgcatcttcaactccgagaaaggacattggggaaccatctgcaacaggcctgccccgcggccgcatgaccagagcaatgtccggttccccttcctgtggtcaactgacgatgtgctcgctcttgatggtcgttttctgtgctgggtagactacttcagcggtgtcctaatatctgacttctccgatacatgctcccctgtgcttcacttcgtgcc

SEQ ID NO: 4017 - DNA, 615 bp, Triticum aestivum
  Clone ID: PAT_TA_4017
gcattcgggcacacatagtcagcaattcagcagagtcaccaccatgggcgccaccaatcataccttgcaggcgcttctcccatggctcctcctgttcgtgcaccaggccgcggcggccagcggcgggtgcgagtgcacgaccgccacggacggggcggacaagcagggcgcgacgaagctgaagctggtcgccatcgcgtccatcctcaccgccggggcggctggcgtgctggtgccggtgctcggccgctccatggccgcgctgcgccccgacggcgacatcttcttcgcggtcaaggcgttcgccgctggcgtcatccttgccaccggcatggtgcacatcctgccggcggcgttcgacgggctcacctccccgtgcatccacaaaggcggcggggacaggaacggcttcccttttgcgggacttgtggccatgtctgcagccatggccacaatggtgatagactcgctggctgctgggtactaccgccggtctcacttcagcaaggcgcgcccacttgacaacatcgacatgcccggacatgaggaagggagggccgatcatccacatatgcacgcgcatggccattcacatggtgaggcaattgttgtcag

SEQ ID NO: 4018 - DNA, 702 bp, Triticum aestivum
  Clone ID: PAT_TA_4018
gcacgaggcaagtcttcggattcggccacagccagatccgctctcccctcctctctcctctatttcgatccacacaaatcgcaatcggcaccaagatcatcaagttcgccgtcgccatggcgcagagggcgctggagctgaccctgatatcgggcaaggacctcaaggacgtgaacctcttctcggccatggaggtgtacgccgtcgtctccctctccggcgacccgcgctcccgccagcgcgtcgccaccgaccgcgccggcggccgcaacccgacctggaacgccacggtccgcttcaccgtccccgccagcgccgcggggtccgtccacgtgctgctccgcgccgagcgcgccctcggcgaccgcgacgtcggcgaggtccacatcccgctctccgagctgctctccggcgcccctgagggccctgttccggtcaagttcgtcgcctaccaggtccgcaagatcgggtccgggaagccccagggggtcctcaacttctcgtataagctcggcgaggtgacacagggccaggccgctggcgcctacggtggtgcgcaggccgcgtacgcgcagcctccccccgccgccgcgtacccgccgcagggcgcgtagcctccggccggcaaggccgacgcctacggggctccgtccgcctatccaccgcctggtaacgcgtacccgcctcagtccgcgtacccgc

SEQ ID NO: 4019 - DNA, 783 bp, Triticum aestivum
  Clone ID: PAT_TA_4019
ctcgtgccgaattcggctcccgcccgtgtctgccacctaccccgtcctctctctccgcaggccgagcagagcaaagccatggcggccctctccctgtccctcgcccctcccaccgccgtgctcccctgtttacccagcaggcccgccgcctccctcctcaggccgcaggtcccctcccgtgctaccctcgtcgtctgcctcggcgcgaagcccaaggtgcccctccccatcgcctcgccgtccccactcggggacgaccccgctaagtgggaccccgccgagtgcgacgccctcctccgcggcggcgaacaggtcgcctccgtgctccaggagatgctcacgctgatggaagacatggagatggatggtgcatttgcaccggtggccgtggagctggtggctcagggagtcattgggaatagggttgatgagatggagtctggctttctaatggcactcgattacatgatacagctcgcgcagaaggatggtgatgatgagcgtaactctcttcttgaagtagtcaagcagacggggctagaccatctgacgaaaaaatgccctccgcatgttcaagtagttggactcctttgccagactgaaaagaaagagagcagacatgaactactacgtcgtgtagctgccggtggtggtgtttttgaaaatgataaaggcctgaagtgtgaaattccaggagccaatctcaatgacattgcaaatcaggcggatgatctgctggagtcaatggaaaccagacccacaattgctgatcgaaaacttctg

SEQ ID NO: 4020 - DNA, 1233 bp, Triticum aestivum
  unsure (1)..(1233): unsure at all n locations
  Clone ID: PAT_TA_4020
gttttttttttttttttttttttgaaacttcaagtcaaatgcatttcaatgaaatcacaggtgacaaaactagacgaccattttgagtagacaaaacggtaagtcggcaaacaggtttgacagcccacatctcaaaaacatacaagttgtatatgtccactcatgctgcacctaggcagcaacagttgccaaaactgcgatcacactgcaagtagatctatacccacagctgctccttgcggtactctctcacgatgaccggcacacttgtaggtggaagcattccataatccgttatgatcatcgacacataatcagaaggggttgcatcatacgtgagatttaacagttggagattctcgttgtcagcccagttcttaagatcgcccaagtctgccctcccaggaattttcgaaatcacatctggatcaccaagctcattagcgcatatagaatcaagttgcaccctctcatgaaatttgtatgcctcgcagcaaaccaaaacaggaattccaaatgcatgtgccaccatagccacggatgctgtgccaactcgggaataaactgttccatttgataatattgaggatgcacccaagaagactcttgtaacttcatgcatgatgtatgaaactgcatttatatgagtatatgtgcagttaatgccctttgccactaatctacgcagtaatccttgcccctcgagcttgggacgagaatccaccactataacacggaacttcctaccaagttcatgagcatgctccaaaatcatttcaacaactgatgatgacccatatgttagcaagacatcatcgtctctgacttttgtgatggcatgactgacaataacctgatctgcaacaactatcttctcattaataaaacgatcaatatcagactgaagactggccttggcttctgactccgacaatgtaattggtagcttggcaatcctgtttttcaggaacctgatagcattgcccatgctaattgagagtggacggcactcgataaaaaatgacacataactactgacttttgcagtaaggtctctgctgagagttttatttggcggtgtggagtaatcttttattgcctctctgaacgcaagaagcattgctatgcaacgaccattgccaccagatacctcaccagacaaatattggagaccgaccttgtacacagaaggatgaattggttccagcnaaagaattttnantcgaggtcagc

SEQ ID NO: 4021 - DNA, 1006 bp, Triticum aestivum
  Clone ID: PAT_TA_4021
tcatctactcctgttaaagctcgtccatctacaccatccaaaactcgcccgtctactcctggtgaaaactcatcaaacaacatccaactctacaactgacgcagctgctggcaggaccacagccacccaaagttcaaggccatcgactccaaattctcgctctcgaattatgttgaattcatcttcagggtctattcctgcaatgagccgcccaagtccatccataggtataattcctgcgacgagccgcgcaggtgcttcctcaagtaatggtcatgggacaagccattccacctcattgtcttctggcacagttccttcagtgagtcgctccacctcacgatcatcgacacctacacgtcagcctgcagtgcgttcatcggccccagctatgggccgttcgccttcttttggacggacttctagtagccatagcttgaccacatctatgaaccgacctgcagctagcagtgtccgaagttcagcaccgtcatcggctccatcatcacgcccaagttccccaggtccacgaccccgagctccagtgcgcacacatgacattccttcctcggctccatcatctcgtccaagctccccaggtccacgacctcgagctccagtgcggccacatgataccccttcatcggctccatcatctcgtccaagctccccaagtccacggccccgagctccagtgcggccacttgatatccctgatttcccaaatgaaacgccaccaaacctgaggacaaagctacctgagcgaccactatctgctggtagatcacgcccgggaatggcttcaggaataagatcaaacccacatgctgaacagttagctgcctcggctcctgcgaaaaagctctccgtgcctgctgcaagtcgtaataagttttctgatccaccatcaaaggcgccttctcgctcaaatggacaccaaaataggcagtctgaaaggtccgttgttgacagccaagctactagaactgcacgggctggtgcagtt

SEQ ID NO: 4022 - DNA, 979 bp, Triticum aestivum
  Clone ID: PAT_TA_4022
aggaattcggcacgaggcggttgagttctttcccccgcagctttcctccgatataaaccctatccctctcgtcctcgcttgttgtgaagctcgtgaatcccgcgccgatctcgtcgtcggcctcgaggagtagcagcccctgatggcgaccgccgtggcgtcgcagccgcgacacttcaccctcggcggcgagccgagggcagccatctgcgcagccagcacatcaaagatttgcaccctggacaaagtatacggattcaggttcgtatgcagaagtgttgttgatctaaggagtcaaaaattccattcccaaatttctaagagaaagtgctatttaacaagttcaccatcggaatttgagaagatcattttgagtgctagatggttagaatttaggagacagaggatagcctttcagagaactggaaggtgggttcacagtattccattggcttctcaagatgatggcagtggtgtgtctgttaatggagtaccacaagttgatccagcaagtcaaatgaaggaaataagggtgaaattggataaagcattgcaaaatgaagacataagcactggccttgtccaatcaatacatgatgctgcgagatctattgaattggctttccttgatcacagcaaatcatcaataaactcttggttcccaaagatgtggcttggtgtcgataacaatgcatggataaaatcgctgtcttacctgcctgcggttagctcgttactgcaagcagttatcgatgtttcatcaagggggaacggcagagatagagatattaatgtatttgttcaaaggagtttatcccgccttctcagctctctagatggtgttatacagaatgaattggctaaaagggaaccttcattatatcagtggtattcatctaatcaaaatccattggtggtgaggacatttgtgaacactcttgaaaatgatcgacgatttaattctgcaacagcaatatgc

SEQ ID NO: 4023 - DNA, 486 bp, Triticum aestivum
  Clone ID: PAT_TA_4023
gccctcatctttctccgtctcctccaaatcaaccgactgtcacactaccacacaccattaccagttgctgaagagtgagagtgagcagtaggcgcggtgctctgtcctgacattgcacgcgcttgtccctctgcattgcgtttgctagcagctatcctcgatggggctgccgggatgcatcgccgtcattgtgctccttctgatttcatggagagagggggaggcggcgatgttcacgttcgtcaaccggtgcgcggacacggtgtggccgggcgtcctgtccaacgccggcaccgcgcggctcggcaccacggggttcgagctcccgccgggcgcgttgcgcgcggtgccggcgccctcggcctggtccggccgtctctgggcccgcaccggatgcgcgcaggacggcgccacggggcggctcgtctgcgccaccggcgactgcggctccggcacggctgagtgcgccggcgctggcgccgcgcc

SEQ ID NO: 4024 - DNA, 919 bp, Triticum aestivum
  unsure (1)..(919): unsure at all n locations
  Clone ID: PAT_TA_4024
ccgtggggttcgccatgatgttcggcgccttcgccggcctgggatgcatggtggtgaagtggcaccggcggccgcaggactgggaccggcgcaacagcttctcgtcgtggctgctgcccatccacacgggccagtccttctccaacggcaaggggtccaagagcggctacaccttctcctccaccgcggggctgggccagggggggaccttcncggagatgtcagaggcgaccaagaacttcgacgagagcgccatcatcggcgtgggagggttcggcaacgtgtacgtgggcgagatcaacgaccccgacgaggaggggtccaggatcaaggtggccatcaagcgcgggaacccgtcgtcggagcagggcatcaacgagttcaacaccgagatccagatgctgtccaagctccggcaccgccacctcgtctccctcatcggctactgcgacgagggcgaggagatgatcctcgtctacgagttcatgcagcacgggcccttccgcgaccacatctacggcgggcccgagggcctgcccacgctctcctggaagcagcgcctcgagatctgcatcggcgccgccaggggcctccactacctccacaccggcaccgcgcacgggatcatccaccgcgacgtcaagaccaccaacatcctcctcgatgacaagttcgtggccaaggtggccgacttcggcctctccaaggacggccccgggatgaaccagctgcacgtcagcaccgccgtcaagggcagcttcgggtacctcgacccggagtacttccggtgccagcagctgaccgacaagtccgacgtctactcattcgggggtggtgctgctggagacgctgtgcgcgcgggcgcccatcgacccgcagctgccgcgcgagcaggtcagcctcgccgagtggggcctgc

SEQ ID NO: 4025 - DNA, 581 bp, Triticum aestivum
  Clone ID: PAT_TA_4025
gaaacccacgccctccacgctgcctctccccatgtttgacgcgcgccgcgaggcgcctcgccggcatcgtccagctcaccaacgccgcctcccctccatccaacgtcgccgtccttcacaacgttcacccctccgctccctccaacacgccgcgcatcgcgtccatgtacagcgaggtgcagacgaaccgcccatgtattcactcctgcttcacgctcgccggctgcggctgcggcggagtttggcaaggccaatcacctggttaatgcgggtcgtcgtggcgtacatggtgattgatagcctcaccgtgttgccggaaaatatccccgtgttgcccatgtccgcatctccagcatcacgctactgaacatcttcgcggtggcggatctgggcgccttgcaggagaagaccgtgcagatcggctacaaggatatgagtgagatcgatctaccggtctgtgttttttaggatggtaccgcacactgccagtccgggcaggagctacttggtgactccctgatgcacaggcatatgggtaaataattttgtttagtgctaagtaggagctaagtctgcatgtg

SEQ ID NO: 4026 - DNA, 1284 bp, Triticum aestivum
  Clone ID: PAT_TA_4026
ctcgtgtttttttttttttttttgcattttttatgtgtaaaaatgatatagcaaatgatttatagttgtatgcaatccataaccagcacatgcaactcaaatacccacaattcaaacccaaaatgttccaaactcaatactcatggactacatttcgagttcttgacaaaagcaagacaacaccatccaaaagccatgcgagcagatattttacataacaataaatactcagacgcgtgaacacccagcgggggtgaagatggactctgctcaagacaccttctgactgtctcaaaaagttctcagcatatttcatcgtcaacgactaccaacttccgtcgacaggaaggaccgacaaactgactcttgccaccgagcaatgctcagcagtaccattgtgacgggcgttgctctgcccactactctgagggggctgtcgcggctttggtttctgtctccttgctagcatcagttgattcctccttagctgcactttcctcaggtttgctttcgcttacactaagtttctccagcagtccagctgcggaagaaccttcttcgctttcaccgccttcattctttgcaagcgactcagcgatctcgtcaaccaagtctttaaacttcttgcaattctccacggtgccaaaccggatggcaaacatctcatccttaagttctccgtcagcaaagtctgccgcgtgccagacacaggacttgtcgctgccggcgtgttcctgcatcttcgtggtcgagatcactaggtgattggcgcagatcttaagtgtcttggcctggcgcataacaaggcggaccttgccgttctccttatgcttgagcagcttgacggtgcccgtgcccctctccttccactggttcccatcccttgtccgaacctgtatagctttccgccttcatgtcgaggagagagtccgtcgtcctcctcccgccggtggtgacggcgacctcctcgagccgcacgatgggggcgacctgggcaccggtgtcctcctcctcgccggcggcggccgcggcggcggagtcctcgccttcctcctccgcgacggggcgctccacgacgggctccttgtccgccatcggaagggttgggcggcggcgcgcttgctacttccgagtcgacgcggcggcgggagggggagggacgaagagagacgccgagggaagttttgggaggtcggtcggggggaggcggcggccgtaaaagggcagtgcgctagggtttttgtgtaccacggagggggaggcgccgccacagaagtggggccc

SEQ ID NO: 4027 - DNA, 1180 bp, Triticum aestivum
  unsure (1)..(1180): unsure at all n locations
  Clone ID: PAT_TA_4027
attcggcacgaggaagaagtcctgggttcgacgcagcctctatgcattgctctgcgcaggggtaaggcttgcctcgtatccttccccagaccccacctggacctggagccactattggtggaatgtgcgctacacgatgttctggttcattagccgtgaggtatggaactatgcgggacaatgttatcaatcttcaggctgttctaccagatggcgacgttgtcaagaccggttctcgggctcgaaagagtgcagccgccgagctcctaactcggttgatcattggaagtgaagggactttaggggtaattacagaagtgactttacgacttcaaaagcttccatctcattccgtggttgctatgtgcaattttcaaacggttaaggatgctgctgatgttgctattgcaccaatgcattctggcatacaggtctcgagagtggaattgttagatgaggttcagataagggcaataaacatggcaaacggtaaaagcttgcctgaagtgccgaccttgatgtttgaattcatagggacagaagcatatgcacttgaacaaacactgttggttcaaaagattgctgcagagcaccatggttctgattttgtttttgtggaggagccgaatgctaaagaggaactgtggaagacctggaaccccgcgctctcgttctccctcttcccccaagcccgggagccactcttggtggaatgtgcgctacacgatgttctggttcattagccgtgaggtatggaactatgcgggacaatgttatcaatcttcaggctgttctaccagatggcgacgttgtcaagaccggttctcgggctcgaaagagtgcagctggatatgacctaactcggttgatcattggaagtgaagggactttaggggtaattacagaagtgactttacgacttcaaaagcttccatctcattccgtggttgctatgtgcaattttcaaacggttaaggatgctgctgatgttgctattgcatcaatgcattctggcatacaggtctcgagagtggaattgttagatgaggttcagataagggcaataaacatggcaaacggtaaaagcttgcctgaagtgccgaccttgatgtttgaattcatagggacagaagcatatgcacttgaacaaacactgttggttcaaaagattgctgcagnn

SEQ ID NO: 4028 - DNA, 463 bp, Triticum aestivum
  Clone ID: PAT_TA_4028
gtacaaattcacgaaccagaggctcaaggacctggggatggagttcgtgccggtgctgcagagcatatacgagacggtgaagagcctccaggagaaagggatgctgccggtgctaccgccaggcgacgacgtccgagacaacctgcatgagcagctcatgatgaagcccgcccagttgctacgtaattaattatactctacatttggtagggatatgctgtcggctagttaattctatgggacatgtctgtccattcgatcggtcttatatatgcgtacacgtacgcacttttaattggtgcgtgcgtgcgtgcgtgagtgggtgggtttgttggcgatcatatataaggatcgatcagtgctgtatgacgcacatatgcacacaatgttatatccatatatagtgatgtaaatccacgaactacaataaccaggcaatgtgcaactttttttttcggggctt

SEQ ID NO: 4029 - DNA, 1554 bp, Triticum aestivum
  Clone ID: PAT_TA_4029
ttgaggccggccgctctactgatctcatacgcagcagctgcctagctctacttactacctgcgcagtgttgtgtggtactgtagtaagtagcagggaagaaccgttccgagtacacagcgtacttttggacctgtggataccttgctaggcacctgctgctcgcaacatccccggatacgtcgtgtcaatccggaagtaagccgagaggaagagagagatgccgatcgaggcggcagacaacgtaccggccgagcttcccggccacggccggacggtgtgcgtcaccggcgccggcggtttcatcgcctcgtggctcgtcaagcgcctcctccagaagggttacaccgtgcgaggcaccgttcgcaacccagttgatccgaagaatgatcacctcagagccttcgatggcgccgccgaccgcctcatcctcctccgcgccgaccttatggagcccgaaaccctcgtcgaggcgttcacgggctgcgagggcatcttccacgccgcttcccccgtcaccgacgaccctgagaagatgatcgagccggcgatccgagggaccaagtacgtgatcacggcagccgcggacatgggcatcaagccgtgtgggtgttcacgtccaccatcggcacggtgtacatgaacccccacagggacgccagcaagcccgtcgacgacacctgctggagcgaccttgaatactgcaaaaagacagcgaactggtactgctacgcgaagacggtggccgagcaggacgcgctggagacggcccggcagcgcggcatcgagctgatcgtggtgaacccggtgctggtgctgggcccgctgctgcaacctacggtgaacgcgagcacggagcacgtgatgaagtacctgacggggtcggccaagacgtacgtgaacgcggcgcaggcgtacgtgcacgtcaaggacgtggccgaggcgcacgtccgcgtctacgaggcgcccggcgcgcacggccgctacatctgcgccgagggcaccacgctccaccgcggcgacctctgccgcgtcctcggcaagctattccctgagtaccccgtacccaccaagtgcaaggacgaggtgaacccaccggtgaaagggtacaaattcacgaaccagaggctcaaggacctggggatggagttcgtgccggtgctgcagagcatatacgagacggtgaagagcctccaggagaaagggatgctgccggtgctaccgccaggcgacgacgtccgagacaacctgcatgagcagctcatgatgaagcccgcccagttgctacgtaattaattatactctacatttgatacagatatgctgtcggctagttaattctatgggacatgtctgtccattcgatcggtcttatatatgcgtacaccggtacacgtatgcacttttaattggtgcgtgcatgcgtgcgtgagtgggtggggttcggttggcgatcacatacatggatcagttctatatatcgatcgggctctcactccacggactacgcttagtgatataaatccacggactacaataaaaaaaaaaaaaaaaaa

SEQ ID NO: 4030 - DNA, 770 bp, Triticum aestivum
  unsure (1)..(770): unsure at all n locations
  Clone ID: PAT_TA_4030
gcccctgcggccctgccctgcggtccatctacggtgaactccctcattttctaaaagaaaaagaaaaagaaatcctgttatcatctcagtctacccctagttccccaccagcatccttatccatccacatgcgtcatcttctccgattaacagccggcggacaaagatgtcgccgctagccatcaccgaagtaattccccagccatcctgcttcttgattcatttcttccaatctctcctcgtcgatttactgctgcagctggccatgtgcgcggagtgcgtagacgcgtttgttcattccgagagatgtggatgctcgacgacctcgtcgagtccggcggagcagccatggggaggagcggggaaaacatgaaagctgcactgcgtcaacctcttcatgttcacggccagatgcccatggctgaggtgttgtatcttgggccccatgggaggagcctgtgagggaaatcactgaatcacagactggatggtgattgttggttctgggaacctgagaatggcggcgccgggcaaagctagcggtatgcaacagttgggggcgttgattgctatcccgggttctgctaattaagttactaaaaccaagatcccagtctccgtgggggctcaagtgctgctgctgatgatanttgtcctgacgcccttcnttgtgccanaaatgcttggcgtngacttcttcaacgttgantggagcaatttgcaatggcttcgtaagcgtcaaaaatgctttgngtaaatttgtcgncgtc

SEQ ID NO: 4031 - DNA, 1380 bp, Triticum aestivum
  unsure (1)..(1380): unsure at all n locations
  Clone ID: PAT_TA_4031
aattgtcggacgatcgtgggattgctgcgattggaagtcaggaatcatatcaacctgaagataatcatcatctgggtgcaacatcccattctaatgttgatgatgattccaatcttttggaagactgccttttggcatcaattaaggttcttatgaacttagcaaatgacaacccatctggttgtgaacatattgcatcatgtggtggacttaacaccatggcctccttgatcatcaagcatttcccttcatttgatttctccgcggacactggccgagatgtcgatcttttacaagacctcaccgattctgaggacagcaaagcatgccaagtgaaagctaagcaactgcgagatcatgagcttgattttctggttgccatattgngcttgcttgtcaatctcgtggatagcgtggtcgcggccgaggtacggcttgcatctgctcgtgtttctgtgggtctgtctaagaatgcgcagagtgaaaaggcacagagggatgttataccactcctctgttcaatcttcttagcaagtaaaggttctggggaagcttctgcaactatatcaccggatgatgaagagtcaatgttgcaaggagcacgggaagctgaaatgatgatcgtggaggcctatgcagccctcgtgcttggctttctttcgatagaaagcatgaaggttcgaggagcgatttccagctgccttccaaacaacaacttgaaagttcttgtgcctgtgctagagaaatttgtggcgtttcatttgcagcttaatatgatgacagacgaaacacactcatctgttacagaagttattgaaaaatgcaaactatgataggatggtgaagaggtcactttgtatagactgactggcctcttcgcagccgaggcacactcaaggcgtcccccctgcagcttaatatgatgacagacgaaacacactcatctgttacagaagttatcgaaaaatgcaaactatgataggatggtgaagaggtcacctgtatagactgactggcctcttcgcagcctaggcacacacaagtgttcctcctcgtcccctcgtgcgccgcagatgacctgcagtcgtcttgcaactaaccaagcatggtgtcattctttcttttcttttccttttgcccccctgttgttgtcgcgcatcttttgtgtgtgctccttgccgcctctcaaaacacgttgtttacttagccaattcaaattgaatgtaaaataacatcatagggaatgtactgtgtgtgcgtgtgtgtgtttgtaatttgtactggtaccagtcatagtcagtcaccacacatgcctaaatctgaagaaacttaatggaacgtaccgtcgccatgccgtttggtttgtgcctcctgtgtctg

SEQ ID NO: 4032 - DNA, 1494 bp, Triticum aestivum
  Clone ID: PAT_TA_4032
cttcctcccaagacccccaccccccccccgcccgccccccccgtccccgtcgtcccccccccctcgccgccggcgcggcgggcgacgcggccgccatccgccgacggcgccggtgcccgcggatgagacggagacgaggaactgggcggagctgccgctggacgcgatctcggccatcctccacaagctcgaccacgtcgacatcctgatggggcccggccaggtgtgccgctcctggcgcggcgccgcccgcggcgagcccgagctgtggcgccgcatcaacatgctgggccacgccgacctcgagcacgagctcaacttccccgggatggcgcaggccgccgtccgccgcagcgccgggaggtgcgaggcgttctggggcgagtacgccgccgaccacgacctcctcctctacctcgccgaccaggcatcatctctcaagagtcttcgcctcatttcttgttataattttgaggatgaaggacttcaagaggcaatagtgaagttcccattgcttgaggagcttgagctttcattatgtgcaaatgtgggtgagagtggtgtctttggggttgtcggcagggcatgcccacagctgaagcgcttcagactgagtaaggacgtgttctatgattttgaagccagtgggtacgacaaagacgatgaagccctggggattgcaactatgcatgagttacggtctttgcagctgtttggcaattgcctcaccaataaaggactgacagctatcctggacaattgccgccacctggagtcccttgacattcgtcattgcttcaacgtcaacatggatgacgccctgcgcgcaaagtgtggcaggataagcacagtgaggcttcccaatgactcaactgatgattatgacttcgaaggtgcaggagcctgtctgggcggattcagggtcctttttgggtgattatatgggatctggttctgactatgagcttgactcggaagattacgatgactactgcgatccttcccgctaccttgatggtgtgtacgaggacgagcttaatgaagaagataggatgcttctcaggggcatgcacatgctaatgaagtgaactccatcggggatgttgtgatcgaagtgcctggatgttttcaccattttgccaaagtatctgcactactgatctgcgcttcggttcttcagctggcggcatggatctgcttctgcatcgacttctcctgtaagatcgtagagagtgctccctgcattgtccaaccgatcttcagaaacatgtgctaagagtcatttaccttgcagtttagttcaagtggttctgaaatatgctctgtagtaagtactggcagtactggtttgcttagctgtgaaacttgcttatcctctgcgtggacttaatgtgaacattgtggctccaggagctcctgggcctccagaatgggaggcccagtcatcctgtgccttaggccctggcgcggacggagatggagcttcacgggact

SEQ ID NO: 4033 - DNA, 1102 bp, Triticum aestivum
  Clone ID: PAT_TA_4033
cggacgcgtgggcggacgcgtgggaaaaaagagagagagagaagaggagaaagtctgcagaaatcgcgatcggaggcacagctcgagggatttgatttttatttgcctgggtttgggggaaggctagggaagttcatcacaagataggattttggaattttatggactttgattgcaataaggcaggagagtcttcagccaagcattgttctagcatttgcaacgagggcacactcatccaggcaaacaccttaattcattgtggaaaggctaaaaagtggaatagcctcaacaaattgaacaacccggagtcaagtcatggatcacttccaagggttactgaccccaaggaagatggtgagacaggaaatgatggaactgcctcagagtgtagcactatgtgcttcactgatctgccgtctgcattggtctgtgaagtccttgcgcgccttgatccaaaggggcttggggttgtatcttgtgtctccacagttctgcagaccctagccacagatcatcagggatggaagaaattctactgtgagaggtggggacttccgaatgctcccatcggacccctagttccaggtggaaccccagatgggaggtcgtggaaagcattgtttgtggatcgggagtttcaaagtagatcattcctgggaagatctactgtggatgctctccccggtcacaatgtagatgtacgctctgtgtaccttctggcgtcagcaaatctgatattcactgctggccatgattctgcggttttgatgtggaatatggcggaaggtctactgattgctgagtcccccccatttggttgcactatccgggcacttgcagctgtcacaagcttttggtgaatggacgatccctagccctcattcaatgatggaggtctcttgatggggcctcgcaccttttacacattcctgggaatggtcctagccaaaattgtgaatttcccctttgtgcgcatgaacgggctgtggcttgcctttccttcgattcccaacgatgtactttgcatcttgggatatgactgatcacgatggcgacagacacgacatggacagcagtcaagacatcgtgcacgctgtct

SEQ ID NO: 4034 - DNA, 1045 bp, Triticum aestivum
  unsure (1)..(1045): unsure at all n locations
  Clone ID: PAT_TA_4034
gcctcctcctcaccccggcccccccacgcccctggccgccctccgggcccaccccctccaggtcccctcctcatcccaccccgaccccggcccaccgcagtctcgcacccccatgcagctccccccgccgatcgcaccccccccgccaccctcccatgccccgttccccaccatcgccaccccccgctcccgccccgaggccacctcagcctctcccccccacaccatgagaagcagtgcagtgcagctagcctaccagctaccactaccagtaccaatctcgactcaacggtagctcaccatggcgacgtctccttcccctaagaagaagcaggtgcttctgccgatagtcgccggcacggagccgatcgaggcgtccatccccatcgacatcctccgccgcgccggcgccgacgtcaccgtcgcttccgcaggcgacgcccttctggtcgagatcatgtacggcgtcaaaataatggccgacgagctcctggctgactgcgccgccgcttcctacgacctcatcgtcctccccggtggtgttcctggcgctgtgaatctcggtggctctgcgacgttggagagcatagtgaggaagcacgcagagaagggaggactctacgctgccatatgcgctgcaccgccgctggcgttggcgtcctggggcctactcaatggacataaggctacgggtcatccatggttcgtcgagaagttccctcccgaggttaccgccgtggacgcgaacgtggtggtggacagcaacgccgtgacgggcactgggccggcgacgtcgatggagtttgcgctggctttggtggaacagccaaccgggaaaggagaaggccgagcagttcgctaaaccaatgctaagtgagatacgaaggtggctatagcatgaaagaactcaactccgtccgagtggcactgcagcggcaccaacccaaggtcttccttccaactaccccaacggatttaagaaatggaggcaataccccgtggacccctcgccaaccccaagcaactcgtgnccctcatcnaaggg

SEQ ID NO: 4035 - DNA, 1082 bp, Triticum aestivum
  unsure (1)..(1082): unsure at all n locations
  Clone ID: PAT_TA_4035
atttagtcttgttgcgctgcgcaaggtgatggtaattgattacaagttgacctatcctagtggaactgctacagctatgttgataaatagctttcacactacttctggagctgaacttgcagaaaaacaagttagctgtcttggaaagtatttaagcataagttttgtctggaattgctttaagtggttcttcagtggtgttggggattcttgtggctttgataatttcccttctcttggacttgcagcatttaagaacacgttttattttgacttcagtccaacctatattgggtgtggtctaatatgcccacacattgttaattgctctacacttcttggagccatcatatcttggggttttctctggccgtatatatccacaaaagctggggaatggtacccagctggccttggaagcaatgatttcaaaggactctatggatacaaggtttttatctctgtatctgtgatacttggtgatggtatctataacctcatcaagatcatttatgctactatcaaggaaataatgaatgcacgatcaaagcaaggaaggcttccccttgtccgggctcaggatgatgatgaaagttctgaattatcttccgaagagaagcttctgaatgacgtatttgtaaaggacagtatccctccctggttagcaggatctggttatgtggggcttgcagcaatctcaactgcaactgtaccaatgatgttcccacagctcaagtggtaccttgtcctttctgcctatgttgttgcacccctactcgccttttgcaacttataccgcaccgggctaacagactggaaccttgcatccacatacgggaagattggcctttcattttgcctcatgggttgggcaacatggtggtgtgatcccngcttacaacttgtggggtcatgagtcatagntcananctgctgatctcancagactcaagacggntactgacctctcgtacaaggtcatgtttggtccattgatggacgcctggtgntattgccccnactttggtcacggnggctnanttgnatctgangattnaaagcccaaancgcnctctnaaagg

SEQ ID NO: 4036 - DNA, 1038 bp, Triticum aestivum
  Clone ID: PAT_TA_4036
cggccgccgttggctctatcccctaccggtaattctcccttagttttaccccttgaaattgccatgattatccgagggagaggcacaacctttttctttttgagattcagagtagtaaagctgctctgctgaaaccataaattcagagatcataagcgggcggaggcagtccggtacgtccgcaatcctctcctggtgttctgaattcttggccaacgctgcaagctcatcagcaagggcattgcacaatctccccacgctactgatactatgatccgaaaagtttgttagtgcttgcttgatgtctcttagcagtccatagcagggggagagggactgcttccctgtcatcagttccttaatccgaatttggcagtcaaattccaaaatcacggggccctgtagatccttgagagcatgcaacccaatgagggctgcttttgcttcggcctcctcaacacctgcgacagcacctgcagaatattcagaatacctcgcaagaactacacaacatttagatagaaataacaacatgccctctgccgtcccttgcgacggcatctgcagaatatttacccttttgctccaagtacgaggctacagaatttagtttgattgatctcaaggccggctctgtccaatgcaagtgctgcgtggtggggcagcggggctgctgtaccacaattgcacccacaccttttcctgcttcatgatcgccactcattgccgctgatttaaattcttcagaatacctcgcaagaactgcacagattccataatcgattctttgcccacactgcgaatgcagtcctcacgcaggcacaacctttttttgtggtattcatacagatcagtttgtatatactttgcagattgcttggcaatttttgtatctattcatgtgactgtcatagtgggttagtttccgatgcttgacagatgaattatgtataatttttcggtccaacaattcagtgcgctcttagcgctttgtgtctttggtttaaaaaaaaaaaaaaaaaaaaaaaaaaaaaaaaa

SEQ ID NO: 4037 - DNA, 628 bp, Triticum aestivum
  Clone ID: PAT_TA_4037
gcgcactcccgcgccgccaagatggagctctcctgcgccggcctctcaggagcgccgccgccctcgacccgtctctgtccggccgacaacgagcagtagctcgccggagttgagctccacccgatccgcctccctctacccattgctggcgctcgccccgtcagtcacccatcgccagagttcctcgccggctcgcgcgccaacctgccgggaccaaggcgtcgaccacaaccaccaggagctggccgccgcttccctgctaagggccccggtccgcgtcctccggccaccccccgtgctcgtcttctcgcccggatggccacctcgccagcatcccagggcccgagctctgccgcgccatgcccacctcgcctctgcctctggtttctctgcatcgaagcagtgcagaggaggacaagcgccgcgagcacccgaggcctcgtccgcccgaccaccagagtaccatcaccggcgtacaggacctcgtctccaccaccagaaccgcccgatcttcctcgtccccgccaggtggaccacctcgatccaccacagctcgctggagcacatccccactgccaggcctcttccgcagcaccccggcttccatgcctcgttttgaatcgatctg

SEQ ID NO: 4038 - DNA, 581 bp, Triticum aestivum
  Clone ID: PAT_TA_4038
agcaaggccaactgcgagaagacatagcagaagagtactaccacgagctaatccaccggaatctcctccaaccagatatctcctattttgacatgtctcactgcaaaatgcacgacctcttaagaccacttgctctgaacatatcaggagaagaatgttttgttggagatgttgaatcattaaggggtgaaaatatgccaaaactgcgacgtgttgctgctgttactaagaaggatatgtcggtgttacctagagtggataaggtggatgttaaggtcaggactttcctaactgttaagggtccacgcagaattgaggatacattgttcaagacattccggcttcttcgtgttttggtactgaattactcacttgtgcaaagcatcccagattacatagggaaagctgatacatctacgtctacttaatcttgattatgctggcctatcttgtcttccggaatccgttggctccctaaagaaccttcaagtactgagcttgagatggtgtgatcatctgcacactcttcctttggcaatgaccctgttgtgcagtttaagatgtcttaatcttttgggcac

SEQ ID NO: 4039 - DNA, 1040 bp, Triticum aestivum
  unsure (1)..(1040): unsure at all n locations
  Clone ID: PAT_TA_4039
ttgttagtttttagttttaaaaaggtatacattggttcctaatttgacccaagcagccaaaatggatggatatattttttgtggtgttctaagggaagcaggccctctgttacagcttgctagccatttttgtttgtgaatacgcaagggtgcctccccgcctccgctctgctcgtgcggctgggtcaagtacagaagacgaaacacaagattcaagatcactctcctgtatgtgattatttactcatttcgagccattttgcaacccagcttgacttcttttattttgtgatctgagctatacacaccaaaattagcccacgtaagtttgaaccatatctgaacatgttagatcactctcctgtatgtgatgatttactctatggagccatgttatgacctagcttgagttcttttattcgcgatctgagctgcaaaataaaaataaaaataaaaatagtccacgtaatttgaaccatatctgaacattttagtatctgaatactgaaattaccaaatcttcacttcgccatgtgtgacaccactgagtactttaactaagctagctgtagtaatattacgttttacatggctatgcaagttaaaggttctaatatagtgtacgtttatcgatattttgtgttatactgattaatatacttcacatataagttttaagctaagagctcctaataattgtttctcctctttgcagttgccattttagtcatatttttgctgagataaagaataatattgagatgaatttcctttccgatgatgagattgggtatgcctangttttgtatttttttcagtattaacttatttcaagcttcagttagatgagagagctaagagataatatgggaaacaatttctaacaaggggggtgagctccattttcaaaggccatgaagttaccaantctgggtaagagctactacnttcaaaagagtaaatcggtttcnntggtaccggnatttagtncattntatgaaaaaaaggngnaancaataatgcccngnaaaatttcnncc

SEQ ID NO: 4040 - DNA, 899 bp, Triticum aestivum
  unsure (1)..(899): unsure at all n locations
  Clone ID: PAT_TA_4040
cgctggttgaggggacgccgcagtgcccgcccccgccgcccgccgccggccccgccgccgccccgggccggcgccgccgctgcaggccgccccaccctccccgcccccggcaccggccacccgcgcctccgccggcgccggtgcgcgcgcccccagccccccgaagaacccccgccgccccccgcgcccgcctgcctcacctccggcggggtcgctggcccggcaaggccctctaggcagcccgctcctccctctcgttcctctccctcgccctctccgggacctcctgcctggccgcgcctcctatccagcctgccccaccaaatcatttccctcattagctcattccatgacttgcttgctttccgtggcacctgtcactcatggcaccccgctgcagcctcttccttcccatctgtatataccttcagcttcccacctctcaacctcaaaccagatgtaagccacgagagttacaactcagatcggaattcgcagcttgtccattctgctaggaaaactttacccctctggttggtcagccccccgtctcgcccatcttcccacgcgctatctgggctgctcacatgggtatcttatcctctctggcaaggagaccctcccccccatcctctgggctccctggcactcacctaaggcccctcgcatcctctcctcgcgggcgccgtcatcccctgggcatccttacggtccactaaatccaacattcantctcaccttctccnagggggggccnggtaccaatncccctaaagtgagcctattacgncnctcactggctncttttaaactctgacgggaaacctgcgttaccaactaacncctgaacanatcccttcgcanctggngtaatacnanaggccgacgatgccttcaaa

SEQ ID NO: 4041 - DNA, 1121 bp, Triticum aestivum
  Clone ID: PAT_TA_4041
tcggcccacccctaggcgattctaaaaaaaacacctagacggcggcggcggcggcggcgattatacgagacgcaaagcctggctggcactcttataccccacataagagagatcgatggccggtgttgttgagggaggcgaggagagggcgcctggtgagatggcgacggaagagacgacgcagccagagatcctgaagatgaagatcgcgtccctgctgaacttgctcagcgagaagcagtccgatgttctttcgtgcggccctgagatcgtgagcatgatcacttcgctgaacagcgaactggcatcgcagaagttggcgagggacagcaaacccttggttcccccggaggtctcatcgccgaagaggcccaaaatggctgatcagggaaacattggtcagtccaataccgatacgcagagtgtcagctcccaggtcagttcagtcgccgagcggggcgaccagaaggagatcgagtcaggaaaaatcaaaccagcctccagattcaaatccaattcccagcaggtatgtgtgccctccggtggtgaggatgaggaggagcgccttaactgccaattcactcatatcatgcagcagactgatgctttgtgtgacgagttggcgtctatggcatctaccccgaacaaaaccagtgcccccattatctcctctcacatggtctcagatttgggcgagaaaacgtccagattaatgcagatctgcaaggttatattctgtgagtctgtcaaaggtgatgaacaggttccttaccactctctagataaccagaggaccaaggaggactctgtggagatgagtggtctgactatggacaatggcaaatccagcacccaatgtgctgataaacagacaaataaaaaggggatgggtggaaccatggagctgcttgaagatttcaacatgtttgaatcggacgatgaggatgaggatgaggaaatgacccaggagcaattagcaatgtctgccaagtttcgcgaggaggctcaggtgatggaagcccgcttggtcgaggccctcgagcaggatgataacaacacaccgagctgctacagaatgactcacctttcactctcatatcagcctgaagaaaaggaggaac

SEQ ID NO: 4042 - DNA, 446 bp, Triticum aestivum
  Clone ID: PAT_TA_4042
ccactgggccgttagaacgagctagagagaagcgtcctctcgtcacgccatgagagccgcttgcttctgcttgtccttcaccgctgcctctccccccctcccttccacctccaccgctgcctcgagcccacgctgtcagagtcacgcctcctaccgctggtcccagccacgccatagccgcggcggggtggtccgggccctccacgagcggctgctagagacaccaacccccgcgccagcggagaccgaggtcgaggatgagagtggtgtcggtgagatagaagacggcggtgaacgggagggaagagatgggcaggctgatattgtgggcccgtcggaggcccaagagcacccgaagagcaggcgacgacagcagcaggaggaagaggatgccacggcggagcgcgcccgggtcaagctcatcaacggcaaagagatatttcaag

SEQ ID NO: 4043 - DNA, 845 bp, Triticum aestivum
  unsure (1)..(845): unsure at all n locations
  Clone ID: PAT_TA_4043
ccactttacgttaaccgaccatgcacgccgatcaactagtaccggcggtcgtcgccgccgtggccgtggtgtgcctgctcatcaccggccgcgtggacggccaggacgagtacgcccctggtggcgcggcgagccangaggtggagccgctcgccacgaaccagaaccccgggcagatcctcccgcagccggaggtgatgccagtgcccggcgatctgctccctnagccgagggccgccctatcccggccgtacaccggcggaaactcccggccgcacccgacgaccgagccggagccagagacagaggcggagcagcagccggagcagacgaccgagccggagccacagacggaggcggagccgcagccggagcagacgaccacgagggaaccggagccggtcacgcccacgcgcgaccagggcgatttctaccgcaccggcgcgacgccgaccacgccagagccgccggcgacgccaacctcgacggagacgtgggagacgccggcgacgccgtctgtgcccgtgcagcagggttatacttagttgttgcacatgcttaaattgtatctgcaggcagaagactcctgtgaagaccaataccaacactccggtcaagaagaagactctaggaactctaggaaccaagagaaatctgcttccttggattgggggatggatatgcttacttgtaatctgttctggaccatgcgtgtgtgtgtgtgtgtgtgttagctcaaactgttacttgaactggtgtctggggtagctgtttgtgtgtggtaactcaagctggagctcgaattttaagactaaaaaaaaaaaaaaaaaaaaaaaaaaaaaaaa

SEQ ID NO: 4044 - DNA, 954 bp, Triticum aestivum
  unsure (1)..(954): unsure at all n locations
  Clone ID: PAT_TA_4044
tgcaggnaattcggcacgagggtgaccttctcccgtccacccgcatcctagcccccacctcgccgccaccaacaccgggtgagtccgacgagttccgacggccttcgccggagcgcagcacacccacgagcccccctcgtggcggtgcttccttccctccgtccagatccgctcctcacggccgcaaacggtcgctcgcaccacccctccccgccgctagggtttcggctgcctccaactccggcgagccaccctcctccatggatgagaggacgaccaccacggcccgcacatggtcaagctctccgccgtctgctccggtgcggtgctgggccaacgacctccgcctccacgtctcctagatcgggtaagcaccccatccccatggccatttcactttccagagcctccttttcttatcttgtgtgtgtgtgtgtgtgcgcgcgcggcgtgcgctcatgaagcttctcttcttcatggacgaacctcacatgcaacagcaagccatctcaagggaggggattctcaagtcaccccacttcaaatccatgtacgccatccacaggtgatcctcttagtcggtcagggcgccatgacgtttagcagctccttctaaaaccaagtgggggattttttggatgaggatgatctctcgactcgatctccgtcagctgtataattatcctctacatcatctttgtcagcagcaggatatgctgtaagtctattaaagtaaactggttccataagcacatgggagtaagctcgagccgcagccgagttcagactcttcctctcactcggtgctccataggaggagcatggtctgttgtgcctctcccacctcctcagcgctcagtaagatggccagcgccgcttagtaccagggtgttgatcgcacaatacagggttaccatttgaatttggtctgaaaatggagctaaacctatcaaa

SEQ ID NO: 4045 - DNA, 547 bp, Triticum aestivum
  Clone ID: PAT_TA_4045
gggactttgaaaagagagtcaaagagtgcttgaaattgccgggaggagaagctttttgttcgtctcttgatcgagatcgtctttgatggagcgcaagaactcgttcggctcgtcgtgggcggaccagtgggactacggcagcgacccggccccgcgggccggcgggaagaagcagggcggcgtggagaagaccaaggcggccgcggccacggggctgaagaaggtgaaggagggcaccgcgcacggcttccagtggatcaagggcaaggtgcagaagaagaagcagggcgccgccggcgccggcgacgacgcggccgccgggtattaggcagccaggctcggctgatccctggaggatggaatggatggatggaacgccgatcgatcgatcggccgatctgttggtttcttgcgtcgtttaattggttgtgtacatatagtttttgccgttcttcgattcaggctttgcaccaccacgtagtagatcagcgatcgttttagatctctgcttattgattggttctttcttcacaaaaaaaaaaaaaac

SEQ ID NO: 4046 - DNA, 474 bp, Triticum aestivum
  Clone ID: PAT_TA_4046
aacttgaacgcaagcaaactcaagaggcaacatggttgacgcagcgacccttgagaaattggaggctggctacaagaagctggctgcctctgacagcaagtcccttcttaagaagtacctgacccaggaggttttcgatgccctgaagactaagaagacctcttttggatccactctgttggattgcatccagtctggtctggaaagccatgactctggcgttggtatctatgcccctgatgctgaggcctactcagtgttcgctgatctcttcgaccccatcattgaggactatcacaagggtttcaagaagaccgacaagcaccctcctaagaactggggtgatgtggagaccctctccgatgtggaccccactaatgaatacgtcgtgtccacccgtgtccgctgcggccgctccatggagggctaccccttcaacccctgccttactgaggctcagtacgctgagatgca

SEQ ID NO: 4047 - DNA, 592 bp, Triticum aestivum
  Clone ID: PAT_TA_4047
ggcacgagggctcgccggcctccccggcctccgcgtgctctccgcttacgagaacgcgctctcggggccgatcccgcccgggctcgggctctcgtccaatctccaggtgctcaacctccactccatcggcctcgagggcagcatacccagcagcctcttcgaccttggcaatctgcaggttctgatcctcaccgtgaataggctcaacggcaccatcccggattcaatcggccggtgcctcggcctatccaacgtgcgcatcggcaacaatcgcctcgcgggcgccatcccggcatccattggcgacgccaccagcctgacctactttgaggccgacagcaaccagctgtccggcagcatccccgctcagtttgcacgctgcgccaacctgacgctgctcaatttggcctacaaccgccttgtcggcgaggtgccggacatgcttggggacctgaggaacctgcaagagctcatcatctccggcaatggcctcggcggcgagttcccgaggtccattctgcggtgccggaacttgagcaaactggacttgagctacaacgctttccgcggcggcttgccagatgccatctgc

SEQ ID NO: 4048 - DNA, 1615 bp, Triticum aestivum
  Clone ID: PAT_TA_4048
ggggccgcctccggtccggccaccccgccctccccccgcccccgctccgccccgcccgcgcccccccccgcctcccggcccccgccctctcggacacgccgccgcgcgccccccgcgccgccgccgacctcttcctctccccctcccccgccgcctcccccgcgccggtcgcccgcacggtgttcgtgaacgtgccgtggtacttctccgtgctgttctcgatgatctcgcccttcctcacggagcgcaccaagagcaagttcgtcatcgcgcgtgagggcaacgtcgcggagacgctcttcaagttcatccggccggagctggtgccggtgcagtacggcgggctgagccgctcaagcgagctggagaacgggccgcccaagccggcgtccgagttcaccatcaagggcggcgagaaggtcttcctagagatcgacggcattgaggccggtgcaacaataacgtgggacctggtcgtcggccgccggggccgcggcgccgccgcgcgggccgtgccccccgccgacgccggcctcgccctgggcctcgggtgcaccggcctggtcggcatcgtcgcctacatgcacggctgggaaccgcgagggccacccggtctgctacaacgcctacggcgtgttcaaggaccgggacatgtacaacggggtgttcggcgacggcgaccgcctcagccggttcctccggtggcgcgtccccatcctggagcgcggcgtgcgcgcgctccagctccgccccggcggcgtcaacgccatcatacaggtcaccgacctcaaggacatgccgaagcgagagctccgcgccgcgtccaaccagatactctccctcttccaggacaactaccccgagatggtcgcccgcaaggtgttcgtgaacgtgccgtggtacttctccgtgctgttctcgatgatctcgccattcctcacggagcgcaccaagagcaagttcgtcatcgcgcgcgagggcaacgtcgcggagacgctcttcaagttcatccggccggagctggtgccagtgcagtacggcgggctgagccgcgccagcgagctagagaacgggccgcccaagccggcgtccgagttcaccatcaagggcggggagaaggtcttcctagagatcgacggcatcgaggccggtgcaacaataacgtgggacctggtcgtcggcggctgggagctggagtacggggcggagtacgtgccggcggcggagggaggctacacgctgtgcgtggagaggaccaggaaggtcccggccgccgccgccgagcccgtgcacaacgccttcacggccaaggagcccggcaagatggtgctctccatcgacaactccggctcacggaagcggaaggtcgccgcctaccgctacttcgtgcgcaagccgtcggcgtaggctaccctgctgctcgactgctgtggccggcggcttgccggccggcttgtgctttgctttgctgggcgtcagctcgtctcggagagtagattaatttaggtctatttaatcagtgctatataatgtgatatgcatgtattatggcatatgtagaatataatgtatgagccgtgagatcctacttgtcatcatcgttataaaagctaat

SEQ ID NO: 4049 - DNA, 732 bp, Triticum aestivum
  Clone ID: PAT_TA_4049
tgttgggtaccggatgtcctgggggcggagcatctgggcacggtgaaggagtgcttccgtcagccgcagtccatggagtgcgtccagttggtgaaccagatggcggaggataactgggcgtgctatgtgtcgccacagtatggtggacatgaaggggcacctcatgaggtaccccatcaaggtcgagaaggacgggagggtggtgccgctgcctgggcatgagagcttcccggacgtcggtggcaaggtgctcggctctcactcctcgctgcccaacgcgctgacaacgtaaccagtcatcctcgatcggcagaggatcagagtgctcgagcttgaagaggctacaaaggtggccacgggcgttcagaagtgggagttgaagttgttcctcggaaacaaagaattagttgatctgttgcatatacgtctgacttttagcattaaccgttaagctgtatatgtgtatatataaaagagagaccagacagaacgtcataccagttggaccaaattttgtgtccctgggcattgcactttggttggagtctattgctatgcacctatgatgtaattccccgttgtccaccgcagtttggttagaagtcggcattcagatcttggtcggtcagcaatccagaacatgtaccaagcttgttcttggtttttttttctttttctttttgcgagattttttccttgcccgtatgtcaaaatgtatataatttaaaagta

SEQ ID NO: 4050 - DNA, 1272 bp, Triticum aestivum
  Clone ID: PAT_TA_4050
gctcacgtccgcttgggcaaaatgaaaaggcgtagaggcgggctggaaaatccggataacggtccgttaccgttggacgggaaaagtttcggtcttggtgagatttccacaaggaaagtgtacccgtctggcgcagagcccgctactacgatccaccatggggagaagggaacgctctagggagtgtcactctcatacaattcccaggtgaggcatgctgcagttgaatcgttctggcaggttctatcaccttgtgttggagttcaagtttctagcattgatggcctgaaaaccggccataccgtctcaaggatccaggaacagatcctcgcagacctccactgctaccagagcctgatccgcgtgacagtccacaagctttagctccccgacaaactgcaggtgatcccgctcaagaggctgtgggacacggactggccggtgttcggcaaatccgatttgggacacaactcgcgccagcgcctgcttgcacagatctcggcaccgaaccaccacgagcggcttttcacgctgagcaacttcaagcatttgcaacgctgcaaccggcaaaaggatgcagcaactgacatcagcaggccccaaccgggaccgcggaagatccggacaccgcactgcgggtgctgcaagtcctcggagaacatggcagtgcacccgctcacgaggcaggccgtcgtgctctaccaggagctcttcagcatggacttctgcgtcaagttccagaccgaggtctgctagaccgagcttcgtcgtcgttggctcgtggtgtgtgtatataggttatctgtctatctatctatggtgacttatggacatgtagctggggcgaacgtcatcatgcggcctgttttgggagggcggaagatccggggcccgtactgcgggttctgcaagtcctcggagaacattgtcaagatcgccgtcccttacggcgccaagctgctctaccaggagctcttcagcatgggcatctgcctcaagttccagacggaggtctgctagaccgagcttcgtcgttggtgtgtatataggttatctatatctatctatggttactgatggacatgttagttaaggttctctgtggctgtggacatggtagttggctggggtcatctgtggttatggacatgtagtggctacgtgaaactccttgtgaccatggcgtttgcgtagctgggacaggcctgctcctatggagcgaagctggccgtgcagtgcaggatatctttgtgcccgtggggatctgcctct

SEQ ID NO: 4051 - DNA, 1465 bp, Triticum aestivum
  Clone ID: PAT_TA_4051
ccacgcgtccccccccgcccccccgctcgcgcccgcgctcgcgcccgggctcacccccaggcgccgttttcttccccgtctcctcccgctccgcccccccaccgcccgtcgtccgtttcttctcctctccccctcgccccctcctccttaacataacaatggctgtgcaggcccagtacccctccaatctcctcttccacgatagaggtgacccggagagggcggacatggacctgcccaagcagcagcatcagcagcaacaccagcagcatccgcagcagctcgccggactctcgccggcggtctattttgccagtggcggagccagtgggaatcggaggaagcgcgccagggaggccatggcgccgccgccgccggccaaaggggggtcgaccggcctgtccgcgcagcactcggcgcccttttttaacatggcgcagctccacagcagcagggtcgcggcgtccccgtcccctgcccctgcctctgtgacgcgcgtgtccacgggcctccgcctggcattggatgagcagcagcagagacagattaattccttgtgttacccgtcctcgtcgtcgccgctcgttcccttctccgttgagttcgccggacagatgaagcagcacggcgacgagctcgacaaattcgtccgggaccagggcgagcagctccgccgggccatcgccgatcggatgcgccaccacaaccgggcacttctggtggcggcggacaagtcggcctcgcgccggctccgggagaaggcgctggaggcggagcgcgaggcgcggcgcggcgccgaactggaggagcggctcgcgcggctacgcaacgaggcggcggcgtggcaggccgaggcgctctcggagcacgccaccgcggtcggccgtcacgcgcagctccagcaggccgcctccgcggcgcgggcatcctgcgaggagctcggcggcggcgacgccgggccggccgaatcgtgctcgtccgcgtacgtagaccctcgccgcgccgggcctgaccgcgcgtgccacggctgccacctcggggcggccacggtggtgctcctcccgtgcagacatctgagcctctgccgcgactgcttcgccgccggcgacatggacgtggccctggcgtgcccggtgtgccattgcgtgaggaccggcagcgtggaggccatcctgtgttgacagagccggcatcggggccatcccgcccgtgccgtgagcgctccgagcaatgcgaaaggcgccatagcttattccaaggaatggaaaaatagtcctaaaatggaaacttagattctttctttctttcttcaagcttttgttcatagtttttcttaatccttttttactgcggacgaggatttacccctcgccgtgtcctctaggagaattcaattgatataagttcattgttaatactacccagcccgtcgcgtgcaactcgagactagttctctcaaaaaaaa

SEQ ID NO: 4052 - DNA, 609 bp, Triticum aestivum
  unsure (1)..(609): unsure at all n locations
  Clone ID: PAT_TA_4052
cgtcgtcggcggactcgtcgcccacgagatcatggggcctcaaggagcagcgcaccgtctacctccgctggttctacctcgccgacgacgacgcggacggtcgcctgactgggaaggacgccctcaagttcttcgccatgtccaagctctccagggaagacctcttgcaggtctgggcgattgctgattcgaaacgtcagggttatcttggattcgcggagtttatgaccgcaatgcagctggtttctctggcacaggcagggcaagacataagccaagacacccttgcacatgcagatttggcgagcttgcagcctccgacaatggaaggtctggagaagaaactaaaaaagagtgcggcacacaagagcagctccgacctcactgcgtaccatccagtccaaacgtctctgtcagctaactggtttaactcgaagtcgggaaagaagatagcgatgaaatcagtcacctcgataatcgatggactaaagaaagcatacattgagaagttgaggcctctaganaaaacttaccaatataatgactttgtttcacctttgctgactagcagcgattttgatgcgaagccaatgatcatgctattgggtc

SEQ ID NO: 4053 - DNA, 1199 bp, Triticum aestivum
  Clone ID: PAT_TA_4053
agggctggaaattctggggcgacagcaatgtaaaatccaagttctgggggcagtcaattcaagttgatcctgttggcgttttgacagtggaatttgatgacggtgaaatcttcaagtggagtaaggtgacaacaactattaataacctcattcttgggaagctgtactgcaaccatcatggtattatgcacataaaggggaatcggcagtattcatgtaaactcaagttcaaagagccatcgctgcttgaccgcaatcctcacctagtacaaggcttcgtggaggacaatgatggaaagaaggcttcatttttaataggaaaatgggacgaaagtatgtactatagcaatttagatacttccaaggtcaagagcgccgatcaattgcagggtgcctccctactttgggaaaagaacaaaccttctcccaacccaactcgttacaatctatcttcttttgcgatcacattgaatgagctgaccccagagcttcaggagaaactccccccttactgattcacggctaagaccagaccagcggcatttagagaacggtgagtatgagaaggcaaatgcagagaagttgaggttggaacggcggcaaagaatgtcgactaaacttcaagacaatggttggaagcctcgatggttcgagcaggacgcagaggacggggcatatcatggcaaaggtgggtactgggaagcaagggaccaaggacgctgggacggatgcctcaacatattcggggagttctcagaaacgtgaacgacaggcattgcagcaacacttggttcatccaccccaactgcaatgcgacgaccgtcgtcggagcagcattgcaccccaaggcatcatcgggttgaggaagaagaggagagaggaatgcaatgcagtggccagtggatatagaggcattgaagaagaaggccttgccgtcttgaatggtagatagatatggatggcgatggtctccggccctttattagtacctaaataataatgcagccattctttcgttcgtttgtgttgtatgcttgttgttcactagtcttttccttgtgggattagctggtgaagcaactcttatctggatgtttcgtagatcgtagtcatttgtagaaaggaaatagaggatgagtttacaaaaagattaccatagagtggacagataatggcataagctcggcaaagaaaatccc

SEQ ID NO: 4054 - DNA, 1682 bp, Triticum aestivum
  Clone ID: PAT_TA_4054
cggcacgaggaaagaactcgacccccccgacctctgaccaatggtcgaagtaaagtggggcaaaagatccaatttctcccctgctgcttcccccggcgttcgctgccccttccgaccagccggcgcatcccgcacggcacgccatgaagatcgcggtggagggatgcatgcacggggagctggacaaggtctacgacacgatgcagcggctcgaggcggccgagggcatcaagatcgacctcctcatctgctgcggcgacttccaggctgtaaggaatgagagtgatttacagtgtgtaaatgtcccaccaaagtttcgtaccatgaactcgttttggaagtactactctgggcaagcagttgccccatacccaactatcttcatcggcgggaatcatgaagcagccaattatttgtgggaactgtactatggaggatgggcagcacctaacatctacttcttggggtttgctggtgttgttaagtttggaaatattcgaattggtggaatgtcaggaatacataagcaacatgattatcaccgaggacaccatgagaggcctccatacgataatgctactatacgatcagtgtaccatgtaaggcattacgatgttctcaagctaatgcatgtgaaggagcctctagatatattcatgtcacatgattggcctcttggcattactgaatatggaaaccgggagaggctccttcgagagaaaccgttcttcaaagaagaggtcaacgagagaacattaggcagtgaatctgcagcaaaattactgaacaaattaaaaccaccgtactggttttcagctcatcttcattgtagatttccagctatcattcaacatggcgaggatggacctacgactaagtttcttgctcttgataagtgccttcccgggcggaattttttgcaggtaatagacattccatccaatccgggaccatatgaaattcagtatgatgaagaatggcttgcaataacacggagattcaatagtgctttcccccttgctcgcggccgaggtacaattcggaatgaagaacttgatattgaagatgaccggcagtgggttaggagcaagttgaatgctagaggggctaagacatttgattttgcccagactgctccaccttatgatccgtccaggccaatttataacccccccatagcagttccttgcagaaacccacaaactgaatcatttctccagtttttagagctcccatatctgctggactcgtctaatcctggcggtgttgatataaatgtatcgagctctcaggcagcacctgcacttgacaacgacgacatagagctccccgatgaagttgaagacgacgaagatgatgaggagtgaagcacttaaagtagtggactcgttggaggtttcaccaggacaagttctgttgtattatccctgcgtccagggttttgttgccagctatcttgatggatgttattacctctgtagagcataactgcagaaggaaaactaacttgtagaccgtagtaccggcccgggcccccgctcgattacgaggtgtaaccggagttattatatgctagcacaatgcagattttttagagatattacgtctttttttaactaacaatgtcaatcttctttattttagattttgttgacgagtctcaggtatcaagtatctatata

SEQ ID NO: 4055 - DNA, 673 bp, Triticum aestivum
  Clone ID: PAT_TA_4055
actagtagtagcggtaggctggaggaggcggaggaggaggccttcttcgacacgcgccaggacctgctggcctcgccggcgcccagcccggcaccggcattgccgtggtcgtccggcggcctcgatggcctcgacagcgtgcgggacaggaaggagcgcttcttcagaagcatgggcctcgagtgcggcccgagccccaggcaggcagtggatcccgtgtttgccgccggcgaggcggagaagcagcaggaggaggaggctgtgccggagactgggaggctctcgtcgcactcggagaacgactgctccatgtccagttggtccacggaggagaccacgagctacgacgagggcggcgcgtcggacgacaattccgtcggtggatccagcaaggacgatggcagcagcaaggtcagcaggagctccagttcgttctcgtttatccggcggcttatgagccgaaatggcaagccttccggcgctccgaagacggttgagatgaggagaagcgggtggctggagaggctcggcgtggccgtttgtgctgtggataatgcggcggatgaacctagcaccagctcctctgacagcgagccgattcatggtggaaggtatgagagagtcaaggtccgatcgtaccggaagcggtccaaggaattgtctgcgctctacc

SEQ ID NO: 4056 - DNA, 780 bp, Triticum aestivum
  unsure (1)..(780): unsure at all n locations
  Clone ID: PAT_TA_4056
ccacgcgtccgcacgctgtccgcccttctggaacagcccaccgaagctcacacgaaagcgcaccgctagaaatggccacgcggccacccgtcttctccactctcacagcgtccttctccccttccccacctcatctgctacgccgcctccaaaccctaacccgcgcgcttgcgtcctcctccccgcagcccatggcgtcgtctcctcccctgaagaaggtgctggtgcccatcgcgaacgggacggagccgatggaggccgtaatcaccatcgacgtgctgcgccgcgcgggggcggacgtcgccgtcgcctccgtcgagcctggggccgcgcaggtcgccgcatcctggggcgtcaagcttgccgccgacacgctcctcgccgacctagccgaagctgattttgaccttatctcgcttcctggagggatgcctggggcttccacctttagagactgcaaaattttggagaatatagttaaaaaacatgcagagaagggcaagctttatgctgcagtatgtgctgcaccagctgtggcgctgggagcttggggtttgctcaatggattaaaggcaacttgtcatccttcagtcatggacaaacttcctaatggtgtgaaaaccgtagaatcaagggtacagattgatgggaattgtgtgactagccgtggaccgtgaacaaccatggagtattctgttgttttggttgaacaactgtatggcaaagaannnnncgatgaagttgctgggccaatgnnnntgcgnnnccagcatnnngcan

SEQ ID NO: 4057 - DNA, 1009 bp, Triticum aestivum
  Clone ID: PAT_TA_4057
gcacgcggcgcgccgctcgccttctccctccggctaaaccctagcccgacgccacgcagctactctctagaaccttccccacgagcgctcccccgagccctcccgcgcgtcccctcgccgccctcgcctcttccgcggcgcctctctcgccgcgcgcccctccctccccgcccccccctgcccctgcactccggcccgggtccgcccgtcctccgccgggcctgccccgcggcggcgccctcccccgccgccggggcgcgggcgccagcaattgcggccggcttctgcagacggctcacggcgagcagcgccccgcgagcgtgcgcgcccggattcgggctcccgggggacgaggggcagcccacgacccaaagatccgcacgactgggggacgtgcacgccggggtgagcctatcacttcgagccagcagggtagggggaaggtgaaggggaggaaggagcggaagcatatcaacaagggcaagaacatgatcatgaatgaaaagaggaagggcaaagcacaagatgctgttgctaggaaggaaaaagaggcagaagggagaaagaggaagacagcggccatggcccgagaccgggcatggaggtaaaggttggcaaagcagaaacagatagaggaagagaatgaagcgacgatgggttaagcagctcctctggaaaatcgtatggcgtgttacttgtttccgcttttctgcttcgtcgctattttttattttcttttcacgctagcctgaatatgttctgtgtgacacttgtctacaatgtctcaacccttctgtgcgggtactctggctgtacccctttccttcaacagcattcccaaaattgctgattttgttttaatacggtgttcccaaatttgtcttcattgtaattaaacatcggctatacgaaacgtgtagaataaaccaaatgatcgtagttgtgtgctggggaacagaaaacacagtcagtattggaactacaagtgattgttattgatctactgctc

SEQ ID NO: 4058 - DNA, 795 bp, Triticum aestivum
  Clone ID: PAT_TA_4058
gcacgaggcttccacgcgccgaaatgctggccgccaccgccgcctgccgcgcgccggcgcggccgctccccgccgcgcgacccggcagcagctacctcctcgggcgcgtccttctccccaaacggagagcgccggcggcgaggaggaggaggggacggagcgcggcggtgcggtgcgggctgctccccgtggacccgtgggcgcccggcgtggactcccagagcatcgcgtcgcagctcttcgccgtgtccctgttcccctacctggggttcctctacttcatgacccggtccaagacggcgccggggctcacgctcttcggcttctacttcctcctcgccttcgtcggcgccaccatacctgctgggatatatgccaaagttcattacgggacctcgctgtctaacgtggacttgctgcacgggacggcggaatcgctcctcacactcaccaatctgttcattgtgctggggctgaggggagccttgaggaacctggacaaagcagaggagagcagccctgaagctcctcaggacagcaaggagaagagttcagtataggtactctcaccggttcccccaaattgtgcttgtaaatccctgagaaccttttcctggtgcctgtagtgatgacattgtgctgtagtgagtgcacatttctgttgctcaactagcttatgaagcccctgctgctgtaataaactgcacagactggctttgtgcatgtgctgatccataatatattgctgcagttcagagtctctaaaaaaaaaaaaaaaaaaaaaaaaaaaaaaaa

SEQ ID NO: 4059 - DNA, 1387 bp, Triticum aestivum
  Clone ID: PAT_TA_4059
ccaggcccctcggcacgaagcaccagtccctctttccgcaacctccgacgtgccgccccgttcgtcccagaggcgcggcgggcatagaggctggaacacgcgcctcacaatctcctcagtaccaccagcagggtatcagcagccagcaatcaaatcctccctcaccaggatgctccccacgctactcggcggctacctcaccgtctccgcgctaccgcacccaaccgcgacagcgactccgcgcgcacgcgtactccctggtctcaggccctcctcccgcctcgtcgcccgccgaagcgcaggggaaactgtacacgcaacggccacagaagaggaggagcaggagtggaaggagctccaggaggaggggctcccgatgcgggggcagcacgccgaggatgaccacgaccacgaccccgagatcgcggacattatgggggattacttcgacgaccccaagaaagcccagtcccgtatggaggaaaggataaagaagaagcggcacaagatcgtgcaggccaagaccggctcgcccaatcccatgaaggtcgtcttcaacaagtttgatttctccaattcatatatatggtttgagttctacaatgctctattgccaaaagatgtgaaattaatttgtgatactctgcgatcatggcatatacttggacgccttggtgggtgcaattccatgaatatgcagctatcacagttgagtttagattgtaaaagaccaacttatgatgctcttgaagcagcaaacaccacaccaacatccttttacaacattggtgatctagagattcaagagaacctagcacgtgtctgggtggacattggtattcaagatccattgcttttggacatcctgcttaattcattaaccaccataaattcggatcatctgggcattaaggaagtacagttcggagggtcggagtttcagagctggaacgacagcttgaatactgaagaagctggatacagtgtccagaagatctagaaagcagagtcgtgcgattgtagaagcagctaccattttggtaacctggaggatccaacaacgatttactggataaaatcacgcctcacttgatcttgacgcactaatcttgcaattgaaaaggacgacggcctccccaccattgctaattgctaagcatgaaggatgatgtctatattgttgtgcaaacgacctgttttggtctccgcctacaggataccaacgactcaagttggacaagtgtaacatgttggcctgtttgttgtgctaaacacgctcactcgagtttctccgtcggataaatgttaccaggtgaccaagtgagatgattgttaaatattgtcgcctattgttgtctatatctctcctcctaagaaaaaaaaaaaa

SEQ ID NO: 4060 - DNA, 378 bp, Triticum aestivum
  unsure (1)..(378): unsure at all n locations
  Clone ID: PAT_TA_4060
aatcaaacgaaaaaaaaagaagcagttggcggacggactggagatgagcggagccgccggcgagctcaccgcgccgccccgtcgccggcgatccggccgagcagcgcagagagaggagacggcgccgctgctggatcccgccgccgaggctccccagggccgaggtgcaaagagaggagggctgttggaccccgctgaggttccccaactccagtgggccgaccccatttccagctcgccgcgtgtgtacggtaggaagcagtggcgtgccgtgtgcaaggtgctcggcaacgacaatctcctcgctgagatcctagtacgcctacctcccaagccgtgctcgctcccccgcgcgtncgccgagtgcaagcgctggcg

SEQ ID NO: 4061 - DNA, 633 bp, Triticum aestivum
  Clone ID: PAT_TA_4061
ccgtcggatcgatcgccgtcgccgtcatgtcgtcgtcggcgccgctcccgctggagagctactgtccgcaccaccgcgaccgcgccgacggcatcgccccgtcggtctcgcgcccgccgagcagatcagagagacgagacgccggcgctcctcgatcccgcgccggcggcgccccagggccgcggtgcagagagaggagggctgttggaccccgctgaggttccccaactccagtgggccgaccccatttccagctcgccgcgtgtgtacggtaggaagcagtggcgtgccgtgtgcaaggtgctcggcaacgacaatctcctcgctgagatcctcgtccgcctccctcccaagccgtcctcgctcccccgcgcgtccgccgtgtgcaagcgctggcgcggcatcctctccgaccccgagttcctcaaacgcttccgcaagcaccaccgcaagcctcctctgctcggcttctttgaagggtatgccaaccgctttgctcccgtcatggactcgcccgaccgtatcactgcctcctgcttctccatgcccaagagcagcacgcgctacaacgaccatcgagaatacatgggctgccgccacggccttgctgttctggtcaacaagcaggagcgc

SEQ ID NO: 4062 - DNA, 318 bp, Triticum aestivum
  unsure (1)..(318): unsure at all n locations
  Clone ID: PAT_TA_4062
cccaccccactctgccaaccctaccgaccaaacacaaacagcacagggcgacagcgcgggcccgccacctcgccgcccgccatggccggcgctcccccgacgcccgccgagaaggacgccctcgtctcctccttcctcgagatcgccgccggccagacgccccacaccgccacccagttcctccagatgacgagctggcatctcgaggaggcgctgcagctcttctacatcgacggggaggccgcgctcgccggggcgcatccgccggcccagtcggccgccgaggccgcgctggcggcggccgccgccgcgntaaag

SEQ ID NO: 4063 - DNA, 766 bp, Triticum aestivum
  Clone ID: PAT_TA_4063
ccttccgtccgcccacacgtccagcccgttcagccagccagccagccagcgcgatccctagcgtcgaggcccattcccccccgcccgcccattccacgatccctcggccgcggtcgggtcgccatgggaatggggccgctcgagaacgccgcggccgtcgaggtgccggtggtgaccgcggcggcggcgggaggggggtcgtacgcgctgctgcagtgcggggaggactcggcgtacgtgcgggacgcgtacgggggctacttcgaggtgttccgcgcgctgctggcggaggacggggagcggtggcgggtgtaccgcgccgtgcgcggggagctgccgtcggacgacgaggcggccggcatcgacgggttcgtcatctccggcagctgcagcgacgcccacggcgacgagccctggatcctcgcgctcgtggacctcatccgccgccagctcgccgccggcaagcgcgtcctcggcgtctgcttcggccaccagatcctgtgccgggcgctgggcggcaagaccgggaggtcgtgcaaggggctgggacatcggcgtgagctgcatccaccccaccgccgcggcggcgaggctcttcgcgccgctcaagatgccagggcacctgcccatcatcgagttccccccatgaccaggtgctgggagctgcctgctcacgcccaggtgctggccccgtccgcaaaggaccggtgtggacatgctccgcgctgggcccaccgccgccatgggccccccagggcccaccccc

SEQ ID NO: 4064 - DNA, 1533 bp, Triticum aestivum
  unsure (1)..(1533): unsure at all n locations
  Clone ID: PAT_TA_4064
ccacgcgtccgcccagcggtcgctgtgagccgcggcggagagatcccgcgcgccaattggcgtcgcccacccccacctcacccagaccccgtgcaaggccgcgcgcggcctccccgtccgacgccctggagccgtcgcagcaggaggcgctgaagccttccccgaccaacggccgcattcgctaccgctcgccctccgcggccgatctgctccccgtcgatgacctcaccgttggcccctccgccgccgatgccgctgcggctactgcggcagccgccaggatgcgccgcttctcggccgccggcgcgcgccagcagcagggggaggccgtctccgaccgcctgcaccgctaccgcggggtgctgatggtggtgctctcgccggtgctcctcgtctccttcgtgctcctcctcatgccgcgctccccggcctccgtcaccggcggggcctccggcgtgctcgtcgccactggaggcaggaggtggggaccccaggccgtcggcggagttggtgacggatcgaacaggtacgcggtgatatttgacgccggaagctccgggagccgcgtgcacgtgtactgcttcgacgagagcctggatcttgttcctatagggaatgcgatcgagctgttcaagcagaaaaaaccaggcttgagttcttatgccaaggatcctcaggaggctgccgagtcacttgtttctcttcttgaggaagctgaaaaagtagttcctgtagaattgcgtgagcaaacacctgtcagggttggggccaccgcaggtctcagagcattaggagctgaaaggtctgaagaaattttgcaagcggttagggatctccttcgtgacaagagttccttcaaatcccaaccagattgggtctctgttctagaacggatctcaggaaggtgcattcgcgtgggttaccatccaactatctgttggagaaaattggggaaagccttactcacacactggttggagtggttgacttaggtggtgggtctgtccaaatgggcttatgctatctcagaaaaggatgcagcaaaggctcctcaagtttcagatggcgaagattcatatgtgaagaagctgggtacttaagggaacaacatattatctttatgttcacagttatttgcattacggttgcctgggcggctagagcagagatctttaaaactgggtgaaaacagtgattacagcaactgcatgttgggatgggtaccatggggaaacacaatatggggatgatacatttgaggcctcaaggtcancatcgggtgctacttttccaagtgcaaggctgtgcaatcaanaccctaaagttgatgaacggcatccccacatgaaatcacattggtggcgttggaaaggtggtggtggaaatgcagaaaatccattgtacacattttcagatgggcnccaagcngtttgaanccagggacatttcaggtaaccccaactttaaaccccccctttttaatttttnggggaatccccccccggtttnggaaacccccctntggnttttnaa

SEQ ID NO: 4065 - DNA, 968 bp, Triticum aestivum
  Clone ID: PAT_TA_4065
ttcaaactgcagttaaagcaagagaacattagaaggacacagcatctatgaaggcggatattgcaagcttcacctcgcgttttcacgccataccgatcttaatgttaggatcaacaatgagcggggtcgagattacactggggcgaacagtgctcctgctaaccatgaaccttccattcttggccctcagccaatgcttgctgctggctctactgcgccaccatacagcagtgctccttccgcagcagctgacgtagtagcagcaccagggactacatctattctggcaacaccaggagcaccatcccttccttccagtcagccacacccacaagccgcttcaggtggacctcaacagtacgccagccagggagtcctacaaggctatggagccccagggttcccgcaaggcccaaatcaagctcaaatgtcacagcattcaggccaaggaaatcaacagatgcccaaccatcaagcgatgtcgttccctggccatggaaggcagcagctacctccaggtcctcaaatgatgcaaggtccaggttatagaggcccgccgtttccacaaggtcatatgcaatcaatgccgcagtttccagtatatggcaatcagcagtttcctcctggtgccgggccgcagatgatgggcttccccgggacagggaggtcagtatcctccatttggtaggccgcttcatccgtataaccgttagctagcttatgtgtatgtaagaaacgcatgtgcgagtgcgagtacttgatattcatataagagtgcgagtacttgccggtgaccattttattgtggctcctgacttcgtagtcgtgtgctcaggaattttggtgcacatgtggcagaaacaagtgggcatacataattattctgtagtgaaacgctttggctatgggttgtatcatttcattcttattattggagaaaatggtgttggctgaataaaaaaaaaaaa

SEQ ID NO: 4066 - DNA, 712 bp, Triticum aestivum
  Clone ID: PAT_TA_4066
ggccaaacccgaaggccagagcccgcgcgacgagatccccaaccccccgagccagagccgccgccgccgaccagatccgccgccccccgtaggcggccaacacggcggccgccaggatgctgcccgacggcggcggcgacgacgaggagcgctggctcgccgagggcatcgccggcgtccagcagaacgccttctacatgcaccgcgccctcgactcgaacaacctcaaggacgcgctcaagtactcggcgcagatgctctcggagctgcgcacctccaggctctccccgcacaagtactacgagctatacatgagggcgtttgatgagatgcggaagctggagatgttcttcagggaggagacccgccggggcagctgctccgtggttgacctctacgagcttgttcagcatgctggcaacgtgttgccgagactttatctgctctgcacagtaggatctgtgtacattaaatcaaaagaggctcccgctaaagatgttctgaaagatcttgttgaaatgtgtcggggcattcaacatcctcttcgtggacttttcctaagaagttacctctctcagataagccgagacaagctacctgatattggttcagagtatgaaggggatgctgatagcattaatgatgcagttgaatttgttcttcagaatttcatagaaatgaacaaactctgggttcggatgcagcatcaggg

SEQ ID NO: 4067 - DNA, 1140 bp, Triticum aestivum
  Clone ID: PAT_TA_4067
gtcgttgatcctttgaagcccatcagttgaaagatcaacatcttggactgcaaggtgaacaccaatatgaaaatgctggccttgcagtcgcactcgctgcggcatggcttgagaagcagggacacgtggacagaatgccactcaaccacactgatcccttaccagatcagttcatcagagggctgtcaagtgcttctttgcaaggccgagcgcaaattgttccagattcacaagtaaattcagaagagaaggaccaagatagttctttggtattctatttggatggagcacacagccctgaaagtatggaaatatgtgcgaagtggttttcccatgctaccaaggagcagtctcagacttgcagcaaatctcggaagattcttctattcaactgcatgtctgtgagagatcctatgagattgcttccacatctcgttgatactgcaactcaaaatggggtgcactttgatctggccctatttgtgccaaatcagtcacaacacaacaagcttggttctaaggcatcagcacctgctgggcctgagcaaattgatttgtcatggcagctatctctccaagcagtgtgggagaaattacttcatgatgacaataaaggttcaaacagcacggattctggcgagactagcctagtgtttgaatcactgccactagcaattgagtggctaaggaaaaatgccgtagaggatccatctacttcttatcaggtcctggttactggctccctgcatctcatcggcgatgtactgaggttgctcaagaagtgacattttttgggaacattatacagttggaagctgacactgaagtagctatactgaatagtgtgaccccaagccggggctcttgatggtttcgagatcttcccagggcaagcacatggtttacagaaatgcgacaagcagtttggaagtgctttgcctgcgatgcgaatcgggcagcaaggtgaaatgtgttgtagtctttcttttcgcgagaggaggggagcttgtttgtatttctcgtttaatgcttttctggccattgttgccactgtattcctccccatgtatcctgggaagacgattcgccgaaaactcagacggacgtcagggcgcaagcgaagcatgattgccaacaaga

SEQ ID NO: 4068 - DNA, 697 bp, Triticum aestivum
  Clone ID: PAT_TA_4068
ggtcagcggccggtgggctcgttgtgctcggcggaggattcgctcgcttcccgatcctcctctcctccgatctctcgtgttatccggaggcgacaacggcggtcggcggcaagggttacggagcggtcggcgattcggctgcggctgctacggcggcggccactcccaaatcacccggctgctccgtcggagaaagcgccggcgactgcaaaccgtcgaaggagaatacgctggtgtcagccatcttccgtaagcggaggtgctgcaaaggagctgttgaatagggggatcaagaagaggcaggaccaataggatggcagtatgacagtatgccattatgtcaatggaggagaaggaggccgtgtcaatggcaaagaacaagaggagcacaacaaggcccgtgaggaggaagaacatcacaagattatcttctttgatacagccaaaggaaaatggcaaatggggattccgatgtaatcgaggaaggaagatgctgtttgtgagtgacttggagacgaagtatctagaggcagtcatgtgcagattacaagatgtgccacttttagttgtatagtatcaatgcacgggagatatagctcatagtccttgttgcacgaatgtacagaaaatggttttacgttgcaaaatcttatgggcacatgaggccatgtcaaaagttttgatgtctgtgtgattt

SEQ ID NO: 4069 - DNA, 986 bp, Triticum aestivum
  unsure (1)..(986): unsure at all n locations
  Clone ID: PAT_TA_4069
tccgcagcctgcgcatcgagctccccgccggcgagctcggcatggacgacggcgtgctgctcaagtggaaggccgacttcggctccacgctcgcccccggcggcatcctcggcgccgcctccgcctccgcctcgccgtcctctgccgccaaggacggcgccacggccgcgcctcctcctccaactgctgattgcgccgagtctgacgattcagggagcataccggagtccttctacaccaacggggggcttaagctgcgggtgctgtggaccatcagctcgttgattgccgcgtcggcccggcattacctgctgcagcccatcatttccgaccacgcgttgctggagagcctggatctgacggacgccgatgggcagggcgcgctcaccatggacaagtggcaactgcaggagctacgggtcaggccaagtatcagcgtctggtgactcacaccgcacgctcatgccggcccttaagcatgcgcttgtggtatgcgccacacattgagctgcctgggggcacggtcctgtgtggtgcgaccctgctcgccgtcgggccgagcgaagaggcaatgatggatgcagttgggaatgcaactgctgggtcagcaggtgggatcctgggtttcaagatgcttttgaggaccatatcggacggccntcgggtgttgcttctcaaagccgaggatgttatacccttgagatgaaccaattctaaactatggagggaangccatcccagaantttcaaccngngagaggttantccngtcccccnacgaaatgcaactcccaaacacattgttactttaacaatgggtccaanttcnccgggcgcctattttnccccaacctgcacctacctnaaaaacccggnaatttttanaantttgaacttnganaaaacatntgcacctcnggtctgttcnggnaccccnaaccctcnatttgggncgcnaacaatcatcgtnaanccgctgggggcgt

SEQ ID NO: 4070 - DNA, 435 bp, Triticum aestivum
  Clone ID: PAT_TA_4070
gtcctgtgagacgcttccttctcatacacatctgaagcaacgtttgatcatccgcattagagagttttgcaggtccttgagagaacgttatccagtcagttatgacttgaccatggtctgaggtgaaattggtcctggtccataaaacgaaaggtgctgggcaagcgcagagaagtcgtctgaaggggagttccataggaatgttcaacttcgatcaaccttggtttggtcccatgcctaaaaaagaaataaggtcaaaaacaaaataggggtgatataacccactgctcgcctaagaatgtactgacgtaatccctactatggcttcccgaaggatccagctgctaagagggtccgagccataacggattgatgtgaccgtagcggcgactggaatcgatctgaatgaggcagttatgggacttatcttatata

SEQ ID NO: 4071 - DNA, 777 bp, Triticum aestivum
  unsure (1)..(777): unsure at all n locations
  Clone ID: PAT_TA_4071
ccacccggccccccccttccccctccctcgcgctctctcccgcgacagcccccgcccctgcgcacgtacgtgcccagggcccagagcagggcccccgccggcgccccgcccctctcccccctcctggtcgccgccgcggcggcgcccgcggcggcccccgccgcctccgacgacgactgctacgagcgctgcgccaacggcgccaaggaggacccagcctgcaccaaaatgtgcggcgaggcatgcggcgtcggcggcaaagccgcgggcgcccgcgggcggcgcgcccgccgcttcagccgatcccgacggctgcatgcatgcatgcatggcatcgcacacgactcaagatacgcgcgtacggccggtcttcggaggagagatgcgtgcctgcttgctatggtcgttccgtccatccaggctacgttcttcctgttgatcgcatggggacttgcctgtgatctgcagactcgcgcttgctcgcttgcccgtgagtttgaaacccgtgtgcgctggagtgcagcattatggtatcggaatcatcgttcccgccagtgttgagagtttatatttttttttgatttcattatctctggttccatgtagatgtgtgagcgtcgtcctcatctcttgtcaattgtactcgctgtaannaaccgagcatgcttcttctatgatcatatatataaaccgccaaggcctagtcctggctggtnnncttttttgtttaaaaannnaaaaaaaaaaaaannnnngannnnnnnnnnnnntctctct

SEQ ID NO: 4072 - DNA, 592 bp, Triticum aestivum
  Clone ID: PAT_TA_4072
ggcgcggcggctcccgctccatctcgcctctccggctgcacaggtctcctccctaggcacgacgtgggtgcacgcagacgcagggcggtcgccggcgaacgaggccgcacgcgagaccgcggcgaggcggcgcggagccctttgctccctccagtttgtgatctgctcatctgcatcggtcacctccatcgccaccgcgagtcacctcctcctccgccgccaggaatcccattgacggcaaggtaactgccctccccggtcatcacgccctgcttgctgcgtgtgtgtggtgtgctgtgtgggtgcttaatgctgagtgctttccagcttgtcgctgatggcccgctgctgttgctttgttgtttagtagtatgatttttgagtcagactatgatccatgcacttaagggaagggattatgatgctgctgaactgggagtcctttatcttgaagccagaagtttggtattggctgatgttccccttagcgtttgggcatttcaagccccttacttaagcgattttacgtgtgcacaagtttaagtggaatacattttctgttcaagaaaaaaaaaaaaaaaaaaaaaaaaaa

SEQ ID NO: 4073 - DNA, 984 bp, Triticum aestivum
  Clone ID: PAT_TA_4073
gctgcgccccgccacaatacgctcctcgcgccttaatccatcgtcctctggttccttccgtcccctccgtcctcccgcttgatcctccaatccatggcgacgctcgccgtgccgcctaccgccgcctccctgcccgccccggaacacccacgcacgagcccgaacccatctgccgccctctctgccgcgcaccccagcgataccgactccggttgagttctcctggggaatcctgatgtggtctgggcgggccacgccgcggccgccggcggccccccgggccgccggcgcctccccttctcgccgctgccgatgttgcctatctgggtgcagatggtgctcggaggcgtcgtctacacggccgtgccgttctacatgagggccaggcagatcgaagacaaggcgatcgaaaacgtggaaactgctttggacgttttggagcgggcctctgaggtgacggagaagtttgctgctaatgtggccaattccctaccggaggatgggtccctgcacaagttggccgaggagcttgagtacattgcggaggaagtcgataagaatgcacagaaggctgaagtcatgattcagaagattgaagcgctcagcgacaagatcgacgccgcggtggagcctgtcatcgaaaatctcgaggaggagttcaagccaaacccagcatcccacgctggatcagacgcccagaaatgaccgttcacataaatcggaggaaaacactgcccaaagtgtcccctgttgtacatatgttgctgtttcttctttccttctttctaagtgccaacttgtgaatatgttcgttgtgccctacgaactagaaggaccccatggttacagtaagaaatggtggtggtgtgcttggtgcccggatctgaagcaccctgtaatcctgataatagtaagaacactgcatctgaagaatggatatgtatccgtgaaaaacaaaaaaaaaaaaaaaaaaaaggggggggc

SEQ ID NO: 4074 - DNA, 910 bp, Triticum aestivum
  unsure (1)..(910): unsure at all n locations
  Clone ID: PAT_TA_4074
ggaaagtcaaggaagtgggagaggaaagtanaagatgttgatgtggcagtgaactgctaataatttttaatctgcaagttgccttggtaaggctgaaagtatagtaacaataataatcaacttaaggcagagtgggttagttgactgtaaggtaggactaccaagtctacaattgttgatgacatttgagttgatggattttagcacctagtctcaaagctttgagtacctgaaaccacttaggattgcataagtaggactaacacatcatttttatttatatagtaaataggtaacatttgtagttgaatacctgaatgttaatctatattcatcctggcaagactatcatgatacactgcagctatacaggactgcagcaacacattcagtacaaccttgatataagttgttgacactgataaatgatcttattcacacattgtattcataaagtctcttttttcgtgatattgcgacatccatctggctatggtctgccgtgtgatttttttttttctctgctagtcatctctggagtaagtttgcagctgaacttctggtggtatcctgtctgcaggctttcctatgcagaagttgccctttacttttgctgatcgtgaatctaagtcattctagaactcgtgccagtcaatttttatttttggtttggccttcaatgtataaatactaatgcaatctggtcacaggaatttggtatcactagattcatcatcttaaatatatttccatactgtatagttgtatgatttgtggcagcaacatagtatgagataaattagttgttgaagtggtatggattaccttgaaggtcgtgttggcatcgagaacgacctaatagttgagagtattatttgatctgtttatgctgtaccaacttaaaattgag

SEQ ID NO: 4075 - DNA, 917 bp, Triticum aestivum
  Clone ID: PAT_TA_4075
ccccgcttcgttcgctcgctcggacttcccctccgcccgccgccggagctccaccctcccgccccgcccgccggtcctcctcccgcccccgcgggtcctccaccgcgcgatcccgtcccgccccgccctgccttccgctcgaccccagctcgcccccgtccgcgaatcgagggagggaggttcctctcagagcttactcttcagaaggaatgggagatagagaaaggcgagtggtgtttgtcacagtagggacgacatgtttcgatgctcttgtcaaagtggtagattctgaggaactcaaacaagcactactgcagaaaggttacacagaccttctgattcaaatgggccgaggaacatacaagccatccaaggcctcaggaaattcaagtcttcaagttgagcatttcactttttcaccaagcatagctgacaacatacgggaagcatccttagtcatcagtcatgcaggttctggcagcatatttgagacgctgcgactgggcaaacctcttatcgtggttgtgaatgaagacctgatggacaatcaccaaagcgagctagcagaggaactggccgagaggaatcaccttttctgtgcccatccacacacgttgcgggagaccgtcgaggcgatggatctgaagacgctccagccttacgtgccaggagaggccaagccagttgtggcactgataaacagatttcttggtttccctgttgattgatagtgcgtattttctcttcatggaacaatcatttattcagctttgaagggcctgtaagacgtggagcaaagatttcaagaatgtacagatttacaccgttttatggcgagatgatttcccggctttacccccccttggcagcggccctctcgccgaccctgcagcccggcctcgcccgcgaccacgtta

SEQ ID NO: 4076 - DNA, 1638 bp, Triticum aestivum
  Clone ID: PAT_TA_4076
ttcggcacgagggtctagccggcacaggagaacagcttccagctgaggcgaaggcgacaagttctccttgaaggtctagccgcgtcacttcagcttgctgaccctcttgggcccagcaaatctgccaattcatctggtttagcccctaaggatgatattgtctttcttcgcattgtttctcttcccaaaggacgtaagcttctggctcgttatatccggcttattgtccctggaagcgagttgaccaggattgtgtgcatggctattttccgacacctgaggtgcttgtttgggggtttaccatcagattcaagtgcagcagagacaacagttgctctggcaaagactgtttcgacttgtgctcaccatatggagctcggtgctcttagtgcttgccttgctgcagtcgtctgttcatctgaacaaccacctctccgtcctcttggtagctctgctggtgacggggcttctcttattatcaagtcagtactggaccgagcaactgagttgctgactgatcagcgtgccgtatccagctataccccgtcaaaccgagctctctggcaggcatcgtttgatgctttctttgggcttctgacaaaatactgcctcagtaagtatgaaagtattctgcagatgtttgtgatgcaggcatcaggctctgtgattggatctgaagcctctcaagcacccagcagggagatgccagtagagttgctacgtgcaagcctccctcacacaaacgagcagcaacggcagatgctgcttgatttcgctcagagaaccacgcctgccagcagttttaatccccctggtgctagcggtggacacatctcttctgaatcggttcctggttaatatagctcaaggcctctgcgcaattgtcttcggaatggttattcttatatatccgaagacatgcatgattgcccccttgataaggttttgagctgggagaagttccatgggctcaggaaagtagccttatttcagtctgtgacttaagtgtaggtttcagattaatctcatagaccaacaaaaagagatggatccccccttttatgtgggtcatttactatagcacaccctcctgatgatcacagatagaccatggagaacatgtacttatattgctgtaactctgtgcagtggatgaaccggtcagctcgctcgtcggggcaatctagtttttaacgtttatgcgcccgtggtgcagaagaccgtagtgtacaggttcgactgctagagctttcctgtctgttctttttactggagcatggaaggtgccaaggagtcaagtgtggagtctggtccatctgttttatttaggaccaggtatgttggaataatgatgggtaagtgcaatttatatgctactgctggaaagatgtttttcttcgttgcaacattttatagatgtgtcatgtccctcccaggtatccactgatattaatagtggagcactggaaatggaagcattgtcatttgttcatcttttttagtttggcactttgtttttgtcaagggatgtggggccagtctagttggctatagaacaatacaattgtatctgttgatgaatcaaagatagaaattatagaatcacaaaaaaaaaaaaaaaaaaaaaaaaaaaaaaaa

SEQ ID NO: 4077 - DNA, 1350 bp, Triticum aestivum
  Clone ID: PAT_TA_4077
gcggggcacttagccgcctcccctgctctcccgtcccgaacctctgccctgcccgcggtggcccggctgccaccgcgttgcccgaccaccgggcccttggtccggcggtcgttggccgggtccctgtcgtggtcaagttgcgggtcctcgttgcggggtaatatactttaaatgattgccacggcgcaaatttgctcttcggtatctggtcctgctgcaagtgcctacaagggttattgctggagcaaagaaaaggcagaatacctctcttcacgtggcactatttcaatgcttcgtatacaatcacgtgcactctgaacttacgggaagatttattgggttgccctattgtgcccctgtcactttccaaggagggataagcctctagttctttccaacggccgacctctgtccccaccctcggcgctgagattggatctctgccgggcatccataatgatataaaacatgagcctgggacaccacctgtggttctgaatgacagtgtcgctggttctggtcaagctcaaggttactcagtccaggaacatgcatttagtgggcaggaagccaaaccaagggtcctccagttattcctcgccaaataaccttaaccacactggagcttttgatgcacaacctgtctcaaaacaatatatggtatgtgtggttcactttgatggtgcttcaaaaggaaacccaggaaaatcaggtgctggagctgtacttatgactgaagacgggagagtgatatctcgacttcgtgagggtcttggtgttgctaccaataatgttgctgagtaccggggccttatcttaggactgaaatatgccatcaggcttggattcaagagaatcaaagtatatggtgactctcaactagtctgttatcaggtgaaaggtacatggcaagcaaagaaagagaacatgatggaactgtgcaaagaagtgagaaaacttcaagagaacttcatctcttttgaggtccaccatgtgcgacgggaatggaactctgaggcggatcgccaggcaaacatagccatcaccctcgcaagcgcgccgttttctgagcacgttgccgtcgccttccgtgcgcgtgaccgttgccccgtcccgccttgaccagtctacgcacctcgggcgccgcggtctttcccgagcgtggcgtcggctgctgtccgtgtggcagtggccttctccgtccatttcctggctttggatctggttctctgtcgcctgtccctaaaaagaagttaacagtagtctgtgttggagtggttatctgtgtccattttcttgtatttgaacttggttctctgtctccagttgaatgtgatgcactgtgcttct

SEQ ID NO: 4078 - DNA, 621 bp, Triticum aestivum
  unsure (1)..(621): unsure at all n locations
  Clone ID: PAT_TA_4078
gcacgaggaaaagatccccgcatcctccaattccattggcatacagattttcgcaagctgattttagttttagcatggagaggttcgccgctatggtcgccggccgccgtgccggtgccgctccgaagcccgcttccgccgccgaggaggggggcgaggagtacctgcggatccagctggaggagatcgtcatcgtcaaggacgacgcctacgacgccctcgccgccgccacggccgccgcgcagtcccgcgccaacgccaacggccaatgcggcggcggcggcgccaccaccacgggcacggcgtccaccgccatggagaactgcgcgagggcggccgcggcggcgcgcgttgagagctcgacgaggcctgcggccgcgcagggcgcgtggaccacggcggcgaggggcgtcggcttcgactaggcgtcgaccaccccgacgcgctcctttcccatcggtgggtgggtggttatccgtacgcgtccttgttcctatccagcatcgaagtcgaagatcgggttgatgaactcnagtctagttatttttttcgtttttgcttgattactnnntggtgnnnntggtggnnnggggatnnnnnnnntnnnnnnnnnnnnnatcg

SEQ ID NO: 4079 - DNA, 996 bp, Triticum aestivum
  unsure (1)..(996): unsure at all n locations
  Clone ID: PAT_TA_4079
ctccttggcctttctgccgtcgctgcggaccggctgcgatagtcaccaggtccaggggtcccttcccggaggcctttccaggtgtctcccgcgcccctggcagctgctgaggggtgtacattgaaattgggtctccttgcatgaccatccggagtcgccgtctctggttgtactgccccgcgccatacggccgtccgcctgcggcctgccgacaggttcctccgtggggcgggtccctagttctccgtaagtgaatggcttgaggtggagcgtgcattactcggccagcggtactgcataagtatccgaaaatgctttccttcatgtggatgctctagagacgcataagaagcgggtagtacccgccttttttctatccaaagttgggtgaacttgccaagaccttgcttccgaaactggagaccatttactatattcacaattttaaaggatccaaagggggagcacttttcaggtgttaccctggcccttggaaggtgctgagaaaagtaggtggcagctttgtctgtttacatgaacaagaggagatgccatcactgaaagaagtggccctcaacatacttccttctgcctgaaaacttcctgggagttacctctcagagaaaagggaaaaaataaatatcctaaagaaaacggggaaaaatgaagctttcagtaatcatccgagggaagcaaaagtctgcaagagttctttcccaaatgtatatgctctagagattcatcatggtcttgttgtggaggacataaaatttaggtggatagggaatagttgattggggaacgcatgtatctccagtaggcgcaacactcatgccaggtcagcttgtcctatcttggaatactatggtggaccagatgaatggcctgacgcacctgtggggaattggaaaagaagaactcatcaattatagattttttttcctggggcttaaacttggtacctgcccgggcggccgctcgaagggtctttaccnc

SEQ ID NO: 4080 - DNA, 728 bp, Triticum aestivum
  unsure (1)..(728): unsure at all n locations
  Clone ID: PAT_TA_4080
agctcccaatcccacccgaagcggcagccatggccnccaaggcagacaagaagcccgtcgcgnagaacaaggtgnagaagncggcggaganaacccccgccggcaagaagcccaaggccgagaagcggctgccggcgggcaagacggcgtccaaggaggccggcggcgaggccaagacgaggggccggaagaagggcagcaaggccaagaagagcgtcgagacgtacaagatctacatcttcaaggtgctgaagcaggtccaccccgacatcggcatctcctccaaggccatgtccatcatgaactccttcatcaacgacatcttcgagaagctcgccggcgagtccgccaagctcgcgaggtacaacaagaagcccaccatcacctcccgggagatccagacctccgtccgcctcgtcctccccggcgagctcgccaagcacgccgtctccgagggcaccaaggccgtcaccaagttcacctcctcctagactgacggcgtgtagttggtttctgtatctgtactctgcttatctatctatctgcaagtagcggtagcggtagcagtacctgtgctgggtgattgccaacgctttgttggctcgttggttgtagtaagaactcaagttgctgctttggcaaactgaaatctatctagaactcaagttgtgttcctatattctgtactagtgatcttgcctgactgatgttagcttttgacccttctg

SEQ ID NO: 4081 - DNA, 800 bp, Triticum aestivum
  Clone ID: PAT_TA_4081
gccggccggtccgggcacacatctcagtccctacctttcccttcgagcaaactcacacaacccacaccaccgaagcccccaaccccacccgaagcagcagccatggcccccaaggcagacaagaagccggcggccgagaacaaggtcgagaaggcggcggagaagacccccgcggggaagaagcccaaggccgagaagcggctgccggcgggcaagacggcgtccaaggaggccggcggcgaggccaagacccggggcaggaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgcccgctacaacaagaagcccaccatcacctccagggagatccagacctccgtccgcctcgtcctccccggggagctcgccaagcacgccgtctccgagggcaccaaggccgtcaccaagttcacatcctcctagactgacggcgtgcagttggtttctgcatctgcatctgtactcttgactctgcttatctatctatctgcaagtagtggtggtggtagtagtacctgtgctgggtgattgccaacgctttgttggcccgttggttgtaagagctgaagttgctgctttggcaaactgaaatctatctagaactgaagttgtgtttttaaaaaaaaaaaaaaggccaaaaaaaaaaaagcggccgctct

SEQ ID NO: 4082 - DNA, 919 bp, Triticum aestivum
  Clone ID: PAT_TA_4082
ggaccaagtcacacaccttccctgcctccagcaaactcacacatactcaccaccggcagctcccaatcccacccgaaggcggcagccatggcgccccaaggcagacaagaagaccgtcgccgagaacaaggtggagaaggcggcggagaaaacccccgccggcaagaagcccaaggccgagcaagggcctggccggcgggcaagacggcgtccaaggaggccggcggcgaggccaagagggggggccggaagaagggcagcaaggccaagaagagcgccgagacggtacaagatcgacatcgtcaaagtgcttaagcatgtccaccccgacatcggcatctcctccaaggccatgtccatcctgaaccccttcatcaacgacatcttcgagaagctcgccggcgcgtccggcaagctcgggaggtaccacaagaagccccaccaacacctcccgggcagctccagacctccggccgcctcgtccccccctgccgcgctcgccaagcgacgagctcgccgagggcaccgaggccgaggccaacatcaccttctcctagtactgacggcgcgtagttgatttcgttatctgtactccgcttatctatctatctctaagtagcggtctcatctacctgtgtgtggggtgattgccaacgctttgttggcgtgttggttgaagtaagaactcaagttgctggttgggcgaaataaaatcgatgctgctactcaacaattgtgaacctatactagaactgaagttgtggtcctaaataaaaattagtgatcttgtctggccatttgtattttggttgctgaactctggttatctgcaaccagtgctgctactgaatttcttggaatttggtagttgtaagaactgaattcagtggtgcaaaccgagattgagaaataattatgc

SEQ ID NO: 4083 - DNA, 1538 bp, Triticum aestivum
  unsure (1)..(1538): unsure at all n locations
  Clone ID: PAT_TA_4083
gcgacggtggcggtggccgcaccggcggcggcggcggcgcgcgcgcacgagccagcgggcggggacgcgccgccgaagcaggtggcgcaggcgatggagcggctgggccgcgcgggcaggatcatcgcggacatccggctcggcgcggaccgcctcctcgaggcgctcttcgtcgccgccagcgcgccgccggacagcgcccagcagcacatcgagaggaacgaggaagtcgtagctaaggaggaggtctccatgcaccgccacttcgacgacctccgcgccctcggcaggcaattggaagagtctggggttctaaatggggcccttaaagctcgaggaaattcttggggcttgcacatgccacttgtgtgcccagatggtgctgttgtggcatatgcttggaagcgtcaattggcaggccaagctggcgcatcagctgttgacagaactaggttagctctcaaggccttcactgaccagaaaagaagattctttcctcatctagaagacgaagttcttaaccatctccatgatggtgaatctggtattgctaaaaggccaaggatgcctgcgggcaatggagagctggaagaaaaaactttgtccgagatacttaagaatctagaaaatgaagtacccaacatgaaaatatccacgtatcgtcgtttagattggtcaaaaagagcttcatcattagcatctctgatggatgatgactttgtggatccatctaaggagttgaacctgcaaaatatgggaaaatcgagacctggttctgtgacgactccgatagatcaggttgcagtaattgagttgctggttccttcaatatttagagttgtagtgtcattgcatcctgcaggatctgttgatcctgatgctgtggcattcttctctccggctgagggaggaagctaccttcatgcgagaggcttgtcggtgcatcacgtctttaagcctgtgacggagcatgctgacaaggcattgcagtacttcatcagtgtggaacccagtaaagcactttctatattattgcattggattgctgattatcagactctatttacaaaactttgcagtaaatgccgacggcttctgctcatggacaagtctttggctttgcttctacccccggttcaccgcccctaccaccagatctcaagcattggttcagatcatcaggaagcctatcacattggatgttcttcctatgatgcctgacgcttctacgcactatggacttctagctaggatgttttctaacaccgtcacccgactgtatttgtgatataccagcctaatccgtaggacgatgaaaatgttgaagtgaatttttaagaactataaacgcttggtgatcgaggagttactctgtttgcattttcaccttacctgtgtaaaacctgtgtatttcatgagcagaaattgtggtaaacagatgttgcaaattttgataattcttatgcactgagctttaactgctctgtgaaactatttgggcattnaaaaaaaaaaaaaaaaaaaaaaaaaaaaaaaaa

SEQ ID NO: 4084 - DNA, 217 bp, Triticum aestivum
  Clone ID: PAT_TA_4084
tccacttcctccatctcttcatttgcatttgcatacatcatatacgagctttctttactcacaccactagctagcgtgctctgcatgccaacgccacctcctgtccactagccctacgtacgtagcagcttctcccaagagcgcagcgcgccatgagcaacgtgttcggcgccggcggccatggccgtggtgaccatggccatggaggagggggcgg

SEQ ID NO: 4085 - DNA, 1139 bp, Triticum aestivum
  Clone ID: PAT_TA_4085
ctgcactcagcgccgctaccgcccttttctcttgtttacatacgcagcgatttctgtgtttcctttccaacgaaggcagctccgcatcaggctgcacacgcacatcttcgtctccacctctcccccacatgccaccgcctcctctctctcaacgccgccagccgcagccgcctcttcttcctctctctctctctctctgcttgtccttgtctcccccctcgctgaacaaggcgcacacgagcggcggtggcagcagatctgtgagaaacatggaaaaggcaggaggtggaagtcctcgcgggagtcatcgtccatgaagaactggatcggaagcagttcgcggcatgtacgtccccggccagccgccggagtccctctgtctgctatgtgtgatagctttactcgctatctgttctatttgcaggaggaggccaagggccgggaagcggtggcaccggcgactggcaaacctcatcggctactgctgcgacggggtcgtccgcccgcgcttcgctgagttcatgcccaacgacaccctcgccaagcacctcttccactattccactatgtcaccggcctgctctccctcccctgcaccaggctcttcgaccggctccttcgcaccgccttccacttcaaagttcaaacagctcaaagacaagaaattcaagcgttctgtgcctctttgaggtatttttggctgtaccaaatttctgaagagggatgacacattcagaatttcagatagacttgtgtctttttggttgtaatggcatatgcttgctacaatctttactgacaatgagcagttggattggatgcagctacactctttattaatgcaagaaacaaaagagctatctgaacttgccaatcatcacacatatagatgttccatacttgtagcagatgttctttgctgcgatgtgtgtcactaaacttagcaccaaccatggaacaagctgctaaaccgaactcatcatctgcatttgctaggcctcattttatagaacaagaaaccggcagcagtcagaaaattacatgcttatagtatgtactaacagttgaaaacatatgcagtttgactatgtatatgatcctcctgtttacttaaaaaaaaaaaaaaaaaaaaaaaaaaa

SEQ ID NO: 4086 - DNA, 632 bp, Triticum aestivum
  unsure (1)..(632): unsure at all n locations
  Clone ID: PAT_TA_4086
gccgccgcatttctccaancctctcaccgcttcctcaccacctccaaaagctcagcaggccatggctggntagacaagcatgtccgctgatcgagcagcttaagccctccatgccctgcgctcgtgcgtgattcgcatctatgactgctcagcagagttccttgttctgaaaattcggaattagttcgcgttccgaaggctccagatctgaagttaggaattgggaggttcagagaattgcatacgactgctgcagatatgggactttttgggttttcttgtctcccgtcaaaaagattgccaactttcacatcccttttatctctctattacaagtaagtcccgnantgtanttcaaagtctcgtcaatttattcttccgttggttacctctttccgcccctgggtgttcgcgcgggggttggtccgaggcatcgcgggtggcggtagatcggcctgcaccagtgtggcccgggaatgttggcgccctgccgcatcaagctctccactcatctcttctatccgacagcaaaagacgcaacaacagcccatgaagatgcaaatgcaacgaagaagaagcatgggggatggccatcaacgatctcgagctgcaagcgcccgccaagtactttg

SEQ ID NO: 4087 - DNA, 1112 bp, Triticum aestivum
  Clone ID: PAT_TA_4087
acacagcgagaagtttgagaaccttactgaacaagaactttgcttaaaagaatctttagcggcctatcgaaatgctgctgacgctgccagtaatatccaagctgcacttcgcgatagaactcttaaactccaaacaaaagcaatacttttggccaatcctgagatgcaagcaactgcgatagttgctgctatgaggattcagcatgcattccggaactacaacagaaaaaaagagatgagagctgctgcacgaatacaaaatcatttccgcacgtggaaggtcagaaggaactttaagaacatgcgaagacaggctatcagaatacaagctgcataccgaggccatcaagtgagacgtcagtaccgcaaggtaatatggtctgttggagtcgtggagaaagctattttgcgatggagaaagaagagaaaaggcttgcgcggcattgcaaatggaatgccagtagaaatgacagtggatgtagaagctgcaagcactgcagaagaaggtttcttccaggccagccggcaacaagcggaggacaggtttaatagatcagtggtacgtgttcaggctctgtttcgttgtcatcgggcacagcatgagtaccggaggatgaggattgctcatgaggaggccaagctggagttcagtaaagggcagcagcaggcgccggcatgcaggaggtgaagtggcttctaggggccatgtaattcttgtattgtacattaagaaaaatcataacttgctaatgctgccctacattttaggaccatcttattgatccttttggccgaatctggtgtatgtatttgctgctagcatgttactgtggtttgcaatttgcctggttttagctatatggcattgtgcttgtaggtgcatgtagatgctggtacggatcatgttgtaaaggctaacaataagtgctacctgggccaatgaccaaataggatattttaccttacgtttcatggattctttcatgtttatggttaactcggtggtccacaggaacaaattccatctaatttaccgataaacaagaaatcgaatcaaactcgatgtaagatgaattcagtgcccagcacaagattatcaagttgaaatcgtg

SEQ ID NO: 4088 - DNA, 580 bp, Triticum aestivum
  Clone ID: PAT_TA_4088
cacgcggctcttgcctgatctccttttcattttgttctatctgcttgctccaaatctacttttgcccgatgagttgtggctggtgacgctgttcggctcactggtgcggccacaggtggcgcctgatttggctccctgtacgcctcctcaatatctgaggccggtcaacggcgatggaggggtaacaggagcctgacttcggcgtctcattcttccaccaatggttcccgcttcgcccctttccggtctctcttatctccccctgtttcttatgcgggcgctgcatgtgtatggttgaaccaatataatgaaattaaggcacagcttgttagtcaaagatgtaaatctatttatgcccgtccaattttttccatgcttcggaccgtcatcggcagtgtaggccccctgctcccattcatattcttatttgagattatctatagttgttctatttcccaaagatagagttaagtttaataagtgaatatgaaatttgtgctattgcatgctacatgtgaactataacaattcgtggatgttttcactattggcttgttcaatataataagcttcaaatatc

SEQ ID NO: 4089 - DNA, 593 bp, Triticum aestivum
  unsure (1)..(593): unsure at all n locations
  Clone ID: PAT_TA_4089
gcacgtggcttctcctccccactcagtcctcggttcccggtccggttcggttccgttcggttcgttagggtttagtagcggggaagaggaaggcatggcggacgtcgagtaccgctgcttcgtgggcggcctcgcctgggccaccgacgaccagtccctccagaacgccttctccaagtacggcgacgtcatcgactccaaggtaccgatcccccgtctcctcccccgatccgcccgatagatctctaaattcgtaggtggatctgtggtgttgtgcttgcggaaccctggatctgacgggtttggtgtgttttggcggtgctgatcatcactgacagggagacgggccgttcccgcgggttcgggttcgtcaccttcgcgtcggacgnngcgatgcgccaggcgatcgnnnccatgaacggccaggacctggacnnccgcaacatcaccgtcaacgaagcccagtcccgccgctccggcggaagcggcggcggcttcnncggcggcggcggcggcggcggctacagcggccagcgtcgtgannnnnnnnncggcggcggctannncggcggcggcggtggctnnnnnagtgg

SEQ ID NO: 4090 - DNA, 608 bp, Triticum aestivum
  Clone ID: PAT_TA_4090
gattttattaggatattggaggtaccaaagacaatatatgatgcccgtttatgtatttacaaccgagcttcactcgcggccgcattagtaaacatctcctagcaattttatatgtttaagtctgagtctgggtggaccatacagagtccgcctcgtccatggcagattggtgagagtttgcgaagaaacttgatatccggcgaggatttgactctcatctgatggcatttgtggaaacagtgcaacgcgagagtgttcttctgctagcggactggagctcaaagcgttgcggagtgtccggaggactggtcccgccaagagtgcatgaccattgggtttagagcctagaacgaaactccatgagttcgtcagtacgcaagtgtgtggaacgtgtgtcctgcatggccagccgctagcccggcgtcggcatcccaagactcccggagtggactactgaagcgcccgctgaatcacttcctgcccactgttagtaataattaactagatcggggcgcgagggtgccggtccaactgatatgaccaagcagtggagatcaagccgcatgatgcattcgtaggatagcaagtttagcacatgtaacagaaca

SEQ ID NO: 4091 - DNA, 848 bp, Triticum aestivum
  Clone ID: PAT_TA_4091
gagtcccacccacccacgaacccgtcaccaccaccgccaccgccctgacccccacgcgcggcggcgccgccccgctcgccaccggcgaccatcgccctggcggccatcttcgtcttccttctcgtctgcgcggtgcacgtgctcgagagcatgctcgatctcgccaagaagaggggatcagtgagcgatgagcaggtcaaactacgggtggcaatcacgcagcttctcaaggagtccagtgcactgtcaacgccctcgacgtttgcgcaggccgcaaagctcaagaggctggctgctgctaaagagaaggaactagccaaattgcaacagtcggacattaaggggaagcagtctctacatgagaaatatggcaaagttctgaaggctaccaaggtcctagtctatggtttgctcgttctgtcgttttggagtgcacctgtagctaccgtccccaaccatcttctacagcccttcggaaggatgttctcctggaaaggcgttgatgctgctacaggacgtgtcgtggttggaattataccatggctatttttgacctctcgtgtcagcaaattattgtcccaaaaactcgcccccatgtttctgcactagtagctccttctgatgaagtaaatgttgttggagcttttatctcctctcacacggttttgtacttatgacttttctgtctgatggtacatctgcagcaccattgtttcagatcctctcactttctgtaaaaatgttgtgcttaattatctgacctactgatacctattggaggtgtttgatatcaaaaaaaactcgagactagtacctcggccgcgaccacgctaatcactagtgaattc

SEQ ID NO: 4092 - DNA, 403 bp, Triticum aestivum
  Clone ID: PAT_TA_4092
acgcggacgcgtgggcggacgcgtggggctactctcgcggcgcacgcgctcccctcccctcctctttcctcccccctggcgtcgacgcggcggcggctcccggcggtggccaggcgggcgcggctacgaggaggtgggcgtgcgcacggcagggccgagctcaggctagggttcgaggcagcggcattggcggcgtggatgaggagctaggaggtgctcggacggtggggaacggcggcagcggcggttgcatgcaggcaggccggcagccatgtatttcgccaggctcgatgactcgcccatgttccggacgcagatacaatcacttgaagaaagtgctgaagtactaagagagaggtgcttgaagtttcataaaggttgccgcaagtatactgaaaggcta

SEQ ID NO: 4093 - DNA, 1087 bp, Triticum aestivum
  Clone ID: PAT_TA_4093
acgagcaacggcggtggcaagaatggaggcggtggccaggcgaacgacccccgccgaggaggaggaggaggcgccccgggcggcgggggccaggcgggccaacctgggaagaagggcggcggcggtggccccggcctcggtgtcggtggaccgatgggcggcatcggcatgccgccgcagcagcaggccatgatgaggcctaacatgatgggcgctgccggctttcctggttatgggcccgatgggagggcccatgggccaccacccccacatgggaggcgcgcagggcggtggcggagccgctcatggcatgccggccggcggcatgcctccacctgggttcttccagggaggcgcgggcggcggcggcggcggcggcatgccgtccggccccgccgagatgatgcaggctgccgggaaccccatggcgcagcagcagtacatggccatgatgcagcaccagcaacaaatgatgatgcagcagcagcagcaacagcagcaggcgatgatgaacgggcacgggcacgcccacgcccacccccaccacggcggtggcggcgctccggcggggtacccggcgatgccgatggggtacgggtacgggcggccgcccatgccgtacccaatggcgtacccgatgccgatgcagccgcacccgcacgcggacccttacaactacttcagcgacgagaaccccaacagctgctcggtgatgtgagaggagacggatcgtggccgccgccgctgcgctgtacccagtgcagtgcagtggccggcgggtgctttcctttctcttctcttctcaccgccgccgctctgtccaaagccagccaaccaaccagccagccggccggaaggaactctgagatcgtcgtcgtcatcgtcgtccatcaccggctcagtcagtcagtcagtatacatgggaaacgagtcccatcccatctagctcgctcctttttctctcttacttagcttattttctcagcaaaaaaaagtgaacttccttgaaggcgaggggtggttttgtaattatctatagttgtcataagagatgatgtgctttttataaaaaaaaaaaaaaaaaaaa

SEQ ID NO: 4094 - DNA, 414 bp, Triticum aestivum
  Clone ID: PAT_TA_4094
tctctctctctctctcgctcgtctctccctccccccgaaaccgtcgccgtcgccacctacgctgcttgatttcggcgtgttccggcgggcctcgccggcacgcagcacagatctgagctcccctgcctccgctcttcccttccttccggccagatccgcctctcgcggccccgggagctcacccccgaccccttcccatggctagggtttcgagggtggcgtccccaccaactccagcgcggcagcggcgactgtgctccgccctcttcgacgcccaccgcaagtcccacgggtggttccgcctcgtggatggtgctcctgcacccgatggctgcggggcggacgcgcgcggtgggtatactccggcgacgcggaacacgcggcctctgctcttccttgcgggggtggggggtg

SEQ ID NO: 4095 - DNA, 1254 bp, Triticum aestivum
  Clone ID: PAT_TA_4095
cccgcaacccacccttgtcaaggcagatcacgagctagctaacttggcgccggaatcagctaagcacaccagctcgctcgcaagcacgctcccacgccgaccggcaagatggtgaagcatgtgcaggacgaggagaaccagaggctgctcctcgacgaccacaaggagaagcacttcacctccggcgaggtggtccgggacatcatcatcggcccctccgacggcctcgccccgccccgccccccccccgccggcccgccccccgcctcgccgtcctccgcccccggccccatcgccggggcgcgccgagggcgccgccccccccagagccacgccgcccggagggtacctcgccgctaagagcgacgccgaccactactaccgggagctgcagcgcgaggcaggacgagatcgacaccgtcccggacacaaaggccgcaggacgatcggggacatactctctgagtacgggctgggccccaaggagtacgggccggtcgtcacctccctccgcaacaacccaaaggcgtgacgccagtccctgggcaagcgcgaacgggcgcgggggaagccgcgcccgcggcgcgcgctgacgggcgcggcgaccatcgcactggcctgcgtcgtcggcggcatggtgccgctctccccctacatgttcgtggcgtcggtcgacagcgccatgatgacctccgtcgtgggtcaccctcgccgcgctgctcttcttcggctacgtcaagggccgcttcaccgggaaccgcccgttcctcagcgccatccagaccgccatcatcggtgcgctcgcctcctccgccgcctacggcatggccaacgccgtgcaggccatctgatcgagctcgagccgcgccgcgccgcgcccgggggacggctaagtatcaagaaaaataagtacagcaagctacctgcctgtgtatgtatgatcaagcgctgccgtagtcgagtggtagctgtacgtgcagactctagcgttcgatctggtaagtgtactggtggcccaagtgtactgatgtgcaccgttcgttttgttttctgtttgtgtacgggtagcccaaagtgtactacagcatgtcagtagtgtatttgggtgtacttgttttttcttgccatctgtcgcgttaggtaagcatactatttgtaaggaaagttgcgttaatttgggtgcggtggtaatctgatgggctttgaatcaaaaaaaaaaaaaaaaaaaaaaaaaaaaaaaaaaaaaaaaaaaac

SEQ ID NO: 4096 - DNA, 1035 bp, Triticum aestivum
  unsure (1)..(1035): unsure at all n locations
  Clone ID: PAT_TA_4096
tgcaggnaattcggcacgagccgccgccgaccgccggtaggcgcatcgttggtcccgtcaaaaacgccgacacctcaaggaactccggcaagaccagatcaccagccatgggattcctcaggaagttctccaagcagacccgcaagctcaagtcccttctcgagctcaccgtctcacgtgtagccatcgcccgcaagccgcgccttgctcgcaagtccattgcggcgcggcgacgtctgccagctcctctccctcggccaaaccgaccgcgcgctccagcgtgtagagcaggtcataaaggaggacaacatgttggaggcgctcggcatcatagagctctactgcaagtgtctcgtcaagaaagccgctcagctagacaagcccaaggaatgcgccgaggaggtaaagaaagcggctgccggcatcatatttgctgccaagcgctgcagtgacctgccggagctgcagtctgcccgcaagatcctcgccgacaagttcggcgacgatttcactgccgatgctggtgtggaagttgtccggagacaaggcaagcattagcctgaagaagaaggtggccaaagagatcgccgccgagaacaatatctcggtggatttgtccaagtccccataagcaatggcggcgttgttctacacggatgaatgcctttggactagagtgacaacgacaatgcctcgagcattttctactcagacggatcagatgataggccgctgaagccgaagatggtgatatatagctttcagtgcgcacgatgagacaaagtcattcctctgcatctggccccaaatgcaactgctatgtgtaggttcaaaattagtatcggaggatggtcatgaagaactatggctcactgtacaagagaagggaagacatctgtattttactctttaaaactagaccagaagctcctgcggttttattaattaagtggagaatgtgagacacaaacatccgagccgagacttgaacacacataggctaggaggcgcaactgtatttcactcttacacttc

SEQ ID NO: 4097 - DNA, 1403 bp, Triticum aestivum
  unsure (1)..(1403): unsure at all n locations
  Clone ID: PAT_TA_4097
cggacgaggctcgccctccaccactacaactgcctgctctacctctgctccaacgcggcggccgaggacgccgacgccgcgcgccgcggcttcgagatcttcgccgccatggaggcgcagggcgtggagcccaacgaggccacgctcaccagcctcgcccgcctcgccgccgccgtccgggacccggccatggccttctccgtcgtccgccgcatggccgccgccggcatcccgccgcgcctccgctcctacggcccggccctcttcgcctactgcgacgcccgcgacgccgtcggggccgccgaggtcgaggcccacatggacgccggaggggtcgtgccggaggagaccgagctcgccgcgctgctccgggtcaatgccgacaccgggagggccgaccaggtgtacagggtgctgcacaggacgcgcacgctcgtcaggcaggtgtgcgaggccaccgcccaggtggtcgaggcctggttccggtcggacgccgcggcggaggccggggtggagaagtgggacgccaggggcaccagggaaggcgtggtgaagggcggcggcggctggcatggccagggctggctcggcaaggggcaatgggacgtcgggcagagcgagatggacaagaacggcaaatgccagcgctgcggcgagaagctcgtgtgcatagacattgatccttccgagacagagacctttgccaagtccctcgccgaactcgcgtgcaagcgggaggtcagggacgatttcgtacggtttcaggactggctccgtcgaaatggaccattcgacgctgttattgatgctgctaatgtcggcctttacaacagtaaagctttcagtttttctcaggtgaactctgttgtaaatggcatacagagagtaaccaagtcaaagaaattgccactgatcgttttgcataggagccgggtaaattgtggccctgcaaaagcaccacagaatcagaagctcatagagagttggcgaaatgctggagcactatattctactcctcctggttccaacgatgattggtattggctgtatgcagcagttaattgccgttcattgcttgttacgaacgacgagatgcgggaccactttgtttcaacttcttggcactagttttctttccccagatgggaaagaaaaagcaccaaggtcaggcttaaccgtactccggccccgcgggccttacaatttccacttgcccgccacccttattttaaattngtcaattcaaggaaatccccaaaacccggggaaccttggcgaaccgtggcccaaccaaccaacccgggaggaaccaacatttngaaaaagnccccccccgggcaagtgggggttttgtcgccccccacccaaggaatttctcgtgggggccnggggnanccccccct

SEQ ID NO: 4098 - DNA, 1036 bp, Triticum aestivum
  unsure (1)..(1036): unsure at all n locations
  Clone ID: PAT_TA_4098
cccccccccccccgcccgcctcccccccctcgccccgcgccgccctcccgggggccgccccgcgccccgccccctcccccccccggcggccccgcccctccgccgcggcccgccccgggggggctgcctcggcgtccgggggcgcgccgcgccggctcgtctcggtgcccacgcccagccgcgccggcgcggcgccgacccctcgctcctgccgggcgtcgcctgggcgactcatctctccttgcaggcgtgcgttattcctcctcccaagagatcgacctgtgccaattatgctagagttgtaaataatattttgcaaggcctgaccaatatgcagttgtggcttaggatacctctggagaagtctgaatctttggacgaagaccgtggcagaagtgaaacagtagactcgtgggaatggtggaattcattcagactgttatgcgagcatagcagtcaactgtatgtagcacttgatatcttgagctcgctgccatcaatgaactctctagggcgctggttcggggagcctgtaagagctgcgattcttcaaacagatgcttttctaacaaatgcaagaggttatccttgcttgtccaaacgccaccaaactctgcttactggtttttttaaccattcagttcaaggtaattatctctgggagatcaaatcataatgtttcccaagtatctgaaggagtgctctcacgtgatgaaaaccacaccgaagatacccccactccgcatgcattgagcccgtacctcgagtacatggcctacctctatcagaggatggatccacttcctgagcaagaacgctttgagatcaactnatagggattccttgcaatcccctctccagcctctgatggataatttggaagctcagncgtatgagactttcgagaaagacactgtgaagtatacacagtatcaaagagcaatcgctannncgttggttgatannntctcagntgatgaagtttccacagctnnnnnnntcttgatggttgttggnnnnnnnngnnnncctctcg

SEQ ID NO: 4099 - DNA, 1287 bp, Triticum aestivum
  Clone ID: PAT_TA_4099
cccgagggggccgcgtcctcgcgcggccccttccaggggcgcgtggtgggcttgccccccgtgccccaggccctgtgtctcagggcgtctgggcgggtcagggggagccgtcgcaccgtctcgccgtgtagccgggggtgcctccgtggcgcctgggaggctggtaggcgggtaaggtggtgctgccaaaattccttccccacaggtagcgggaggtcaagcacaacaaagtcagtggagccccaggttacacatcaacttctttctatttgctgcgaccctattccaaagttagctctgagaagagtccgcaccagagatgagtgtaaccatgcttactggtagtcagttgcggtgcatggactccgatgcccgttgtgccaaaactaacacattagaatcttgcaatttgctgctaccatatttcaaggtaagaacacgatgatgcagaggaatcttattatgtagccatatgtaatctcagtttgttgctctgtataaactatgataggagtaggcccacatagatgtgtatccagttttgccttctactgatctatgacaaaggggatgtgctggactaactggccattcctattgaaacaaaggagtggaactgacaatttttcaaacaatagaggttgtctttcatatggattttattattagatacttgcagatgtgtttcgcttccttagatcatgtttgattcttaaaaaatttagatgtttcatgtaaccatcaattatgcaactggcagtccctgtacattcttttttatctgctctaaaaaaatatatttcggtttataagcatcatacattttagtctataagtaagattataagttgatccagtgtcatacacaattcagttgaacatgtttgttctaccggttttaggcaacaattcacgcgcatacattcacgtgcatacgaagtttgattccatgtgaagtcaatgattgattttttattgaattctttaggtttgattggtgaagctacattcagcaaaaaagatatgtttatttgtgggaattaattttcgcagggaatatccatccatgcatgcacaagactgacaatatcattctttaacaatgtgcacttggcctctactctgtcgtgcgtagagataaggctgggacatctattgttttttgtacaatcttacactgtaaaataatttttggtaccaaacatgttaacaagggcgcaagtttttcatacataatttcagaagtactccatccgtttgtaagtatgtgacattttggtagtctac

SEQ ID NO: 4100 - DNA, 950 bp, Triticum aestivum
  Clone ID: PAT_TA_4100
ccataactcacctccggcggcggcggccgcgtctgctacacgttctccaccggcaggtcaggtcaggtcagatgtcaacaaccaggaagagacctcctcccagttctgcagttggacagagcaaaaagccatctggaaaggctccgctgcccacggatcacctcccagacgatgatcccaaagatacccttcggtgtgagggtgtagatggtaaacccatggtttcagaatttgtggtacattactggcgcacagaagtatggtcagtctctcttcctggacccaaatgtgaaaggcggctatgttgatgtgagatttgcagaccataatcaagcacaattagttgtagaacaacgtgaagagtatccattcaaagtgacttggacacctactgttgatagatcgcagatgattacccctgggaaagtggaattgtaccaacctcctcgtgatcgtgatgtctacgatatggagcttgctgtccccatgccttggaccaatccttttcccgtaagatttgaacctcggaaaatggctggcgatccggtgcggcccatctacccagaaaaagctcagccaaatcctccattatcgaagcctcctttcgctcagcctatttggccggatccaccatcacgtgaccatttcatcaagtactacatgaccaacgtcccggaaccagatccttctacatgaccaacttgccttctacattgctgaagggtactatgtagtatggatgagttcgtttttttgccatgaacttgccttcataaccaactattcattactgttgtggtcagtaacgtagtatagactgttaattttgcgacagtgttgatttatgacagatttgtgggataaccccccttcctttttgtatgtactggtccaagcaaaattcatcaagaatatcaaacgatttactgtctaaaaaaaaaaaaaaaaaa

SEQ ID NO: 4101 - DNA, 759 bp, Triticum aestivum
  unsure (1)..(759): unsure at all n locations
  Clone ID: PAT_TA_4101
ccgacgtccggcgcctctcgcagaaggccgacgtccacagcgtcggcctgctgctgctggaggcccacgcgggcgacgcggcccccctcgccgtcgtgagcgtggaggacctggtgctgccccggcgcctgctcgcggtcggccccgccgcgctgcgccccccccggcggcccagaccgtcggacgccgccgcccgcctcgacgtgggcgggggcgccgcctcctcctcctccgccgcccagcccgcgacgaccgcggagcgcccccccccccgcccccgcccccgacggcccccgccgcgcgcatcgccgagatccggcgctacgcatcctcccccgtccatcccgcgacgacagccagcctcgccgcccccgcccccgagggcgacgagccctccctttaaccgaccgcctttgtgcccttcatcagttggaagaaaggaaattgctttgttctttgcatcgttcttgtctttgctcatcagcttcttgtgcttgtcttcatcttttctttcatcttcttctcctttttggccccttgttggttttttctcacgggctttgattctgttctatagcacatgtcagtcactactgtaagcgtttgattcttggaaagtaacacatggatgatgcctgtactgtacctaaaaaaaaacaagcacaatgctggctggcttgctgctctgaagcgcccaggtggagttgccaggcaacacaggatgatgntgtgcaatggaataaagntaaganccncaag

SEQ ID NO: 4102 - DNA, 822 bp, Triticum aestivum
  Clone ID: PAT_TA_4102
cccctgcctgcccccccgcctccccgccggcccccgcgagcgccgcggcgtcggccccgccgccgcggcgctcgggggccccctccccgccccccgcccgcgggccggcgcccgccgcctccccccccgccggtgccccccccccccccgccgccccggcccccgccacccccgcccccgccgcccccgcccccgcctcccctgcccccgccaccccttccggcggctacgcccctaaaggcccagctgggacgcagcccaaggcgacgaccgaggagcagaatgtgatggagcaggtgaacaacgccttcaaggcggccgtggcggccgccgccgtcgtccctgggccggacaagtacaagaagttcaccgacacctacatcccggacgtggagagggctatagcggacgtcttcaaggggtccaacgcctcaactttcaccaccaagatcggcatggcccagaagctcgcctacgactccgccgacggcgccacccccgaggccaagtacgactccttcatcgccatcctcagcgagtccctccgcatcatcgccggcaccctcgagatccacggcgtcaagcccgctgccgaggaggtcaagggccccatccccgtcgccgagatgaaggccgtcgaccagatcgacagcgccttcaggattgccgccaccgccgccgacgctgcccccgtcaacgacaagttcaccgtctttgaggccgccctcaccaggaccatcgccgccatgtgcgtcgcagccaaaggcgccgccggcgccaccaacggaactgatgctgccggtggctacaaagctcccgccg

SEQ ID NO: 4103 - DNA, 658 bp, Triticum aestivum
  Clone ID: PAT_TA_4103
tcggccacggtccggacccccccagcctctggcggtcatccccggcgcaggcgctggaatgcgggctttaccccacggcgcggggccggcatccgctggcggatccgccagcctccggcgctgctgcagatcgatggtgtctgtggggtgcgcggtgcccaggccgcttccctccccggctccgtccgatcctgtatcgtgctgggccggtccccatttctatcctgggtccgcttcacccaactccattggagcccaccccgtcaccccctcccctcctggtcaccttggccgtcgccgccgggccagtggctggggcctccggaccccttgagtgccgaacctccccccctgctcgctccccctcccgtcggccgccccgcggtgcagttcattatcccccaatcatcgccccctgcttccctgccctttcattttctcctggtcctggttccaccgggttggttttccgggccggtccggtaccggttggttggtttccgccgccattggttggccgcccgttgccccgccttttatcctccctccgcccggggtcccccccctcctcctcccccctttccttttttttccttggccgggtttttggtttggttacctggtttttggggaatttttctctgtcatgttttttatg

SEQ ID NO: 4104 - DNA, 920 bp, Triticum aestivum
  unsure (1)..(920): unsure at all n locations
  Clone ID: PAT_TA_4104
ccgttaaggatgcaatggatagtacggatccaaaaacagcgttagaggggaagtataaaatgaccgcactctttcaaaagcatggtgttagtccatttagtccactaaaaggaatgctaatccaagggccaatgttcatgagctttttctttgctataaataacatggttgagaaagtcccttcaatgaaaggaggaggagtattttggtttactgatctgacaaccccggatcctctttacatctgtcctgtgttagcagcactgaccttcttggccacagtggagcttaacctgcaggaaggaatggagggcaattctatggccgataaaatgaagacattttctagaggaatggcactcatgacagtcccgttcacaatgaattttgccaagggaattttctgttactgggtcacgtcgaacttgttctccctcgtatatggtattgttatgcgtcgacccgctgtgaggaagttgtttaatcttcctgcttgggaagctccgtctgcacccgcactgaattcagccttgaatatgtttggtggatccaaggcagtaccttcagcaaagtcacctttagcactcacggcagcccagcaatcttctttggagaaacctgatgctgccgctcttgggtatcgggtaaaaaatcttgaaaagaaggggaaatctagaggcaaatctcggaagcgcaggtaaaccatgcggcacataggagcttaatgagagaaaaaaaagtcattttgacctcgtggacggttgagacttgatttgtcctgacatggtgctaagatttnattttgcacaaggaggccgccattnattctaaatcacattgtggggttgctgtggccttcttcagtaataagagcgatttnatatcagttatacacaaatgnattnagcaagtgcaacaat

SEQ ID NO: 4105 - DNA, 1037 bp, Triticum aestivum
  unsure (1)..(1037): unsure at all n locations
  Clone ID: PAT_TA_4105
tgtactgaagtaggtagatccaaaggagactccgcacccanaaataaccaaggatgatgtgcagatttcaggggagagagcaaaacagtctgaagtgggtgcatcacctaaaggaaataccatcggaagctcagctgaggatagcatatcaactttggtagatgtcacagtaggacattcacccgaacatgaagctgctagttcatccggaatctcaactcagggttccgctgaaattaatgctggaaaaggagtctcagccggcacctcttctacgaccatcaaagctnaggaagctggtcgcagtgacgatgcaggtagctggagatatggaccttcagttgctataacaccttaccagtttcctcagacccaggcaatggtaccacatgaaactacctcatctgctttctcagaattnacggaattacctactggtggttccactgggatgaaagaaaagattgttgggcataaggcccctgaagttttaagaacagaagantaagatgctgagctgaagaggagaaagattccgagaaataagcaggtattaaaggaaacatttgatgaatgggaggaagcatacccgcatgatgcttaacagagaaagactgatgaactattcctgaaggaggctttactttgaagctcagagggctgcagatatatgggaagtgccagttggagctgtgctagtacataatggtgaaattattgctcgttggttgcaatctagttgaagatctcagggattcaactgcacatgctgaaattgtttgtataagagaagcttctagcanactgaagacgtggcgcctggcggatacaacactttatgtgacactggaaccttgtgcaatgtgtgctggtgctattcttcaagcaagagttgacactgtagtatggggagccccgaacaagcttcttggagcggatggaagctgggttaggcttttccctggagatgggcaaacaagcacattggatccatcgaaccagaagcaaactgccgggcctgtgcacccattccatcc

SEQ ID NO: 4106 - DNA, 1150 bp, Triticum aestivum
  Clone ID: PAT_TA_4106
cggcacgagcaacgtatagatgaagtagcaaaacagaggaaggagttgcaggataaaccgatgatgtatgtcgaggcttgtgaaaatcacgtccatgctaagaaaaagatccaggtgctttctaatgggtgtagtgaagatttgcagaaagtgcaagatgcactacagtgggaggattttttcaaacagaaagctgcaccggagaaaaacaaacatttcagagctattgaagaagctgagatggtgaaagaggcattcactcgtgaggcttattccaagcacaatgctgaaactgtaaccaacatggcgactaccgagaaggcaaaggttctggatgctcttctgtcgagaggcaaaagttgcaggcgctactcgagacatgaaatagagctcgccaccgagaacttctctgatgcaaaaaagatcggtgagggaggctatgggattgtatacaggtgcacccttgatcacactgaagtagctgtcaaggttatccagcaagattcccgtggcaagattgatgagttctttaaagaggttgagattctcagccgacttcaccatcccaacctggttttgttgcttgggttttgtcctgaaattggatgtcttgtgtatgaatacatggagaatggaagtctggaagatcaacttatcgacaatgaagggcgccaaccactccattggtttctgcgcttccaaattattttcgaggtagctcgtgggcttgcattcttgcatggaacgaagccagagcccattgtgcaccgtgatctcaagcctgggaatatcttgctggacaagagcggggggagcaaaataggtgacgtaggttttgcgaagctcatatcagatggagcgccagatggtttcacggaatacagagacgacaccgtcattgccggcacaatgtattacatggaccctgagtaccagttaactgggacagttcgtccaaaatcagatcttttcgctctggggatcatcattctccagctgctaactggcaagcgtccgcaggggctaatacttagtgtagaagaggccatccgaaagggcacatttcctgatattctcgacgtatctctgaatgattggccaatcgctgaggcggagatgctggcaaaactggggctgcattgtacggcgc

SEQ ID NO: 4107 - DNA, 1343 bp, Triticum aestivum
  unsure (1)..(1343): unsure at all n locations
  Clone ID: PAT_TA_4107
aaccctggcggctggcggctggcgactggtgactgggcacaatcgaaggagcggctggaagtggctaattgaagatggcaaatgttctgctatctggtctccgtggagcaaaacagctggggcagaacttcagatctgcatgcaggtctctttcatcaggacaattggtcgagcccggctatgtcttcggtcgtaaatgttttgggccaggggacggggttaccacctctgttggtcaatatggactgcccaagtctgtggactggagaaaagtcccatggcttaaaatcccagtgaaagatcagcgtggctgtggtaactgctatattcaggcatctcttgttggtattgggagtcttcattccatcataactggaataaacgtcgaactttctagccagcatgttcttgatgcgaatactataactaattctggatgcatgggaggcacaataccaaaggtcttcgactttgtcatgaggggtggagtagtcctagaatctgcttatccatatactgggaagaggggcttttgccaggatattaaggctaaaggtcttactattgagggttgggcacaagtcgctccagcagaagaagctctcatgtatgctgtggcccatcagccagttgccgttggagtagctgctgggacagagtttgaaaattatcaatatggcgttatgaatgtcccagtagaccatggaattttaaatcatgcaatgttattgattggatataatgccacttcttggctacttctgaattcatggagtgaggcatggggcattaaaggtgcttgtcggatcctgaggaaatcgccaaattctgatggatctattggaattttatctagggcctatctccccctaaatccatctttcacaactgtcagaacgagaacagaaagttgcccttgttattggtccaggacgaaatctccttgaacgaatggtgccaagacagataacagagcactttttgccgaagtttatggccgtggataagtgctggattactgttagttacctttatgcatgattgtggattggaccactagtatttcatacgatgtgctaggagctctcgtaattcgacatttgtttcaagttggagtctggtttggcctgtgttggcacattttggcaaagttggactttggtttggcctatgtagactgagtttttgctgcttggtatgtggtgcagtgtatgatccttcgtgatcaggttgtaatattctgnggagtcgatccttgctagtagtttgtttatgatctggaccatgtggtttctataatggaattctaaaggctctctttcattaaaaaaaaaaaaaaaaaa

SEQ ID NO: 4108 - DNA, 1076 bp, Triticum aestivum
  Clone ID: PAT_TA_4108
cacgaggccatcctccactctccccatccatggtcgccgccactgcacgaaaaaggctggcggccaccgcaacgtcgccatccacggccatctgccgccgcaaccacggccatccactctccccatccatggtcgccgccactgcacgaaaaaggctggcggccaccgcaacgtcgccatccacggccatctgccgccgcaacaatagtctcatcccttaggcggggacggccctgaaggcggacctttgtgcagcgtcgcctctgcggatggtggccatcttgttgcaaggggataacaggtccctcgtgtgtgttccaaagatggatgggcctggcgcaatgagtacggacgtgctcgaggtggagtttcgccgcatcggacgggcgggatctcatcctctctttttttgagggagatctcatcctcgatgcattttgtggaggccaggggctgcgtgcctgcgaagatatactaacgggcccatgcatctgggctgctatgccatactaagcctggtgccatccatttgtctccactggtgacacttccgtcgccttgtcatattcaccgacctcggcaggctgtgagccacatgtaccaccaggtagtttatgttccatggagtcttcatcagtacagagaagttgacgttcaggagcattggtcttggtgatatggttgcgaaaatggtctcctccctctaatgactttggtgtgtacggccagatctatggccacaaaggaacggggatgaacctgtttgatgtatgacgagctccaccagtgcttgaggagttggagagtagcttagtgtttcgtccgatgtttgtaatttgtaagtttttagcgatcttttttagcattctagatagaccacagttgccggccaaaattctacacagtagcatccggttggattagctatcgggcgagtgttgttcagccgaacatcgtccataagtacttttgatctttttttctgtacatgcgtatttccccggggcttttatgtaacaattattcatttaataaataaagatgcattttttccaaaaaaaaaaaaaaaaaaaaaa

SEQ ID NO: 4109 - DNA, 1132 bp, Triticum aestivum
  Clone ID: PAT_TA_4109
ttaatgatgaacctcgggtgaaatgctacattgttaatgctcagaaattggaggacacgtcgaaagagtctcgctttctactgggaccaattgatagccttttggtgggcgatggcttaggtccaacccctggggtgagtggtggtgctgctgctgtcaacactggtttcttgtgggggggcactggtacctacagcacgaatatgagtggcccaaatcagggggggcagcaaaccagctcatctaccatggtgcctgccacaccatcagcgacacgatattcacagaactgcagtgtttgtgggtccactgggcatagtgtgcagaactgccctgcagtggccatggatatgcagcaaccagcagcaagcggctacgcggctagttcctatggctcttcacctggtgatgccggctcgggtctgtgcttcaaatgcaaccagcccgggcacttctccagagactggtccacagcaggaggctacctcctacaggtctccagccgccaacgccaatgccaactcgggtctgtgctacaaatgcaatcagcctgggcacttctccagagactgcccagggcaggcggctaactcctataacgcctcagctggtggcaacgccggcgcaggtggcctgtgcttcaaatgcaatcagcctgggcacttctccagagactgcccagggcaggcggctaactcctacggtgcctcagctggaggcaacgccggcgcaactggcctgtgctacaagtgtaaccagcctgggcactttgccagagactgtcaggggcaggctgctgccccccagcgccaggcttacgggaacggtgccgcatcaggagggtacaaccggcagtcctatgtcggtagcttctgaagtatttcggccgacccgattgcatcttgcttcggttttagttgcgcggcgatggctacaaccggcagtcctatgtcggcagcttctgaagtattttggccgacccaatagcatcttggttcggttttagctgcgcggcggtggcatcgccgtgcgttatgtatagttgttaaaaaaaatctgcctgctgcgtctgtgcgtggcagtgtcgtctggaccttgtgctactactttaagtctttataaatcagtgtgt

SEQ ID NO: 4110 - DNA, 416 bp, Triticum aestivum
  Clone ID: PAT_TA_4110
gctgcaggacaccacgctcggctccctgctctcgtcgctcatgcagcactgcgacccgccgcagcgccggttcccgctcgagaagggcgtgccgccgccgtggtggccgccgggaccgtccgaggcgtggtggccggaggccggcgtgcccgacgacctcggcccgccgccgtgcaagaagccgcacgacctcaagaaggcgtggaaggtcgccgtgctcaccgccgtcttcttgctcatgtcgcccgacgtcgactggggcggccgcctcgtgcggcagtccacgtgcctgcaggacaagatgaccgccagggagatcgccacatggctcgccgtgctcaaggcggaggaggagctcagccacaagctgcgtcccggcgcctgcctcccaccgcggccctccgccggcgcgctgt

SEQ ID NO: 4111 - DNA, 829 bp, Triticum aestivum
  Clone ID: PAT_TA_4111
tcaagggactgcctactcttgctattctcacctgcagcctgccccacttaggcacttagtccaatgataagtcgatgcaggtccttcgatccacaatacggcaccagcgagtaatgcatgcttctatttcttattatcttctgtgggcgcggaatttaatgctcctcgcaaaaaaactctaatttaatgcgcgcgatgttgatgcccaaatatgcaacctcgattcagttttgtttcatcaagatcctctattctttcccctacttttcgtgatctgcacataaaagaatggttggtatgatcctttctattcacgtgttgtgtctttatatgcttaacttgatcaattgttcttcgcacttttgcagttgactaatggctgagtctataggatgattctgttgtgttgccagaacttattttccaacattatgctctatctgaattattgttattggagtgtcctaacttcatcatttgtttagtcaagcggcatcattgtgcacatatgtggaatgagtctataggatgattccgttgtattgccagaacttattttccaacattatgctccatctgaattattgttattggagtgtcctaacttcatcatttgtttagtcaagcggcatcattgtgcacatatgtggaattgggcttaatgtttcccattaagttataaattgttacaagaatcttttttgatcaaagtagacagtattagaaccaaatgttcctacattggccatatagtttaccagacgtccttgatttcagttatcaacaaaaggcatgcatacatttagctacattatagccatctatatat

SEQ ID NO: 4112 - DNA, 581 bp, Triticum aestivum
  unsure (1)..(581): unsure at all n locations
  Clone ID: PAT_TA_4112
ggacttggagatgatggtgctatctgcttggcaagaagtttgaagataatcaatgaatccttgaaatcacttgaccttggatttaatgagattagagatgatggagcatttgcattggcacaagcactcaaggccaatgaggatcttgcagtcacatcattaatgctcgctaacaacttctttgggaaatttggacaggttgctctgaccgaggcacgggatcatgtatacgagatgaagtggaaaggaaatagacatttattattaagtacaattggtttctcattgcactgtagctactatctgatggttcaacttgtccgtgggatggcctgctttcctgcataattgactgtgtnattngaggcttttggggcaattacccaaattagatcaaaggaaatgggggaaagaacatggcttaagctttgccaatgcaaattttgggtaaactactngactggnntttaatcatcaactgtananaagcaaatttcaanaggactnccatcctaatgggtggnaanggccanacctcattcngggaaggattggcaattaangagactttgcaacttttt

SEQ ID NO: 4113 - DNA, 1041 bp, Triticum aestivum
  Clone ID: PAT_TA_4113
ccacgcgtccgcacgaccaaccgctccccgcggcccctcccgctcccgtcgcccgcccccgcttgccgcccgcccctccagctcccgctggccgccgcctccccctccccctctcccccgcctaccccgctccctacctctccctagagcctccctccccgtgctcaccacgcgcccccgcccgccgcgcggtgtaagccggccgggtcggccccgcccgcccccgccccccccgccccgctaacgacggctccagcttccgcctccctccgccccgccgcccgcgccaagcgcccctgcgccagcccccgccctgctccgcccgaccgcccgctcgaagagccccttcgccgccgacaaagccaccgacgctgccgagcaagagcagcccctggcgcaggagggagcggggaccaaggagaacggcttctgccactacacctaagcagccgaggctggactgccctccgtgacccgccaccggacaccaagttctgctactacaacaactacagcaccgcgcaggcgggccactactgccgcgcctgccgccggctactggaacccacggcggtcacgctccgcaagctccacgcccggcggcgcctcccgcccgcggctcagccagcaggaacagacgcctcaacgcctccccccgtcctcccgcccctccccgccgctgcccccagcaggtcccctaagaaccaccacggtcccgggctacacgcctggccggcctcgtccccccccgcccccctttccgcccccctcgcctcggccgcgccccgggcccccgcgctctcccccccccgcccctgggcgccccgccgcccccgggagctcccgtggcctcccccaccgccccccgcgcccggcggcggatgatcggcgtcgtcgtgacagtcgccggcgcgttcgaggctcctgttttatcatcgcagcctcgatcgatcagctagttgttgcttaccttcaccagtttgcagtgtgtctgtctcctctgctaggaattaatgactcatgcagctccatggatcttca

SEQ ID NO: 4114 - DNA, 671 bp, Triticum aestivum
  Clone ID: PAT_TA_4114
gtgttattctacctcgactgcaaccggtcatggtcgtctctgcgctgccgccccctcgcatcgcgccgttgcctcgcgtaggactacgagcatgtgacgctaggtcgaggttttcttgtctcgtcaggattctcgtgctgcgaatttagtaatggggcaattttttgggtgtcctattttgtttgcggattgatgagaatttggcgtgggggatcttaaaccacctgtcgctgcggcacatcaattgtggggggcgctggaaggacgccatggcgaacaacatgggaacaaggaggaactttacatcgagccgatgtttcctctctcccattctctttcctttccgagccgttcacaatcgttagaggtggacattgattgggagggaggataagaggcctcacatcgtggatcctctttgatccggacctcctcgacgccttgcgcgccgtcatctacgcatactccacgcgctctggtgcgaagtgtccacacatgcgcccgactgggacgagctcggcgtgcttctgccaggccaaatggtgccatgcccctgctgttgtggacctgtggtggtacatcagcgaagatgatgatgaggtggcgctacacgagcggtcgtgccgccacccgatgcaccatcacgccttgcgcaggggtgcaagcaagat

SEQ ID NO: 4115 - DNA, 607 bp, Triticum aestivum
  Clone ID: PAT_TA_4115
cggacgcgtgggctccccaaggagatgttcaccagggccgactcggcatgcgtcgtcgcggcggcgctggcgcccccgccggccgccgtcaactcgatgcccccggagccgcccgagagcgcgcggacgccccagacgaagctgccagggccgcccgcgctgcgcggcggggccaggaacgacactgcggtttcgccgccgtcgtcgtcgacggcaaaggcaacagcaattgggcggtggtgtatagaattgttgtatgtactaccagtactgctgcctctggtatgagatccgcgatatattactaggagtaaacctgtacacaatgggtttgaaaaggtggggagaagggtgatgactcgaggtgatgtatgtagtaccagtactgctgcctctggtatgagatccggtggtgagctagtcgtccattgccgtctccttgctgagctcaattcttttttgccttgcttttgttacaattgtttcttctttgttgctcctactagtatattactaggagtaaacctgtacacaatgggtttgaaaaggtggggagaaggtagatgactcgaggtgaagaagattgagctgcaaagcaaagcagcgt

SEQ ID NO: 4116 - DNA, 1024 bp, Triticum aestivum
  unsure (1)..(1024): unsure at all n locations
  Clone ID: PAT_TA_4116
acatggcagaagcagggagcatgggattggggctgtacaaacgacgccggtcgacggtggtgcttgctagaggagaagattaatggtccaaaacggtcatttcatgatttacgagcttgcggagagggcattggatgaatccatcagttcgaagcttaactaatatatttcctagggctcgtgcatggcattgaggagcatggcaggtgttcaggtcaacctcttccatagtagtaacaggggtgtcggtggtgacaagggaggtgacaggcaaccaatagagcaatgacattaaccgagataggtctctaatcctttctttactactcgattcacttcgctcctgcattgatctcgcggccgcgcccacgtctatcattgtggttgcagagtggaacagagcagttgggaagcggacatgaggattgatgtgcatatccattagtacttgctcaagttaaatatctaaattgtcaacatgttcatggtagaggggaagatgccgcctgaatcctttaatttgtttggttgctgttctgcctgccttcccccttgtgtcaaacctggaagattgccaagctggcgtcatcctgcgctggcgcgggggccgtggacgatccacacacgcgaagcattgtgtcccgtcgttctgccctcccagtcttccggaacggattcacgaaacatccatgcgcacgcatgacaggccaccgctagctccatttaccctgcccctagaagcctcccgacgcctccccgccaacgggtctctagggaagttggtgcggacggctccgaagtggagcctanaagtggcgaattttcttaatactgctacattaatcaccttgaaagtggcaacagtgacaacctaaaggaagctgatacaaccgaaagtgatgtgccggtggatgatatggacgaatacaacgagaatattgccaaggctattattgcatcaagggcgagacttattaccgatgctgagcgcaaagttgaatatatgctcatggaattatgggtg

SEQ ID NO: 4117 - DNA, 626 bp, Triticum aestivum
  unsure (1)..(626): unsure at all n locations
  Clone ID: PAT_TA_4117
ctttgttatcagatatttgcatcagcacgtccgctgctccaacttatttgcctgcgcgttacttcaagactgaagattctcatggaaacatcaaggagtttaatcttattgatgggggagtagctgccaataatccggccttagttgccattggagaagtaagcaagcagatattcaagcaagatccagatttcttcccaataaaacctatggactatggccgggttttggtcatttcacttgggcacaggctcatcaaaattcgaagagaagtacgatgcacaaaaggctaaatcatggggagtgttggattgggttatgtagcagtggatctacaccattagtagatattttcacacgggcaagtgcagatatggtgggatattcacattgcttctgttttcaaagccttacattcgggagcaagaactatctgagaatcaaagatgataacctacgggggacacctcctcagttgatgttgccacaaggataactggngaaactgtcaatgttggagagtctgctaaagaaacgtccacggcaaattggagacggcaaatggtgctgctncaatgcataangagacatgaggaacaccagagattnaaantgtgtcgatgaaa

SEQ ID NO: 4118 - DNA, 680 bp, Triticum aestivum
  Clone ID: PAT_TA_4118
ccttcggccgtcaccatgaccgacgccgccgcctcgtcttcccgccggaggatggaggccgtccgccgccatctcctccctcggcctccgcccgtccttagcctgaatcagctaagcgccccggaggcaggacagagcccggtgatcatcggcggaatggtgctggacatccacgcgaagccatccgtgccgtcacatcctggcaccaccgttcctgggatggttaagtacatcggtgggggagtagctagaaatattgctgagtgcatggctaagcttgggactcaaccactcatgattagtgtcattggagatgatatggcaggggattttctattgaagtactggaggttggctggactatgtacagatggaatactgcaggttcctgatgttacaaccccagtagtgtcaaatgtatttgatgggaatggagaattatttgctggtgttgcgagtgtgcaagcagttgaaacttttcttacccctacctggatatatcagttctaccgccgcatctccattgcacctctactaatgcttgatgccaatttatctcctgagtcacttcaagccgcttgcaaagtagctgctctccccgaatgagatgacttatggcatggcaaaccacgtcactcaaggaaatacaacttgtcaaactgacagtgcaacaacaaaca

SEQ ID NO: 4119 - DNA, 897 bp, Triticum aestivum
  unsure (1)..(897): unsure at all n locations
  Clone ID: PAT_TA_4119
tctccccccccccgccgatccgatccgctcctctcctcgacccatcccccgcacggaacgagcgatggcgaggggcgagaacagcgagtcgcacggcagcggcaacgtcccggcggcccccgcaccaggggcggcgtcagcgtcctcggggaagcaggcgccggcggccgcgcgtggcgcggacgggcagtcggtggtgcggcggctgcagtcggagctgatggcgctgatgatgggcggcgaccccggggcgtcggcgttcccggagggggacaacatcttccagtgggtcggcaccatcgacgcacccgccgccgccccgcccccgcccccctcctgcccccccccgcccgcctccccctccccctcccccgccacgccccccacgggccgccccgggtccccctcctgcccccccgccgccgccccccccgccaccacctcccccgcctcccccccggcctcctccaggacaagtggtcctccgcctacgacgttcgcaccatcctcctctccatccggagccccctccgacggcccccccccgaccccccacgcggccccccgccggccgcgccctgggcggttcaagaagagggcggggaggcgctgcaggcccgcgtcaagccggcgtaaagaggaagatctaggcgggagctgtcgccttggcggcgccacatgggcgtcgctggtgcgggtctggtgctggagtgttgtttctcatgttggcgtcgactgggccatctgttggggcggcgcttcgattgctcggtgggtttagcaaacctgttgtttctgatgtcatgctgttctcccatcgctgagatgggcatatactttactgaaataatcaggcgttccatagtctttcaaacggaaagatgcgggtganaaaaa

SEQ ID NO: 4120 - DNA, 810 bp, Triticum aestivum
  Clone ID: PAT_TA_4120
ccaccaccacggcctcgtcgccgcagaacggcagcactagccagccaattttagttcggcatggtggtggtaacggtggtaacaatggagggggcggcgatggcaatgtgagcactcatagccagagcaccggtaattatagcagtgacgggaacagcagcagtggtggtgacggtaactggaatgatgggggtcttagtggtggcagcaacttgaactctagtgttcatagcggcgccattggtggcagtggtattgacaatagtaggagagtgttcggcagtaacaattggaatggcaacggtcgtggtggtggcagctacaacaatgccaccggcagcggtgatgggggcaacagatataacggcggtagtggcagcggccactggaacaataatgcccgacatggtagtggtaatagcaatggctttggtgctcgtggcggtcggaatcgccgtgaccatgaaagagggagtaatttctcaccaaggggctattcccgtgcattgccagtgcagcagcagcagccgggctactaccagcctggtccattttaacgaccaccaccgccatcacctgctgctgcccatttcatggtgccacaaccttttgtgccatacgttcaacccattccctatcctgctgatttacaagcctcctatccttactatgtcacacaagtttgagcagcagtttcaaaacatgccttttatccggccgccaatgcaaccatttggcgttttaccaagaaaaaattaatcttcaaacggacatttcacttgcagaacgagcacttattttagcactaac

SEQ ID NO: 4121 - DNA, 599 bp, Triticum aestivum
  Clone ID: PAT_TA_4121
gcaggaattcggcacgagggtttgaggaggagaagagagatcggccgagactagccaatcaaccggccggtgcaactcacacgatgagcagcgaacaggaacacccggagacgtcggagctggaggaggaggcggagaaggacgaggacgccgccatcgtggagctggtgacggagctgaagcaggaaggcacgacgctgttccggctgcgggactacgacggcgcggcgttcaagttcgacgaggcgatccggctgtccccccgggccccgcgcgcgtacaacgagaacgacatcgcctccctccacagcaacgtggcggcgtgctacatgcacatgaacgcgcaccgccccgaggacgactaccactaccaccaggccatcgaccggtgcaacatggccctggacgcgtcgccgaggtacacccaggcgctcctgaagcgggcgcgctgcttcgaggcgctggaccggctggacctggcctgcgtcgacgtgcaggaggtgctgaccctggagcccaacaacgcggtcgcgctggagctcctcgagagcctccgggaggagatggaggagaagaagttcctgctggagcaggaggcc

SEQ ID NO: 4122 - DNA, 631 bp, Triticum aestivum
  Clone ID: PAT_TA_4122
tcaagcatggaggtttcaagagcatcccttcgtcctggtaatgtttttttgttccttcttagtccgcttgagtggatcctctgaatcaaatcacgtgtcctttgttcatcttaattagaacatttggccatttgcaaattattgttttgttaattgtaggttatctttctggtttgcctgacaaaactccacagtttgttggctttgggacaaaacaagatccgattcctctctaggttcagcgccaatgatctcactttggggtgtgctattgctacggtgcccgcatttgcttccatttcttctcacaagcatatgcacctgcacgtctagtctgtgggtgaccgaggaaggcatgtcgctgttttgtttgttcccagccctgactatggttgtccaacgagtctgcatgttgttcatctaactatagtcgtccaacgagcttggcatgttgttcatgacgggagcaggtgcctagtttgtgatttctatggaaggagtttgtaaagcttgtagagcttgtaaagtattgtattacacttgtagttgttactgtgattgccattgtattacatgatctagtgtgattgccattgtattacatgatctagtttctcttaaaaaaaaaaaa

SEQ ID NO: 4123 - DNA, 1227 bp, Triticum aestivum
  Clone ID: PAT_TA_4123
ggggcggacgcgggggccgctccagggccgacgccatcacgccgagagcccgccgtccctgagcaatggagtcgaggaagccgcagcgctccgctctcgtcgacagctatgtggtccccggcgacgtcatcctggacctcgccgacatgaccaaccagaccatcaagctcggcgccggtctgcgccaggattgtgacactatccaggcaactagtgctgggaggcttcgactgtccaagcccaacaagtactgggtggagaactcccagaagaggtatgtaccttctgtagaagatacggttcttggtattgtagttgacaccaaaccagataacttcttggtggacataaaggggcctaatttggcctttttaccagttctttcatttgaaggtggtacaaggaggaacataccaaagtttgagattggtacattaatatatgccagagtggtgaaagcaaatagcattatgaatccagagctttcatgcatggatgcaagtggaaaagctgctgaatttggtcaactgaaaagtggttatacgtttgaaacatcaactggcctggcaagaatgcttttaagttccccaacatgtccacttctagaggcccttgggaaaaaactatcatttgagatagctgttggactgaatggtcgagtatgggtgaatgctccttcgccaagtaatgtcattgttgtatcaagtgcaattaaagaatcagaatcttatagtcgcttacaacaaaaaagcatggtggaaaaactcctggctaaactgtcatgatgggagcaggacataatcaggcactgtaaaaggattctgaattattgtttgtcaaacgccgcagatgattctgcaaccggaaagatggctagtcactatcatgcaccttagcaaggaatagtagatgggatggcatgtaaaatagacgcgttaaagtggttggtgctttttgatgatgcaggggctaaagcaaccggttgattggtaaacattctaaatcaccgtgtggatgttgtacttgcggatacatggtttcttagctttgtaatatgctactgtaagagatttgcacaaggctgcgtgtgctgctctactgaaagatgattgatgaatattactcctatattttataaatttatagcgtgtgaaactatcaccctgagctctgtaagcaagatcaggtgaactcctgctcaatgatatggtgcatgatttcaaaacc

SEQ ID NO: 4124 - DNA, 864 bp, Triticum aestivum
  Clone ID: PAT_TA_4124
gtcgacccacgcgtccggcagcacgcaatggtactccaaagcctgatgcttcaatagcaagcagaggccatctgagatcttctagattacatcaatccagatgatgagctcaaggctaaggaaatgcaaaagaaacaagcccgtgctaagataaaaggtcgtactgggcaaaacccatctgaattagccgatgatgaagatcaaaggagccctccacctaacagtgatcgttcctcaaccgagaaggaaaactctgatgtcaaagagaaattaactgagaagaaaaactctcaagccaaagagaatggaaccgttgttgagcatgtgaaagtgaaactggaagaggcaaaacccggtaacactgtggtccacctgcctcaagatgactatactgaagagaacatatctgaggaggggtggcaagaggctgttccaaaggggcgtaccacggggaatcgcaaaactggtgcaagtgtgaggaggccaaacctgtcaaagatcagtacaaatgccatcaataatagtgagaatggaagatacaaaggcagagttccatccaactcttcccctcgagtttcacctaatgaggctgcagcttctgttgcttccagccctcttgcaaagaaattggcgaagagtttgagcttcaattccaaagcaggtaatcctactatctcatcaaacagtggggagaattcacccaaacctaaatccatggcagcaagcttagccaccacccctgcagctgccaaggtgatgccatctgcagcaccaattgtcagtcaaacagtaaggaagtcactgtcatacaaagaagtggcaatagctgcaccaggaactcttgccaaagcgttgaatgatgtg

SEQ ID NO: 4125 - DNA, 714 bp, Triticum aestivum
  unsure (1)..(714): unsure at all n locations
  Clone ID: PAT_TA_4125
gattcggacgagcagatatgttggcgacttcctgggtgatcagagcatgctagtatatggattcattgctatccgggatgagttggattgtctgcgcaattacatcttcaactgtactagagagcaggcgcacgagattacaccggattcccgggcattgccgctcatatctcctgttcgtgggaactctattcttgatggtgttgttcttgagtacagcctgaaggtcaagtctaatggcagtgacaacgctgagatggattatgtattagctgatggttgcattgaatacacagatcatatgattctgcgtggtactacactgaagtcgaggctttttggcaagcttggccctgttgacttccattatgctttccttaggcagggcattgaagcaacaattgacattgagattccaatggctagtccagcttggggcctgaaggcagtgactgcttttacaagtggactctcagatgcaattgtgctgtatgatgggtctactaattcctctcctacacaatcagtgttccctatatcatcagttgttgccgtccaattgggccatgagctaaagcttaaatttgacatcacctcccaggatattgtgcccaaggggtgcgcgaggtcgtgcccgccccgaacntcgggcaatacaaaggctgatntgtnatggtggnagggggaacaacgaatttcccgtcccaatcattc

SEQ ID NO: 4126 - DNA, 1803 bp, Triticum aestivum
  unsure (1)..(1803): unsure at all n locations
  Clone ID: PAT_TA_4126
gcacctgcatcggctgcgcggtttgcttcggtttcaaggctcttcgtgttcagtttatgttgacagtactttgggagttgggatgctatctgtacaactatagtagtagttttttggtgtttcagcacaattgtttactgtgcttgtttttggagtaaatgtcgtttcgtagcattgtgcgtgatgtaagggatggctttgggagcctatctcgaagagggtttgatgtgaggtttcttggccatcgcagagggaaatctcatagcgccgtccacgagttgcatgatccagcacctgtgatacagagcagttgctgggctaatttgcctccagaattgcttcacgatgtgattgagaggttggaggccagtgaggctacatggccttccaggaaacatgtagtcgcttgtgcggctgtctgtcgaacctggagagaaatgtgtcaagagattgttaagaacccagagttttgtggaaaaattactttccctgtctccttgaagcagcctgggccccgtgatggaaccatccagtgcttcattaaaagggataagtctacacaaacttactacctgtatctgtgtcttacctccgctgtggttgctgaaaatggcaagtttcttctattggcaaaaagacactcccgtccaacctgtacagagtatacaatatttatgaatactgacaatacttctaggtcaagcaacatgtacattggaaaattgaggtcaaatctccttggaacaaagtttgtaatatatgatacccaacatccatgcaacatacccaatgtttcacagtccgggaaaacaagccgtaggttctactcaaggaaggtatcaccgaaggcctcacccagtacttacagtatagcacaggtttcgtatgagctgaatgtcttggggactcggggccctaggcggatgaactgtgttatgaactccatacctgcctcatcccttgtggctggtggcactgttctatgccagccggacagtgccgttgctcattcccttgatgagtcatttggcagcatctccttctcgaagtcatccattagggatcgctccatccgattcagcagcacccgattctcgggcatctcaataggtggctccaggaatggaggccaggcattgggtgataatgatgagtgcaaggagtggccgctgactctccgcaacaaggcaccaagatggcacgaccagttgcaatgctggtgcctcaacttcaagggcagggtgaccgttgcatctgtgaagaacttccaacttgttgccgcgacagagtctactgctgaagcaccgaccccgtcacagcctgccccgccacctccatctgagcatgacaaggtgatactgcaatttggtaaggttgccaaggacatgttcacaatggactaccgatacccgctgtcagccttccaggcctttgcaatctgcctgagcagcttcgacaccaagctggcttgcgaatgaaatcatcagcatgggcaccgattatgtaagagactggtggccccctcaaatttatctgggaccgccacagtggtgtctattgttcatggtcttttaacttgtagttgtcactagaaaaccgttgattagcctccccccccctgattttatagctgctgcccaccgctgtttgctcagctgtatcaccatttgtcttgtttttaacagcttgctttctagagtctttgtctttctgtaataactagcagacttaattgggttgttgatactttgncttgtgttgcccgaagagttccacatattcatactggggttaagttacaaa

SEQ ID NO: 4127 - DNA, 789 bp, Triticum aestivum
  unsure (1)..(789): unsure at all n locations
  Clone ID: PAT_TA_4127
cggacgcgtgggctgggaagtcctcgtgaaagggtttcatatctagcctaccccaacttgtttgggataacaggcttcataaataagtatctattttctgttcttgaagtaaggctattaagttgtgctctgaaatgtgttgccttggttttgtatatttatccagtcatcaaagaatgtagagtctaaatgcccaaaagataatcatgatgtttggcgaataaagaccaaagtggcagtattatgagctccaagttggagcatgtgaaagctatacagttaaaagataaagtggtactagcactcaagagtgtagagataatcttggctaagaaacctgaggaaaacagttatttttcaagtgagctgatgctgttgagctagcagtcgcaacaccttagtgcattgcacgttatatttggggatcaaaagtgggtaaccaattttgtgatggagcaggtaacattgatatctcacttttcaattcacttggcttggcaataggcatgaccagccagtggtgatgttgccatgctgcattagctgctgtagacaagtttgcagttctctaatttagtttgcacatggtgatactttcttgctcttgtacttgtcagttaccatatgttttttggtgtgttgctccttgcatactgtcaatgtgtttggtacgaaggtcaaatctttgattgtttgcagggacagagataattattctcctaagggttcatactctccacatactncggacaagatgcagcacatatcagatggtcgatcgcctagcct

SEQ ID NO: 4128 - DNA, 651 bp, Triticum aestivum
  Clone ID: PAT_TA_4128
cccccgcgcagcgtagacgcgacagccccaatcccctccgcctccgccgccgttcttctccgtccgcctgcgctccagccgtgcccttctcgtcgccacttaccgacctcgagctccccagccaccgacaaccggaggcggcgccatgtctcagaacaacccctcccagctcctcccctcagagctgatcgaccggtgcatcggatccaagatttgggtgatcatgaagggagacaaggagctcgtcggcactctctgcgggttcgacgtctacgtcaacatggtcctcgaggacgtcaccgagtatgagtataccgccgagggccggcgcattacgaaacttgatcagatcctcctcaatggcaacaacatagccatcttagttcctggtggttcaccgccagatgctgcatgagctagcaagcacttctggaggatatctgtttgaggctaaacgagacgcagtgaagtctgaaccttgtattgtgaaagcgctagatatttcttggtcaaatgtgctttcctctgtatggaacctactgagctgaaacatgcacctgcgattgctgcacttgtatgacttggcattcggcaaatgctaattgtgacatgtctctagttgctgtttatgtttttcattctgcaaaaaaa

SEQ ID NO: 4129 - DNA, 1050 bp, Triticum aestivum
  Clone ID: PAT_TA_4129
aataaaccacgcgtccgcgacgcgtccatggccaggtaccgcagccgcagccgaagccgcagctacagcccacgcaggcggtacagccgcagtcctccccgctacaggcactacgacgacccgcgtgaccgctaccgcggcggcggcggcggcgggccccgccgcgggtacgaccgaccgtcggcgcccaccggcctcctggtccgcaacatttcactcaccgccaggctagaagacattcgtggtccattcgagcaatttggccctataaaggatgtgtaccttccgagaaatttccacacaaaggaattacgtggttttgggtttgtgaaattccaccaccctgaggacgctgcatatgctaagcaagaaatgaatcatcaagttatttgcggtcgagagattacaatagtttttgccgaggagaatagaaaaaccccacaagaaatgcgcttcagaacaagatcaagtggtaggcatatggatggaaactacagaagaaggcagtcgctgtcaagatccccaaggtctcgttacccctcttattcacctgaaccttctccagttagacggcactccagggacagagataattattctcctagggattcatactctccacatactcgggacaagaggcagcacatatcagatggtcgatcgcctagcctagatggacatgaacgtaggatatcaccatccagtaatggacatggtccaccagttgacaggacggagcccaacctgatctccgctcgcccctaaacgcgaagacatttccagttccacatcccctgatagggtgtttccttcatatgcaggctgagatgaatttcagttctacaatccgtgactgggtggtgagagcagagaacaatgccttctttcctactatgttttctagaataggtcggtagtttttgtagtgaacagacttgtgttcaaaagccagttgttgagtgttgacacgttttatcagtactgtttgtgatatattgtgggatccgttgaagtctatgatcaactggtactttgtgtgttttacgctat

SEQ ID NO: 4130 - DNA, 769 bp, Triticum aestivum
  Clone ID: PAT_TA_4130
gcgtccggtctccctgccccacgtgacgggcagaacgctcctcccctcttgagcctccgagtttggcttctcccacacgctcatcttctctcctccctcccttctctgcgtgagagcgtcgcgtccaaaccctcccccggcgcccgccatggcgaggccgcagcaggaggctatcgacaccttcatcagcatcaccggggccgacgaggccgtcgccatccgcaagctcgaggaacatgctggtgacctcaatcaggcagtcaatgcacacttcactgaaggagatagcacagtgaacgcaatcaatcaaagtattccacctgttaatcatgatgatatggagctggacggaccacttgataacacgtttcaaagaccgttgttccctgaagctctgcatgacccttttgcactaatggatcccaatttccagcaaatgttttttgatagtgttggttctgctggtactcccaatcgtgatgcacaaggtccgcaccctagagagacatctaatgaagttaatgacaacaacattcaaatcggtccttctggtcaggcttctgttgttgagaatgtcactggacgtgggtcttcttatggaccagaagttcgtgacactatcataatagatgatgacgatgaggagttgtcatctgggctgtcttctcagcatgctagtatccgtagcaatgtgccgcagccaaatcctctgccaactgctcctccactagttcatgtcacagacaatgacatagaagaggaaatgatt

SEQ ID NO: 4131 - DNA, 717 bp, Triticum aestivum
  Clone ID: PAT_TA_4131
tttcgcccccctccccgtccggcgctctgctcgccatccccccccgccgcgcactgctcgaccgccgccgccgtctgcacccaaagcaatacgccgccgcgccgcctccctcccagccgccatctcttttcgacgccgcggaagagaaggccgtccgaggacaagccaagcaccaacaacccttcccccttccgttgcccgcgcacccgtccgatgggcgagcggctcgccggcgccgagaaagaggtgctcgtggagatcgtgaggttcacccagaagaacgggctgaagggggccgaggggggatggaaggacttcctggcccggaacgacaagaagttcggcgcctccgtcagcgaccccaagaagcggaccaaggacgtgctgctcgcgttccttgtaaccttctccaaagatttgcagaagtactttcgcaaattggtgaggcgtcacgctgaacggagagctatcgagcagtacatgaatgagttttccggcatgatttctccagagcagaagcttgttcagttgacgacagaacaccttgactacaggaaaaactactacttcccatcttatcaagaggggtggaaagtaatgcggataggaaaagtttctagtagtatgaactctggagtcatgttggcaattgactgtgagatggtcctttgccacgatggtacagaagctgtcgtccgagtatgtgttgtagacaac

SEQ ID NO: 4132 - DNA, 1169 bp, Triticum aestivum
  Clone ID: PAT_TA_4132
ggccacgcgtccagggtggcaccagcttaccgccaccagaaccagacacgcatgcgatgcacctcaaggccgaggtttgtccctctcggtttggtttgttacccctcagtcttgttttgtttgcagctcattaacctgctgtgggtttgaagggcgtcagaaccaggagaaacaactacatactcgagcaaggtgcgggtttacccgaacaggctaaaggggaggaatatgagagggtgaagttcccagtggagaagacagaaataaaaagcatttggaacagcacaagcaagtggccgttgtaacaacacatgatggggctgagggaagggaacgggatgtggctgctgggacggaaaaagaagttgcttggtaaaaccacacgtgaatgttccactggacctgcacattgaagtggctgttggcacgaggatcgatgtggctgttcaaacatcacaagaagtgggtgtggatacagcacgaggaagtggctcgttgtgatttcacaagaagttgccactgaaacaacacaggaagtggctgttaaaacaacacaagaagtgggcatcgaatctgtccagggtgggaccagcatagatgcacctgaaccaaagactcctgcgatgcacctcaaggttgagcaagcagcagatccaaagactcctgcgatacacctcaagtttgagcaagcagcagattatccgactagttctttcaagactcgtagcaccgggataaagaaatccatagtccaggagtgcttgagttttctcaacagcgctaacaaggagcaattgaagagcttgaagggcatcggagagaagagagcgaattacatcatcgagcttcgtgagaattcaccggagctgtttaaagggatagatgatctgagggatgttattggaatgaataagacggagataaaaaagatgatggcggggatcatcaacagcccctaatccccttgctgatgatcaatggagtggagctaatttctttgtgcacagtgagggatttattgagagtagtagtgcaacggttggttgttggttgttgagaaagacagacaaaagacaagacaagacaagagtagtagtgcattgtaacttgtgtgtttttggtggtttggtctctgaatcatctgcatctgcattttgcggagaggttca

SEQ ID NO: 4133 - DNA, 1207 bp, Triticum aestivum
  unsure (1)..(1207): unsure at all n locations
  Clone ID: PAT_TA_4133
tcacactgttacattttgcaagacggcgcttctttctttacgtggctaggaagtctttcttcacccagtgaccatgttctacttgatagaatgatggataagttgtgtccactgaagcaatcattgttagtaagagaaggttctgaacctgaccgtttctggacaacattaggaggaagatcagaatactccaaagaaaagtgtgtcaagggttggccaacagatccacatctgtatacgtgtacttttcaacaatgtctgttcaaggcaaaggaggtattcagcttctcgcaggatgatctggcaactgaggagacgttgatactggactgcggcgaagaaatcttcgtctgggttggacttcactcaggtgtcacgtccaaggagcacgccctcgacttcggcaagatgttccttcaggcaggcattgctcgggatggaccacggtcgatcaatgacgcaaccgtgtatgctgtcgcggaaggggatgaacctgcatttttcaccagcttcttcaactgggatagctcaaaacaagctgcagctatgctgggcaactcatttgagaggaagctggcaatgctgaaagggctttcaccaaaattggagtcaccggacaggagcttgcgcaagtcttcgtcgcgaagacaggggatgtcgtcagagccgacgacgccggagcagcagcagcagcagcagccggcggcgaggaggacgttcggttctgcctctgccgggaggaccgctagggagagactgccaccatcttcatccgcagcgtcgccgtcgccggcaacaccttcctggtctctcaagagccgagggtcgtcgtcgccgtcgatgccagccacggcacggcggcttttcccttcctcgctgcacgcaccggggacagcggccgcacatctcccctcccctacggccatagggagtcctggtcgacgacggtgagcagagctccccggtgcacaccggaggaggataagtgatacctgtacctgtaccgtaacatacgcccgatatttgcttgccctaggggatgaactgcagtcaaagtcctccatcacagaacgtgatttcgcctcgtccttggctaatcacaacgaaaatatcataagattgcccatagtgggagtaatggtagtaaagtttattagtccactttgtattttgtgtaaaattttnaccttaatttttttaaaggtaa

SEQ ID NO: 4134 - DNA, 1135 bp, Triticum aestivum
  Clone ID: PAT_TA_4134
tggcgggccgtcttcgtctcaggccgcccggtacgcgctggcgcggcgggccgtgctcctcggggtctccgcgctgccgctcctccgcgacaccgccgccaaggccgccgcgcccagcagcgcgggtctcgtgactgagacaaaggatgtcccaaaggtggatgaacctcaggctggcgggactatggttggtgaacctcagactggcgggactcagtcagaaactcctctacttgaagcccctcaacccgaatcatccttaccagtggtgcaaacacaatcttcagggaatccacttgccggacttctgaatgcaattgcggttattgcctcgggagttcttgctggattgtatggtacatctcaacaggaaaagaaggccctgcaatctgtcgtctcatctttggaggtcaaattggctgaaagtgaggcagcgatctcattgatgagggagacttatgaaaaaaggttattagagcaacaagcagcacagaagaagcaatctatgaagttccaggagcaggaagcttcattgctagatcaattggcttcaacaaaaaagactgtaacatcactaagtgaagaattcagaagggagaaggcacgggctgaggagctcaaggatgaaatacggagattagagagtagtattgttaaagctggggatgataaagatgtgcttgaagccaaactgacagaaaaggttggtgaaatgaatgatttgcaggaaaagttaagtctactcagccaacagtatgatagcaaggagaaacgcattgaggaactcaactcatcactttcttcaaaggaagcggagtatcagaacctgcgccgtttctctcatcaaacgaaagagagtcttgaacttgcaaatgctaaaatacaacaactgggaggaagagattcatacaactaaaaatgatcttgcttctaagatatcgtcagttgattcactcagtgagaaacttcaagtattaagctctgcaaagaaggaagccgaggaaaaaataaatgagctaattaaagagtgcacagacttaaaggcttcttctgagataagagcgaaccatgattctgaactactgtctgagaaagatgatctgatcaaacagatggaagaaaagctctctgttgc

SEQ ID NO: 4135 - DNA, 596 bp, Triticum aestivum
  Clone ID: PAT_TA_4135
agtatagccccattgcagcatatgggcagtcaaaagcttgccaacattttacatgctaatgaacttgccaggagatttaagcaagagggtgttaacatcactgcaaattctctccatcctggagctatcatcacgaaccttcttcgccaccacagcatcatagatgttctccaccgaacgcttggtagactggtgctgaagaacgccaaacagggagctgcaacgcagtgctacgtggcgctgcacccggacgcgaagggggtgtcggggaaatactggagcgacagcaacctgtacgagccgagcgagaaggccaaggacgcggagctgggaaagaagctctgggactacactctcgacctcgtcgcctgatgatcggtaggcgcagacgagatgagaccaaggatgtgaggaacgcaatgtaagcttacataatgtacaacaaccacctagactactcgtagataaaatgctggatactggaattagtccagacagaattattatttttactcctaaacaaatttgtgggatgctgtaatcgtcatattaagatacaaaaacattaacttcagagtacagcacccccccaaacc

SEQ ID NO: 4136 - DNA, 1409 bp, Triticum aestivum
  Clone ID: PAT_TA_4136
agactgcccgccggccggccgcccgccccctcccgccggcctccgcctccgcctccgcctctgcgtgatttgatttgaccagtcgagaagagaagagaagagaagagaagaaaagatgctgccttggatcttcagccgcaagggcgcgtcgggcttctcctgggcatccaccgccgaccaagtcaccgccggcatctccgcagccggcctcaccgcaatagtcactggtgcgtcgagcgggatcggcgcggagacggcgcgggtgctggcggcgcgcggggcccacgtcgtcatggccgtccggaacctcgccgccgcagaggccgtgcgccaggccgtccttgccgagacccccggcggccagcatggaggtgatggagctgggacctctcctccctggcctccgtccgcaaattctgcccccgacttcgccgccaccgggctccccctcaaaatcctctccaacaacgcagcgggaagtggtggacccctttctccctctcaaaagggtggcactcgagaagcagtttgcaactaaccatgtcgggcatattcttctgacaaatcttctgtaggagaccatgaagaagacctcccgtgaatcaaacgtggaaggaagaattgttaacgtttcatcagacgggcacaggtttgcatacaaggaaggcatccgtttcgccaagctgaatgacgaggaagagtatagcaccattgcagcatatgggcagtcaaagcttgcaaatattttgcatgctaatgaacttgccaggagatttaaggaagagggtgttaacatcactgcaaattctctacatcctggagctatcatcacgaaccttcttcgccaccacaagcatcatcgatgctctccatcggacgcttggtaaactggtgctgaagaacgccaaacagggggctgcgacgcagtgctacgtggcgctgcacccggacgccaagggggtgtcgggcaagtactggtgcgacagcaacctgtacgagccgagcgacaaggccaaggacgcggagctggggaagaagctgtgggactacaccctcgacctcgtcgcagcctgaagaatgtcccgtttggggtggttggttgggtgcggtgtggaggggtgcgtgaggtgcatggactcccaggatatggggggatgagatgcaaggatgaggggacgtcgaattgacccctcccccagcacgttcggtgcggtatctatctgggatgtatggtactcatactcttttcctgcggtgcctgtgtattgtgtacatacggggatgaagtcagaatgaaatacacattatatttttcccctccccgtgatgtgggtctccgtgtcctcaaagtgtagtgtttatttcttcttttatgctagaaaatgctgttgaggaccaaaaaaaaaaaa

SEQ ID NO: 4137 - DNA, 688 bp, Triticum aestivum
  Clone ID: PAT_TA_4137
ggtcgctgcggcctcttgatatcacgcacagcaacggccttctctctggccttcattgtcgcgcccctgcctgccctccaggctcccacctccctctcctctcccctctcccctcgcggaggagcaaagtgagggatggcgccgacgtaccggccttacgcggcggagtacggggcggtggagcggaaggtgccgggggcgcggtgggtggcgtcggcggcggcggcgtcgtcggtggcgtggttcgtgggggacccccccccgcccgcccgccgggggtgcctcccccgcggcattgcccccgccctggcgcccatggtgtcggcccccccccccccgcccccccgcccgtgcgtggccctctgcccccgcctcgtccaccccgggcccgcccccccgccgccggctcccccctcccccctggtggctcatcaggcgggcggccgaccgatggtggcgagaacggatgcgcgagggatgcacccgagggacggactcatcgaacgttccttgcgagtagattagtcactagtgtaagatcatcatgcatgcatgggtccttttttcttcttttctttttctagttgttctgttgtcgagagagagggggagaatgtttgtttccggggctgcaagcaacgttggccatcaatcaggcaaaaaaaaaaaaaaaaaaaaaaaaaaaaaa

SEQ ID NO: 4138 - DNA, 766 bp, Triticum aestivum
  Clone ID: PAT_TA_4138
aacacccccacgccatttgacccaaacaccccaccgttctccactggcccttacggttattggatgtcgcacccgggcgtgatatggggcctgttcggatactggtgcccgctggtgcggctgttcggcccgagcgccgcggtgccgttcgggtacgacctgaccgtgccggaggcgctggccaacacgcgcgccgacggcgtgggcgcgctctaccgcgagggcacggcgtcgctgctcaactccatggtcagcagcgggttccccttcaccacggcgcaggtgaaggacgcgttcggcgccgcgctcagctccggcgacgatcgcgccgccgccgcgcaggcgcagctcttcaagatggcaaacgaggggcttgccaagcactacgcgtgggttcgtgactgatgccgagctgcactggcatgcagcgtcacgcgacaacccgccagcttggatctcttctaaagtacgtgtttgactcgtttgatcctggtttagatgttgtgtcgtgcttgtattaggcgtgctgcgtgcacgtgatctctgcgtgtttgtgagagagagtgtgtgtgtctagaagtgtttaagtggcctgtgaattcggtctgcgtacgtacgtagcgttctgctagctgcaactgtgttttagtagttccagacttccagcaccaatgcagagataaatcaagtgcagctaatgttggacggggaatcgacacgtcagtacttgtgcatttacgccgaaaaaaaaaaaaaaaaaaaaaaa

SEQ ID NO: 4139 - DNA, 686 bp, Triticum aestivum
  Clone ID: PAT_TA_4139
ccgcaggcggcaagacgtgctctgtttttttctaaggtttgcactgcattttgctcagcgcgaccacaatttccatgtggtcagcatcgacgtcttgccgaagcagcgctcaacgtgtcaggtcggcttcttgcagtatgtcttctcccacacggtggtgcagatcctgcgctcgttcgacgtgctcgccaatgaggcgctccggcaggggctcatggagtactctagctggcccgcctttctggagtattacatagatggtgtctcacacaatacggacagcaacatgggctctgcgttcttgagtggcgcggccatagttttcaggtggcctgcactgacgtcttgccaaagcagcgctcaacgtttccggccggctactcccagcgtggctgctcccacatggtggtgcaggctctgtggtcgctcggtgtgcccttcgcaacgctcaatgcgctagcctacccgccgctcctgcagtggctcacctccccgcagctctgcatcgactttcgagttcttcagagggtgtgacatcacagttggtatgatatatatgagatttgctctctggtctctgccttcccttctcccacgattatggcccagaactttgagactgtctgttgcagtacacgcgcatggtagcggaggcatggtgcattcttcttgtacctgatgtgtct

SEQ ID NO: 4140 - DNA, 937 bp, Triticum aestivum
  Clone ID: PAT_TA_4140
cggcacgaggccgtcccgcacttcccgatagccaccaacttcgccctcgacaaccatccatgtccgtcgccaccgcccaccacctccgcccgtcgccaccggcggcccgcgaccgcctccccgggtgcgccgcgcgcgcctcctccttccgccccctgcgccgccgcggactcgccgcgggggccaccgccggcggcgaggcgaccgccgccgtgtcggcggtcaccgcgagcgccaagagggatccggtgcggcgccacacgatttcggtcttcgtcggggacgagagcggcatgataaacaggatcgccggggtcttcgccaggagaggctacaacatcgagtcgctcgccgtggggctcaacaaggacaaggcgctcttcacaatcgtcgtctccgggacggatagggtgctcaagcaagtcattgagcagctcaataagctcgtcaacgtcttgaatgttgaagatctatccaaggagcctcaggttgaacgagagctcatgcttataaaactcaatgttgaaccagatcaacgtgctgacgtcatgtttgtagcaaatgttttcagagcgaaagttgttgatatttctgagaacagcctaactctggaggtaactggagatcctgggaaaatcgttgcggcacaaaggaacctaaggaaatttgggatcgaagaaatttgtcgaacgggaaaaattgctttgaggcgtgaaaagatcggagcagctgctcgtttctgggggttttctgctgcttcttacccagaccttgtagaagcatcgcgcaaaaatcctcttacctctgtgaataagacggttaatggcagttttgatcaatcatccagtgccgggggtgatgtttatcctgtggaaccttatgagagcttgtccatgaaccaagtacctgatgcccattggggtgttcttgatgatga

SEQ ID NO: 4141 - DNA, 495 bp, Triticum aestivum
  Clone ID: PAT_TA_4141
tctgctacccgtcgcggccggagagccccatcttcgccagcttctgcctgcgcgtgccggcgggtcgcacggcggcgctggtgggcagcagcgggtccggcaagtcgacggtggtggcgctcctggagcggttctacgacccgtcgggcggggaggtggcgctggacggcgtggacatccggcggctgcggctcaagtggctgcgcacgcagatggggctggtgagccaggagccggcgctgttcgccacgtccatcatggagaacatcctgttcggcaaggaggacgcgacgccggaggaggtcacggccgccgccaaggccgccaacgcgcacaacttcatctcccagctgccgcagggctacgacacacaggtgggtgagcgtggtgtccagatgtctggagggcagaagcagaggattgctattgccagagcaatcctgaagtcacccaagatcctcctccttgatgaagccaccagtgcactggatactg

SEQ ID NO: 4142 - DNA, 600 bp, Triticum aestivum
  Clone ID: PAT_TA_4142
ccgaggcccctccctctgcaaaatcccccaaaacacatggacggcgataggcggcctccggcggcggccgcggccgcatcggcggcatcggtcctcggcgacgacgacctgctccgcgagatcctgctccgcctcggcttccccacctgcctcgtccgcgcagccctcgtctgcaagcggtggctcctccacgcctccgacccggccttcctccgccgcttccgcgagcgcaacccgccccgcctcctcggcttctgcctccgctgccctgacgggtattctttcgtgccgctgccacagcccccggagctcgccgtccccatacgccgggcgacctcctcctgcgccgccgccttcgccatcaaaatccatcgaatcaagcactgccggaacggccgcctcatcaccaactacttcgacggctgcacacatcatcatgccatcatggcgccgctgctgcacggggaatccgcaaccgccctcccgccgatcccgctacactcccgtgactgggccaggcgcgctcaagtgagattctttgagatgttcctacccgaggatgggggcctccacggcatcaccttgctgcatctctggatg

SEQ ID NO: 4143 - DNA, 618 bp, Triticum aestivum
  unsure (1)..(618): unsure at all n locations
  Clone ID: PAT_TA_4143
ttgactgacaagcacatgaacggctcgcatggcatggcaggtgacccacctcggctgcggcggcatggtgctgtgcacggccatcaaccactgcctctgcgacggcatcggcacggcgcagttcctgcacgcctgggcgcgcgccgccaggtccgacatcgccggtggcggtgaccaccccgtcgtccacgaccgccgcgccctgcgcccgcgctgcccgccgcgcgtcgagttcacgcacccggagtattgccaaggacgccgtcgcccacgacgagcccaccctcctggagcacctgctgggccagccgctctcgccggtgtccctcaccttcacggggggcgcacctgggggcacctcaaagaagcagttgctgctgtcggcgccggcgctcaaagcgctgcacctccttcgaaggcgctggcggccacgggctcgcgtgctgcgccgcccgcgctggccccgccggccgcccgccgccgcccgcgcctctcccccgcgggcgccccccggggccggctgcccgtgctccccccgcctctcggctaangccccggngtcaccttaaagccggggcccccccatggtaatangggaatggtttnttgcccggggtg

SEQ ID NO: 4144 - DNA, 950 bp, Triticum aestivum
  Clone ID: PAT_TA_4144
accggtccggaatcccgggtcgacccacgcgtccgcccacccgcgcccccggccccggcgcgctcatggatccggcggcgcccccccgccccgcgcgcccggcggtgcggcggatggacgccgtcaagcaggccctcatgctcttcctccacagcaagctcaccatgtgccccgaccaccgcttcgccttcgcctccctccgcgacaccgtctccttgataagcaaagaattcaccagtgatgctgcttcttcaattgagactatccggtccctggctgctactgacacgagatatgcagtggctgatctcactcatctcttcaagatagcgtacgaggaagggaaaagggcagaaacgcaagggcgactacttagagtggtactcatctactgccggtcctcaaccaagccacaccatcagtggcccgtaaagccgaagaacttcaccatggacatagtctatctgcacgacaagcctactgctgataactgcccacaaaacgtgtatgactcgctggttgatgcccttgagcatgtcagccagtacgagggctacattcttgagagcggccaagggcttgcccgggtcctgttccgccagatatgcatcatcttatcgcaccccttgctacgctgcatgcaggatgaccttgacattcccaagcaagttgttaagaaaattctggccattgaaggtgtgcagagcgaagatggcgctccggcctccagcagccagtagcgagtcaccctagttcaatggtatgtgtccatgaagcctgttctgtgtgttgtaaagggccaagcagatgacacttttactgctgtggagagcttgggttggcattgaacttgtataaattgctcctttatttgcagcatatcaatcactgcaatctaccttgtattttctcggtgtcgtgaacgggtgacgaatctgatactaaaaaaa

SEQ ID NO: 4145 - DNA, 361 bp, Triticum aestivum
  Clone ID: PAT_TA_4145
aggcgacaatgtacatagatgatcatacaaccagactgcgaccttcgacattgaggaagagttgtggttccatgaaaagtgtctgctcagcctcttgcgagagccattcttgtcaccggcccccgagagttcaagagtgcctcttttatccatggttaatgaatcagtagcaacctactgttttgccatgtttttacaatcagctgctctctttcttcatctagtaggcttccataagaccacgccatatgattcgattgaataatgtgcgaaacatgatcctgtacgatttattatattcaactgaaggaaaaaaatatatactccacaccctatcataagctactctttgtcttgtttt

SEQ ID NO: 4146 - DNA, 778 bp, Triticum aestivum
  Clone ID: PAT_TA_4146
ggtgacgttccctcacggtccaagacacggggcttaaaagtacctggggaggatgcggagcggcaagaaccagatggactgcagcgccatcgccccggagatcttccccgagatcgagaagtggaagccatcatggaggagctttgactacgatgagctctgcgccgcgacggacagattcagttcagataatttgatcggaaagggagggcacgctgaggtgtacaaaggacagcttgctgatggacagtttgtggcggtgaagaggttaacaaaaggcggcaacaaggaggacaggatcagcgatttcctgtccgagcttggaataatagcgcacgtcaaccacccaaacgcggcacagctcttggggttcagtgtggaagggggcttgcacctggttcttcagttctcaccacatggaagcttggcttctcttctccatggtgcaaagggaggcctcaggtggaaggcccggttcaatatcgcacttggaattgctgaagggctattttatctacacgaaggctgccaccggcacataattcacagggacatcaaggcttcaaatattcttttaactgaagattatcaacctcaaatctcagattttggccttgcgaagtggcttcctgacaaatgcacccatcaggttgtattccccattgaaggcacattcggttatatggccccagagtacttcatgcatgggatcataaatgagaagacaggacgtgtttgcatacggagtattgcttcttgaattagtgacagggcggaa

SEQ ID NO: 4147 - DNA, 643 bp, Triticum aestivum
  unsure (1)..(643): unsure at all n locations
  Clone ID: PAT_TA_4147
cgattcggcacgagaacaaacaaccctagccttccgcgtcgcccacgcgcgcctcgcctccgccgcttttctctccgccccggaaacagactcgccgcctcccatcccattgccgtcctcctcgccggccgatggcgctggagacgcggaagctctacgtcggcggcctcccgccgtcggcgcagcaggaagaactccaggagcacttcagccgctacggcgaggtgctgcgcgtccgtgtcgtccgcgactgggagacgggccagtgccgcggcttcgcgttcgtcgagtttgccgacgacgagggcccgcgcgccgcgcttcaggagaaggagaaggccaaccatgtcttcggcgaccgcacggtggatgttaaacgagctcggaccaggccaatgcgataccaaaatgagcaatcattctaccaatacgctttaaatcagagcccaattcagagcccaattcagagcccagttcacaaccagtggtacactcagtcttctagtaacaactcatatgctggtaatggtcatagaacttgtgatccaaacaaggtctttgttggtgggctacgaggtaatgttaccaaggagcacctccagagctattttgagaagtttggtannnnncagatgttnntgnn

SEQ ID NO: 4148 - DNA, 851 bp, Triticum aestivum
  Clone ID: PAT_TA_4148
cccgggtcgacccacgcgtccgtaaatcccttgctcctctcggcgattccgctccttgccaccgcaaatccggccaagggagcctcgtccggtgcgattgatccactctgaggctctcgacgtcccatttgatccagcgtcgtgccattctggaatctggatagatttctggtccgggttgtgggcaggaaagtctgtagctgaatctctgatccgacaatggatctcgacatggacgactacatggacccctacgaggaggccgaggccgaggccgccgcggaggccgccggcgtgaccggcccagtcgccgcatccgcggacgaggagtcggacggcgaggacgactcggaggccgagagcgactacgaggagaagtcctacggccttctcaagtccggcaaacaccgggtgcgcaacccggacggcaccttccgctgccccttctgccccggcaagaagaagcaagactacaagctcaaggacctcctccagcacgccgacggcatcggcatctccagcaagcaccgccgccacggccgggagcgtgccttccaccgtgcctttgcccgctttgtccgcgccgacccgtcctttgcgcaggagctctccactatcgttgggattcccggtgccactccatctgccactgctaatgcagatgcctctgacaaaggaaaggccgttgccaatggtcacaccagtggatccagtcccgtggcagtggctgagggaccaccacaggatggcgaagagaagtttgcttggccatggtgtggaattcttgcagccggtgcagggttcaatgctgaaagctttgcagatagagtggccatgtttagcccagaaga

SEQ ID NO: 4149 - DNA, 518 bp, Triticum aestivum
  Clone ID: PAT_TA_4149
ccccccgcccgcccgccgccctcgccgtggccgctgctcgcggcggccgcgcccccgtccctcgcccgcccccggcgtcgctcctcggggccgcccccgcccgccccccgcccctcccccggtcgcccccgccggctccccgcgggtccggccccgccccctcccggcgtcgctccctcgcgccgccgcgagctgcccgcgcggacccacacccagccccgtgacgatcgccgcgcgggttgccggctccaccccccgccggacctccccctgctcctcttctcccgccccctggggcgcccgctccacctcctcacccattcgcggcttcttctctggtccctgccgcggggccccgctccggcccttggctcgttctcgcgcgtggctcacctggcctgcaggcctcggtccggcgcacgggtgttcctccgggctcgccttgccgacgaagcttttgccgatcttactattttcaggtgcgaccaatccaagtgttcatccattctggtctattt

SEQ ID NO: 4150 - DNA, 1496 bp, Triticum aestivum
  Clone ID: PAT_TA_4150
atttggatgctctgcgttttctagtcaatcaacacacatacgatttatgcagtaagaataatgaggcggttgttgcttgtcaggttcatcagggaaaggaggacgaaaacatattgcatgaaggccaagttagatagcagtattcagcatgtgacttttgagatctgtcatcctggactagcatatgcaagatagacactagtatttagaatccagcatcacacttctatattacttcatcaaaagaagataattgtctgccatcagctatctccgacgagcatttggtttttaatcaagtttgcgacgtagtcagcaacccagaaggatccagcctccgtgcagcagtagccgtgtgtatgaccttctttctcgaccgacaaggcaacccctggagcatgccttgagatctcttccaagtgagtcagtggaccccagtgatcatccacaccgaacagaaaagcaatttgagcctgttttgctctgatgaaattccagtccggctcttcatgaagcttttggaactctgtctttgccatgaaaagcacattgcgcatcgtatggtactgcaagagatggctacatccagcatcaatggctgttgcagaccaagaagatccaaggaacctttcacaatgctcctcgtaactgaagcctggagtgagccgatgaaagacgctaacaaactaacgcctttactaaggagagatgaccttgcaacatatccaattgctgattgcttcatagcattcttgttcaatgtcaaaaatggataaagccccacaaaaaaaattaccttcttctggaatcttttgcatatttccagacctatgtacgcgccaatagaatgacccaccacaattatggactgttcggtatgtagaagttcttgctcaagaaaatcaatcttgtgctcaatctgttcgtgtaatgaaaacaatcgtccgtgctcgtaatccttctgcccatgtgaaatgtgccctatcgccgtgacagatgcctgcccaccgaggttttcatagagggcttggacaaagtccctgtagaatccaacaatacctggattgccggggacgaccagcacgtggagcgacggggacggctccctggatctgatctcgagcagctccgtggcgaagctagagaccatgcagacccgggccgtggcccgcgccctcgggggggacggcgcgaggagccccgctctctccatgccggatccggcgctcggcctcgccccgccgccgccgcaggccgccggtctaagcagcctggggagctgcccgatggagcgccgtgagagccgggcaagtcaggggggcgataaggtcgggggaacagcgcctacctacctgggctctgcaccatccggacggagcgcaggggaggaggagtggggaggcgggcgccggcgactcgcctcgccgggagggtgccgcgcgccgccggggaagagagggctcaggcttcagagcgacagtgaagactgagcgggt

SEQ ID NO: 4151 - DNA, 553 bp, Triticum aestivum
  unsure (1)..(553): unsure at all n locations
  Clone ID: PAT_TA_4151
ctcgcgcaaaccttctccctcccccctgnagctagcatctctctccttctcctctctcccctccaagctccatttccggtttcccacgtcgtgtagggggctttgaagacccgcaaaaatggcgaactctgcatctggtctggctgtgcacgacgactgcaagatcagagttctcggacctgaaggcgagacgaagcttcaggttcatgcgtgttcaagatcgacgagaagtccaggggaaatcaaggtggagaggctcggtgagaccggttacggctacgaagaattcacaaacagcctcccagctgacgagtgtcgctacgctgtctatgacctcgacttcgtaaccgacgagaactgccagaagagcaagatcttcttcttctcctggtctcctgacacggcaagaacaaggagcaagatgctttatgcgagctccaaggacaggttcaggagggagatggacggcatccagtgcgagatccaagcgaccgaccccagtgaaatgagcctcgacatcataaaaagccgagctcactaatgaagcacaagt

SEQ ID NO: 4152 - DNA, 1215 bp, Triticum aestivum
  Clone ID: PAT_TA_4152
gcacgaggcccgcgccctcccccgctcctctctcctcccctcggctcacgcacggcaaagtcgcctcctccggcatggccgccgccgccgcagcgacgctcgccccggcctcccctccgctgctgcccgccgtctgcggccggctgcgcctcgcgccccgccgcgccgccgcgtgccgctgcagggccacggcgcagttccagggcggccccgccgccagctacgcccgcgagatggagcgcctctccgccaaggagtccctcctcctcgccttcagggactctggaggcttcgaatcctttgtgagtggcaagaccacggagatgcagaagatcgacgtcaatgagcgcatcgtcggcctcgaacgcctcaatcccactcctcgacccacgacatcaccctatctggaaggtcgatggaacattgaatggtttggtgatagcagtcctggaacatttgcatccaagcttttgtttgagaggtcacctacaagtgtcgcacactttacggggcttgatgtggtgatcagggatggctactgcaaaatttcctcgaacgtcaagctgttgaatacgatacaaaacagattcgtgctgaccactcaactgtccgtggaggggcctatcaggatgaaagaggaatacgtcgaggcatttttggaaactcccaaaatcagtgaagaaacactacctgaacaactgaagggcttacttggacaaactgcaggagctctacagcaacttcctgcctctataagagatgctgtttcggagggggttaagctacctcttaatgggatgtaccagcgcttattcatgatttcctaccttgatgaagaaatactgattatccgagatgctgctggagcacctgatgtcctgacaaaactggaagggccgcaaccaaatccaatggagaacacgccagacgtagtgattcctgaatatcaaagctagtgtttgggcactaaccggagcactatggttaactttttcggagatgtcttttctgtcttgccactttccaggttttcgcatacatgagaaagtagtgcatatgttagcagtcacttgagtgtgtaaactcaagctcctttttgctgctggctagagtagttactgctatatcctggaggtgagcaatactcgagcactcagatgcgatgaaaaattagctgtgcgaaatgggcaggaaataaaaaaaaaaaaaaaaaaa

SEQ ID NO: 4153 - DNA, 619 bp, Triticum aestivum
  Clone ID: PAT_TA_4153
gtcccctccccctccaccatcaaaaccctatttccggcgggccgcgcactgggtgcggtgctggcgatggccgacggcgtcctctcgcctgccgtccacccgaacgggcactccccggagttcgtcttccggcactaccgcggccgccgcgccggcattgtgaaggccctcaccgaagatgtggaggagttctaccagcagtgcgaccccgacgagaaggccttgtgcctcgttggactgcctgatgggacctgggaagtgagtcaactacctgaggaggtccctgttcaacttcctgagccagtatgtgggataaactttgctcgtgatgttacacccaagaaagtttggctatctatgatagctattcatagtgatgcatggttaatgtccatagcattttaccacgcgggtcgtgtctcatttgacagagttggcagggaacagctcttcaggttgatcaatcgtcttcccaccgtctatgaagctgtgacaggaagctatgaaaggcaagcacagacccccaacggcagcaggaaaaataagtccagctcccagccaccaaaccaattcacttctaactgcaagccggtgacaccggccctgccgatgcccaagg

SEQ ID NO: 4154 - DNA, 1340 bp, Triticum aestivum
  unsure (1)..(1340): unsure at all n locations
  Clone ID: PAT_TA_4154
gagggttttagcccagccgcagtccctctccaaccttcgctcgtgctctgctctccgtgcggaaggcggctggccggcggcagctacgtcacctggcagcggcgggcgaccggacgacgtacacgcaggtctgctaaaggagagcaacatggcaacacttaaagatgtggcaacgcggaagcctattctagcgacaatccgcctcctagttcctgctggagcagcccgtcccgcaccccctgtcggaccagctctgggtttctacaggctcaatctgatggctttctgcaaggatttcaatgcaaggacacagaagtacaaggcggagactccgatgcaagtcacgctgactgcctacaaggacagcacttttgagtttgtagtcaagtcgccctcggtctcatggttcctcaagaaagcggcgggcgtcgagacggcaagcagccggccaggccacaacatggtgacgtccctctcgctccgccatgtctacgagatcgcgaagctgaagcagtcagacccgttctgcaagcacatgtcgctcgaggccctgtgcaagtccatcatcggcacggccaagtccatgggcatcgaaatcgtcaaggatctctgaccgggcctcgagcatagtttatgttgctttcatctgcagctggtctgacctggaagaaagtagggatcagatttctttccggagaaactttgctgctagatccgtcgaaatcgtgcccctgtttattttgtgatcaatatgtactatgtgacatttcttcagcgcggtggtggttgggtaataagtttgtttcagcctgtgtattgtgtaactctgggacagaggcttggcaccactggacctgtataactggaaattgcaacttgaacgccttccattccatgtgaagatgtttgcttggtaaggagacattgttggcatggaaaaaaaaaaaaaaaaaaaatgtctgctcgaggccctgtgcaagtaagtccatcatcggcacggccaaggccatgggcatcgaaatcgtcaaggatctctggccggggctcgcgccgagttcatgttgctcccatctgcagccgcctagtttcatctggcctggaagaaggtagggatcagatttcttttgaaggagagaacatttgctgctagatccgttgaaatcatgcctcccttttctgtgatcaatttgtaccatgtgacacatttcttcagtgcaaccacatgaggttggtggttggctaataanttgtttcagcctgtgtgttgtgtaactcctggggacagaggcttgggcaccactgaacctgtctaactgggaatnactttgaggggggggggc

SEQ ID NO: 4155 - DNA, 503 bp, Triticum aestivum
  Clone ID: PAT_TA_4155
cccagctcggggctgggacgccggcgccgcggcggcatgcggcggcggtttccgcgttcctcttcctgctgctcgtggggcactgccacggcggcaagaccggcatctgctacggccgcaacgccgacgacctgccggggcccgacaaggtggcgcagctcatccggcagcagtccatcaagtacgtgcgcatctacgacaccaacgccgacgtcatcaaggccttcgccaacaccagcgtcgagctcatggtcggcgtccccaacgccgacctcctcgccttctcgcagtaccagtccaacgtcgacacctggctcaagaacagcatcctcccctactacccggccaccgccatcacccacatcaccgtcggcgccgagatcaccgagagccccatcaacgtctccgccctcgtcgtgccggccatgcgcaatgtgcacgccgcgctcaagaaggtcggcatgcacaagaagatcaccatctccagcacgcactcgctcggg

SEQ ID NO: 4156 - DNA, 354 bp, Triticum aestivum
  Clone ID: PAT_TA_4156
tcaataactctgataacaggcaatcacgatgtacaaggtgaagaaggacaacaagaggaggaaagacaagcaatcgtcgtcatccggatcaagtaagttgaagccccagaagaaaatccacaagaaatcttcaaagaaaaccgcttaggtgcacatcatcgttgaggcatgccgtgctgtaggcggcgagcgcagtttccaagcatcaaggagtgccttggcaaattttgtatggtcattgtcctgtttaagtcccaagggagaaatattgttatcccggttactactggttatgatatgacgcaagaagctgagtgccgtgatgacatagctgtacacgtattatattttcag

SEQ ID NO: 4157 - DNA, 1236 bp, Triticum aestivum
  Clone ID: PAT_TA_4157
cgggcgcgagggacagctcctgcaccccagcaccagcggcgcagccatgggcggaagaagccgccgccgccgcctccgcctccgccaccaacttcgaggtggacctgggccacctcgtggcctacgacccctcgccccacctcgccgccggcgccgcgtcggcccgggcggggctgcgggacgagcgcctgcagaaggacacggagctcgcccaggccaacgccaacgcccccctgccggtcaccgcgaccgaggtccgcgacgtcgcccgcctccggccgcccacgccctcgatcccccgcgccgagcagtagccgaggccaaagcccccgcaccatagtgggaggcatgttcgcgaagtggaaagggattatcaagcacaagaagaaaaagcgtgcatgggacgagcaaactaattcctgtaagcggacttacggctatgatcgtgtcaatgatgacagagatgttcccatcattgaagccaaattgacagatgagcctggtgttgatccttttgctcaaagaagggaagagaagaagggcagggtagataaacaagaaaagaacagacttggaaatttgaagaatgctgcaaaagttggtgctctgccaagtcacatacagcttgctgccacgtccgtgcccatcacagggacaaaagctgatctgcctagaaaagctaagaaggaagatctcgagaatgttgctggtatggcttctgcagcaactgctagcggtggaaagtttgacaaaaagttgcctggcgagaaacctcttaagaaggctggcaaaaatagaaagttcctccctgttgtacaagggaaaggaatgggcaacctggagaaacagcagaacgacaagatcctgaacagtctgctggccaagaactttgaggagccgttggatgtcagcaaggcaatcacgatgtacaaggtgaagaaggacaacaagaggaggaaagacaagcaatcatcatcatccggatcgaataagttgaagccccagaagaaaatccacaagaaatcttcgaagaaaagtgcttaggtccgcatcatcctcgagacgtggtttgctgtaggtggcgagcgcagtttccaagcatcatggagagtgttggcaagttttgtatggttgttgtcctgtttaagtcccatgggagaaagattgttaatccagttatactggttatgacacaagaacctgagtgttgtcagaagttttggaaaatatttctgg

SEQ ID NO: 4158 - DNA, 1720 bp, Triticum aestivum
  unsure (1)..(1720): unsure at all n locations
  Clone ID: PAT_TA_4158
tgatgctgaccggnagccttctttccgaaacaagnaaaatgtattatacccggcaaaggacccaaaggagtacatttaagcgaaggaagatgttggatcgtcattcaactctagtatctgaagaatttgcaaaatcaaatgcaaagagaaccacaaaggttaatgcaagagaaccacatgctgcttccttggaagcaaataagggcagcaactcaatgccattccatggatcttgtaaatcaaacgattgccatgtgaaacttaagatcaaatctttcaaggtgcctgaacttctaattgagatcccagaaactgcttctgttggttcactgaagaaaactgttctggaggcagtaaatgccatgcttggaggtggtctgcgtgtgggtgttcttcaccatggaaagaaaatcagggatgatagcaaaaccttaatgcaagctgggattggtcatgatgatattctggacaacataggcttttcactggagcccaactgtacacggcattcatcacaacttgcagctcctgaagatatcgaattcctagaaactgttgaaaccactgaacccctagcaaggatcgcacctgctgactcatcctcgaagcacggcgaagtagatgcctcacaggagcttgcattgacacccttgacagctaattaccagggaaatgatcatgattcagtgcactctcctgggggcatctcctcacctgagaaagcttcagcaaactcgcgagctattgttccagttacacctgtagattccagcgcaggggcgatagttccagcaaacaaggcgaagagatcagcggaacaggggcagcgtcgaatcagacgtccgttctctgttgctgaagtggaagcacttgtgcttgcagtcgaaaagcttggaactggaagatggcgagatgttaaacttcgtgcttttgataatgccaagcatcggacctatgttgatcttaaggacaaatggaagacgctggtgcacacggcgagcatctcgccccagcagcggcgcggtgagccggtgccacaggatctgctcgaccgggtccttgcggcccagtcctattggtcccagcagcaggccaagctccagcctaagacgcccccactggctgaggctcgcctgctcacctaataactcccatctcagcaaatggtctcttaagaaaccattccagcttttgtataaagtcagtaagtcagccagtcagcccattcaaaggaggttaaggaagatagtagaaaaatatatactacataaaaaaaaaaggtacaagaagtattgaccgaccgaaaattgttgtaatatctactcaccaactattcttttaagccagggttctctctccttgtgaatttaaccaaaggaaagggtcgagcggccgcccgggcaggtacatgatgatgatggaagaagaagatgattcattccatgaactgagatctgcagtgaccactactaactcacaattctctgcaattgtgctaaaaaagaagagcttcagattcttttgttcagttcaattcattctttgttaagaggatgagaaaggtggacggataaggagggaggatctgtgctccccttttcctatttttcttcttctgttactacttagttgtacctcggccgcgaccacgctattgtagctattttgatcccctcaacattgtacttgatcaactaacaatattaaaggaattttttat

SEQ ID NO: 4159 - DNA, 1368 bp, Triticum aestivum
  Clone ID: PAT_TA_4159
gtaattctccacccgcagccgccgtcgactccaccgcgtcgtcccctcccccgcccccggccccgcccgccagatctcctccgcagtccccaccggagccctcccccgcccgcgcccgcgcgcgcacgcaagcaggcgagcacgccgatggcggcgtcgaaggcgaatctggaggcgattcaggtacgtaatgtctatcccaccctctgacagacagacctcgccaacgcaacccaggcagacttcccatgctgacgcctggcgctctggcttggggccatgggggtcatacatgcttcgtaaaaatgcttcctacaatggcacttcaaagtgtacttgctgtgctggcgagatgtgatgtatttgtgagtttggtgaaagcgaatgctgagaattcatgctcggaattgaggtgtttctgtgctttggtaattcagttgcttcaacccgcttcttgcttcaagacgaattcaacatacagacaaccaagtgtgataactgcatcattggtttcatgttctgccttcaacaagttgcttgcatcttctcaatagttgctgctattgtcggtagtgaggaactttcagaggcttcccagatcctttcctgcctgtctgatatggtctactgctcggtttgcgcctgtatgcagacacagcacaaggttgaaatggacaagagggatgggaagttcgggccacagcccatgcaagtgcctccaatgcagcagatgtcacgcatcgatcagcctgtccctccacccgctggctatgcaccacaaccagcatacggccagccttatggtgcctacccacctcctccagctcagggttacccaccgccgccagctcaaggctacccaccggcaggttacccgccagcaggttacccccaggcccagggcagttcataccctccacccggttcgtatcccccacctggttcctacccccctcagcagggctactacggaaagtaaagtatgtgcagcgatcggagtggtattcgttggtgaggcaacagaagtatggtgaacatgtaaacagtagggactattgtagtgatatataggtgatgttaaggtactcgtcgatattggtctgggtgctgaattgggaaccgcatttgggtctcctctgggtggtgaactgtctctggatttcttctgggtggtcattggtcgactatgaactgcatcacatctgtagttcctctgggtgttaaaattgtgaactcttcgcattccgagtatgttgttctccgaataaatatgagcggtggtgtgttactaagctgtgcttgcagtgttggaaggtttcatctaaatctgatgatgaatttgttggtgcacaacaaaaaaaacaaaca

SEQ ID NO: 4160 - DNA, 459 bp, Triticum aestivum
  unsure (1)..(459): unsure at all n locations
  Clone ID: PAT_TA_4160
gcccgctcgcccgccaccggcattgatccggccgggcgtcgtgagactgggcgtctggtgggcgtgattgcaggagctttctctctttacaggctcgtgccgccggcctctttttgggccgtctttaataatcctcgcctctgcttcctgaatcttgcggacggtctctgcttccgttcttgatctcgttcccccacccccaaatacgccattcgctggtccttcttttccccgtcaatcgcctctcgagggattcttgctccttttggtccgagccgccgagcaattcttgggaattcctgcttctccttcccagtgtggaatcttccaaacaaggggcgaaaaaagggggagggagaggaagaatccgccctcctcccttttgctntaggatatctatataaactgttcttagtgggggtactggaaaaggggggcgaaattgggaggggattggag

SEQ ID NO: 4161 - DNA, 1887 bp, Triticum aestivum
  unsure (1)..(1887): unsure at all n locations
  Clone ID: PAT_TA_4161
gagcaacagtgtttggcatggaaaagacttctgacattcgagaaggggaatcctcaaagaattgatgttacagctgctaataggcgtattacctttacttatgagcaatgcctaatgtatctataccatcatcctgatgtatggtatgattatgctacatggcatgcaaagaatggttctacggattctgcaatcaaaatatttcagcgtgctgtaaaagcactccctggttctgaagtactaaaatatgcctttgctgaactggaagagtctgtaggggcgatccagcctgctaagacaatatacgagtctcttgtagctgaaaattcaagcatgtcatcacttgcacacattcagtttattcggtttccaagggagaacagaagggcattgaagcagctcgcaagtaactttttggaagtttccgaagttgccaagctgcacttatcatggctatggtgcatatgctacaatgtcgtttgcccccgacaaagatgcgaagtatctgctaaatattctcttgtaggtggctcaaaatgtttttgaagttggtttaaagcgatttatgcaagaaccaggatatgtccttgaatatgcagacttcctgtgtcgcttaaacgatgatagaaatgtacgtgcattgtttgagcgagctctgagcttacttcctcctgaggaatccgtagaggtatggaaacgatttgctcaatttgagcagatttatggggatttgtcaagcatgttaaaggtggaacaaagaaggaaggaagctttatctaggacatcagaagatgtcgtatcgtccttagagaacacactttatgacgttgtttctagatataattatatggatctctggccatgctcatcaaaagaattggattatctgtcaagacaggagtggcttgcaaagaacatgtctaagaaggctgacaggtcagttatgctaactagtggtggcggttctaccttagataaaggcactgttggagttggtgccaatgcaaagttattgccgcagtctacaaaagtcgtccgtcctgagacttctcgaatggtcatttatgatcctagacagatgaaaggaccagtgatttcagccacatccagtgggtacacaaaggaggttgacgaaatattcaaaatgctttctccaccacttcatgtctttcatcacaaatttgcctgctattgaaggtccatcaccagatatagacattgtgcttagcgttctactgcaaagcacactgccaacaggacatgatgttggcaaaccgtctgctccagttcctggccgtgccacaactgatatctcaggtccccgcaaccaaaatggatcagttcgtagacctccaaaaaggaaggctgttgaaaggcaagaggaagaagacgcagcagcagctgcgcagagtcgagccctcccgccgatttccgcgcgcgggcagatccagaggagccgcggtgggggccctgctcagtctggatcggcggcgatgtccaagtggaagcatgttttccggggaacagtcagccaacagctcaagctagttcaccaatctgtagctagttctttggattcacgtagttcgttcggtagctatgtagtttggccgctcatggggaaagttatgcatgtacaaatgtaacagcaagactgataaacctgtaggcatggcaagtgcattgcgcgagaatacgaaccgaaagtccaaaaaacgacaggagcgtgcagaatcagtgtcatctggatgagtaaaggccaagatcatggagaatagcatgatgtgactaatatgcatttgaagaagataacatgtgtatgtattatgattactgggnaaagcacgaatctgaatactgcgaaatactaatagttgtgtcaattca

SEQ ID NO: 4162 - DNA, 238 bp, Triticum aestivum
  Clone ID: PAT_TA_4162
tcgagcctgcagctaatcataacagccactcgagcactcgattcgatcctctctcgagctctccgttcttcgatctccgtccatggcgccgtccatcaccattgccgccgcgccgccggcctctggctggaagagcggccggaaggccgtggcggcgccggcggagggcgaggcggaggcggaggcgctgctgctgcgtcgccggaacgccgagctggagcgggaggtggcgctgctg

SEQ ID NO: 4163 - DNA, 488 bp, Triticum aestivum
  Clone ID: PAT_TA_4163
ggtggtgggccgtttggggttgcctctcggtgggctcgtgttcggcatgtatatggtagcgcctcgaaggggcttgctgcttggcgccggtggtctacgcggttctttgctggtgttcctgacctttcggctccgctgccccggcctcacttgttcgcggtgttgggcatgtgggccggttctgtcggtctcgacggggccggaggtcctcgcggtcttggcctggttttccttagctttctcctccctggactcggcctcgcttgccccctgcggtgttccgcatgtgtcccggttctttcggtttcggcggttcctttggtccggatatatatataggtgtctgttcgtcttcttgccgggttgctttgttatccttacgtttgcatctatgttacaggtgttagctttcatggctaggatttttttagcatattcaaatctgtattagaataaggtttcccccttggatgttccttatgtatcca

SEQ ID NO: 4164 - DNA, 578 bp, Triticum aestivum
  Clone ID: PAT_TA_4164
gacccacgcgtccgccagttatcatccccgcatctaggtctccgagcaagctccactcgtccaacctccccgccagatgatcgcctccagcgctaccccgacgggccgcgccaccactccaacccccggtgcccagtcccggtggccgcgtgccgttgcgcagctccacctggctctccgctcgccagccgcgcggagtggtagcagcgggcgctggatgggatgcttcaggccggcgccggtgcccgcgccgtcgtcaccggcggttacggtggcggtgaacgaggggagggggaagcggccggaggcaacggaggtggatatggagccggcacgcggcggaggggaggatttatggagcgttcaggccgaggcggaggtagcgcagggtggggagtacccggagcaccttgtcgtcatggtcaatggcctcgtggggagtgcggatgactggaagtttgcagctgagcagttcgtgaggcggatgccagacaaagtgatcatccaccggagtcaatgcaactctgctacacagacatttgacggagttgacttgatgggagaaaggttagcaaacg

SEQ ID NO: 4165 - DNA, 795 bp, Triticum aestivum
  Clone ID: PAT_TA_4165
tattttcaggagttagtgtcatgctcatttcttcagcaaggaggagaatggcctgattggtttacaattcctgacttgttgcatgatttattagacaagattagtggaacggaatgcttcagaatcgagaatgcaaggagtcagagaggagaaggatggaaaggagatgttccccaagacgtctgccatcttcttgtagagaattatgatggagaattgattactgaaaagatccttggattggaaaatttacacactctcataatttatgttgttgaaaggggtacttcagtggaggaaaacgtcatggacagtatatgcaagcggctgcataaattgcgggtactggcggttgctttcagccgggaacatcttccaatcacccaacccaagaagttcccgttcccagaatccattggccagttaaaggacctatgctatcttgctttcaggacattcgaatgcaccgtaattttaccaagcacactaacgaagaaacttcaccagatccagctgctagactttggtaatcatagccatggccaaatttgggaatttacccttgataaccttattaacctgcgacacataatttgtgagaagttggaatgtcctaacataggcaggctgatctcactccaaacgttaccaagcagcaggttcacaataaggaatgaaaaaggttatgagataaagcagttgagggacctaaacaagcttcgatccagtttggacatttatagccttgaaaatgttaaaagcaaggttaaagctgttgaagccaatctaactgcc

SEQ ID NO: 4166 - DNA, 1954 bp, Triticum aestivum
  Clone ID: PAT_TA_4166
cggcgcggcgcccacccacccacttcgccggtggcgggaggagctttggccggagcctcccccgccgccgccgccgccactctcaccgccgcagcgccgcaggaggaggaggaggagggagggagaagccgggggacgaggccatggggcacggggtgagctgcgcgcgcaccggcgacgagcacgacttcttccgcgcggcgcagctcggggacctcgacgccctgggcgcgctgctcgccgccgacgcctcgctcgcccgccgcgccacgctctacgaccgcctctccccgctccacatcgccgccgccaatggccgcctcgaggcgctctccatgttcttggatcgcggggcgcagcgggacgccgtggatcggcacaagcagacgccccctgatgctcgccgcgatgcacggcaagatcggctgcgtggtcaagctcctccaggccggcgcaaacatcttgatgtccgactcggtgcaagcgcggacttgcctcccccacgcggcctactatgaccacatcgactggccggacgccaccctccccgcggctgggacgacgcgcggggactgtccatgggggttcgccctgttcgtcaactgcggggacgaccactgcaccacgccgttgcatcccccggccaggcatggccggccgcgctgccggctcctggtgctggagaacggcgccatcgtgtcggcattgaaaggatcatatggtttccctggtagcacgtcgttgcatttggcagctcgcagcggggacttggattgcatccggaagctgcttgcgtggggagctgatcggctccaaagggactctgctgggagaatcccctatgtggtggcacataagcgcaaccatggggcatgcgcagcattgctgaacccttcctcggcagagcccatggtctggccttcccctctgaagttcatcagcgagctcgacccggaagccaaggctctgctggaagcggccctgatggaggccaacagggagagggagaagaagatcttgaaggacgcaaagtgctcgccgcagtcccctttgcaatacgatgatgatcacatcgacgacgacatgttctcggaggtgagcgacacggagctgtgctgcatctgcttcgaccaggcgtgcaccatcgaggtgcaggactgcgggcaccagatgtgcgcgccctgcacgctggcgctgtgctgccacaacaagcccaacccggcgaccctgaccctgccctcgccggcgtgcccgttctgccgcggcagcatctcgcggctggtggtggcccagacccagacagcagacaacggcgaccccgacaggccagcctccccgcagctcgcgcaccggcggtcccggcgctcccacaacctcagtgagggcagcagcagcttcaaggggctgtcctcggccatctccaagatcgcgcgcggctcgagccggatggccgagagcgacggcgctgcgatggacaagcccgagcacgatctgtgacggaggcagaacacacacacaagacggacattgccagtgagctcatattttggattccccggcttctgaaaatcccagatgatgagaagagaagcggaaaaattccatggaagctttaggtaggaaccaaataagcatcctccatttcccacccatccttttgtttgtctgcctgtatttttggagtcgccggccaatctcggaaatgcatataggctgatctctgtgatgagatgagatgaggggagctgttcatcatcgtctggtgttggcgaatgatgcagagatctgatctgactgtgggagctgccattgctgctgcttcacagtccaatgatatctgaatctggcctgccgcggccatgccatggcatgtgagcgctgtcccccactgtcctgtgcgttggatcacggccatttttggcccttaatgcctgttgtttaatggcaccgcggc

SEQ ID NO: 4167 - DNA, 1355 bp, Triticum aestivum
  Clone ID: PAT_TA_4167
gcatccataaacatggggacattacataagcagacattacatagtactatattagaaaatactaacaaacacatatgtacaaaaactgaaaaagctaaaagctaatcagaaaagaaaacgaaaaataatggtaataggccaaaacagaacagcctactaccgtggcaaagccaccttctttcttttcgttttttatttttttttctctgctgctcgtacaacatggattagtggctagtgtgctggctgtccaacagccatacacacgcacgagtggatagggaggcgacgggatacttcgttcccatcgacaatcatccccaatccaactcgagcggtggctgtctgcatcactaccaccaatctccgcctccagcgactgcctcaccggcgggaggtcgacggccccggcgcagcacctgcctcctccgtcccaggtccgccgccgtgcggcggcccgggggcgacgccgttggagtggccgttggccagtccgagaaccaccgcgcggctgcgttgcagctcggcccgcggcactatgtgccagcggcggggcgccgatgggccagtggagctgctcccccagttgtccaagaacgtccccgaagcgcagcagccccgcgcggggaggcgcagccccgaggctagcgctccaccaagaagccccagcgccggccgcctcgtgcgccggcgtccgagaccgaagacgccgggagtccggctgcgcgggctccgcgggcggcgcaggcccggcctcctccggctcctcctggtcttgtggcgggggtggctgcaggaccatccatggcccccaaccatgcaccgggcacggacgcggtggtggaggagccgcaagttccggctcaacgtcgacgtccactgcgtcgtccgcgggctccagtacctcgtccgcatacaggtttggagcggccagtccggcaagaatccaggccgggagtggcgccgccgcccgcatggccggttcgggcggagccttagaaggcccagcaccatcgcgacctcgggcgccatgtccaagacgtggtccgcggcgacggaaaccgttccggtggcctctgaaccggcgcagatcacgggcgtggcggttgtggcggcgaagtccaccaacaccatggcgacgacgacggccctgtcggcgtctaccgccgctacgaacaaggtgcaggaagaaggacaggagaccacaaggcatcctctcaccttttccttttttcctttctggctctcttttccggctactgtcgccggcgtgatttgcctatgcgtgctctgggcagagacaagtgctgataacgtgttaaagaatgatttgatggaagtgtccggacgcgtgg

SEQ ID NO: 4168 - DNA, 681 bp, Triticum aestivum
  unsure (1)..(681): unsure at all n locations
  Clone ID: PAT_TA_4168
aagaataacgaaaantattaccggcgcgctcgagggagacctcttatcaggacncgcgaganggagccggcccgancatgcttctgacaccncgttnttgtacncagacgttatgcgcgccaagaccgagcagacccgtatttccggtcatntncnccgttcggtngtctcttcgctcccnttccgcggctgccggtgttgctcccnatgacttcttctcgtgccgaattcggcacgaggccaacgcccttgttcttcgttctcttgttcattccctgtaggtatcgctctcaaaaaggcagttagaaatcgagagatttctgtcgtgaccctgcacggggcgaggctgccgcttggaagcgcttgcgccgggctgatggccgccgcggtagcgggcgccaccacgccgaaccgagggctgcggtcgttgaactcgcgagcgagcgagctcgtagccaggcgccgatagaatcgctccgccgggagcgtgctgataacgtgttgggacttgtcgtcgggcgagtcgacagagacttccagggttcgttctgcatcttggttgcactctttcgtactggggattcggatgcgtccttggcacgcgacggttccatggggcgccgccccgaggggccgctgccaatatgggaagcggggattatcccttaataaccactgggt

SEQ ID NO: 4169 - DNA, 672 bp, Triticum aestivum
  unsure (1)..(672): unsure at all n locations
  Clone ID: PAT_TA_4169
ggaaggagagagaaacaaaggtggtagatgtgagccaccctctttgtatccctcgccaacttctcctaccaacttcttttcctctcccctcgtctcgcggccgctgccgccttgccttgggccgccttttcctactgccgccgccggccggccgaagccgccggtggcagttcaagtatggttagcttgaggagacgtcgactattgggtctttgttctggcaaagattcattgccagttgatcttcctaagcctgttgagaatgaaaagcatggggaagttgaacatgcaaatgtcaatccgctcagtgtgcacccactgcccttgaccaaggacttctgacgtacttccagaatcctcaaatggttccgactctctgaaagaagagaaaaaccaatactatccaaggtaaggagattaagcgcagaaagcgacatagaagaaagcagtatgtggaccaagaagccatgcataatgagagggtctattcaaaaatatgaaatggcaagctgctataaaattgacaagaaacaaatcactggggtacgttggaacaaggatgaggaagccggctatatgaaaggtgctttagtgtggagagaccaatttgacctccgagaagagaaacaccggtagtacctggcactcggataaacagacatacacaaaaan

SEQ ID NO: 4170 - DNA, 1960 bp, Triticum aestivum
  Clone ID: PAT_TA_4170
cgtccgcggacgcgtgggcggcgatttattaggggacgtcctcgccagcttgctccctcgcgttcccctccgagtattcgccgcttctccccccgaccctctcgatccgcccaccttccccttccccttccccacgcctgtggtagccgcgtgctccggccatggcgttcttccggggcctcgccgcggtctcgaggctgcgatcccgtatggggcaggatgccaccacgcttggtggtgtgagatggctgcagatgcagagcgcttccgatctcgatcttaggtcccagctgcaggaaatgattccggagcaacaggaccgcttgaagaaactaaagtcagagcatggaaaggtccagcttggaaacataactgtggacatggtccttggtgggatgagagggatgactggaatgctctgggaaacatctttacttgacccggaggagggtattcgatttagaggtctctctattccagagtgccagaaagtactgccggctgcagttaaagatggagaacctttacctgagggtctcctttggcttcttttgaccggaaaggtgccaaccaaggagcaagttgatgctctatcaaaggagttgcttagccgttcgattgttccaggttatgtctataaggcgatagatgctctccctgttactgctcatccaatgacacagtttaccacaggagtgatggcactccaagttgatagtgaatttcaaaaggcttacaacaagggaatgcccaaaacaaagttctgggagcctacatacgaagattgcttaaatttgattgctcggatcccacaagtggcttcatatgtttaccggaggattttcaaggatgggaaagctattgcagctgataatacactggactacgcagcgaatttttcacacatgcttggttttgatgacccaaaaatgctggagttgatgcgcctatacataacaattcacactgatcatgaaggcgggaatgtcagtgctcatacagggcatctggttggaagtgctctgtcagatccctacctttcttttgcagcggcactgaatggtttggctgggccactgcacggcctggctaatcaggaagtgttgctatggatcaaatctgtaatggaagaaaccgggagtaacattacaaccgaccaacttaaggaatatgtatggaagacactgaagagtggaaaggttgttcctggctatggtcatggagttcttcgtaatacagatccacgatactcgtgccaaagggagtttgcgttgaaatatttaccagaggacccacttttccaactggtctccaagttgtatgaagttgtgcctccgatcctcactgagttaggcaaggtgaaaaacccatggcccaatgtcgatgctcacagtggagtgttgctcaaccacttcggattaactgaagcacggtattacactgtcttgttcggtgtctcaaggagcataggaattggatctcagctcatctgggaccgtgcccttggcctaccgcttgaaagaccgaagagtgtaaccatggagtggctggagaaccactgcaagaaggctgcggcttgaagctacaccagttcttcgtcttacaactcgagtggcctttgatgttaataattcgacgacataaattaggcacgtttagcctcattttcccatctttttcctgtccaataactggagcaagaggggctcccagacggtagaattttgtacccaagtcggacaatctgtcaaacttggcatgaaagattaggacacgatgcttgggctttgtgtcgctcggcaacgtttttgtactttatgttgctcgagttttgaaccacaccagttacggaatacggcagaataatctgacatttctaccgaggtgtttgtatttgcgagttatactatgcaattacgttttgtgtgcaaaaaaaaaaaaaaaaaacactcctgaattc

SEQ ID NO: 4171 - DNA, 581 bp, Triticum aestivum
  unsure (1)..(581): unsure at all n locations
  Clone ID: PAT_TA_4171
tgacaacctccccctccccctctagcaacttgccaagccactccggcaaccatggcctcctcaaggtctctcagcagtcgcagcggcgcaatgctggccggcgcgctgctcctgctgttgtctacggcctccgccgtggctcagctgggcgtgggcttctacagcaagacgtgcccgcacgtggaggagatcgtcaggcaggagatgctcgggatcctcaaggaggcgcccacgctcgccgggacccttcctccgcctccacttccacgactgcttcgtccggggatgcgacgcttccgttgctgattgactccaccgacgccgccagtaacccggcagagaaggacgcgccgcccaacaagagcctccgcggcttcggcgccgtgcaccgcgtcaaggacaggctccagtccgcatgtcctaacactgtgtctgcgccgacgtgctccccctctgggccccgacgccctcttttcccctgcgggcccaaattggccgtccgcccccgcacgggggcccgcccncagcccatcnctaacagaaaaaccaagnttcccaaccaactcaaanttaacggctnt

SEQ ID NO: 4172 - DNA, 1160 bp, Triticum aestivum
  Clone ID: PAT_TA_4172
gcctccccccccccccctcccccgccccttatactctgtccattagagctctcgcagtctcctgtctcctccctccccgctataaataaaatcgagagccttcctccagggcgagccgctctgtgtccagccagcagcggccgtcggcaagtacgtacttggtggttcggtttccctcgagtcgcggcaatcagtcgaggacggccggtcggttgaggaaggaggggaagcggcatggactgcggcggtgaggagcaggcgaggcagaacggccatgccggcgacggcggcgacccggccgagtggaagatggtggccgagctccgggccgtggtggaggcgcaggaccccgcagccaaggaggaggacgacttcatgctgcggcggttcctgcgcgcccgtgaccacaacgtcggcaaggcgtcggcgatgttcctcaagtacctcgcatggaagcgcgccgccaagccgtgcggctccatcaccgaggccgaggtgcgcggcgagctcgtgcaggacaagctctacgtgcagggcttcgacaagacgggtccgccccatgatctacctcttcggcaaccgccacttcgccgccaagcgcagacctcgcggaggttcaagcgactccgccgccacgcccgcccccgcgccggcccagcgctacgttgtctacattctcgacaacacctgcaccaagttgccggcggggcgggggacgcgagctgcgacatccgggcaaagctggcggcggtgggcctcctgcggcactccggcccggcgcgcggcgttggagatcatgcagaactagtgccttacgtgttcatggcggcgtggaagatggtgtaccccttcatcgacgacaacaccaagaagaagttcgttttcgtagctgacaaggacctcgacgccacgctccgggacgccatcggacgtgtctcagctgcccgagcagtacggcggcaagctcagacttgaggggtacaagagctcgtcgacatgcaactgatccatgtattatgggatgtcccaattgtgcgcaagtatgtaacattgccacgctccaattgtgcgcaagtatgtaacattgccacgcttgataagtataagtaatacttctccattcatctaatgcaaggtcgttttttagtcgaaaggggggg

SEQ ID NO: 4173 - DNA, 819 bp, Triticum aestivum
  Clone ID: PAT_TA_4173
gcttcgccgcagcgccgccgcctctgatctccaccctcctcgacgcggcgactctgctttacgcccttacgcggcggaggcaaacagatcaaggataacacaaaatcatactttgaagaggtgtcttgtgccaatcactggaataatgactccgtcggcatctgttggaaaggaagtcaacttgaaggaagtcaacttcaacttgaaggaggataagaacataccctgtgctattcagtttgtaacgacgatgttggggacgtcttcaacattgacgatcggggaccggaacaagaagttcagggtgagccgttcttcgacttggataacggttgtcttcacacagtctatgttcattgccaccacagcaggttggatctacgacatgtataataaacctatctggaatgccggcttcccatggtggctgccagttgctgtgttgttgggcgcctacctggcagtggtagacctggcgcgtgggtatttgaccctcttcgtgccacaggcacccttggcggcatggaatgcacttgacgaagttggcttcaaggtgattggattttctgtcatcttaatctctgtccctgttttcttgtttgaccaggcgtggctgcacatcacctttgcttgccttcttagtgtcctcattgctaccatacttgccttctgtgtctgtcttgttcgcacgtaccggcaatagccctcttggcacctagcggctttgtttatggtttggatgtcgtttgctagtagacgaataagcttgtctctccaagccaaagtcgccccttttgtgaaacagtcgggccactcatg

SEQ ID NO: 4174 - DNA, 1018 bp, Triticum aestivum
  unsure (1)..(1018): unsure at all n locations
  Clone ID: PAT_TA_4174
tataaatcgagacggnaccgccgcctcctccaatccaatccccaaaccaagcgcaagcgacaagcctcgaaacccaagatctacgtcgacagcagaggaaccatcaatcaatcaagaagaggccatggcgggcaaggaggaggcggggaagttgatggtcagtccgggcagcgctgccaattcggcggaggccggcgtcgatggtcctgcggcggtgttctcctccgccgccggattcatctacaaggagggtgacgaagtcagagaaggggtttgctgcgattgagaagatgcttggggaggcgaatctgtcatccaatcagccaagccgcagcaccaccaaggtccaaacaagggcaaaggttcggncttgtccaaagccggagattaaggaagcataattgcccctgaaagccgggagcaacaacccagcgcggggttcccggacgatctggcagagtatttccctccggagtggattgaggaaaggaagcgtgcccacgccgacagcgtaaagcttttcaagaagatggacgatgatttcgaagagtacaggcagcaggtcatcgcgtctgtgcggggacaagggctacttcgaggtcgatgaagacttcatcgccaagagggaaagagacaatgagttgtgtctcgaacaacagaggaggattcgggcggctaatccctgtacccgcaagtatgttgctagcccggaggacacagacggttatattccctacgttcctacgaaagctgacgctcttgttgattatgtcgtcattgatgatgaagttgtgtttcttaaagattagtcttgaagacagagtgcaagccatgaaattcaactcagagggtggctcgtttactatctaactgtgtcccatctcctgctatgttatgtttggcaccccagtttatcatttacaatcctgctatgttatgtgcttgctgctgtgggtcactcctttgctaatttgcttgtgcaatgaacgtggtttttgctcccaaaaaaaaaaaaaaa

SEQ ID NO: 4175 - DNA, 423 bp, Triticum aestivum
  Clone ID: PAT_TA_4175
cggacgcgtgggacctgccattctacgggtgaacaatgtgacaggcatttgtcggtgtagctcacaatctaaatgccataatagttgcaatcagagggactcaagagaacagatttgcttgctcagtgtgcagaattggatcaaggacttggtatggaagcagcttgatctaagctatccagacatgccaaatgcaaaggtgcacagtggatttttctcctcctataataatacaattttgcgtctagctatcacaagtgctgtgcacaacgcaagaaagacatatggggatatcggtgtcatagtcacagggcactcaatgggaggagccatggctgccttctgtgcactcgatcttgctatcaagctcggaagcgacaatgttcaactcatgactttcggacagcctcgtgttggcaatgc

SEQ ID NO: 4176 - DNA, 1580 bp, Triticum aestivum
  Clone ID: PAT_TA_4176
gattgtgcgtccgcccacgcgtccgcccacgcgtccggccaaatccaagctcggtcttcgtcaatttggtataccttgccgcccatcttgtaaatacttttctgcctccgcatttcgattctatcgctgattccccactcagctcccacaatagtttagcactctcttgacgaatcgatgggcaactcattcatgcagatgcgccctgccagcgcatgggacccaaactgctgcaggtttttacggagcacagacccctgctgctctcggcttgtcatggaagaagagagttctctctaaatcaagctcagagtcttatatatgatcatactcctgctaagaccatctgagcatatgctaccatttcacatatgacagagtagacaggtaatcagatgaggacatcacctgcatgcacatcacagcacaaagcgttgagcgattacgtaagcatctcagcagcaacatcatcatgacaggcctcgcccgcgggggctcccttgccgagtgcagcatgcggtccgaccagagcgactcaagagaacattctgcagcatgtgatcaccgacttagtgcagaagaagccgcctctacgctctcctgacgtgcggggggcacagttggggaattgcattcacattggctagtacattgctctttcatagcctgctattacaagggatgtgcacaacgcaagaaagacttaaggggatatcggcgtcatggatacagggcactcaatgggaggagccatggctgccttctgtgcactcgatcttgctatcaagctcggaagcgacaatgttcaactcatgactttcggacagcctcgtgttggcaatgctgttttcgcctcctactttgccaaatatgtgccaaacacaattcgactggtacacggacatgatatcgtgccgcatttgccaccttatttctcctttctttccaaactgacgtaccaccacttcccaagagaggtatggatcgacgaatctgacgacaacacaacggaacagatttgtgatgccagcggcgaagacccaaactgctgcaggtgcctctccatactgagtttgagcattcaggaccatttcacatacctgggagtcgacatggaatcagatgactggagcacctgcagaatcatcacagtacaaagtgttgagcgattacgtaaggatctcgtcagcaacatcatcatgacaaagcacggcgtcgaggtctccattgtcgagaatagcatgcagacagactggagcagttccagatagcatacagtattgttaacaccaatttagtgcagaagatggcgccttttctttctcttgaagaaggggggcttcagttggggaatttcattcagattgggttgtacattgttctttcatagcctgtgaatatgtaggaatgtagacacgaattataggctctagagtgtaaactcttgtcggatgcacgaaagatccgtctctgtgtttgcatcttgtaaaaaatacaatacccatgcagatatctatacagatgtctccaatctgggaaataaagcagaataaattgagaacattgccctgaaaaaaaaa

SEQ ID NO: 4177 - DNA, 552 bp, Triticum aestivum
  unsure (1)..(552): unsure at all n locations
  Clone ID: PAT_TA_4177
caacaattggcaccaaagagagtcgaaggggcgactcgtccgtaaagccaagattgagatcctgctatgtaaatcagagaacttcaatagcatcatgtccaacaaaaaatcacacaagtctgttgatgatgagatgaaggtctgataattgttgagaagaggtagataccactatgcttgagatggtgagaggcagcacgaacgttgattcagtagtaattagggtaccttagtcctagttaaggagggatggatcatatctttgcgagtgcattcaagtgatatgtgtcttgtctcctcttaattgttgctctagtgttccagctcaaatctgcaaaaatgcaactccttacaactagttgcatccgtatgagatgatgatgaaatgtacttagaatcccgccataggctggagatagtattcctaagagcaccttacttttcnagtgtgttgtaccttttgtgcatgtagcgaagcatttggacatgcaaatcggtactatgatcaatagttgtaatgttttcaaagctgtaaaaaaaaaaaaaaaaaaa

SEQ ID NO: 4178 - DNA, 493 bp, Triticum aestivum
  Clone ID: PAT_TA_4178
tttttttttttttttttttttttttttttttcgatgacagtgaactgcccaacagggcacaggaatgtgacaaaccttgcactttggaattacagcatccatcacacatcaagtcatgcaagaataatgttaagcgtgtgatgacagcatcagactgacagacagacaggaacatcagctagttagttaacatgccaagaggcagacactactattgacaaaaaatcggtcgcaattccagccgcgcaagacatgtcggtgtctgattctaagagcattttgcttatgacacataacgttactcgtcaggaagagagcaaggctgctgctgagaacaccgcgtgtcctttttttttttcctttctaactgctgcgtggcgatatctcaaaattctgacgcaacttcctgctgcttgcgcattcaacagatgatatgggctcgtcgtcgccagtagtttgagcctgttgctctggcccttctcccatactcgac

SEQ ID NO: 4179 - DNA, 795 bp, Triticum aestivum
  Clone ID: PAT_TA_4179
gcacgtcatcacaaatccaaaacaaaacgtctccgccgaccacccgcatccgatagcccccttctccgcgccttctccggcgagaagcacccacaacggtctcaccggcggccatgccggctacggactaccagggctcctcctcctcctcccactccccgttcgcctccttcggccgctcgctgctgtctcgaatccgtgacaccccggcgtccccctgccatgcttcccaccggcggggaggccgaggtcgaggcgtcccagcggcacgccgacgttaagcctcgccggcgctgagggacggtcagcctcgccgcgccgacgggtggatccggcagcttctccaggcgttcctgctgtcccaggaggagtttcgggcggcggcggccgaagtgcggcgccgcggctgtggaggcgcggctgccggagaggctggtgggcgagtaccacgagcgcgcggtgagggcgctccaacgagccaacggtgaacgcgactgacttgaccaagtccggcgctgggggcgtcgaccaggcacggcgctgtgcgcgctgctcgcgcatcgcgagatccacgctggtcgcccccgccgagagccacgagcgccagctccgccgcgccaggaaggcgctgtccgacctctcgatcctcctcgtcgacgacgcggccgcccctggggggcggggggcggcgtcgcctccttcctcgcctcccaccgcaaccgctccttcggccgcgggagccgcgcgtccccgtctcgcgcgtcctccgcctcctcctcctcgtcctcctcctcg

SEQ ID NO: 4180 - DNA, 1209 bp, Triticum aestivum
  Clone ID: PAT_TA_4180
actgttaaggacaaccaatatccaccttttctcctacaaggagatcagaagagcaacgaacaacttccaccgtagcaacaagctaggcagaggtggtttcggaactgtgtacaagggaacctttggagacggcactgcatttgctgccaaggttctatcctgtgaatctgaacaagggatcaaggaattcctgacagaaatcgaaagcatcggcgaggccaagcatgcgaacctcgtcagcttgctgggctgctgtgtccagaagcaaaataggatcctggtctatgagttcgcggagaacaacagccggcaccaggcgctctcagctctaggttcagcgagcggagcagcgatcctcccatggagcgtgaggtcggacatctgtatgggcacggccaaggggctgagctacctccacgaggagcacgagcccaacatggtgcacagagacatcaaggcaagcaacgtcctcctcggcagaaactacactactacagccccaaaatcggggacttcggcttggcgaagctgttcccggacaacgtcacccatgtcaccacgtgcgtggtcgggacgaccgggatacctggcgcctgaatacgtggtgcacgggcagctgaccaagaaggccgacgtgtacagcttcggggtcctcgtcctcgaggtcatcagcggccggagggtctcggagacgattcgatcggacacgttcctcgtgagacaggcatggctgctctacgaggagggaaggccgctggacatcgtggacgccagtgtcagggactacccggaggcagaggtgctcagatacgtcaagggaggcctggcgtgcacgcaggcggcgcccgacgggaggcccacgatgcggcaggtggtgaagatgctgtcgcggcccgccgcgttccgcgagctggagatgcacttgaccgaccacgtcctggcttgagcttgtcacctctttcctccatggcaacaagtagtacgaattgcacctcggccacttacagtgaaatcgtgcccaggtagatccgtagatggattgttttttgaaacaaaaaccatgttctaaaaaacattgttttttaaagcactttgaagcactgaatttttattcagagcattaggaatgtttttcctatacaaatttttgcacgtatatagaacattcaaccatatgcttgttgccagtttcaagaaaaataacaatgt

SEQ ID NO: 4181 - DNA, 416 bp, Triticum aestivum
  Clone ID: PAT_TA_4181
gataaatcctcatcatgctttacagaggggaatgtgtcgatgtatgattacaaggggaaggaaataaccttgatgaaaaacaacctcgatgccaaatcattaaaccctccacaaacagtcagcatatttattacagatttcagtctgctgacaacacgtcacctgaatgtaaagtgaaaatggcatcaaataaggcatatattatacaacaccaacagcacaaaacaccaaagaaaacaaagacggattaacacaatcatgtgttgcttcagtccttttggaccctgagtgtgaaggcctggagggacaagagcactttcttaatccgctctctgatctcggcgtcaatcagatttccatcgttgtcaaacttgggtggctgctgaaatgcctggacgaacagctctggcttgtta

SEQ ID NO: 4182 - DNA, 981 bp, Triticum aestivum
  Clone ID: PAT_TA_4182
gcaggacaaggtgtatgataaaccctcataatgctttacagaggggaaagtgtcgatgtatcatttccatggaaaggaaaaataaccttgattcctagagatgaaaactaacctcgataccaaatcattaaacactccacaaacagtagagcagcagatttattacagatttcagtctgctgacaacacattacctgaatgtgaagtaaaaatgtcatcaaataaggcatattatacaacactcacagcacaaaacaccaaataagaattgcaaaataataacacgttcatgcgctgcttcaatccttcttctggaccctgagtgtgaaggcctggagggacaagagcacctgcttgatacgctctctgatttcggcgtcaatcaggttaccatcactgtcaaacttgggcggctgctgaaatgcttggacgaacagctctggcttgttgatgaaatgaagatctaagaacaccccgacctgccggagatggtactgcgatctacctcctccaaagccacctcctgcgctgacaatcgcagcaggtttgtctgcccagcaattctttcccctagaagcccagtcaagtgcattcttcagaggggtcgcgatggagtagttgtactctggcgagccgaagaggaagcagtcggcgctggcgatgcgttcgcggaaagcctcgacggcgggcgggaagcccccgtcgggcgtctcgaggtcggtgttgagcagcggcagcgctgagatgtctacgtgctccacgcgcatccccgggatggactcctcgcacacctccgccgcggcgcggaggaggccgcggttgtaggaggccctgcggagggagccgcagacggcggccacgcggaggatgggcttcgccgcggcgacctccatgctctcgtctcccggcttcttcttttggctttgggagggagggggcggggatgccgtgccaggggccttctggtgggtgggtgggttc

SEQ ID NO: 4183 - DNA, 932 bp, Triticum aestivum
  unsure (1)..(932): unsure at all n locations
  Clone ID: PAT_TA_4183
ggaattcggcacgaggcgccgccgttgaagacgccgtcgcgcgcgtctcccagctctgggatgcgctcacggccgagcagaaggagcattgggttgggctgttcttctacacggagctgctgcagactttctacctgctcagggtctgtgactacaaggctgcctcgaagcatgtggagaggttggacaccgctgttaagaacgagatggagaggggacaccgtattaaagagcttggtactgaactcagtgcagttgagggaacgctagcgcagaccatgttgaaggagagggagagggtggctctagcgcataagcaggggcagttgagagctcagnctgcaagcgttgtgcgggtatgacacattgaaagatgtgttagattatggggacaagttattgttagcaccaccgccaatgcacggagagtggctcccacggactgcggtgtttgtgctggtggatctcatggtcgtgatggtcagtcggccaaaaggcatatttaaggagtgtggaaagagaatacattcaggactacagctcatccatgaggaactctcgaagcttgggatcgtggatggtgtgacagagggagatttggaacactcaacgatatggacggccgggttgtatttgatgcttttacttcagtttctcgaaaacaatgtggctgtagaactcacgagatcagaatttgttgaagcccaagaggctttagcacagatgaaaaattggtttactcgtttcccaacgattctccaaggttgtgagagcacaattgaaatgctaaggggacagtatgcacattctgttggctgctttgacgaggctgctttccacttccttgaagcattgaagctgacagagaacaaatcaatgcaatctatgtgccaagtttacgcggcagtctcctacatttgtaagggtgacgc

SEQ ID NO: 4184 - DNA, 542 bp, Triticum aestivum
  Clone ID: PAT_TA_4184
cataaacgggatcacgaactggaggacttcttccagctcgtcgtcgccggcgaggactgcggcgagggccgttccaagccctgccccgacccctacctccgcgcgcttgacctgctcggcgcgtcggcggagcggtctctggtgttcgaggactccgtcgtcggcgtgcaggccggcgtggccgcggggatgcccgtcgtggctgtcgcgagcgagagccgggaggccaaggtcgtcgccgccggcgcgtccatggtcgtcagggactaccgcgacgccgagctctgggccgcgttggaggctgctgccggagctcccaagattgattcagagccgagcgcggtggacgccaagctctgagcctcttgtttccgttggagaattgagtagctggaatcccgtttccttttccttgtcgttatactagtgcagaatccagattccaaattcagttcagaaccagagaaagaaatgaaagtaaaccgtggttcaaattgagattttcgtacaaccaaatcaagcatttcttacaattttcattc

SEQ ID NO: 4185 - DNA, 1059 bp, Triticum aestivum
  Clone ID: PAT_TA_4185
attatcaatataattattgttattaaaggtatcaatccaatctgcagaacagcagagcatcctcaagaacacaacagccccatggaaacacagctcggcgggaatgggatctcccgggcggcgccgctggaggcgctgctgttcgacatcgacggcaccatgtgcgtctccgaccccttccaccaccgcgccttctcggagctcctccagaacctgggctacaacggcggcgcgcccatcacgccggagttcggcatggcgcacatggccggccgcagcaacgagcagatcggccgcttcctcttcccggactggccgcaggcccggctcgacgccttcttcgccgagaaggaggcgctcttcgcgcggtacgccggggaggggctccgggaggtgcccgggctggcggagctgtgccggtgggcgcgggagcgcgggctgaagcgggccgccgtcaccaacgcgccccgcgccaacgccgagctcatgatcgggatcctcggcctggccgacttcttccagctcgtcgtcgccggcgaggactgcggcgagggccgctccaagccctgccccgacccctacctccgcgcgctcgacctgctcggcgcgtcggcggagcggtctctggtgttcgaggactccgtcgtcggcgtgcaggccggcgtggccgcggggatgccggtcgtggctgtcgcgagcgagagccgggaggccaaggtcgtcgccgccggcgcgtccatggtcgtcagggactaccgcgacgccgagctctgggccgcgctggacgcagccgccggagctcccaagattgattcagaggtcaacgcggtggacgccaagctctgagcctgttgtttccgttcccgtggataattgagtattagctcgaatcatatttcctcttcccatgtcatagtagtgcaggatccagattccaaattctgtttagatccagagaaaaaaaaatgtaaaatgtggttcaaatagagatttttcgtattggttcaaattgagatttttcgtataaacaaatcaagcatttcttacaaaaaaaaaaaa

SEQ ID NO: 4186 - DNA, 1077 bp, Triticum aestivum
  unsure (1)..(1077): unsure at all n locations
  Clone ID: PAT_TA_4186
acgttggaaaagccagtatcgttcctcgctgctcacatggacagaatagggagtgacatatttgaagagattggtgtacctaatagcaaggtttccattgtttcgatgcactctttagcttctaaatactccacgcgtgtggtttttggtgttcttccttatccaaaagatgcttcaataagtttgccggcccttagtgtactgaggtcatccttaatagggatgatgctgaagcagctgaacctatccttgacaccatcaatttttggttatccatcttccatcgagttgttgggattccctggaggaattactgttgttcctgcgcaatctggttctatatgggcaagcacagacccactattcaactttgtgctgaacaactccattggtcagatcttgggtaatcttacagagctaaaaaatcaattggaatttggattgaacttgaggtcctatgagagaatatacttgcagttcaggaatgaaattggttcttcagttgaagccccagcaactattgaggcatcggtgttagatgggactangtattctgttgccatatagattgaaacaactagctgagctaatcaaagaacctgacgcgaggaaccttgggcttaatcactctgtatttggtaaggtaaaaggagttcagctgtcatcgtatctgcaacactcaatctcatatttatctcctagtccagctccttcaccatctccatatccacccccctctccatcaccttctacaagtgtaccaccatcttcgtcgccatctgggagtgtcccgtaccttgcacccccaacctctagtccctcccctcgggcttctccccctttaccaaaccaccccccttgttttccatgttctgactgtaaccccttttcctccaagctggtagggcaaattgtaaaaaccacccctgnctttggtnntgggccccnaagcctggcctccaatttgtncaattcacnaaaangccaatnctgctggtttccatccccccccangtttcaatnannccaatcccttcccccccaacnatttccaacnaatcccctgggccgttgtta

SEQ ID NO: 4187 - DNA, 537 bp, Triticum aestivum
  Clone ID: PAT_TA_4187
gctccggcggccccggccccggcggcggcggccgccgcggagggtgagcaacccgagtgctacttcgacgtcagcatcggcggcgagatggagggccggatcgtgatggatctctacgcctccgtggtgccgcgcacggccgagaacttccgcgcgctctgcaccggggagaggggcgtcagcgccgccaccggcgcgcggctccactacaagggctcatcttttcatcgtatcatcaagggttttatggtgcaaggtggagatataactgctggtgatgggactgggggcgaatcaatatatggattgaattttgaggatgagaattttgttttgaagcatgagaggaaagggatgttatcaatggcgaattctggtcccaacacaaatggatctcagtttttcatcactaccacccgaacaccacaccttgataggaaacatgttgttttcgggagggttgtaaaagggatgggagtggttcgcgcaatggagcatgtttgtgctggagaagctgaccttccaactgatgatatt

SEQ ID NO: 4188 - DNA, 766 bp, Triticum aestivum
  Clone ID: PAT_TA_4188
ctcgaatgtctcccccctgctaacaggcagtcctttggaaatgggggggctgtgccgggtccagggcaaatggctaatggcgggcttccgatgaatacacttcagcaaagaggggggcttgatggtgctggtgacttgattggcatgggtggatctgatcctatgtcatcctcccaggttagtttgggcaatcacctaggttcagataacttgcagcagcagcagcagaagatggatatgcaggatttgcaacagcagcagcagcagcaccaccaccaactaccgatgtcttacaatcagcagcaagtgccaacgcagccgctgcagctgcatgctacagtgaagatggagaatggcggcagcacaggtggagtcaaattagaacagcagatgggacagcttgaccaaaatggcccagcccagatgatgcgcaatgctggcaatgtaaaatttgagccacatcagttgcaatcgttgaggggtttgggtgcggtgaagatggagcaaccgaattcagatccatcagcattcttgcagcaacagcagcagcagcagcagcaccatttgttacagctcacgaagcagaaccctcaagctgctgcggcggcccaactgaaccttttgcaacaacagcgtatcatgcatatgcagcagcagcaacaacaacagattctgaagaaccttcctttacagagaaatcaattacagcagcagcagcagcagcagcagcaacaacatcaacatcagcagcagcagttacttcgtc

SEQ ID NO: 4189 - DNA, 594 bp, Triticum aestivum
  unsure (1)..(594): unsure at all n locations
  Clone ID: PAT_TA_4189
ctctcatctagggtttccctaatcccagccgacaccatgccaccccgtcctccaggcagcctcggccgcggccgcggccgcgggctcggatcccccgtcgccaaccccgtgccaaccagtctcggcgccggcggccgtcaccttccgcgccaccgcgtactgcactttgatgttcccatcatcaacgggcgagagattatttcagtcgattcgaatgggccactcaccgcagctcgttctagctcggacgacgggccagtgatctttgtggacgtagatatggacgggagcttcttgacggaccatgatattcctggcgaaccatttgaaagcatggaccaactcatccacgcggccagtgtcacttgctcgtcgcctcctgctgtgatctgtctcgatataaggaggactgcatctcaagatgcctgttcaanactcagcatctcactatgaacaactgtgtaagcctgcaagcggaggtnatgccctgatgctacaacacacctgggagcggagaanaattatggatgncagactctatctcaaggattgtaaacatacatgaggaacacacggactctcgnctcgtganta

SEQ ID NO: 4190 - DNA, 1626 bp, Triticum aestivum
  unsure (1)..(1626): unsure at all n locations
  Clone ID: PAT_TA_4190
ggcacgcctccctgcccctccttgcgttcctcctcccccttgccctcccccccctcccccccgccgctctcgtcccgccgtcccgcccccagcctccgcccctccgcgcgcccccgacgccgccgaggaggagctccccagacgagcaagccaacacagcgacaacggacatcgactgccggccagcaaggcggcagcgtctctctgttgagagctctgccttcaagaccaaccgccccacatggagggctggtactgcatcgagtccctggtggcccaccgatgagctccgtacccactcgccttatatcgcggccctcacaattccgctcgcctacctccccaatgttcacgagccccttttcccacccgagtagtcctctgtgttcccccccctgccgtatcttcccgagtttcatcccgtcattttcgcatgtgggtccacacacctggtatccgattcgcccatcacctcgtgcaccgaaagcggcgccctcgtgacctcgatctcctaggtgttccccgccgctctgggatgtgtgaccgcctccttccgcaatcacgtcaaacacgaattgtagagcgtcaagacaggggagccgcttctcgagaagagggccgacgagctcgacagggagatgagcctcatgcgatcgcaggaggagaccgggaggcatgtcaggatgctcatccatgagaagcagcacgcttgacaggcacaccatcctcaagactactctggttgctcgggaactgggtctgcatgaatgtgctttctcgatgcccgtcaaggagcggttcgagccttgagctaactcataccatgcgttccaccaccacgggcctatcttctgtggagattaatctccctgttgtcaaccaagtcttaagtaccaaccgggcgattatagtgccacatacttctccttttgcgaggatccaccctgttcaagggcggcatgtcccacccgaggtggctgctgtgagagttccgctgctgcatcttttcaaactttcatcccgagcttttggcgaaaagctacgcaattatggttttgatgctcccatctgatagtgtgaggaaatggcttgctcatgaactcgagctcatcgaggtcgtcgccaatcaggtagctgttgccctctctcaagcggaaattcttgaagaatcaatgcgagcacgtgatctactgacggagcaaaatgtcgccctagatttagctctgcgagaggctgaaatggcaatacatgctcgcaatgtcaacagggtgggggttgaacttgtggggcctgaggacacagacaacgtcgctaccatcaactcatctgcttctgcagccaaggtgcacaacgccgagccatgatcgacgcgtctaccccaacttcgcccgacactgatgcgtcacttctacccaccaagaagtacgccttgatccaaatcgtactctctagttgcctttgcttgcaccctataggtgccccaaaggcccaaaccgtttcctttgctgctgctgcgacagcactatctatctagtttaaatttggccctgctgtggcaatctatctggatttgtgctaagttgtgctatttatctagaaaannnnnnnnnnnnnnnacccannnnn

SEQ ID NO: 4191 - DNA, 1229 bp, Triticum aestivum
  Clone ID: PAT_TA_4191
ccctttttttacccctttccccccttcgtcttcgtctcctccccgctttgtcccccccgcccgcctctcccctaaaccctagcacgcgagccccgaatccccacactcaccgcggcgatcgccgacgcgacccaaccccgcggccgcccgtagcggccgccgccgccgcacatgaccatggtgactcctcgcgcccccgagccgccgccgcaggaccaggacgaggagatgcttgtgccacaacaggaagtggaggtcttcgaggggccgcagccgatggaagaatccatgccagctgttgacaatgaaagtttgcctgatgcatcaacttccagatttacatggaagattgaaagtatatccaagcacagtggtagaaaaacccactctgatatttttgtggttgggggttacagctggcgagtgttggttttccccacaggaaacaatgtaaatcacctttcaatgtatctggatgttgctgatgccaagtctttacctattggctggagtaggagtgcccaatttagccttgctgtgatcaaccaattagacagcaagcactcagtaagaaaagaagtaacacatacatttaattctcgagaaagtgattggggttttacgtcctttatgcctttaattgatctatatgatcctagtaaaggttatattgtgaacgatcaatgcatcattgaagctgaggttgctgtgcgtaaaattgtggattactggaactacgactcaaaaaaggagactggttatgttggtctcaagaatcaaggtgccacttgttacatgaattcgctgctccagacactctaccatattccctactttaggaaggctgtgtaccatatgcctactgtcgatacaccttcagggagcattcctttagctttgcaaagtcttttctacagacttcagcatggtgacaatagtatttccacaaaagagctgactaaatcttttggatgggattcctatgagtcgtttatgcagcatgatgtccaagagttgaatcgggttctatgtgaaaagctggaagataaaatgaagggaactattgtggaaggaacaatacaaaaattatttgaaggtcaccatatgaattatattgagtgcattggtgttgactacaaatctactagaaaagagtcattctatgatctcgcacttgatgtcaagggctgctcggatgtttatgcatcttttgataagtatgtagctgt

SEQ ID NO: 4192 - DNA, 707 bp, Triticum aestivum
  Clone ID: PAT_TA_4192
cggcacgaggcaacactagcgcgggcgtggcaccaacaagagcagcgaacccacctgcaacgcggtaccgtacatggcgacggcgatggctctgctccgtctcgcggctctcgccggcgccgtcgcgctcctcctgccgggcgccgccgaggcccgcatcctcctctcgctcgacgacttcggcgccgtcggcgacggcactgccgacgacacgcaggctctcgttgacgcatggacggcggcctgtgccagcaccaacggccacgtggtcatccacgtccccgccggcaggtcgtaccagatctggccggtgacgctcgccgggccctgcagggacgagatcatgatcttcgtctccgggaacatcatcgcgccggacagcccggaggactgggagcggcgcgacggcggcaagtggctgcacttcttccaggtgcaggacctgacggtgagcggcggcggcgtcatcgacggccgcgggcaggagtggtgggcgcaggcctgcaaggggaggcaccgcaacgacaagcattgcacagccccggaggctcccaaggcgcttcacttcgaggagtgccatggggtgcgggtgcagggcgtgacgctgcagaacgggcagcagcagcacctgaccttcacccgctgctccaacgccagggccagcttcctcaggggtggcctcgccggagagcagccgggcaccgacg

SEQ ID NO: 4193 - DNA, 1215 bp, Triticum aestivum
  Clone ID: PAT_TA_4193
gggcggacgcgcccccgccggcgccgcctcggtcgcgcccgcccgcccctcggcctcggcgcgccgacggcgggtttgccgcgggcgtggggtggcccccccgatcgctcgatcgcttgctctcgggcggcgcacgacgtggccgcgccgggcagcctccttttcgacgccctggggtgtgggttccccatcttgcgtccgctgccccacgcccacccccacgtgccggcgtccccccccatcccccccctcccgctccgcctccgccccatcgccacgcgcccgcagcgcccgcccaaggcccgggcggcccccttgctcggcaccgcggccccaggcctggagaacgccctccgccgagcgtccgcgtccgcggccgtttgctagcccgaccggccgatcaatcggttgctcctcgtgccgaggaagagatggccgctccgttcagcctccttagggaggccctggaccttgggttcaagatcaagggcgcgcgggacaaggaccaaacacaacgtggaggagtgccgcaagatcgacgccctcctgctcatcctgagggccatcgccaagaacctgcagggttcgcccaagatcatggaggaccacttgatgagggacacggccaagggcctagagaaggccctgcagcgcgcgtccgaccttgtcgccgagtgcaagcgcaagggggtcctgcgccgtgctttcaacgccaccgacatcgccgagaagctgggcggggtctgcctcgatgtgctgctcaacatgaacgccctactgcttgccaacggtgccttgaacaactcggagctggccgagcttaaggaaattgtggctcagctccgcgccgacggtgccttgaacaacttgctgttgaccaagattctgcagattcttgctgatttgccacaagaggtggaaaaattggtgaaggacaaccagataagttctaaaattaaagacaaaagggagacaaagaaaacagctgtagctagttcccaaaacaaaaacaaaggggaggcaaaggaaacagatgttgccaggccgaaagggaagattcagaaaaacaagaaactagggggtagcacggtggtgccagatacttccttaccagatggcttagatgagtccgcttcagcggccagggtggttggacaaggctctagtactggtattatcaataaggcaaggagctctatctccaagtcggtggac

SEQ ID NO: 4194 - DNA, 621 bp, Triticum aestivum
  Clone ID: PAT_TA_4194
gctccttctctgcccttcccgcttggctctgcgtgaggcggtttctctgctccaggggcgaggacccgtgttaggtgtaccttgtgttccttgggcgttggctcttcctaattaccccagcttgtgtgttccgcaggctatgcccttgcccttggccatcttggttgtgctacgcccggatgctcgctgctgctcggttgttgggtctcccttaggccctgtggttgtaggccttcgcccctagttgtccgtgtattggccgacttacctggatgtctcccagttggcccctactccatggttttcgggtctttccccgcctgtgcgttgcttcgcctttgacccgaggtaatcgcttgctgtctccccttcccttcgcatccgtgccgcccgcaaggaattgcgttccgggggcccctctctcttgtcctttcctttgcagttgtcccgaggtccgtttcattcccttcctgtgttctggcctcctgggcaaacctgattacctgatccaattacttacctgtgtaaagtgcaaacttgtgtgctcactacctattcttctcttattggagatgcattcacctgcattccattcaagtaacggatagatagttgttgcta

SEQ ID NO: 4195 - DNA, 540 bp, Triticum aestivum
  Clone ID: PAT_TA_4195
tcttccttggggatccggccgacgcgcgcgaggggatctcgtggcgcacgatgcgagtgatgcctcatctgatggaaactgctccgctgacacataaaagatgcaataacacttcagttttcgagcgcgcattcatggtggttgccgatcctttccgatgccgaggagtacaggtacgtgtatatattcctcctttcctgtcactcttcgcccaccctttccactccagcagcagaacatctttcagcaagccgaggcaggccacggcgactgatccccgtcgagtgcatggccttctcagtggcggggcatgcgggtgaggcagcccgtgacacttggatttcgtgagagaagcgaagcagccctatggctgttcggtgaagcagacaactgaatctcatctaccgggttgaaagaggcgacgaatcatcagttcttggaagcgttaacgacaactgatgtgcgctgtcgttcgcctgcattgtttagtggagatatacatcgttattttcctgacctgctgctgcttgaaaaaaaaaa

SEQ ID NO: 4196 - DNA, 490 bp, Triticum aestivum
  Clone ID: PAT_TA_4196
gatctgctgcagctcatcagtaagccggcgcaaccaccggcactagccccgatgcccctgctaatggattccgacgtgtcggagccggccctaccggccgcaagattgaacaatggtactacagctccagcaccttcgtctgcacccaggatgcagactcggatcccattcctcgtcaccttagcgatgctttgcgcctgggccacggtctgaggtcgcaatgccacatgacacgctagaggtctgccggtctactaatccaatgttctttcccctccctcggtaattcgtttgttcttgtaatttttgcgttgcggggtttatatacggacgcccctatggcactctcagtccctagtgattattcagtacatatgtgttggaatatatcctcttatgttctggaccgagttctcaacaatctgaatttctgaggcttgatttaaaaaaaaagggggggaacaaaaaaaaaaaaaaaaaaaaaaaacgg

SEQ ID NO: 4197 - DNA, 435 bp, Triticum aestivum
  Clone ID: PAT_TA_4197
tgatgtggagatgaagcctgccgaggcgaatgatgctgcaaaaaacgcagatgtggagatgaaagttgctgaagaggtgaaagctgctcctagtgaagatgcagggaagactgaagactccactccagcacctgcagaacacaaggaagatgtcaaaccagctgagtctgatgccgctccggcactagcggcggaggacaagaaggaagatgtcaaaccagctgagactgatgcccctccagcaccaacagtggaggacaagaaggaagatgtcaagccagctgaggccgatgcccctccggcaccagcggttgaagacaaggaagacgctaagccagctgaggctgatgcccctccggcaccagcggttgaagacaaggaagatgctaagccagctgaagctgatgccccaccggcaccagcggttgaagacaa

SEQ ID NO: 4198 - DNA, 1819 bp, Triticum aestivum
  Clone ID: PAT_TA_4198
ccgccctccggacggccctctcgccgcacgcccacgcgtccgccccctcctcgcgttcctcgtgcgtgcgcagaaccccgaggcctcggcagccatggccaccggcggcgaccgcgcggcggaggagctcgtgtccgtcgagatgcccgcgcccgagggatggaccaagaagtttactccccagagcaggggaagatctgagattgtttttgtttcaccaactggagaggaaattaagaacaagaggcagctgaacagctatctgaaggcaaaccctggaggccccacttcatcggagtttgactggtcaactggtgataccccaaggcgttctgctcggattagcgagaaagtgaaggtatttgatagccctcagggtgaaaagataccagagcgcaataggaactcaagtggcaggaaggggaagaaagagaaaaagcaggagcttgaaagtaggcccctagtgaagactgtaccaggagaacaggtgtggagagaacgtttgctaaagcgatttgatctggcgataacggttgctgaggcgagagatgctgcacagaggactgatgtggcgaaaaaacctgatgtggagaatgaagctgcaaaaagcaggggaaagctgctcgtagtgaagatgcagggaaaaatgtagactccactccagcacctgtagaacacaaggaagaactcaaacccgctgagtctgatggcgctccggcacccgcggcgggggtcaagaaggtagatgtcaagccacgggggactgatgcccctccagcaccaccagtggaggacaagaaggaagatgtcaagccagctgaggccgatgcccctccggcaccagcggctgaggacgaggcacctccctaacccgccggtggcgactgccccgccgccacccccgctgaaggccatgcacctccggcaccagctgaggccgatgcccctccggcaccagcggttgaagacaaggaagacgctaagccatatgaggctgatgcccctccggcaccagcagttgaagacaaggatgatgctaagccagctgaggctgatgctgcttcggcaccagcagtggaagacaagaaggaagatgtcaagccatctgaggctgatgcccctcctccggtgagttcggaggaggtgaagatagaggaagctcctctggtgagttcggagggggcgaagacagaggaagtagcccctccagcgagcaagccaactgagaactcagttgttgctcccagcgagccagctattgctcctgctcctgcctgcagtatccggaaaccaaatcagactgctgccgcagtaagacagccaacctgggtgcggccaccaatgagtcgccgtccgccgtcaacaatgggcagctgtcgcctggcgcctctcacggtgaagtgcacctgtaagcagctgccccctcctccgcgccgccgtttcctaggatcattcaacattcgcattgtaatcaatcagcctttggtatgcatgttaatttagcccgtctgacggtgctgcgatgatgagaaccggtcaagtcaggccatgcattttgttagattttctatcgcctgcgtgggtcaccgtgcccgtcgccacatacatgtaccccacccataccgtcaccatgtcgtatgtttttctaacttgttaatattagggacatatatactcgttgtctgtttgtccgtgtctgtttatcatgtacccgtgttgtattgtgttgttagacctgaaataccctctgtctggtttgctgtttatccccaatgaataatgatgagggtttctgtttatccaaaaaaaaaaacgcacg

SEQ ID NO: 4199 - DNA, 1071 bp, Triticum aestivum
  Clone ID: PAT_TA_4199
aaaacctcttccggccatcattactgaaaataataataataataatgcggagagcactcacaggcattttgaaaggaacagtcatgagaaagatcttaaagaggtgaaggttgtcaatggaaaagactctgagccttctaaaactgacaagtttagagatggtgacaagcataccatgcctgaaaatattgataaaaagggcacctacaaagaggaaaagggttctagcaggtatgcaaaacatgggttggatagatgggatgatgccaaaagagatcgaaaggaccttccaaaggatgcaagagagagaaagagggattctgctgatagaagcgacgcgtccgaagatgggaatgacgatagatcaaggcaaattactaagagctcagctagccacagcagtagaaggtcacggtcacggtcaccaagtgggagaagccgtactaggaatgagagttcttcacgtgttcgagggagtgtttcaagcgacgagccttctgataatgcaaaaaggagaaagagtcattctcgtaaaaacagcatgtctccctcacctccaaaatctaggagcaggtatatcaatattcctcccttctctgtaatatatgttaatagtgggaaatttttgctagttagctccaacatgttcacataactattgtaaggttgagattgatagttttgctgatcacgaatgctcagaatcttgctatagacatcaatctcatttctcatcatgaaggggtagggcatttatgataaggtggctctgaaacaacagttggactcccatgcaacaatttgtaggactgtgctgcactccatctcgacgtaataattctctttgtgagcgatggcctgaaagcgatataacgtggtgaccagtgtaattatattatttgttgcttagatatggataagtactgagtatgacacccctgggtgaacctacttcatattcatatatcgcttatccaactacttacccatttgtatttctcttggggtctcttagtactagtatgcaaggagactgccgagtttcgttgggacaaaaaaaaaaaaaaaaaa

SEQ ID NO: 4200 - DNA, 548 bp, Triticum aestivum
  Clone ID: PAT_TA_4200
cttgccgcattctgggataaactcacggtgggccaggcccaagcgatactgtccctggagggcgtggctatagaggagaccagcgctttattcattttgacatcattgtcgtcggcgcggggcaagccagggtacgcttcgttgccgctgccatatgccagagccggcaatgaactcctggaccttattcagacagcagcctcaagactacccatctcatcaaatgaactgtttatcatgctcgacgaagcaagcgagaacacatttctttgtaccaacgcagccgacgctgcctgtgttcagaagtttttgtttgacggggaggttgagaaggtcgcaacagagttgaaaaacgttgttgcgtgcaccagttacatccttgaacagaagctggtcgaagcatggtctgctgataaggccgctgaagcgttaagatgccagaagttgctagtggaggaagaggacgctgctcagaaaaggcaagctgaaatcatggaaaggaagcggatgaagaaactgagacagaaagaacagagactgaaagacct

SEQ ID NO: 4201 - DNA, 1075 bp, Triticum aestivum
  Clone ID: PAT_TA_4201
cgccgaccgcgaaatcccccaaatcagcgcaggcaaccgagccgcgaaatccatcgtcgaggggagagggatcgctcggcgatcaataagcaaggccatggcgggtaacaagaagaagaaggaggaggcggcggcgaggaagtgtatgatgaggccgtgcaccgccgccaagtctacggagggtgcggtggccggcggccatggtcctgttacgcgtcccctctgcaggaggaaggcggtggccggatccagcggtgagcagcggccggagggatcgtcggatctgctcgaatcagcgaggagggaggacaagatgctgggaaaggccaagctgtcatctttcgtccccaagcaggctggggccaatgcaaccgtggcagcagcagcagacgcagcacaagggagcagcaaatcgcggcggctgaccaagagcagcgagatcatgacagtactcctaaagccggagccgcccccccccgccgccgacctcctggatcgcctcgccgactacgacccgccggagcgcatcgcagagcagaagcggcagcacgaggaggacgcggcctactttgccaagatggacgcggagttcgaggtgttccggcagaaggtcatcgatggactcaacaacgacggctactacgaggtcgatgaggactatctcgaggcgagggagaaggccaatgaagaggccatgcgacaccccatggggctatgggcggatatggacccccgcgaacgccgtctccgtgttgctacccctgaggaaaggcttcttctcataggtgatgcctacattccgtacgtgcctgacgaagaagacgaggctctgatcaatctcggtgatgatgatttctctgcgagtgatgaagaggatgatttccctccgagtgatgaagaagcaggagacaatgctcacaagcgtcctcatcttattgtatccaactgagaagaggattcagccggtccatctctatctatcttatctaactatatatctctagcagatgtctgtgtaatggatctatttatctatctatatgtgttaattgtggtcaaaaaaaaaaaaaaaaaa

SEQ ID NO: 4202 - DNA, 527 bp, Triticum aestivum
  unsure (1)..(527): unsure at all n locations
  Clone ID: PAT_TA_4202
gagagacanggtccgcaaagcnagcaccgcccggcaaaggcaaaanaagccattcatccatcatccccttcctcgtgtgatgctgcctcttccctcttgcttctttcttcttcgtgtagtaccaagttagatagatatccatggtctttctctccttgcttgcttgcgaattgctgcaggttgtaaagtagataggtgttgtacgtagagtacgagctagataggcagcgggtgggagaggagatgaagctccatctcctgctgaaggtcctgttcgggccggtgccggtctacttctcggcgctggccatcctcatcctcctgaccaacgcacagtactttgggctcggcggcgtcggcgtgccgcgcgccaccaagctggcctcctccacgccggtggtggtcgggtgaagactgcagatcttccgcgggantgggtnccaangcgnaggggnctactacnannacagactgcggcntgatcaggagnncagagctgctcangtncgngcccncctgngtctaag

SEQ ID NO: 4203 - DNA, 579 bp, Triticum aestivum
  Clone ID: PAT_TA_4203
atccaagtatcatattggatgtaaaaactagacttggggtggcattaccaatacaggtgaaggacatcggcttcacgggagttttccgcttgattttcaaaccgctggttgaacaactgccttgctttggagctgtttgtttttctctaagacagaagaaaaaactggatttcaaactgaaggtcattggtggtgatatttctgctattcctggaatttcagctgctcttgaggaaactataaaaaatgctattgaagactcaataacatggccagtaaggaaagtcattcctatagtacctggggactacagcgatctggagctgaagcctgtgggtacattggaagtcaagcttgtgcaagcaagagatttgacaaacaaggatctgataggaaaatcggatccttttgccactttatatatccgaccattgccagacaaaaccaagagaagtaaaacaattaacaatgatctcaatcccatttggaatgaacacttcgagtttattgttgaagatgctgatactcccagcgtgacagtcaagatttatgacgatgacggtattcaagaatctgatc

SEQ ID NO: 4204 - DNA, 585 bp, Triticum aestivum
  unsure (1)..(585): unsure at all n locations
  Clone ID: PAT_TA_4204
ctacccatgagcggcggcggctgccctggagaccatgatagctcagctgcctccaaagatggactactctccaggttcgatgaggccgcgactcgcctaagcagctgccccgataataagcgaggcacatcgttccatatggacgactatctgcatctgtggaggagcgaggatttcctcttcgagcgattgagtcagaagcaaagaatcgactatggcggtctaaccgtatgcaggaggtcgacaataatgtagattattatggcataggattctcctgctgggttcaggcggcgaacatatgtagtgtgcccaattgattaattgattgattgggttaagttaggctaataagtgtgtagatttagggcctgtttagttgggagctaactttggcatagttgtgctttttctttcagaaattgaacacccttcggcttggttaatactcccccctctccgcttttgagtgaaagatgcatgaggcatggttgtaaaaaaggaaatatcttgcctaatgtntggctggaaccgaacattcgcctaagttggtcaaatttgtttaaaaaaaaaaaaaaaaaaaac

SEQ ID NO: 4205 - DNA, 658 bp, Triticum aestivum
  Clone ID: PAT_TA_4205
ggttttgggaactctttgagtgcacacgaatgtagccagaggtctaatccccatggcatcgcactagatatcaacaaagttgttccagatggaaccagcttggctttgacacagaagggcttagtattgcaatctgcagaacttgaaaaacagtgcttgaaaatcgaaaatgaggcactggagcttgcagaacaacgcctcaagtgggaactatccagtaaaattaaggacaaggaactggaaaggatgaggtcagataacgaacatatgaagattgagattaaacgcttagaactggaggtaaggcgcaaagagttagagcttgaactcaagctgaaaggaaacggcagtcattcatgacatttatttaggcggtcaagattggcctgtaagatggtagccgatggcttctgatgttagcgtagaatactgccagcaggtcgcccgtgcacttcgcaagatctcgttttgcaaggattgggtatttgatgaggcttatgatcaccccttcagtttttctgtttttatcgcaatacattctttgctatagcgggcttgtagcagtgactctgagtggtaattgagtggatggcttgtgtttgcttacaatagatatcaaatgccaatcgctgtcgtaagttttatcaaaaaaaaaaaa

SEQ ID NO: 4206 - DNA, 392 bp, Triticum aestivum
  Clone ID: PAT_TA_4206
cgcccgcaagtacttccagcagctcgtcgccgccgtcgccttctgccacagccgcggcgtcgcgcaccgggacctcaagcccgagaacctgctgctcgacgaggagggccgcctcaaggtcaccgacttcggcctcgccgcgctgcccgagcagctgcgccacgacggcctgctccacacccagtgcggcaccccggcctacgtcgcgccggaggtgctccgcaagcgcggctacgacggcgcgcgcgccgacatgtggtcctgcggcgtcgtgctctacgtcctgctctgcggcttcctccccttccagcacgacaactacgtcaagatgtaccagaagatcttcaagggcgagtaccagatgccgccctgggtctccggcgaggcgcgcc

SEQ ID NO: 4207 - DNA, 690 bp, Triticum aestivum
  Clone ID: PAT_TA_4207
gtgtcaccaaaaataataacaataaatcaattatgatacaagttaactcgtccaaaggaaaaaagcagtgttcttctttctcaaaactgtacttgatgtgtaaattacagtgacaagccacaaaaaaaaccttgcgcgctacagctttttgggagatgacttccatgttcatttcccaattcatctatacgctgtagcgagcaagaactatgtattccaaaagcctcacagcttcattggtgtcttccttttctagtagccacaccacaggaaactcatataagtctcagttcgtattcacctgccatggtaatgtatctaacccacggaagcgcctggtacccactcttttcaatgatctttagatagcgaacctgaatacccgatacagtgaaatatggtatttcaaatttcactcgtatcggtgccttcttttcagggactgcttcttccgcacttatacttggtagactaaactccgctctgcacatgtactctttgccaccaggaaatgattttactttccagaccattgcatctctctcaggtgcatatgcagcagaacccattgaagttcttatatttgggtttgtggcatcataaggaacaggaacttcaatttcaacatttgttgctgtgcttctttcgttaaaccgcagccgtaccggtcgacccggactggcctgaccg

SEQ ID NO: 4208 - DNA, 2380 bp, Triticum aestivum
  Clone ID: PAT_TA_4208
cgatggatttattgttattatgatacaaattgcctcgtcctttggaaaaaagcttttttgcagataaagaaggattatcatactcaactcgcgagaagcgagctgctgttggttcaagaaccctctactcactagcttcacaaatccttttcccaagttctacttacaatgttggctagttccccgcataatataataataaaaatgcagcctaaacgacccaaattgcctaaaattgaaccaattttttgtaatgcaaggatgctcactgtgaataataaggtgagagtttgcggaagctacaatggtggttgactgtaactgatcacagaactttcacgccactcggtcgtttaccttccatggcatccttcttgtcgcggcaatcagaacaaaggaaagggccttcccatggcttagagctcgaagagaatactgaacctacatgaactgatgtaccttcacttggttcaagatctgcctggcagatggcacatgtaaacaagcttgacgatgttctccgactacctgagtcattacccaacctctctgatagtatcgctgaaccttcttcaaatatctcttcaaccatacccactgaagaaagctgcttagtcaatttattgggctggtcctttgcttttttcctaaaaattttttttttctctgaccaggtcactaagggtaatacacctccaatcaaattagcttggaagcgaaatcgtaacttagaaacaggacccaagtttggtagtgacacgatcgcccaacgtaaaacaatatcatacctgtgttcccaagctgtacttaatgtgtaaactagagtcccactagacaacaataccgatggatgatacatcattgcacaaaatggcttaaacctctaagagaactttgcattataggatggtgcacgtttaaggaaaagatcccaaacctcccggagtaccatcgtcgttcccgctgccttatttcagcaccagcactacatgagatcattcccagtccgtctcagcctgctatgctaatgaatcatagccacggaagcggcagccacgttcccttaagcctgagctcaaaatcgccagcccttgtactgtacctaacccaatgtggtgcctgatattcctctcgtatggatcacttttatatacaggacctggttctccgagaacttaagttatgaagactcaactctgatatgcacatatactctttttcaccaggaaatgatttaattttccagaccattgcatctctctcaggtgcatatgccgcagaacccattgaagtccttatatttgggtttgtggcatcttagggtacaggtacttcaatttctacatttgttcctgtgcttctttccttgaactggctccttgccttcaccatgatctctatccgggcttcttgaatgcttctcaacttgtgcttctacccagatcagaggcttcacctgtgtggtgagtctgtaagtcattagatcaaaagctccatccggaggaacgaatgatatagtcctatcattctcaaatctggtcaaccgaacacactgatgaaatttgatatcatccagatctattgcttttcctttagttgctcggccttgagcttccaaaagaactctatcattcaacccaagtttacactcgggcattccactcagaaatgtccgcatcttcagcgcaccgatgatgtcagatctcacaatctgcccattgctattgacaagaatgttgacactctccactacatccaagaacacttcgttctttttgtaccgaatcccctcactcctccatgagacagcatttgtcacagccatcggtggcctctgtgagacctccatcttgtatgcatctgtcttgatgaactcgcttaaaatctttgcctcggtgtattgtggatacccaaaatccatcatctcatcaagcaactcatacacgacgacaaagttatctctgagtgattcctcctccaattcctcgaaatagtgcttgaacacatcgacgacgcggtggaggaataggaggatgctagcggcgttgcagttttggcgggaggcggtgaggaggaaaatattgttatgctgtataaacatgtaggtgacgcccgcgtcgtcgtagaccaccggcgagtagagatagagggcgtatcgtttgatcaggtgggattatgtcaacaacgacacatgtcgtgtcatcttttaggccccttgtcttgagtgcctccttaactatttgcttggcagcgagttcagcaggcaaccctctgcaacactttgcagctgtatctgaagacaatgcatcccaaatgccgtctgaagcaataataagcctcccaccagtagtagacaccggcctgccgcctcgagcggccg

SEQ ID NO: 4209 - DNA, 971 bp, Triticum aestivum
  Clone ID: PAT_TA_4209
gcacgagccctcatgccctcccccccgcgcgccctccccttgtctcaagccctcccgtttccacccacgccgtcgatcggccgttggacgccaccggcgacatggatcccctccgcctactcctcccccgcgcccaggcccagccattgcttccgctccccgccggcgtcccagcgccgagcgtcaggccccgcctcgtcccgcggcgacgggcgcgccgccaccgcaacggggccgcgcggatgctgccagcctcggccgtggcgtccgagtcgccgtggacggagcaggagccggcgtccggggagaaggaggagcggttcgactggctggaccagtggtaccccttcgcccccgtggaggacctggaccccggcgcgccgcacggcaagatggtgctgggcatccgcgtggtggcctggtacgaccgcggcgccggcgagtggcgcgtgttcgacgacgcgtgcccgcaccgcctggcgccgctctccgagggccgcatcgacgacaagggccggctccagtgcgtgtaccacggctggtgcttcgacggccgcggcgcctgcaagttcatcccccaggcccccgcgctcggcccgccagtgcacaacaacagcaaggcgtgcgttgcatcgtacccgtgcgtggtgcagaacaagatcctctggttctacccgcgcgccgagccggagcacagggacgtgctgcagaggaagcggccgccgttcatcaaggagatcgacgacccctccttcgtaacctccttcctggtcagggacatgccctacgggtacgatgtgttggcggagaatctcatggacccttctcacgtcccctacgcgcacaaaggcttgctccgcggcctcccccggcttgtagaccccggcagagaggagtacgacaaaggaaggcggcgtgccgatggcggtgaaaggtaaaggattccagcgtgaatgggtttcgcgtctcct

SEQ ID NO: 4210 - DNA, 686 bp, Triticum aestivum
  unsure (1)..(686): unsure at all n locations
  Clone ID: PAT_TA_4210
gccnaaaagtgctcgccgcaagcttcttattggcccccctaagtctaagggcactgaactacctgcctctgttagcaacgttactgtccaggctggaaaggttgtcgcagttacccaaactgaagaggttgccgccactggaaatgttgttcagcctacacccatgccaaccgttcgacatgagactgaaaccacaactgctgaggatccaaagatcatcattcctgacccctctaaggccaagaggacaaacaacgctagcaagggtgctggcatcccaaagaaaccgaagcggtagttctttcatggagtggtcgttccatgttgtaatctaaatatgtacatacgggtttcttctatcttctgcttgcttatcaagtaaagtctacgatggacggatgtcgtgctgaacagaccttctcaactgtactacatcacagcagcggtttggccatcgggtttgaagatcgtcgactcagtgcgcttttgggcatgcactggatttacttttgtgcagctttataagacagggctttgacacctgtagaattgtgtcaaaccactgtcatggcaactcctttatttacgtcctcgaacaaagcatcatgcgttgtaaatatctgccgtagctcttcctgtatgaactccttgtgacaactattcactgtaaataccgctggatcatg

SEQ ID NO: 4211 - DNA, 632 bp, Triticum aestivum
  Clone ID: PAT_TA_4211
atgcctacatcaatttcggcctcgccccctccttgggtccctaccaccaatcccccctccctcccatcctcccccttctgtcctcatcgtgggtgctggctttgctggcctcgccgccgcacgccaccttatgtcccttggcttcaaggttgccattgtcgaatgtttttcttcgcccagtggccgtgtgggggcggagacaatgcggtcctctgcagcagactatcctgacattgctgggggtgctgatctgggaggcagtgtgctcactggtattaatgggaacccccttggtgtcatagcacggcagcttgggttcccacttcacaaggtgcgggacaagtgcccgctgtatcttccggatggccgcccagttgaccctgacatggatggtcgtgttgaagctgcctttaaccagcttcttgacaaggtttgccagctgaggcatgttatctcagatagtgtcccacactgtgtggatgtgtcacttggcatggcactcgaggcattccgggcagcgcatggtgttgccgctgagccagaggaacggatgcttcttgattggcatctggccaacctggagtatgccaatgccgctcctcttgctgatctctccatggccttctgggacc

SEQ ID NO: 4212 - DNA, 731 bp, Triticum aestivum
  Clone ID: PAT_TA_4212
cgttccgctccccacctcgcggtatcccacccattctgcgtgtcaagctaggctcgccccgcccgcccgcccccatagatccccacaccaaggcacgcgctagagcctagaggagctgcacgatccgatggcgccgctctcatggcggcaccatacgctgctgcaggcgctgctctcccgtggaccgctctcggagcgagacttccacgccctcttcaccgccatctccggcggcatgaaccccgccactcaccagcaactattcactgatacacttatgaagatcaacaatgagctagggtatctacaatttgatctgcgagcatgtataaaccagtatgatggaacagtttattatggagtggtcaacaacatttctgatgaagaatcgaagcttggctccaagtattctgtaccacagattgcattctacaagggactgttagaagcaatagttcatgaagctggaaatgatgggagcataactagtattgaagctctcaacgtccggattgacaaccaggtcgtgattgcggatggtacacaagacactcaatctcgtcttccttcttctatcacaaacttcttgttctctcaaaaggaaaagactcttattgaactgatacaagatcgttggctggcgtacacctcagagggcaagattggtcttggtatcagatcatttcttgatctccggagctggtttcgcagcaatgatatcccatcatgcg

SEQ ID NO: 4213 - DNA, 1144 bp, Triticum aestivum
  Clone ID: PAT_TA_4213
atctctcctccagggccgacaccgccgcctcgcctcctttgtccccctcctccccaccgccgacgactgccccgacacctacggcaagaatggggagcaccgacgagactggaactccctatggcgagtacacctatgctgagctggagagggagctgtactggccatctgagaagctgagaatctcggtcactggagctggtggtttcattggatcccatattgctcgccgtctgaagagtgaggggcactacatcattgcctcagactggaagaagaacgagcatatgaccgaggacatgttctgccatgagttccaccttgctgacctcattttcatggacaactgccttaaggtcaccaccaatgtcgaccatgtcttcaatctcgctgctgatatgggaggcatggggttcattcagtctaaccactctgttatcatgtacaacaacaccatgatcagtttcaacatgcttgaggccgggcgtatcaacggcgtgaagaggttcttctatgcctcgagcgcatgcatctatcctgaattcaaacaactggagacaaatgtgagcttgaaggaagctgatgcttggcctgctgagccgcaagatgcctatggcttggagaagctcgcgaccgaggagctgtgcaagcactacaccaaggactttgacattgagtgcgtattggccgttttcacaacatttacgtccctttggaacatggaaaggcgtcgtgagaaggcaccagctgtctgtccagcgagaggtttaaggttcacctacttctggatcaaggagcagatcgagaaggagaggaccgaggggaaggacgtcgccctgtatggatcatccaaggtggtgtccacacaggcaccggtgcagctgggctccctccgcgcggctgacgggaaggagtaaactatgcagatcaacgcgagatctactatgccactgcccatcgaacggatccttccttgcgaaaaagattcagagaattgcacagcctgccctaactaccccatgcacgatttcagcagattcaagtgctcctattcatcgtcgcccccattaattattatctttgtgtcaccgaattcctgggataccgaacttttgattggatgaagaataagatcccctatttt

SEQ ID NO: 4214 - DNA, 1644 bp, Triticum aestivum
  Clone ID: PAT_TA_4214
gcatcggcccgaacatcccggccacacggccataataccgtcccaagcagccccacgaccccctccgtaactccccggtcccccccttcccgctccgatccccccggttcgaagcgcctccaccggccccgcgagaaccccccccggcgccccggaccagccctccctccatctggcacggaaccggcccgtcacgaggagaacgctcccgcagccggggaaacggtgacgctaacggccacaaggagcccgcccggctcttggacagggggagctggtcggttacagggtctcacagatcaaaaagcgcctcaagggcgacagggctccacttcattggccacctgacgagcacaagagcgaggaaataggccgtgaatatggccacagattcgttccatcgtggcttcgtcctcggggatcaggggtcaattggctcaagcggtcacgccacgcgcgtcggtgattaggttttcaatctcgacggtcagataggaggagtgggctgcatgcagcactaccattatgtcgtcattttatacaacaactgcatgaactttaacatccttcaaactgctcgtgtcatttgtggccttgagggtctttgatgactcgactgctggcttcaatcatgcctttattgaagaagatatcatcagtaagcacctggtagggggcagcagggagtcccggagcgccaagatattcatggctccgggaaaatttatctaccgggaattgatcaaaccctacaccaaagaatttagcaatgaagcgccggattggtcgctttcacaatatatatggtacatatgggacatggaagggggtgaggggcgaaggcgcacgtgcccctttgtggaagacagccactaacctctccactgattcagatttgagactgtgggtgagaaggtcagcacgtctacaattcttcacgtatgttggtgagtgtgtggtaaggctgacctcggctctcagaaacgtctgatttctgcgaagcctgtacacattggaaagtgacgaaactggtgaagcatggaacgagatggctgagatagtcctgaggttcgagaacaagcaggctgcccatccaccacatccctggccccgagggtgtccgtggccgcaactctgacaacacgctcatcaagggagaagcttggctgggctccaaaccatgaggctgaaggatgggctcaggatcacgtattcttggatcaatggagcagctgggagaaggaaaagtctgaaggcaccgacatgtccgcatacggaacatccaaggtctgcaccacgcaagcaccggtccagcttgggctcccgactgcgccgcagatcggcaaggagtgaaacactcagctctaggcaaggagatcagttggtttgtcaatgttgtctcaccatttcttgattcaatctgtaaactttgaagatcacctgcatgagatttatagccttttgtgctgttggtacaacgggaataactgcttggtgcaagaggatgttatgttaaacattttatttatatacatgtaaaatctggtcagttcgtcattatgaaaacaatgaaataatagtttgttaccaaactttcttatggatgaagaataagatcccccttttttactttgaaaaaaaaaa

SEQ ID NO: 4215 - DNA, 1658 bp, Triticum aestivum
  unsure (1)..(1658): unsure at all n locations
  Clone ID: PAT_TA_4215
gtggtgtatcactccaacgagccgctgccggcgttcaaggacgtgccggtctcggagaagcagaatctgtttgtcagaaaggccaccctgtgctgtgctgtgtacgactttgccgatccgaccaagaacctgaaggagaaggaaatgaagcggcagacgcttatggagcttgttgattatgtcacttctgcaaatggaaagttctcggaaatcatcatgttggagatcagcaagatggttgcaattaacttgttccggagctcgaatcccactcctcgtgagaacaaggccatcgaaggagttgatatggaggaagaagagcctctcatggatccagcatggtcacacctgcagatcgtttatgaggttttcttgagatttgtagcgtcgcaagagacagatgcaaagctggccaagagatacatagaccattccttcattctcaagctactagatctttttgactctgaagaccccagggaaagggactatctcaagacaatactccatcgaatatatggtaaattcatggtgcatcgcccattcatcaggaaagcaatcaacaacatcttctacagatttatatttgaaacggaaaagcataacggtattgcagagctgctggagatcttgggcagtataattaatggttttgccctgccacttaaagaggagcacaaattgttccttctccgtgcactgatcccacttcataagccaaagtgtgtggcaatgtaccatcagcagctatcgtattgcatcacacagtttgttgagaaggattgcaaacttgctgacactgttattaggggcttgctgaagtattggcctataaccaacagctcaaaggaggtgatgttcnttgggtgagctagaattaggttttagaggcaacacagcttgcagagttccaaagatgcatggtgccgctcttccgtcagattgccagtagcatgaacagctcacacttccaggtggcagagcgggcactgtttctatggaacaacgaccacattgagaacctaatcaagcagaattacaaggtgatactacccatcatctttcccgcgctcgagagaaacgcccggggtcactggaaccaagctgtccggagcctgacgctgaatgtacgcaagatcttcaccgatcatgattccgcatttttcggggagtgcatgcagaagttcgatgacgacgagctcaagcaggaggagtccagttcgaagcgggaagcgctgtggaagcgcctggaggaaatgggcggcgagagcaacccctcgggtatacccaacggcaaatccagtcaatagaatatacccatagcgaccgcgatcgcgcgatcctttgaacgatgcgcgactgattctctggaacttgggctgtggttgtagtgttggaatttttcttttttcttcttggttggtgagttgacttcccctgggtagggtgtatttggtttcgtgaggactgcatgatcaaaaggtatgcatacatgagagtttctgtgatatttggcatgtgtcgtggcatgcgtcaggattatcgtatagaccaataaacagcgtcaggttttgttgaggatatgctcttgggtggtttacttaaatcacaatgatcattttgttgttgccctcaaagaaaaaaaaaaaaaaaaaaaa

SEQ ID NO: 4216 - DNA, 980 bp, Triticum aestivum
  unsure (1)..(980): unsure at all n locations
  Clone ID: PAT_TA_4216
gcctctcctccttcacttgccttggccttaaccncgccccaaatccaaccttcaaagctttcctcctccccctgctgccgtcttggtgataactaacctccgcaagggcccatgggtgaacacctcgcgctgctggtggaccggctgctcacggagtccacgctggaggcggccatcgtgagcaggaagcagccggccgcggacgacacgccggcggcgatcgtctactgctgtgacatcgccgccgctggcggcgacccgagcaagatggtggagtgcaggatctgccaggaggaggactgggacaccggcatggaggccccctgcgcctgccgcggcagcctcaagtatgcccatcgaaaatgcatccagcgttggtgcaatgagaagcgcgccaccgtccgccaggcaggctggcagcttgccagccctggcctcacgcccccccagcggctgttccccttgggaagcgtcccttgggtcctcagggggaactgggaggtcgcgcggcacgatctccacgactcgcaggtcataacaatggtgccctcggagcgcgacttcatggacgagtacgacgactactttccagtcaggacgaggagcagcgccctgtgctgccggacagtcgccatcattttcctggccctcctggttctccggcacactcttcctctcatggtcggcggcgacggggagtactcgtttgctctgtttttgctccttgtgctgaggaccgccggaattctgtttccgatcttggtgatggtgagagcaatggcaaccttccatcgtcggcgtcgccaacaggtaatcccatccctgaatgaccagccattgttgggtttggaacctggtcaggcgtagtgatcctgataacagttggccgtcagcagaacactgataccagtttcacttgcactgcagagttctgcgtatactattttctgatgcataactctggggtctagatcacttga

SEQ ID NO: 4217 - DNA, 1252 bp, Triticum aestivum
  Clone ID: PAT_TA_4217
cggacgcgtgggcataaactcatcagatccgaataatcggttctgcgaggaaaaagctctctaacctctaactgctctcgggtcgctcctcgtgggcgactcgagggcgacaaaccctagctctctcaggcctccccctcctcccttccccgccccgccgccacccgaggtggtcgccggcgttcccgcgccgctgtcagtgaaggtggcggcgaggtccctgctgccctgcatcttgtggggagctttggtacgccggggcggcggccctgggtgagaaggcggcgtcgacctcggctggcgggtggcgccgcaggtgttggctggccctcccggtcacgtgggcggcggtggctcctcgcggcgtggtctgccccggcggctgcgccagatctggatcccggtgggctgcttcggcctcatccatcctcgccggctgcggattcggctgtatctggatcccgtgcttcgggccggcctgtggacgtggtgagggaagatctgggaggggggaaacccccggtcgacctcaacgccaacagtggctccggccccgttttccctcttgagggggcgctcgattccctccttccccctcctccatccacctcatcccgggtgaaaaccttggctgcatgcggccaggcgacggcggcgctccggcgtcgttatcttcttgaagacgccaccttgggatggttggagggttgtggatgtgcgtcgagctatcggcttcggttgcggctgtgtggttcctgcaggatgtcattggtagtgggtgtgtggtcgccttcccgctctggttgttgtggttcgccgtcaggtggcgctgtggggttgctggccagtggtggtgctccattggggcgagcggagatgaggtctcccctccggcaatgtgtgaggaaagatggtggtctctcctccattcccggcttgcaattctgactatggcgacggtgatcattccgcggtggtgtccctgtcatcctccatctagtgcatctcttcggcctctgcacacgctgatcctcttcatcttggagttcctcttcgacttgatcctgtaattttcttaagtggcaactgtgtgtgaccttctcaagttagcttcttggtctagctgcctactcttttttcttgtatcaagtttgttccaatgttggaaacaccattgtatcccctagccggttgatggcttcattaatttgaagtcgggcatgatgccttttatctaaaaaaaaaggggggg

SEQ ID NO: 4218 - DNA, 1408 bp, Triticum aestivum
  unsure (1)..(1408): unsure at all n locations
  Clone ID: PAT_TA_4218
cgcggccggcttcttggcctgccaccctgccgtcccccgacctagcatcgtcgacgacagaggcggcgacctgggctggcgggctgcgagcgcggtggcgcggcggcgaggcggcgtcgggggcaggcgcgcgcgcgctgctccggacggggatctccaccgcgtcgtcgcgccccaaggtggaggacgtgatgaggagggagatggggaggccgtcgtcccccggcgccccggccgcgccgctgcgcctcctgcgcttgcccccctgcgtcgcctggccgccggggggctcgacgacgcaggcttcgctcaacaagacgccggcaaggtccgcgccgccgaacccgacgctgcacaggatcggcctggacgggacgtggaagagggcgctgcggaccgccctcaccgacaccacctcgtccgcggccgtgtccaccgccagccccgggaccgccgcctgcccctgcataaggcccctctcgaccgggactccggcagcccgccccaacggcacagtctccaccgcctccttgtcccgcgcctccgccgcgccgcacccccccagtgactacacccacgtgctcccccacgccttcgccgccgtcatcctcaacgccggggacctcgtcgtgctctccgactggcaggacgtcgtcatgccgcactgcctcctccccacccatcgactccaccggttcgccggccccgacgctccctccgacctccacggcaggctgaagacacaagtcatctagcgtcaacgtgaaccccactccagggcaaacgccaacctcaagcttcacgagctccgcccccgacaactccacccgtgctgaacagactaatgggatgcttcagcgcaggaggacggccccctcccccaccgacgtacccagcgccaacgtcccccgcccccccgccgacggccagcaccacgacaccttcagccaccaggcgctgcctcccatcgcccacgcggggcacaggataaccacggaacggcggccaggccgagatccaggaggaagaggagaggagttaaccatgagttcacaaccaaccaagtgcagaaaaagaaggaggttaatttgtgatggccctttcttatgtaaccttaaaattctggatatctcatatcgccccataaccctttgttcattcttctattttattgtttcttttacagccttgtaaagttttcgccacgaacacatgatcatatatacacactgtcctttcacgccatgtcacactaaattgattgaaggttttgttgtgagacatccatgtaaagtttgctccaagaactcagtcacaataaaccttctttgttctggtgtgttgggggggttaactcaagacatacataagttcacaatgtncaagttanaaaaanaaaaaaaaaaaa

SEQ ID NO: 4219 - DNA, 859 bp, Triticum aestivum
  Clone ID: PAT_TA_4219
ttccgcaactgcgccgacctgagcatcaccacgtccgtcggcggcgggctgccgccagagttcgccggctcggacaaccccttcctgctgtacgtccgggacctgcgcgcccccaactacgtcttccccctcgtcatcatatcgcaggtttgcgtcgcgacgccctggtaccgcagtatacccgggatggacagctggtgcgagaccaactgcctgcgctacccgccgaactgcccgccgtccgtgtgccactgccccgagtcctgcgagggtataggcgatctggccggcaaggagggtgcggacgtctactgccaggacaagtgcatcgtctaccggtccgtgagcgagtgcccaacccaccgctgcagatgctactgacactgaccactgacgagcatttccttgaaatcccatttgcctaattatttcgagttaccggaagagcgttctggtctgcgagaagcactggctagacaaaaccaagaagtggcgacctcctacatctctgtcatgtcatctcgcagacgggcactcacaccatggtgcttgattttgtttgggggcggacaagtttgttgggatgcaactagtacgactgtgtttaagtcagttcagttagagttttcggtggtttttagctgattgactttagattaggaaaaatagtgtacctgcatatagaagttcagtttgttaaaaaactgtcataaacatgataaccaggttttcagatttgttttgttctgtggattcctgataaccatattagttaatcgagttcctcaatttgttcagcagcaaggtttcattgaaacaataaaaaggagaaaattgaaaaaaaaaaaaaaaaaaaaaa

SEQ ID NO: 4220 - DNA, 936 bp, Triticum aestivum
  Clone ID: PAT_TA_4220
ttccctcctccacctccttctccaccgcccaaccgagtaccacggctactaagactagcagacagacgcgaggattctgctgcttctgttcaagcacaagcagcgccggcgccggcgatgaggtctcctcctcatcgatgatgactgtgtccatcaccggagccacggggttcgtcggacgcaggctcgtgcacaagctcctatccgaggatcacaaggtgtgcgtcttgacacgctccacctccaaggcctcctctgttttccctgcttcgaggtatccgggcgtgaccgtggcggacaaggagggagattgggagcgatgcattagggactcaactggtgttgtcaacctggcaggaatgcccatcagcaccaggtggtcaccaagagattaagagggaaattctgcagagccgagtcaatgtcacctcaaaggttgtggatcacatcaattctagtgacagcagcaatggcaatggtccctctgttttcgtcagcgcaacagccgtcggctactacggcaccagcgagacggacagcttcgatgaatccagcccatcaggcaatgactacctggcacatgtatgccgagaatgggagggccgggcacggcaagtgaagcaggagcacgtccgggctggtgctcattcggattcggggtcgtcctccggcaaaggacgggcgggcgctctggccaagatgatccccctcttcatgatgttcgccggcgggccgctcggcacaggaagacaatggtctactcttctgcttcttcttctttcttcttcttctttgctaggtagtaggtagtcatcaggtgtatatatatgtcccaaatacaatactgaacctgcacaatgtgatgtgaacgtgatgtgcctctacgaatatgtacatatatatagttctcatggattcaaaaaaaaaaaaaaaaaa

SEQ ID NO: 4221 - DNA, 810 bp, Triticum aestivum
  unsure (1)..(810): unsure at all n locations
  Clone ID: PAT_TA_4221
ggccccttttcttctcttgtttatttgtttgtttcttttgcggggaatctcgtcgtcgcgtagatacatctgacccaccaccgccacgccctagagcgcgcgccgtgccgcctcacccccggcgactcgcgccccctccgctgcgcacctatcgcgcgcgtcgccatctccgtcagttcccatctacccaacctcgtcgcgcccctgctccgtccgcaaccttgcttcctgaggtgactggtgtgcgttcttggtagcagctggttgtagcaatggatgatggggacctcgatttctccaacccagaggcgtacctggacaccggcgccgatctgcccggcggaggctgctccatggacagctactttgatgaatacctcaacgacacagagcaccttgcctgcactcatacccacacctgcaacccgcccgtcgacgacagttcacacacccacacctgcgtgcacgcgcacaccaagatcgtctcggcgtcgtaggatggcggcgccgacaaccgggcggccgtccacggtgccggcaagaagcggacgactggcttccgcgcagcccccagcgtggaccgggggatggacctggcccacgccccgctgcgcgggggggtggtggttcagttgaaggctctgaacttccggcggcgccccgggccccagttgcccgcggcacggggggccgacgctgccaggcgccgcggcctgcttgctcggggcagggggagaacccgcggggtgcccgcctctttcccttaccancggcctgtgaagaacggcgatttggtttctggtgttgatc

SEQ ID NO: 4222 - DNA, 1373 bp, Triticum aestivum
  unsure (1)..(1373): unsure at all n locations
  Clone ID: PAT_TA_4222
acgagggttgacgttctgcccatgggnaataggaaagctgcaatttttgcaaacaatgaacttaagaacgtgtatggtgatgccatccagtgttggtcggctaggacatttaatgtgcctctatgttgatattacagtgagattaccagttgagatagggaatttggtgtccttagaagagctgaatgaagttatggtgggtggtactgatgcgattgagaaagaactaggaaagctggcggagctgagtgtgcttggtctttggtgggagggagacgacgagagtgtttgtaattctttggtggtgtccttggccaatctgtggaaattgcataaattaactagttttctttgtggggatgcaaggtttgatgacagctgggacagatgggtgccccctccacacctccacgccttttatttttatcactgtacctcaacattgcctagatgttttaattcatcattgtttcccgttctctcctgtttgcatgtagtagtggatagagtgaggctggaggtcgacattcagatccttgggaaatttcccgctcttcgttctctctggctgggaaccaccaaagaccaatgcacacttctgtcgaaaggttcatcattggcaatgatgcattccccttcctgaggcagtgcgtattcgataattttcagacggggccatctatgtttccacgaggatctatgcccatgcttgaatcccttagcttctatgcccgcgtgtcgcacattgcagctggtgatttggatgtcgacatgcaacacctcccttcacttcagaaggttgatgcttgtctttggtctgaagaaaactgctcgccagcagtgaagaaagtggctgatttgctggagctagcatcgaacgcccatcccaaccgtctaacttttcgttggggtctgctttcattacccaaggaatgggaagaggagactgcatcactatccaccgggaacgattcatcagaaggggaggctgttagagccaatcccatcaattaaaatctgcagaatactgagcatgtcattgagaagatggacgtgaagctggaaaatggtgatcatgtaatgcagccttactgacagaggcggagttggctgatagccgtgtccagtttttcctttggtgtggatcatgtgggatgaggaactccttttcattttagctggcctagattaggtttggctggtggttttcattttccttgcagttttttgtgatcaatctgctgctgtctaaaatacaccaaatattattttgttttcgtcagccagtacgcactcattatcttgggtactcaacgcatgctcggaaaatatgctgttatcatgcgcactatcctataagaatggacaatttg

SEQ ID NO: 4223 - DNA, 575 bp, Triticum aestivum
  Clone ID: PAT_TA_4223
gcacgagggaggccgtcaacctgcagcatcctcccgccgagccgtcgcctccctcctgctctctctcggtctttatttggcctgccctccccgcgcgcgcaccgataaatacactctcgacgagggcggtcgagaagagaccgaaaggagcaagaaacatggcgcggctctccgtgaccaccactgccctcctcctcgccgccgtcgccttcttcatcgccgccgaggccgccgtcgggaaggacgtcaccaaggacttcaccttcgcccggggcataaagctgcacatctcgaagcagggcacggcgaccgaccacatcttcgccgggggcagcaagctcttcgtcgcgaggcacgacgcggcgccggccgaccacgcctccgcccggggcagcaagctcgacgtcacgcagagcaagatctccatcccgaagaagaggctcgccgtctcgcagagcaagctcttcgtcgcgaggcacgacgcggcgccggccgaccacgccttggcccggggcagcaagctcgacgtcacgcagagcaagatcagcatctcgaagaagaggctcgccgtctcg

SEQ ID NO: 4224 - DNA, 575 bp, Triticum aestivum
  unsure (1)..(575): unsure at all n locations
  Clone ID: PAT_TA_4224
ccatcccccactccactctccccatcatctcgccggacgcgtgggtctgcctgcccccttcccagcttggctgcttcagcatttccttccatagatcaagctattccccaagaaacgaggaaaaagctgtggcaactctcctgctccactgaccgctccgcacgcttcactcgaaaagcagagcagatcgagccagagcgcgtcgggcacacagccgctccaccgatgaagcccgccgccgtgaggaaagaggctggcggcggcattggcagtggcgcgttcggcatctcctgcctcgacatcaaatccttcggcgcctccctggtgctcttcgccctcatcatggcgctctggcagttccacccgtaccagccaatcctcgcaatcaccctctcctggtccctcctccttcccttccccggcggcacggcggcaacacacacacgnagttcttcttaatcanagcgacagaccgaacgacangcgcaggcaaaaggcaactgcatccggaaggaccacagggatcgctngaaccggnggtgtgcantggctnggggcngaatccacggggtgnn

SEQ ID NO: 4225 - DNA, 608 bp, Triticum aestivum
  Clone ID: PAT_TA_4225
aacccgcgcgtccccggtggccgccggctctgcctccccgtaatcccaacgttgcagcagggaacccgccgtgatgggttctgcatacccgacgggaggagactgaccggcggagaataaggtgctgccgcaatctgccgggtgccgggcaatgggcgtcgccgtgggacagatgaagccgacgtcgctgggcagccgcccccgtcgaatgcggccttcgtatgcccccttctccgagcccttcactgaacgccaggcacatgccgcgccgtcatccccatcctggccggcagcgtgctgtgcgtagaagcccatccctccctccgtccagctttctccaccgatctggctccaattttttttctgcttcctctccgtgttcgcaaattcgtttcttcgtgagggtgatccaagatggaagtatttggtgatcgggatgagccgaccgatcctgaatacatagaggtggatccgaccgggcggtacatgcgctacaatgaggtgttggggagaggagctgtcaagactgtttacaaggcatttgatgaggccgaaggtatcgaagttgcatggaatcaagtcagcatagatgaggtgatgcattgtcc

SEQ ID NO: 4226 - DNA, 733 bp, Triticum aestivum
  Clone ID: PAT_TA_4226
gaattcggcacgagatggcaagtggccacatcgcccaatgcctcggtggcatcctcgccaggcgggccggcgctactgtcgccgtctccggcgacctccgcctgaacggtgctcagctcgtggatggcgtgcgcagtctggcagccggcctcttggagcgcggcgtccgccccggtgatgtcgtcgccgtcgtcggcttcaacagcattgagtacatggagctgttgctggccatcccttacatcggagcaatcgttgcccctctcaactaccgctggagcttcgaggaggcggtgcaggcgctggagcttgtgcggccgtcggcgttcatctttgatggtgcttacagctcatgggcgctccggctgatggagagccagagcttctcatccatctgcctttacatcaccatcggggatcctgtcaacaccggccaaggtgcaaactttgtgtcagttgatcatgtcaagaggagttgcagaggaaccgcggaaatggagcccgtgtcggctccgagggatgtcgctttaatatgcttcacatctggaaccactggacagccaaagggcgtagcaataagccatacatctttgatcattcaatctcttgcaaaaatcgccgttgtcggctacggtgaggatgatgtctacctacatacagcccctctatgccatatcggagggatctcttcatgcttggccatcctgatggctggaggctgccatgtcctgat

SEQ ID NO: 4227 - DNA, 945 bp, Triticum aestivum
  unsure (1)..(945): unsure at all n locations
  Clone ID: PAT_TA_4227
gcgacgccttgnatctgactgtgcgaagaccgcnaagatgtcatggcttgcaggtacttgtggtcccaaggtaatcatccaantctactggccgcgggccacgcagtgcttcatctataacgcgaccggcgacaccctctaccacgtcggcaaccatgactggtctgggcacatcctcaatagcaggggctaccctgaacggattggcaacggtcagtgggctgccttcgttcactgccaagggtcattttcaggttcgatggcatcggttatctatcgtggcaagaacaaagatggtggagatcagcactacctggtttcctggaataacccaattagatatacttttgggttcaacaaggcttattgcgggatcggccctgtagactacttccatacacgttgggatcatacactcgataacctttcaaattctgataactattcatacgccaagtctgatggatgcgagattgattcaaaaattggcaagcgtgatgccccattttttattgcaaagatcacctcgctggttggtcacctccagcattgtgcaaggatttatatggataaatagatagtcagttaattccgtttgtgagagcatgccgaatggtggtattcttacgatcacttgtaatggagttaactttttcccatgtcatcgttggcgggtaggccacctctgtcataattgcgatcaatttcccaaactggcaactaacccgaagttgtagcgatttgcaacgaattaccccgactagtcgccaacccgtgcattcgcacggccagttatttagtattacattgtaatctatataacataaagctatgtgttgtgtacatttacactgggacgtgccatcctattctttcaaataagtcatatagtattttcaaaaaaaaaaaaaaaaaaaaaaaaaaaaaaaaaaaaaaaaaaaaaaa

SEQ ID NO: 4228 - DNA, 1131 bp, Triticum aestivum
  Clone ID: PAT_TA_4228
gaggggcgcgccgaagtgaactccgcgctggccgtgaaagaacactctgccatcttcctcgccggacgggatcctcccgcaccagccttcaccgacgggtcgctggccgtgctttcgaggctgcccccatcggagactcccagtatctgagctagcatggataggatgcgggatgccttggagcgggtcaagatgctggtcggcatggagttcgacgaggagtccgcgccgccgccgcctgaggagcagtccttcttcgacgacatcaaccggcactgcaccctcaacaccacccagaggttgtatggttttgcgacatgcttggctgccggtttgacttgcactttcttgtcgatgatcgttttcttcaatcctgtgaagtttggagttacattcacgcttggcaatgcgatggcactcggaagtacagcgtttcttataggtcccaagagacagtttgatatgatgcttgatcctgtccgtatatatgccactgctatatacattgcaagcatcataatttctctattctgcgctctcttagttcacagtaagctgttgactctacttgccatcgtcttggaatttggtgcccttatctggtacagtctaagctatataccctttgcacgatcagttgtttcgaaactgatggcatcttgcttcgacactgaattctagagcaatcatcatgatcggatctacctttggttgatggaacagtagtctcattgctggatcagtagatgctgctgatctactgtgtacttttaaccaagggcatgatcttctgttatgctcagaaatcatgttaaccttttccccactgttgctcccttcttgcgcacatatgtatatgacactcctttgttccctttggcttgggacctttcatgaacagtgcatttgtcgtggattggtaggaccagcacctgataacgcggtgtttgtgtggaaatcctgcttgcttaaagtcatatatgttgttaaaagtttcactgcttatcccggtggtgcttgccaatggcatcttacgatgtaaggtataaccatggggaaatcatcaattgcgcagttaaacttaaacttcatgtactccaacgtgagttctctccatctttaaaagggcta

SEQ ID NO: 4229 - DNA, 526 bp, Triticum aestivum
  Clone ID: PAT_TA_4229
cgtccggccggggccgcctcccgccgccgcgcggcgggggggcccgcgcccgccctccgcttcctctgcgccgtcccctcctcctcctcctcgcgctccgggaagtccgtcccccgcgcgcgccgccgcgacggcgacgacgacggggatggggcggccgtgaccaaggagcggattgtgcaggtggagctccacaaggaggccaccgacgcgtacatgtcctacgccatgtccgtgctgctcggccgcgccctccccgacgttcgcgacgggctcaagccggtgcaccgccggatactctatgcaatgcatgaaatgggacttgcatctcgtaagccatacagaaaatgtgccagagtcgttggtgaggtactcggtaaattccatcctcatggagattcagccgtctatgaaactttagtgcgaatggctcaggacttttcaatgaggtacccacttgttcaaggacatggtaactttggttcaatagaagccgatccttccgctgcaatgcgatacacagagt

SEQ ID NO: 4230 - DNA, 643 bp, Triticum aestivum
  Clone ID: PAT_TA_4230
cgcacacaaatcacaaaagcatataatcatcatccacgtttctcaaactcgaaagcccaaaggaaacacggcagtactcttcagtctccccaccgcctccgagcagacgcgagggccggggactggcttttattttcaaccacaacacgaacgatgaaagagacataaacttggcggcggcgaccacccgggaaggaggccgctggattattgtggcgggcgggagtcggtgggatggtcctcagctgacgagcttcctctggaggagggccctctcgcccggcatctcgtaggtgcgccggaaggggtcgttccgggcgtgccacgtgtccctgggtcccagaggcacgggccgcctcacgggctccggttggtgggctctactagtgcccttcaggtcagcaaacctgccggaaggcacggccggcgcccggttggtggtggaggccatcgacagctgggacagcttctcggctatgtcaggcgcgccgccgccgcgagggatgtgctccttcggggcgaggtagttcccgttgctcctcactggtgctggtggtagtctggaccagggctggttcatggcgttctccttcgtcagcttatggtctcccatggtttcacctgatgatccaactctagcttc

SEQ ID NO: 4231 - DNA, 2720 bp, Triticum aestivum
  Clone ID: PAT_TA_4231
gaataggcgaccatctcaatttcatctaatcgtcgagcaatcgttgggtttgcacacaaatcacaaagcaggtttaccaatccacgtttccggcactagaaagcccaatggaaacccaccactactctttactcacacaaaccctccaaccgacgtcattaccgacggagactggcctttaatgtgatcacgacacggagcgctactagtctccacaccctccgccacggacgcaagggaaggacccgctggaggctggtgttttgtggtgggggacggtcgatgatagataaagcgaagggggcagatggacggcaggcggcagggcgggcattggtgggatgggcgggcggggattggtgggatggtcctcagctgacgagcttcctctggaggagagccctctcgccgggcatctcgtaggtgcgccggaaggggtcgttccgggcgtgccacgtgtccctgggtcccagaggcacgggccgcctcacgggctccggttggtgggctctggtagcgcccttcaggtcagcaaacctgtccgaagacatgatcggcgcccggttggtggtggaggtaactgacagctgggacagcttctcggctatgtcaggcacctcgccgccgagagggatctgctccttcgcagcgaggtagttcccgttgttcctcactggtgctggtggtagtcgggaccaaggctggttcatcgcgttctccttcgtcagcttatggttgcccactggtttcacctgatgatccaactctagcttcctttgcacgccagctgctcttgctggggcgttagtgctcaggtacgagttattgactgccggtctcccgttggataaagtccccacagggtatctcctagcattcttctggtccatagctcctttagccccaactgatggtggtgttgttgcatatccggtcgatctgaaacgaagtgaaggggggacatagaagcatggctgaaagaagggatgctgcaaaacctccactgcggttggccttttacgtgggtcccatgagcaaagccacgaaataaggttcagcgcgtcttcacttgctgtgggaaccacttctgaaagatttatgcttccagactgaggaaactgaaaatggatagatgctgccagctgcagtcctccagcccaagtatgctgatttggtgtgccaagaatgctacagattttgtatatctcgtccgcttcacttgagcctgggaaaagaggtcggtgcgaaaaaagctctgcaataatggcgcccatagcccacatgtcaactgctgagctgtaaacagaagcttgaagtagaacctctggggcacgataccagcgagttgacacatattctgtgtatggtggttcagaaataatctcacgagcaagcccaaaatcagctaccttgatgagctcctttgtaactagcagattttcaggcttaaggtcacgatgaaagtatccacgttgatgcatgtgactaagagcttgaaatacttgaaagcaccagttccggatctcagtctccgaaaaaggcttgcccttgctcttcatcagctgatagagattgcattccatgtattcaaaaacaaagaacaacatgtcattctctcttatgacctccttgagcttcacaatgtttggatggttcatccttcggagggacttcacttcacggagattgatgcactcctcccaagaaaaatattttttcttcattttcttgattgcgaccacttcgccactttctttattgattgcacgccaaacactaccaaacgtaccgtcacccacttccgtaataatgttatacctctccattttattagctagaatgcaaagctgtccttatttttgaacagtcctataaacacaaacaagactcatacgcgtattgccggaatgtctttggagagtagatcaccaaagtcactgcaggcttttttcaaacgtctgtaagcaatacccatactttgtgacaaataaacttgaacacctttgccctcacgttacgccatcagaagtgaagcctgatgaagaacagtgcacactatacacaccaaagatcaagccggacaaactgaaaactcgcagtgataggggagaagagagctgacagaagcaaagaaaaccagaacctagagcttgtaaccgacaaggaggatctacgggttagatcccaagtgtccaaagaagttctgatggtaacttttgctggctgaccagtgccacggcaaaaattacgaaaatgttgccagagaagagacgcaccatgctcgaatagatgtgcaccgcaatcactagtcggccctaatgtccagtagcatgggaccaggcacggtagtcgctaagccaggtgtgttcttcaggtgcaattgacgaaggagatgacaaggaagtctccgtaaagacaaaatctccagccaagaacttgctcaagcagcgagacgtgggatacaggggaacttgcatagagggtgcgctccatatcctttctgagaatgctagaaacccagaggcgaatggtgttgaaacctgggcgcctctcggcataacaacgcgccgccgccgccgaaggacgcgcccgccgccgtggggggatccagcgtggggggaggggtcaacaccgcggcagcgcggcggaggtcgctcctctcctctctgcccggtggtggaggtgggtttgttttttcctctcgccgggtcgggcacgag

SEQ ID NO: 4232 - DNA, 600 bp, Triticum aestivum
  unsure (1)..(600): unsure at all n locations
  Clone ID: PAT_TA_4232
tcccccacaccccgcagcaccgacccacccatatccaccttcttccccggccgcgcccaaatcctagcctccaccttctctccttcggccggcgagcaagccaccagcgccgcccccgcgggcttccaccacaccgcctcgagcttcccctcccctcccccctcccccgcccgccatcgcctccgcagtgaggcgcagtgcgtttccagttcgaggcgcgccaccggccaataaccacctcgggctaccggcgcggatccgtcgacccaccgaactcaccaccatggatggccacctgcatcgctggatggggtcacctccaaccccaatggtaggatctacccatcccgtggtttcctcttcgtggatctggatccgggcgaggaggccgccctctcctgtagaccacgccgcgcccaacagccccaaccggcgaccgtacccttccccggtgacccgccgctccactcgtgccccaccacctctcggtcgccgtcccttagccccccacaccccanccatcttccccgtcgggcggcgcacctccctgtagtaccatacccgttagccgcacgatgcgacccctctgctggcccccga

SEQ ID NO: 4233 - DNA, 624 bp, Triticum aestivum
  unsure (1)..(624): unsure at all n locations
  Clone ID: PAT_TA_4233
ccctgccctcctcatctagagcccttcccagccgacggaggagcccccttcccagccctgcgtcggagttcagaggcaggggaggtgtggatcgatgatggtgcagcaaagaagaggatgtgagatcgaggagggagcgagccgttgcagaggagatgggagaagggggtgcgcggtggtgaggcatcggcaccggagaagcagatccgcggtgcgcggtgaagcgggatacgtgacgccggccggcgctcgcgggtacgtcctgcgggatgacgccgcagctccagtcttctccccgcggtggtccactggcgctatcactgtcgtcctcagcaggaggaccgcgggacgcagaggcggccggctccgtcctgctcttgtgccgccgtacctctgcctttctcgtccgccgcgccccaggctagcaggtggacggcgcggagagctctcgtcacaagacgcaggaggatggctctcgccgacgccgcgctctgctcctctcgcctctgccgcgctctgctccggctcgcccccgccgcgcccggccctgccgtccannnagccgatgggtcgccggatccgtcggccacccatggacttcgcctggaacgcgggctgggnnnn

SEQ ID NO: 4234 - DNA, 432 bp, Triticum aestivum
  Clone ID: PAT_TA_4234
atgggtttggatggggatgtctcagtatgcaattctttactcagcatgtatgcgcggtgtatggatttctcctctgcgatggatgtttttcatgagacaaaagatcgtgatgttgtcacctggaacagcattctcactgcatgtgtacagcaccagcatctggaagtagtctttgagttgttcaaccttttgcagaggtcggtgccgagtctggacgggatcagtttaaacaatgttctgagtgcttctgccgagttgggttaccttgaaatggtgaaacaggtccatgcatacaccttcaaagtaggtctggtgaacgatacaatgctgagcaatggtctaattgatacctatgctaaatgtggaagtttagatgatgccgcaaagcactttgaaatgatgggcaccaactgtgacgtgttctcttggagc

SEQ ID NO: 4235 - DNA, 1650 bp, Triticum aestivum
  Clone ID: PAT_TA_4235
tcgccgtcgccgacgccgccgtcccctgctccggcgccaccggcgcagggcaggggtacgtgtggatgtcgcaccggacgcccgggagcgacacgtgggacctggcggtgcggagcaagcacctgtgggaggacctcgcggccgagcgtggggcccgcctccgcgccggcggcgcgcgcgagagcctcgggtggatgagagacaggaagcttattggttggaagaacctccaaagagctggctacgctggaggagaagactaaggttctgtctcaggcaggcatcaatgcggagtgcttgtctgcctcttcgttgcatgcattagaacccgcactctgtgtcggaaacgatggtggtgccatgttcttacctagatgaccgtcagatcgatgcgttccaggccgtgtctttgattgaaaagatcaataggtcatatactccaaaagggagatatatggagctctacaatgatcctgccatgtcattgatcagatcagaggttactggaagggttgaaggtgtccaaacttctgagaacatcttatatggcagaaaagctactgtagttgcttctggtgcttggactcggtccttattgcatagtttcttaggaccaaattctacactggatattcctgtgtagccacgaaagggtcatctgcttgtgttggaaaattttgacatgctaaagctgaatcatggcataatggagctgggatatgttgaccatcagggcgataattcacatagcatacacttgtcctcaacatccaataaagatgagcatgacgccgcatccatatcaatgacagcaacattaaatacaaaagggcatttagttttaggaagcagcagggagtttaaaggattttcaagggaggttgataaatccatactgaagagtatatgggcccgtgcaggagaattctttcctgccatcaacaatgttcatcttgatattgacgaggacaaagaaatcagaattgggcaccgcccctacatgcctgatgggaagccagtaattggatttgttccggatatgtcaaatgttttgattgcaacaggacatgaaggaagtggacttgctttggcgctaggtactgctgaaatggtgacagatatgattcttggtgaccctggaagagtggacttcacgcctttctccatagaaaatagattttcaggaacagcatgaccgtttatccgcaagccctccttgagctcctcaagcgtcaaagtaccgtccttgtccttgtctatcatttgaaacatctgagtgtagttctcgatgtcctccgccggtaaatccttggcaacgaccttcattaatcattggaaaatgattcacatcaagaatatatcacactggaagaaaaatcaagaacaatgtggcccggttccgtgcaacttactccgagtgccttctttttggactggttcatggacgagaattgcttaagcctggatcgaacaagcgctccaagtgacacatttggagccttgtcggcgttcttgagccacggatgctctgtttcgtaggaggagaaattaatgctcttagttcagtgcataacaccatttgtcatgcatcgctagacctccggtttcccaataataccatgaattaggcaaaaaaaaaaaaaaaaaaaa

SEQ ID NO: 4236 - DNA, 1704 bp, Triticum aestivum
  Clone ID: PAT_TA_4236
cgcacgcgtgggggtgattcgtaatcaaacttgcaaagaacatccttacttttgatgatgtttgaaaagtaccaaggattgatcaacttagaccaccggttgatatttggttgcctttgctttgtaaccagtgagggctgaagtgaatgaatctggaagtgctttagcgattaatgctctgtcccaagttaagcatattctacttccggtcactggccgaaagccttacctttcagttctaattccttgagatcagcgcagttgagaatatagccatcgattcggacgagaacttccctgcgctctgctaaatcaacttacctactcctttaaccttttcatggttccttattcattttggcagttccccagtccaaacgagcactcatctttcatgggtgatttctctaccgcaactggacttgcaactttcatgatgatgctgttaggctggattacattccaaagatttggttggggggtggcttcgtctaccaccgcgtggggaacaaacttgtgttgaatgatccttctcttccaaaatctgacctcaagaagaaaaagaacaaacctaagcttagcatgaaagagagtatgaaagttctgatctcttcaaaatacgtgagggaccttgctaccttagtcgttgcatatggcattagtatcaatcttgtggaagtgacatggaaatcgaagctcaaggcacagttccccagtccaaacgagtactcatctttcatgggtgatttctctaccgcaactggaattgcaactttcacgatgatgctgttaggccggattatattccaaagatttggatggggggtggctgtgatgatcacccccacagttttgtcggtgactggcacagtgatcttctctcagatttggtttgggcaaccactggctcccctgcttgccacatggggtatgacccctcttcttgcggctgtttatgtgggtgcgctgcagaacatatttagcaagagtgcaaagtacagtttattcgacccgtgcaaggaaatggcctatattcctttggatggagatatgaagttgaagggaaaggcagccattgatgttgtctgcaatccattgggcaagtcgggtggtgcgctgatccaacagtttttgatcctgatatttggctctttggcaaactcgaccccctaccttggcggtatactgttggtcatcgtgcttgcatggctaggcgcggcaagatcattggacaagcaattctcaagcttggccaaagaggatctcagaaaggagatgtcgaaagagaaagtagaaacggcggcacccaaggaacctgaggcggctactgatgtattggtggagcaatcaaatggaactgagaactcaccatccgactcatctccagctcaatagaccggtcaaccttctttggagaagccataggcaggaggatactggttacgttgagcagaaataatgatgaaggaacgattgacgatttctttccagagtttgtaacagtgagcagcatcaagggtgctggttagtttgtaatggtaagcaaattttgacaactggcctggtaggcctggtgagccggtgtggaaattcaaccattgttgcaattacaacacacagatttttattgtgttctcgcaaaaaaaaaaaaacacgggctcagaactttaccatgtcattggtgcctggtctcaaaaaaaaaaa

SEQ ID NO: 4237 - DNA, 1375 bp, Triticum aestivum
  Clone ID: PAT_TA_4237
gcatcggcccggggcggaggcgggctcgtggtcatggcccggggggcgcccccccggccctcacccggggcgccggcggggacctctggtccgccgacctccccctgcgccaggtccgggcgcgcttcgccgccggccgccgcagccccggcctcgccgcccgctgcgccggccgcgagggctttacgggcacctatcggtggatggctcctgaaatgatcaaggagaaaacccacactagaaaagtcgatgtgtacagctttggaatcgtcttgtgggagattttaactgctttggttccattcagcgagatgacacctgaacaggccgctatagctgtcgccctcaagaatgcgaggccaccgttgcctgcttcgtgccctgtggccatgagtcatctgatatctcagtgctgggcgacaaacccagaaagaaggcctcagtttgacgatattgtcacggtcctcgagggctacaaggaagcgcttgacaatgacccatccttcttcctgtcatacataccgcctccgacgcaccacccgcatcagcatcagcagagcctactacggtgcttccctcgggtcaaatcaatgcgccggtccgcgtctctcaaagcgtgatgtctgcgggcggtgctcctccttcatcctcgccatgtataatatgcacctttctctgagtttcttcctctctatgtgccggccctctattattgcggcatctaggctcgctccaatttcgttttttctttcttcttggttattatgattgccatcattgatgatgccgtcgaagccggccgtgggtttctatctagatatgacaaagcagttctccctgccagatcgtcccggcccttgcagggtccacaaggaagcggcttgacaacgacccgtcactcgtccttggtcatgcaattaccgcctccgcctgcaacaccatcccgcagcacccagcagagccttctccggtgcttccctcgggtgaaatcagtgcgacggtccgcttctctcaaggcatgatgtctgcgggcggtgctcctccttcatcctcgccatgtataatatgcacctttctctgagtttcttcctctctatgtgccggccctctattattgcggcatctaggctcgctccaatttcgtttttcctttcttcttggttattatgattgccatcattgatgatgccgtcgaagccgccgtgcgtttctatctagatatgacaaagcagttctccctgcagattatctatcggctgccgtctacttgtgaccgagtgatggaaccatgaactagctagcttttgtaattgtaattataactgagctcttcatgaatcgtgttcctactcaaaaaaaaaaatcaaaaaaaaaa

SEQ ID NO: 4238 - DNA, 690 bp, Triticum aestivum
  Clone ID: PAT_TA_4238
ccacgcgtccgtgctgtcctcttcatagccctagcccactccccgtcgccgccccccgtccccaaatccgccgcccccctccgccctatcggcggcgatctgccgcgagcactaccatgcgaggggcgcagctccccgccgcaccctgtcgccgcgcctctgccatcccactcgagcaggaacggcttctccaatctgcgccggcggcaatccctgatttcccttccacctctctggtccaggagatgcctagaaagaatcaagaatgtacacgcatgggaggaggagcaagcacaagtaagaagagaaaggcttctttacagtccaactccaaccgagaagattctccgcctccgagggatgacctttcacgcatattacgcaagagcctacttccccgtggttatcctatgccatctaagattactgggggcatgcgcttggtgaatacatttgagctctgctttggaaatttagatggctacagtgaagagcacaccagcattaagttacttgctttgagcctatgtcagtccattgtctcacttgctgcttttaagggtcaaaatagacggtttacatgcacaggcacaatcatccagcacacagcatccagcatgagcattctaacctctgctagcttgattagatcctctgaagatgaaagtaagatacttgataaactggaga

SEQ ID NO: 4239 - DNA, 664 bp, Triticum aestivum
  unsure (1)..(664): unsure at all n locations
  Clone ID: PAT_TA_4239
cgtgtcggtccgctccatcctgctacccaaaccctcggtccatctcggcatcgatgaacaacctccgcctgcttgatctcacctgatccgagatcccgaccgaatcgaagccctcggcgatctcaacgagcgcgtcgttccggaggacacatcaccggcttggtcgccggatcgggatggaaggcgatccgatgggcgtggcgctgcccgaggacgccctcgcggaaatcctccgccgcctcccgccgcgcagcctcgccacctcgcggtgcgtctgcaaggcgtggcgctccatcgtcgatggccgccggctgctgctcccggagctcctgccgcactcggtgcgtggcatcttcctcgagtataacgaggcctcttacccgggtttcctctctcacccctccatggagccgggatgatatcttgggcaagctcaaacttccatcgtcctccgccccgacccctaccaagtggacctataactcacaatcgaaggggtcacggtaatggggctccctgctttacccgaaaaaaaaggcaagggntccaaattggcaaaccccnccaaaccaaattggggggggaaacctngccccccnccccccgggaaangggaaaaggganggggggggtncttcaaancccaaaccttntgtttttnttt

SEQ ID NO: 4240 - DNA, 512 bp, Triticum aestivum
  unsure (1)..(512): unsure at all n locations
  Clone ID: PAT_TA_4240
gtggctcgcggagttcacgaggcccttcgcctgggggggtctgctcgggctcgacgcctctccgatcctgggtttctccccccgcccggttccctgcatcctccttttcggccacgcccgcgtcaactgcgcgtgcgctttttgaggcccctctccagtgctgtcggggcgcgggcggctcgcgtctgtccctttaccccatcccccgctcggggccagtgaacatcttttatgtttatacaagcacaatttgttgctctattcatccgtggaaattgtttggaggaagcagccctgtaatgcctacttgtcacaatctacacgtggcatacggtcactactgcgaaaacatggggttcgcttttctatgcctcctttgcaatngctgaagtggagcaagtttactggacnatgacctgatgggaattttcaaaaaatccaaacactcaatctggggcnagacacctcaaaaagatgcnttatctgaggggggcaacaactacagaagtcac

SEQ ID NO: 4241 - DNA, 1051 bp, Triticum aestivum
  Clone ID: PAT_TA_4241
aaatcatagcacccggccggatctatccgacagccggagctctcctcgctctgcacaaccatttttggttcgatcccggagaagctccggggctccttgaagcgatggatcagcgggcgaggcaccctcccggcatcggcaacggccgcggcgggaatcctaactaccacggccgtggcccgccgccgacgcagcagcatcaccagcagccgtcgccgccttcgccgcagcaggcgcaggggcacccgcagcagtacatgcagcggcagtgggagcactcgcagcactcgcagcaccacagccagcagcttcagcatcagcagtggcttcggcggaatcagaccgctggcgaggccgccgcgggcgccgccagagccagcgagcaccacgcgccggctgccgcgggtgacgccgatttgagttcgcaagactggaaggcccaattgaagcttccacctccagatacacgctaccagaccgaggatgtcactgcaactaagggaaacgaatttgaagactattttctgaagcgtgaacttcttatgggcatatatgagaaaggatttgaaagaccgtctcctatccaagaagaaagcattcctattgcattaaccggcagcgacattcttgcaagagcaaaaaatggaaccgggaagactgctgcattttgtatacctgcgctagagaagattgatcaagacaaaaatgctattcaagttgttatattggtccccacgagggaattggctttacaaacatcacaagtctgcaaggaacttgggaaacacttgaagattcaagtcatggtcactactggaggaacaagcctaaaggatgatattgtccgtctttatcaacctgtgcatttacttgtggggacgcctggtcgtgttttggaccttacgaagaaaggcatttgcattctgaaggactgttcaatgcttattatggatgaggcagacaagcttctttctcctgagttccaaccttctgtggagcagttaattcgatacctttccatcgagtcgacagattctgatgttctctgcaa

SEQ ID NO: 4242 - DNA, 492 bp, Triticum aestivum
  Clone ID: PAT_TA_4242
tgcccgcggccgccgcggcggcgggccggagtcccagtgggcgcggcgggctcccgcgccggcgggcggctgccgacgaggaggacgatccggagacccaggaggcagagtgagctacgtgcgggcggaggggttttgaagaaatttccaaaattttgcccgtgagtatttatatccctaccctgtcggtgtgaccgagtggaacaactcggtggcaccgagattcataaccgcaagcagttgctgaaactcggtgtgaccgaaaggttcaaatcggttgcaccgagattgaaaacctagatcgacttagtgaactcggtatgaacgaaatggatgaatcggtcagaccgaaatgcacaaagaagttttggaagtttaagtctatgaagaatcggggactccgagtgctcctcacacagagtggttcgaatctgacttgatcaaattttgtgatgtagcatgaatagagtttgagacgagaaaagcatagat

SEQ ID NO: 4243 - DNA, 713 bp, Triticum aestivum
  unsure (1)..(713): unsure at all n locations
  Clone ID: PAT_TA_4243
accggtcggaatcccggggggcccacgcgtccgggtttttttttctgccgaacttacctatttcctttcttctctgccgccactgtaattctagaaagtgagatcttctaatcaagtgtggttagtccagataaaaaaagtagttagtccagtgattgcgtggcattgttgtctcctgtgcggcgccttttcgagtaaaacatcagtaatggagtattgcaatcaatttatgtgattttgatgatgcatgantgctgcaggcttgaacaagagtcgggcttttacttcaacgtcaagtactttgaggagaaggtccatgctggggagtgggatgaggtggaaaggtatctctcaggtttcaccaaggtggacgacaataggtattcgatgaagatcttcttggagatcaggaagcaaaagtatttggaagcccttgataggcatgatagagcggtagatatccttgtcaaggatcttaaanctctcgacatcaacgaggattattaaagagatacacantctcacnctngagattcanggaaatgacantaccaagtaggggataaaatcnccncatatagcgatngggctaaaaaacaacnaagaatccctttcggaaaattgcntcaacctaggancgttggcntaatacaagttacgganacantttanacccggaatcngtcagatttagtaaatgnccccaggaagaa

SEQ ID NO: 4244 - DNA, 980 bp, Triticum aestivum
  unsure (1)..(980): unsure at all n locations
  Clone ID: PAT_TA_4244
gccgtccgcaagaagccaaagcgtaaagaaaaagtgagacctcatctctttcagctaagctcgcaatggagctcccatggggtgccctgctgctggcgctgctctccgtctcctcctcctccgccgtcgccacgctcgccgtcaccgctccccctccggcccctgcccgtgctcctgcccccgtcaccgcccctgcccccgcccatgcacctcctcaagctcaggaagctgaaggtctgctgatcaacggcaacttcgagacggcgccgaggaaggtgaacaagaccctcatcgtggggcggcactcgctgccggggtggacgctgcggggccacgtcgagtacgtctcggcggggccgcagccgggcggcatgttcttcgcggtgccgcacggcgtgcacgcgctccgcctcggcagccacgcgtcggcgtcgcatcacgtgtccgtgcgcccccgctcgctctactccccctccgtcgcctgcacccgcacctgcccccgtcaccgcacctgccccggcccatgcatctcctcaagctcaggacgctgaaggtctgctgatcaacggcaacttcgagaatgcgccgaggaaggtgaacaagacccttatcgtggggcggcactcgctgccggggtggacgctgcggggccacgtcgagtacgtctcggcggggccgcagccgggcggcatgttcttcgcggtgccgcacggcgtgcacgcgcttcgcctcggcagccacgcgtcggcgtcgcagaacgtctccgtgcgccccggctcgctctacgcgctcaccttcgccgccacccgcacctgcgcgcaggacgaggccctgcgcatagcncgtgtccccctcgctctcggcccccgccgacgtcgccgtccgcaccctctacagcgccgacaccgccgacacctgggcctggggcttccgcgcctnctcccccgtcgcgcgggtcaccttcagcaaccccggcgtgc

SEQ ID NO: 4245 - DNA, 835 bp, Triticum aestivum
  Clone ID: PAT_TA_4245
ctacgacacgctcgtcagcgcgtctcaaaaagccggcgtgcccacctcaagtcgtcgtcggcgagatcggctggcccaccgacggcaacaagaacgccaacgccaagctcgcgcggcgcttctacgacggcctcctcaagaagctgggcaagaacgagggcacccacctccggccgggcaagctggacgtctacctcttcggcctcttcgacgaggacatgaagagcatcgcgccgggcaacttcgagcgccactggggcatcctcacctacgacggcaagcccaagttcagcatggacctgtcggggcaagggaacgacaggcggctcgccgccgtgtccggcgtggagtacctgcccaagcagtggtgcgtgttcgacgacgaggccgcaaaggacgaggacatggacaagctgggggggaacatccagtacgcctgcgccagcggcgactgcacggcgctgggctacggctgctcctgcaacggcctcgacgagatgagcaacatctcctacgccttcaacatgtacttccagatgcaggaccaggacgtgcgcgcctgcgacttcgacggcctcgccaagatctccgacaagaatgcctccaccaagagctgcctcttcccggtgcagatcatcagcgccgccaccgtcccggcacgcccatcgtcgctgctgctgctcgccttgttgctcgcgcatgccctggtgatgacgacgggttttatcatcatgtagtagctagctagctagctagagggcggtcaaacatcggagcggagcgggggagcaacgaatccgatcattcattttgcttgaaaaaaaaaaaaaaaaaa

SEQ ID NO: 4246 - DNA, 608 bp, Triticum aestivum
  unsure (1)..(608): unsure at all n locations
  Clone ID: PAT_TA_4246
gcacgagggactaatcgacgccattagcgagcgagagcacgagcgcggcacagtgccacgcatcgcacgcgaaccttcccaccccctcccccccctcccccgccccccagccccgggccggcccccgccgcgccgccgcccctcccctccctccagtcccccctgcccgcccccccccccgcgcggttcggccagggacggaggcatcgtcgtcggcgtctggtgtgtcggctgtcgaggcgaccgcgcggatggcggcggtggcggagggctcgcccgcggcttccgcggcggcggccaaggaggcggagtaccgcaaggacgtgcagaagctggtggacctgctctccaagctgaacccggccgccaaggagttcgtcccgtcctccgcggccgccacgcccaggaaggggctgtcggcggacgcgccggtgttctactacggcccgatcggaggccggaacggggggatcgccgggtaccccggcgccgacgccgggtacattgggtaccagcagcgcatgaggaggaattttgtagataatgagaggaggaatgtatacatcaatcatggaaggaggacaaacgagnnngcgaggcgtgcagnn

SEQ ID NO: 4247 - DNA, 2101 bp, Triticum aestivum
  unsure (1)..(2101): unsure at all n locations
  Clone ID: PAT_TA_4247
ggtgtcttcccgttgcgtctgatgtgctcgcaggtggtggtgacgggggactgggtctgcggcgtgctgcagcgcaggggcgctctcccgtctcttagctgcccctgcgtggctatgcctctctcgtcccgtgggcccttggctctggaatgctgctggcgcatggagttctgctgacctattcacaggtttggcggggtagagaagtggcacagaaggagatgtttcatgttatgagggagacatttggccatttgccctggtaccgtgacagactttttcagactgtcccgcccagccctcctgcattgtcgctgtcagtgcatccacgccgtgcttttggcgcattccctccgtcgctgcccgctggtgcattgcggggcagcccccgccttggtctggtcccggctccgctcgcggccgctatggccttctcgctgcgggctgcggcggcgcgtgttgcagctggtggcctccttccaggggcgggtcctgggggcggaggggggactctcggcggccgggtttggtgctggctgcagctgcggggcgcgctccctgctcgccgtgggaaggacctctaacaccttccattgattacaaagcaaaggatgagataaccaaggctggcaagctgaccgtgctatgctcttctgagactgtgtttgaagtgcggggcagcggtatttttgttgttaatcttgcaaactgcgaatgcacgtgccggaggtggcaactttctcgccgcccctgctcgcgcggccgtgccgtgcggcactggtgagtttaatgcatcaattgagagcataaggaatatatccactgaagctgccgactggatcattgcgagtaagccagagcattggtccccggccggctcccccggctgtcgggcgctccagctctcgtcccgcctccctggccccgggcatcactggatcccagcagggagcggggggtccccggcgcggcaaccactcttatacggctctgtagcaggtgcaagcaggcaggccacaacaaggccccgcgtgtcgcggcttggcccttgaccaccctccatcgttttctgcgcgctgggtgacaggttcacggcgaggaagctgaccgtgctgtgctcttccgagactgtgtttgaagtgcggggcggcgggacttttgttgttaatcttgcaaattggggatgcacttgtcgggggtggcaactttctggcctcccttgtgtgcatcctgttgcggtgtttaactggattggacgatctttctacgactactgttccaagttttttaaaatagagagctaccatatgccatactctcggtcattcctccctagtcccgtcgtggttccctctgattcttgtgcggggcctacgtcccctcctcccttgccgcgctcctcagctgctccctgttgtgggcggtttaatcccaacaaggtaaccactcttatacggctctgtagcaggtgcaagcaggcagtgccacaacaaggcaacatgtgaagcccttctgtagacaacaggcaaaatcttcatctgcagtatgtatagcaggttcacttggaagtctgagtgtggtgaaagagagttcatggtagtctgttcacttggaagtctgatgtggtgaaagagagttcatggtagtctgttcacttggaagtctgatgtggtgaaagatagttcattgtagtggcttctgtttttagagggaagggtggagataacacgacatcattcgatatgattttgtttatatgaggggtgtaacttaaagttctgtagcgatggactacagatgatgatccggtgctagcttctggacagtgtcaactgaaaacagagtagtcgatggttagctgtttagctatagctgtaggttcagttattttatcctagtgtcatagtattattctcaaattcttgtgaatgtcatagttcttgtagtcagttattgctctgcatagcagctgtctattgtggtcaggatcacttctcctttgtagtccatcaagctttgctctctgttctgttgggatcatgtatagtagataataanattttgtgagcacttgggaagtatatacattnctcacgatttg

SEQ ID NO: 4248 - DNA, 851 bp, Triticum aestivum
  Clone ID: PAT_TA_4248
ataatgctttgatcaaagtattacaatccattaatgcagctcgatacgttgaatccacattggcacaatggtgtgaagatgtgttctttcttgaaatggaaaatctacctgtggttggagaagaaggggggagtgtattccagcaagagataaatcaactgaaagaattcatatctgaatgggtagataagatttctactgtcatccttagggcatttgatgctcgctcccgtgattatctgaagaacaagaggcagtggcaggagcactcagaagaaccggccatatccagggccatcatagagtcttcaggctacattcaagggaggctatctaagcttgaagacggcctaaatgtgctggattttgtaacagtagggagagctgtggcaaccggagtggaccagctgctttttcacaggcattttcgctggaagcccaaagtttagtaacggtggggtggaaaggcttcatgctgatctgagtgctcttttcgctgttttccaagcctggtgtctgaggcctgaaggcttcttcccaagactgtccgagggattgaaattgctgaagattgatgagaggcaactaagagatagtaggttggttacagataaaaattggctgcggggacatggcgttaggcatctgacagccggtgaggccgaaaagataattaaaaatagggtgtatgatgcatgataatgatacatgacattagacatcgtcaggcttttgaatgtcaaaaatgaattgccttattggaatggacttccctttttttgtattttatacaaatttgtgtcatcctcttttagagatgtatcctcccctttgttttttttaaaaaaaaa

SEQ ID NO: 4249 - DNA, 487 bp, Triticum aestivum
  Clone ID: PAT_TA_4249
ccaagggtgctctgttttgcattgattactttgctctaagatcgcagcagtacaaatggttggaacagtttgctgaagagtaccagtgtgataactccctctggctgtttcctaatttctccttttctctagccattgcacggttttatcttgaacgtgatgctgaggatgtttctgatcatgctgacaagtcaacagctgtggatctcatgaagcaagcattgatgcttcatcctctggtgctttctaagattgttgacaaggctcctttgaaggactcctcatggacccaaatactcaagaatgcgttctttggatcagcaaagccaggaagcccttcacttgagcatgtgattaacatatatgttgagccgtcattatatcatgtggaggttcccggaacttcagaacttactcaaagaagctgctcttctggtgattgaatcactaaagcacgacagcagagaagcccaggactgggcatgtg

SEQ ID NO: 4250 - DNA, 606 bp, Triticum aestivum
  unsure (1)..(606): unsure at all n locations
  Clone ID: PAT_TA_4250
gcacgagggacccacctccggccggcctcagagcgagcgagagagagagagagcggccatggcggggaaggggagcaagaaggacatcgattccgtcctcatgcaggccatgctggccgccaagacggtgcgggcgcagcgcgaccgcctcctgcagctccagcaccgcctgcaggacctccaggccgacgccgcccccgcccccgccgacgccgacgccgacgctaagctcggggagctcgcctccaacctcttcaaggtctactacatcggcctggaggccggcgcccgcatgctcacgacctgcatcgagatcgccgccaagaagggcattcacttctccccgcccaacctggctttcgcggtcatgcccgacgagcagctccacgacgcgctgctcgcgcagcagttccctgcccgccccaggtcccaggcccaggccctcgaccgcgtcatggccgccgtcctggccatcaagctgctggaggagcacctcctnnngcgctgcgtcgagtgcctcgccggcggcnnnnnnccgtccccggcaagaccccgactcatcctcgcccgacagcagcnnnnacagggacgacgacanggaccnnn

SEQ ID NO: 4251 - DNA, 785 bp, Triticum aestivum
  unsure (1)..(785): unsure at all n locations
  Clone ID: PAT_TA_4251
gccgctcccttctcctccttgccctcgttttctcctctctggctagggttatcgccgccgccttcggcaccatcccagctcgcagcctcggtcgatttgctctgcgtctccaaccgtccaaagatcccaaccctatcatcgtctcctaccacgagctcggcgacaagatcgacgcaagttcggctccgttcggatctatgccgttcaagaggttcgtgctgatcgggcgggtggccctggtgaactacggcaaggactacagccgccttgtcgtcatcgtcgacgttgttgaccagaacagaaacgtcgaggacacggtccaccgcgacgtcgagatcatgcaacacctctcgggccaccctgccgtcgtcacgctgaaggccgtctgcagcggctgcaaatcgaagtagctgaaagggagaaggcgattgggagtcagggactacatatctctcctctcctttattttctgtccaaaatataaggaagacgtatgggttctcgtcgaatgcaagcggtactactgtgaaaacgtgtactgattgctccctgggccccccccacatcctgggcgtctccgtcatgccagctttgtgacgtcccgcccgggcgaggcaaaacannattaacggaacgntaaactgggaactcacaaggaccccaaantcaacgaancccaancgtcgggttcattatcaacacaaaaatcacacattaccaaaaagggcnattgctttgnaaaccccaaattcaaggttngccaaattccnatgncccaaanttcc

SEQ ID NO: 4252 - DNA, 985 bp, Triticum aestivum
  Clone ID: PAT_TA_4252
gctttgtgcctttaaaactcctgtggatcagtctgatctgtcgttaagaaagtttgaggagttaacgaaggagctagaatcccttcagaaagagaagagggaaagattaaagcaagtgatggatcatttgaacacattacattccttatgtgaggtgcttggcattgacttcaaacaaacagtgcatgaggtgcaccctagcctggacgaagctgaaggatcaaagaacctgagcaacactacaatcgagagactagcattggctgtggatagacttcgtgaaataaaaattcagaggatgcaaaagcttcaagactttgcatcgacaatgctagaactatggaatcttatggatacaccaattgaagagcagcagatgttccagaatgtaacgtgcaatattgctgcctcggagcatgaaataacggaacccaacaccctgtcgatcgacttcctcagctatgtggaagctgaggttttaaggcttgagcaattgaaaggaagcaaaatgaaggacctcgttttgaaaaagaaatcggagctggaggagcacagaagacgcgcgcatctaattggcgaggaaggatattcagatgaatttaacattgaggctattgagtcgggagctattgatcctgcattggtgctggaacaaattgaggctcacattgcaacagtgaaagatgaagctttcagtcgaaaggatattcttgagaaggttgaaagatttctgaatgcatgtgaggaggaagcctggctggaagattacaacaaagatgacaatcgttacaatgctgggaagggggcacatctgacgctcaagagggctgagaaagctcgcattttggttaacaagattccgggaatggtagatgttttgaccacaaaaatcattgcttgggagaatgaaagaggaaaagagttcacatatgatggcgtacgccttctctcaatgctggatgaatacatgattgttcgccaggag

SEQ ID NO: 4253 - DNA, 581 bp, Triticum aestivum
  Clone ID: PAT_TA_4253
cccaagtgggactgccactgccgccctcataaacgggttccacacacctcaaggagataagaatgcaaggcagcaggtccgtgggattcctcaagtactttgggatcagcttcttctggagcttcttccagtggttctacaccggcggcgacgtctgcggcttccgccggttccccaccttcgggctaagagcctggaagcaaacatttttcttcgacttcagcctgacgtatgttggcgccgggatgatctgctcgcacctcgtcaacctctccctcctcttcggcgccgtcctctcctggggcgtaatgtggccgctcatgagcaagcaggaggggaagtggtactcagccaaggcgtctgccagcagcatgccaggcctgtccgccgtctacgtgtgcgtcggccccggtcttgctgcgttcgtgcccttcagctgagtctctcccctccttccaggtccaggccttcctccgctttgcgctcccctttcgcgccggcttcttctgctccccctttgtcttccgcctcgcacttttaccaacttgaattaccgtgtatggatgagcacttgaacttat

SEQ ID NO: 4254 - DNA, 742 bp, Triticum aestivum
  Clone ID: PAT_TA_4254
cctctctgactctccctctctctctctctctagggagaggggagctgctgttggataagagaagagaagagaggagagctagagataggcagattagcatccagattagcccgtacaacccatctcgcagattctgaatctcctcctcgccctacagtccatcttcttctctggctatccagcagtgtattatcaggccactcactaatcaactgaagcagcatgagctcccatggtgttgttgcggtgaaaccaatcgccgcgccggacaaaacagcgcattcttatgcctgtggatccgcacagtcttcagttcataagttgctggatgctaaactggaccaccttgggcctgttggatgacaatctgtcatccaccagccagtcatcagacatcaagactgaactgatccgaacgtcgagcctgggaagaagcagcctaccatttaaccttcagagaagaagccctgagcctgatcctgaaagcccattgtctcatgtctcgcaccccaatttttcagagcccatggcctcaaactcttcaacgttctgcacaagtttgttctcgtcatcttcgacaaactcggcgccgtgccggcaaatgggtgctctgcctttcctgcctcaccctcctaagtatgagcagcaggttctcccagggcagtcatcaacctcctccctgcagcttagtggtgacacaggcaatgttcatgacgaagctgaacagacagatgacataaaa

SEQ ID NO: 4255 - DNA, 1340 bp, Triticum aestivum
  Clone ID: PAT_TA_4255
cgcgcacccacaagtgagcgcgcccgcgtgcattgcagccgccacctgctgctcctcctcctccttccccgcaaaccacagccggcacatcgcaacttactcccgtgcgtctcgccttcctcttcatcggccagcttggcgtcgctctctccttgctgcctccccgccggcgagccgcctccgcttccgcccccggacctccctgtcggcgtctccggccgcagcgcacgcctacgcggttgccgatacaaacgggtttgtcgagcttgaggctagactggtggatcgctttggatctgagggtaccttggcatggtgttgtcaagtagccgtttgcgttgccgtggtcgacatgtccctgctcatcagagcccagtctgggggaacactgaggacttggatggatgtcggcacgctgttcgacagggttaagtcttctgatgacgatatggtgcatcgatgaggatcagttggtggtgaatctgaagaaagtcgagcaagagctgaaatggcccgacattgatgaatcctggcaatcgctcactgctgggatcacgcagttgttgacaggtattagcgtccacatagttggcgactccacggagatcaacgaggcggtcacctaagtgatggctgagggcatcgcgtatcttccagtttgcacaagtgagctgctagagagtgccactcaaaagtctgttgatacctgggcggcctcagaaggagcggactctgtagctgaagcggagtgtgttgtcctagaaagcctcagcagccatgtccgtgcagcggcagcagctctaggtggcaagcaaggagcggcgagcaggttcgacaaatggcagtatcttcattccgggttcacagtgtggttgtcggtgtccgatgccggtgatgaagcctctgccaaagaggaagcccggagaagcgttagcactgggagcgtggcttatgccaaggcggatgtggtggtgaagctgggtggatgggacccggagtacacgcgagctgtggcacagggctgccttgttgccttgaagcagctcaccttggcaagacaagaagctagcagggaagaagagcctttacatcaggctaggctgtcgaggggactggcccaacatcgagccacccggctgggatccccaatcagatgccccgcccaccaacatctagtccagcttcaagtatttttcttttctttttcaagactccattcattgcttagggatgtacacaagagcatagcctcatacaaccgtactcttattccctactggatgctcttttatagaagaaaggctgaaatgccaacattctctaaaaaaaaaaaaaaaaaa

SEQ ID NO: 4256 - DNA, 661 bp, Triticum aestivum
  Clone ID: PAT_TA_4256
gcttccaaggccgacgacctggccaagccactcgaggaggcgaagatcccctacaagatccacatcgtcaaggatcacgacatgaaggagagactctgcctcgaggtggagaggctagggcttagcgcggtgatcatggggagcaaggggtttggttcggcgcggcgggccaccaagggaaggctcgggagtgtgagcgattactgcgtccaccactgtatttgccccgtggtggtggtgcgttcccctgatgatgctgtagcagagggcggggagtccgccactgcgatggaggcggcagtgggtgcagaggacgtgctgcaccctgtgccagaggaggatgctgagtaccatgacgccgctgaggagcacaaggatacttgattggatctatgcatcgatgtcctgttggatccagcatgtaaaggttctagcagtcgactgttggctgagtgctacctcgtggtttctgctgagcacattagctgtttgttagactttactgttcatgtcgatctgtgcttccactatgttgtatttggtgaacatttgttctctagaacttttgtgcttcttggatatcaaattatatgttgctgatgagacagtttgactacttagagatccacatgattgcctgctatacttactcggttttgct

SEQ ID NO: 4257 - DNA, 1431 bp, Triticum aestivum
  unsure (1)..(1431): unsure at all n locations
  Clone ID: PAT_TA_4257
gcctccagcagcttctcccccttccccactatacttccaagcaaaggcgagaaccctagcctcacgagcaccgcgcagcggagatcccgaccatcaccgcgatgcaggccccgacgaacccccccgtcgacctcccgccgctggtggcgccgccgccgcgggtgaaggcgccgaccccgcgcccccctccgccggcttcgctccagcccgactccccgggcgtcttcttcaccaacgctgccgcagccgccccactgggctccgcccaccgccgcatcgccatcgccgtcgatctgtccgacgagtccgcctacgccgtaagctgggccgtcgccaactacctccggcccggggacgccgtcatcctcctgcacgtccgctccaccaatgtcctctatggcgccgattggggctccgtcacccccacatcccccgaagacgacgctgaggtcgccgcgcgcaagatggaggaagacttcgacgccctcaccgcttccaaggccgacgacctggccaagccactcgaggaggccaagatcccctacaagatccacatcgtcaaggatcacgacatgaaggagagactctgcctcgaggtggagaggctagggcttagcgcggtgatcatggggagcaaggggtttggtgcggcgcggcgggccagcaagggaaggctcgggagtgtgagcgattactgcgtccaccactgtatttgccccgtcgtggtggtgcgttcccctgatgatgctgtagcagagggcggggagtccgccactgcgatggaggcggcggtcggtgcagacgacgtgctgcaccctgtgccagaggaggatgctgagtaccatgacgccgctgaggagcacaaggatacttgattggatctatgcatccatgtactgttggatccagcatgtaaaggttctagcagtcgactgttggctgagtgctacctcgtggtttctgctgagcacattagctgtttgttagactttactgttcatgtcgatctgtgcttccactctgttgtatttggtgaacatttgttctctagaacttttgtgcttgcttggtatatcttctatgtcgatctgtgcttccactatgttgtatttggtgaacatttgttctctagaacttttgtgcttcttggttatcaaattatatgttgctgatgagacagtttgactacttagagaaccacatgattgcccccttgtccgcttcgggcctgccgctgacaacatgcccangncatcaactggcaagaggttcttgcaaaggctaagngctgcttgccgtggaanggccnggtggaacgctcgcttnctgcnaanactgnaagttctaaaaaaaacggcgggtgtaaaatcatactaccgncaaanaatccgggcggtatttttggcccaanaccccgtggcaccanctcct

SEQ ID NO: 4258 - DNA, 946 bp, Triticum aestivum
  Clone ID: PAT_TA_4258
gaattcggcacgagcccacctcaaacatctgctctctctgcctcacgaacgcgacccaaaacccctccctaacccactccgcctctcccctctcctccgccatggccgctgggcgggccttcttctgcgccccctcctccatcggagccaccgcccgtcggctagccttcgcctcacccccggcccgccccctcgcctccgcgccccaccgacgcgtccgcggccgctgctgcgcctcaatctcctcgtcctcagatgcctccgcgcccgcgccgccaccctatgtgctcaccacgccgctctactacgtcaacgcaccgccgcacatgggcagcgcatacacgaccatcgccgccgacgccgtcgcccgcttccagagattgctagagaagagggttatattcattactgggacagatgaacatgggtgaaaaaattgccacctctgcagaggccagtggtagaaaccccaaggagcactgtgatataatttcaaattcatacaagatgctttgggctgatctagacatcgagtatgacaagtttattcgcacaactgatcctaagcacgaggctgttgttaatgacttctattctagagttctaagcactggtgacatatatagagctgattacgaaggactttactgtgtcagctgtgaggagtacaaggatgaaaaggagttggcagaaaataattgctgccctgtgcatctgaagccttgtgtacctagaaaggaagataactatttctttgccttgtcaaaatatcagcataaattagaagagctgctgacaagaaatcccaattttgtaaggccatcacatcgtttgcacgaggtcgaaggctggattaaaagtggattgagagacttttctatttctcgtgcatctgtcgagtggggtattccagtgccaaatgacaccaaacaaacaatatatgtgt

SEQ ID NO: 4259 - DNA, 823 bp, Triticum aestivum
  Clone ID: PAT_TA_4259
ccccgctcggccgccccccgcagatcctctgctgccccacggacgcgaccgcggactgccgccgccgatgatcccatctgatggcggcgccgacccatccctggcgctggatgcggtgacctccggcagaggcgcgcccggccacgccttccccagcacagtctcgccaggctgcctccgctcctccggcagcgccgcgcccgttcgccgcagcccgccggcgagggcacaatcgatgccgacctgcacgcgcaaggggaggcggcaggagcagtcgtgcaagggcaggaccagccgtgcggtcaatcgagcaatccttttgcatcttggccgccatgtcccccgccgtcgacgacgcccgctgtggcgatctcccccctggcgaccagctctgcctcgcctgccaaatcaaatctacgaactaaggctgctcccgatggcttccgctcgcgggtggtcccggcctgtcgcttgtgagcctgaagacataagtaacctggagagatggtgctggtggattctagccgcaagtcgaagacatgcagttgcttgccgtcgatgaagcgacatcaacatgggcccttgtccagatggaggacttggcttcttcagtgaggataattcaatactacactttgattcaatagagtgcgagcttgcttctgacatagccaagattaaaggagaggggaggcattgctgatggcttggaactttttggtgcatcatgctatgcgactaaggtaccctgacagacacttggtgagatgtttgaagctgctcatagtatatgactagcttggagactgtgcaagctgaagtt

SEQ ID NO: 4260 - DNA, 674 bp, Triticum aestivum
  unsure (1)..(674): unsure at all n locations
  Clone ID: PAT_TA_4260
ccaacgnttgcggaagtttgcnccntgtgctnccggggaggtatnttgaccttaagggagcttnttcaaagttntcccgggtgttttggacggcaagtacgacgacatctcggagcacgcgttctacatggttggaggcatcgacgaagtcatcgccaaggcagagaagatcgccagcgagaatgcctgatgacgaggtgttaccaccgctctgtacaagttaaattttttgggtttcagctgttcgcccgagacttgctcacgagcaggagtgtgccagctcctgctgagggatccttgtttttgttcgtttttactccaatttacccgtaataagcaactgcagtgacattggtttagtctgcacaacagcaacactactcttggcttggaaaacacttgtgccctttgtaatgcagatccgacagatcatgaattggtttagtttattgttgttggcgaagctgtttcctgttcaggtttaaaaaatggctcgttttcaaaaaaggncaganatgnaaaaananaaanacccangggggcccggtaccaantccccanantngatcttttagngccccactggnctcgtttaactcgngacgggaaacccggggtaccactaatccctganaaaccccttcccacggnnaaacataggccncgtnnctcca

SEQ ID NO: 4261 - DNA, 660 bp, Triticum aestivum
  Clone ID: PAT_TA_4261
tttcctccttggttggccggttccatcccccgccccccccgccccgtgcaggcagcatcggtccccgtccccctccttgccgggtcatccgacgcccccaccgtccaaacttcgcaactcaatcaaccaaccacacagttcaagaaccttccgttaccactcggtcaacatgaagaaggccccttagatttttaacggatgaagctagacgccctgactgcccctccgtcgaagggttccctcttctttgtccgggcagaagacgaagatggcacccaggaatgaggacgtacgacagtcttcttcgtggaactgctccctgcgctcgaagcgtctctcatgttctagcagaataccaatatccttctccatcacgcacaagttctcagaaaacttctccagggccgcctccatgcgcatgtgggccacgcagcacgccttgggttcgacgacccccccagccccagcactgaggaagcgggggcacttgatcggaggactgcgcgggccgccgggggaaggtccacgcccgcgggttcgatcggcggaggatggcggcggaggagcggagcaggggagaagccatcggagtcgccggaggatcgaagtcggcgtcgcggcgtaggagcgacccaccgcgaaagaatccatgcagcccgg

SEQ ID NO: 4262 - DNA, 747 bp, Triticum aestivum
  unsure (1)..(747): unsure at all n locations
  Clone ID: PAT_TA_4262
cgacgactccgaggacgacgacatgacggccgagaccggcggcagcccggacggcctcggcaagcgaaagcgtggcggcgggggtagcaaaaagatgatggctttcttcgagggcctgatgaagcaggtcgtacagaggcaggaggagatgcagcagcggttcctggagaccatggagaagagggaggccgagcgcacggcgcgggaggaggcctggcgccggcaggaggtggcccggnttaaccgtgagcaggagcagctcgcccaagagcgcgccgcggcagcttcccgcgatgccttcatcatcgccttccggacgcgtgggcggacgcgtggggtgcatgtcccacccgtcgtcatgcccatgccaacgccgatgcaggtccagaccccgccgccgccaaagaaacctcgacagcacctgccacccccgccgccgtcacaggctacacagcagccacagccgcagcctcagcccaagccagctgcgcccctccaacagcaaccgccggcgcaaccaccgcagcacaaggaaacgacgcgcgaagaggtcgggacgccccgcagcgcaccggccccgacttctgccggcttatcactcgcgctggttcccgtcgccacggagcagcacgtcgtcgaggccgctggtctgggaagaggggagagcggaggggggccctcgtcgtcacggtggcccaagacggaggtgcacgcgcttatccagctncgcatggacatggacaatcg

SEQ ID NO: 4263 - DNA, 746 bp, Triticum aestivum
  Clone ID: PAT_TA_4263
tgtccatgtctctctttgcttattttcccctgcatcggctctctcttctcgatctcttagcagcagcttgtccatggaggaggccgcacccgcactccggcctctcgggctggtcggtatcttccacgaggccctccgcgtcgcccgctcccaccccccaggctctgccttgttggccggccaggtgctcgtgctcaccatgtccttcctcgcccacattgccatctgccccgccctcttcccccacgccctcgcctcctccaacgccggcgccggcctcctccgtctcgccgcgaactgggcacccttcttcctcgtagaggcggccttccacctcgccatcgccgtccaagtcgttcggcgccaccgccttcgtcgtcttctccgtccgcccgcgctacgggcgtgagggacgatcgcgcctggcgcctcgtggtcaccagcttcgacgccttcctcctcctcctcggctgcaccgccctcttcggcaccgccgcctggtgcggcgtgcaactggcgctggtggcactgctgctgctggtcggtggcgtgtacttcgccggggctgggcacatcggctcggtgtggcgcgtcggctctgtgatgatggtgctggaggacgcctggggcttccgcgccctgtgcatgagcgacgagctcctgctcgacgcccgcatgttctgggccccgtccgccgtcgccgtgttcacgctcacgctcgtcggctgcatcctggccgtgcaact

SEQ ID NO: 4264 - DNA, 1525 bp, Triticum aestivum
  Clone ID: PAT_TA_4264
gcacgaggaaagaaagaaaagaaaagactagctgcgggcggctgcggctgctttctgctttctttctttctttctttctttcccaatcaatcaatcaatcaatccatccatccatccatccagataaaaatccaacctttctccaatctctcctcttcttcttcttccccaatttgccctccctcccttccccaaaacattccccaatctcgctcgcttctcctcctcaactgtcaactggcgaggggagctccaatccaaaatcgaatcgaatcccactggactggagccagccagccagatccgtgtcgtgcgcgcatgaagacgaagctgctctgctctcgccgtggttgagccaggcacgacgactctgcctcctgctgcttcgtgtccgggagcaggagccgggagggaggaagatgcgcatgcgggtgctgccggcgttcagcttcagcttcagcaccgccgccgccgccgctgagccgccgacggctgctccttcggttgctccggccccggctccggcgccggctgcgacctacgcggtgtacctcaacatctacgacatctcccccatcaacaactacctctactggttcggcctcggcatcttccactccgccgtccaagtgcatggtatggagtttgggtacggagcccacgaatacgcgaccagcggagtgttccaagtagaaccgaaaagctgtcctggctttatcttcaggcgctccgtgtgtatgggcaccaccaatatgtcccgggctgaagttcgcgctttcctagaggatcttgcagaggattatcatggggacacctatcacttgattgtcaagaactgtaaccatttcacagctgacgtctgtaagcgtttgaccggaaagccaactcctggatgggtgaatcgacttgccagattaggttccgtctgcaactgtgttctgcctgaaaacatcaaggtttcagcggtcagagatgaaactgcacaccttgaattttccgatgatgatttggagtcggacacatcgatcatcgacagcgacatcggtgatctagatcacctcctcacaacaccaaacagcgacgtcgtacccccgaaagacaagacgttaactcctggaagggatagcttgtaattgtttcaggttatttatgcacagcattacctgcttccgggttgtttgcccgaggatgggaaatcttagccgtggtgctgatgtcctcttgccaatggcggtgggcagatcctgatactgatccggtcgaagttgctgctatatatatgtcgatgtagagagcgggggtagcgggtgtggcttgtctaatcgtggcgaaggccaagttaaccaacacgtgtgagatggttgcgtgcatagttgattgtaacttttaattgtttttgacagtagagtggtgcaggtgtatagtgcttgtgtaactagctgttgggtttattttatggtgattgacaatggttgtggtgtgtgactacctgcccggccggccgcgcgcctcactgaaaaaaaaa

SEQ ID NO: 4265 - DNA, 699 bp, Triticum aestivum
  Clone ID: PAT_TA_4265
tgcaataacttcctcctcgggggcctgggggccatccttgtcgtcgcggtcgtggtgggcgtagtcgccaccgtgaccagctccggtaacaataaggccggcgacaacttcaatgtcccgggtgaggccaaccttgccacctccggcaagtcggtcaagtctctgtgcgcccccacgctgtacaaggagtcgtgcgagaagaccctcacctcggcctccaatggcaccgagaaccccaaagaggtgttcgccaccgttgccaagtcggcgttggagtcgatcaagtcggcggtggagcggtcaaaaagtatcggggaggccaagtcgagcgaccccttgacggagggcgcgcgccaggactgcaaggagctcctggaggattccgtggacgacctcaagggcatggtcgagatggccggcggcgacatcaaggtgctccttggccgcaccgacgacctcgagcactggatcaccggtgtgatgacctttatcgacacctgcgccgatggcttcgccgacgagaagctcaaggcggacatgcagggcatcctgcgcaacgccacggagctcagcagcaacgcgctcgccatcaccaacagcctcggcgccatcttcaagaagctcgacctcgacgtgttcaagaccgactcccgccgccgcctcttgtctgcggatgagtccaggtaccccgcgtggatg

SEQ ID NO: 4266 - DNA, 1352 bp, Triticum aestivum
  Clone ID: PAT_TA_4266
ccaccatttggaagacataaatggggtgattctactgaacgaagggttccgactaattcagttcagaaccaagcaaaagaacgtgaacataacttcgacggaaagcaagaccataagaagttgcctcctgatccaaagaaatctccacttgacagattcatggatgtgtcgatgccatcaagaaattcagaatctgtttcaccatcctctgccaggtcacacaggcttgattgcgtgttcgatgatgtttctgaatgtgaaattctctgggaagatcttgtgattggtgaacggattggcttaggttcatatggcgaggtataccgtgctgattggaatggaacagaagtagctgtgaagaaattcttggatcaagatttctatggcgatgctttggatgaatttcgaagtgaagtaggtgcggattatgcgtcgactgcgtcatccaaatatcgttctctttatgggtgctgttacgcgccctccaaacttatctattgtatctgagtatcttccaaggggaagtttatataagatccttcaccgtcctggctgccaaattgacgagaagcggaggattaagatggccattgatgtggccaagggcatgaattgcctgcacactagtgtaccaacaattgttcaccgggatcttaaatcacctaacttgctggtcgacaataattggaatgtcaaggtttgtgattttggactttcacgcttgaagcacagcacatttttatcatccaaatcaactgctggaactcctgagtggatggcacctgaggtcttgcggaatgagcagtcaaatgaaaagtgcgatgtctacagctttggcgtcatcttgtgggagctggcaacactaagaatgccgtggggtgggatgaacccgatgcaagtcgtgggagcggttggcttccaggatcgaaggcttgatatccccaaggaaattgatcctctagtcgctaggatcatatgggagtgctggcagaaggatccgaatctgcgcccttcgtttgcgcagttaacaactgctctgaagacggtccaaaggcttgtcagcccctctcctgcggagacgcagagcccccctgtgccccaagagatctgggtgaactcctctaccccatgacagaggagagttatcgaggaattcgttcgttgctgcggcctgcaaatgtgagcgcgttgtgtatagtttgagcgctccagcccagatgtggtagacatgtcctgctgccgtggcaacgctccagtggcagccatatagtacacctgttctgttcatgttgctgtctcgaggctgtcgcccaccggcactgactgttatagatccgttaacttgtgcagtc

SEQ ID NO: 4267 - DNA, 682 bp, Triticum aestivum
  Clone ID: PAT_TA_4267
ggccccgacgcgcaccggcagtcgacggaggagatggtggtgaccgcggccggcgggttcacggtgccggcgggcacggcggtgttcatcaacctgtggtccatcgcgcgcgacccggccaactgggacgcgccgctggagttccggccggagcggttcctggccggcgggcgcaacgaggcgctgggcccgcgcgggcagcacttccagtacctgccgttcgggagcggccggcgcgggtgccccggcatggggctggcgctccagtccgtgcccgccgtcgtggcggccctggtgcagtgcttcgattgggccgtgcccgccgacatcgacgggaagaagatagacatggaggaggccgacgggctggtgtgcgcgcgcaagcacccgcttgttgctccgcccctcgccgcgcctcagccccttcccggcggtcgtctaagcccggccgcaccgtacgtacgtaccatacctgggcgctgcacggacgccggcgcgcctggtccggcacggcgtcgctgtcgtgcatcggtgcatgtccctatgtactttttcttgtgtcgtccgcacgtacacgtcaagagtgttcttttcacctgtacacattggtgaccatgttaacctactattgccgttgtcacgctaattaagacgtgccgttggatcgttccaaaaaaaaaaa

SEQ ID NO: 4268 - DNA, 1012 bp, Triticum aestivum
  Clone ID: PAT_TA_4268
ccgcgggcccctcgccccgacgcacaaactcttctcgttcccctttccaccgaccccctccatccgcggtctctctcctctccggccgccattccggtggtgggagagtggaggggcccgggttctgtgccttaggtgtgtttatagtaggctgaggccttgccgcgggcggcggagggggggtccccgcctcgcctccctcctcggcaccgtctgctgctcgtcttccacctcggcaccgtattctggggcgatgccgtcgagcggccgtcgtagggtgctcgtcgatctatggatttggcgggcttcggtggcctgggctaggtcgtggcggcggaggtgacgacctggctgtggcttttttgtcccctgtctccgacttcgcggcggtgaggtgggctccggcctcacagtggagtttctgggggtggttctggagttggagacgccggtgcgcgtccttgctttctctggctggccgtggtggcagggggaggagcaggcgtgcctgcgcgctggacaaggtttctggaagcgacgaccttgggttgcggcttatggtggaggatctggccgtcttttgctgggcggtgtggcttcgtccccagatccggagcggcggaagctcggtgagcgctctcgttagtgggagatgtcgccggccgtgttccttctcggtttcaagatccaactctgaggagttggtggctactgcggctcaacaacgccatctggcaaggggcttcttcacctccaaggacaagacatctgcaacaagctgttctcccatcggccattccggcgccggtgatggatccagctgtgttgcggttgcaatgaacacgaagaagataagggacctgggtgtagtttcttatttcttcagggtcctttttcgtagttttggtggggtctgttgtttcctgttccctgtctttgcttctgtattctctcggaatgtgtattgtctgtttccttaacatgaatacagtgtagcgtatgccttcgggtg

SEQ ID NO: 4269 - DNA, 1214 bp, Triticum aestivum
  unsure (1)..(1214): unsure at all n locations
  Clone ID: PAT_TA_4269
ccttgtcctcctctcccgttttccgcatcgccgccgcccccacgccctcaatttctctcgccactggattcggccgtcgcgggatcgattcctccgagcagcaggtggtctcgcagggcacgtccaccgtcggcgacgctcccgcggataggcgagtctgaccccaacagcactggcgctgcgtcgagttggctcggtgcagcgacgacgagatctcctcctcaccgaccaaatcgtcagctcgagtagggagagcaagttcctcatccacctcagggccagagcggttcccttcctattgggggtgcgtcgttggcgtcttctcttcctgcggcgccaggtccaagactatgctgatggtgaggactggcaagtgtgatgccatgttcgtgacgtgctgcttccttccaagccatccctgtcacggagaggacccgcttttgttcattatttttccttcaaagtgtcagatttcacagttagaaaacttgcgactttgtgaaagtaaagtcgcaaacaggcaaagaaggagatgatagctcaaggtggaaaaacctgggaagtcacaggctttagagggagggatgttgatacacggcacatgtaccaagcttatcctgccacatgtagccgctgtagtggtggccgcctcgtccttggttcagggatcaactaattcatcctcgtgacctgctgcttccaagccatctctgtcatgagaggacctgctttttttattacttcccttcaaagtgtttaattttgcagttataaaacttgcgacggcaaagaaggaggtgataactcaaggtggaaataacctgggaggtcacaggctgagagtgagggaagttgggtacccgccaaatcgcccagcttgtcccgcaccctttcccaggcttctccgccgttccacccctggtgtaccagcgcagtgccggcccgccgtctttcgcctcctcggctagggaatcccggagtggggctctgcttcttggcccccagtcttttcccgggcgaccccccgcgcacgcctctgtccctggcctcgctcttaacttcaactgtcgtgggcttgcctttttggatatcaaagnacatantggataacatagtncaagcatacatgagatngctcncaaaacttcattcaacatcctcaanaaaactgggccagnatcaaggtgtcatcaaattgtgtgctccgcggttct

SEQ ID NO: 4270 - DNA, 1808 bp, Triticum aestivum
  Clone ID: PAT_TA_4270
ccacgcgtccggacggaggataccgtgcacattgtaaaggtgcttcagaaatagtcttggctgcatgtgataagttcatagaggagacaggtgctgttacccctcttgataaagaaactgctggcaagctcaatggtattattgatggttttgctaatgaagctcttaggacattgtgccttgcttacagggaaatggaagaaggcttttccattgaagagcaattaccacagcaagggtacacatgcattgctatcgtaggtattaaagatcctgttcgcccaggtgtgagagagtctgttgcaatttgccgctctgctggagttacggtgagaatggtcacaggtgacaacataaatacagcaaaggcgattgcccgtgaatgtggtatactcaccgaagatggcctggccatcgagggaccggatttcagggagaaaactcttgaggaactccttgtgcttgttccaaaaattcaggtaatggcccgatcatcaccgctggataagcatacacttgtaaagcatttgcgcacaacattcaatgaagttgttgctgttactggtgacggcacaaatgatgctcctgccctgcatgaagcagatattggacttgcaatgggcattgccgggactgaggtggcgaaagagagtgccgatgtcatcatcgtccgcgacaatttctctacaattgtaactgttgccagatgggggcgctctgtttacgtcaacattcagaaatttgtgcagtttcagttaactgttaatgttgtggctttactagttaacttctcctcagcttgttttacaggaaatgcgccactgacggctgttcaacttctttgggtcaacatgattatggacacacttggcgcacttgcattggccactgaaccacccaatgatgacttgatgaagagagagccagtaggaagaacagggaagttcatcacaaatgtgatgtggaggaacatttttgggcaatctctataccaatttgttgttatgtggtatctccagacgcaaggaaaaaccttttttgggcttggaggctctgatgctgatatagtgctgaatacaattattttcaactcattcgtcttctgccaggtgttcaatgagataagttcgagggagatggagaagctcaatgtgctcaagggcatgctgaagaactatgtcttcatgtgtgtcctcagcagcaccgttgtcttccagttcatcatggtccaattcctcggcgagtttgccaacacgacgcctctcaccagtctccagtggctagccagcgtgctccttggcctcgtcgggatgccgatcgccgttgtcgtcaagctcattcctgttgggtcctcctgatgaaaagggcaacccaccatgtgaaggaggtgtggcgaaaagaccgattccataatgtgtggacctgaatcctccatgcagggtcttttgggatgcatggagagcaagcctgagaagagctgcactagacaagttttaaagcctacgagtgtggcagatttgcatcatattgttgtgtaagaagcatttgtatctggtgctgtgctagggcttagggcctgctcgtcagcagacctgtaagattgatgtctggctgggattcagacctgaaaggatgtatattctgtggatcgataaacagaaacctgatcatttcgacccctttattccgtctcggcatatgaccgagaccttccaggaatggggcgcatgtagtccagacagactagtcccttatgttggatttcaagtgtttaccgtgaaaaaaaacctgcccgggcggccgctcga

SEQ ID NO: 4271 - DNA, 1113 bp, Triticum aestivum
  Clone ID: PAT_TA_4271
gcggccctcccgcccgaggagcccagccctctaatgacaagactgctgaaaatgaggaggttgaaatatctcatgttaaacatgcaaggaaaaggggcagggcgacaagcagtagtccgggcccggtccgggctcctccgctgccagtccgacccgccaggcctagacgggctatcgtgcagccgacgatagcggcccgggtgcctcaggtggacatcaaaagctgggcacagattccgtcgtaaagatggaacaagatagcctggatcaggaccgaggaccgccgccgtgtcccccgcccacgacccccgcgggccgcgccccaaaagtcgttaaattgagtgcagcagaggatacgacagccagtccaaagttcgaaagcaaaggcacttctgagagaacagacgctggtgaaggaacgagcttggcaggtgagaagatagaacagatggttgatcctctgcacgcgatgctcctcgacatgataccgtcacttagggaagacgcgagcagcgatcccccagccaaagttgagcatgatccatcgcgtgtgagaagttccacgtcggataacagggttccggtgcctgagacaggaggctctgcatccaatcctgtggctccggcaccgcgtgcaggaagttcgtcatacagtgcgggggttccagccccagatccaaatcccgtggctccgaagaagaaaaaggtgagctacaaagatctggccgacgagtttctgaaagattggtgagaccgtgagagtgcttcgcctctttggtctcggggtagcatgtactgcgaccggccgttctgcagcgactcccgtcccgtcgacacggccggcccgccgaccgaccaaccgtgcccgggccccgcccccggatccaaatcccgcggctcccaagaagaaaaaggtgagctacaaagatctggccgacgagtttctgaaagattggtgagagtgcttcggctctgtgggctcggggtagcacgtacgccgtacgtctttttcaccgtttccacggtcctgtaaatatgacagatgcttgtaaccatcaaccttgtccgtaccatggccctagttatctcgtggagtagagcatagcagagact

SEQ ID NO: 4272 - DNA, 527 bp, Triticum aestivum
  Clone ID: PAT_TA_4272
gcacgaggcctcgtgcccaattcgctcatttggatgtttgttcgtgatttggagtccgatccagaactaaggtttgcgataaatttgtaccagaacgaggactacaggttagaaatggcatccacgattggtgacgatgtccttactgtgccaattgaggagttgattgaggacctaacccttggtgatgatgaggaggaagaggaggaagacggtgcagatgctggtatggtggaatgagcgagcatgtctacctagaccattggtcatgattgttcatgcccactgcaggtcataggtctaactgcatctgtttaattcatataagttttgtttttctttactgctataagctatgaatgtcggaggtgttgcttaaaaggtctaagttttggatttctctgtttgttgatgtcgacattgtttgaaaccatatctcgtatcttggtgtaacgataatgtctcaagttaaatacatttcctatcatgtcaaaaaaaaaaaaaaaaaactcgaactagtctctctc

SEQ ID NO: 4273 - DNA, 651 bp, Triticum aestivum
  Clone ID: PAT_TA_4273
gcggcccgcgggcccagccacccacgacctctgccctctctccctcgatggccatggcggcggccgtcggccggagcaccttcccttcctccactgcaccccatcatcgacggcgtcctcttgtgcgcggtcgcggcggatgcgcggccgaggtctggctcatcgaagacgcagcctgcatcacacccgctatgtcgctgacctctgcccctcatcggaagtgcagcctcgccggcgtctcctgtccctcctatctacccctcgaccagggatctggcggaaggagttcggggtgaggtgcgtctgtgtgtacgtgaggaggcgcatgtgtgtgtgtgtggcgtggtgcgattagaaggccaacctagctcgcaaccatggctgccgagctcgagcttgagcggctggacggcctcggtgcaagagcaatgtgcaattcaccccgtcggccagatgattgaaaaagaactgaaggagcaaggctgcgtttgggtggctgctattgatccagaaattttgtatttgggtcgctgctatcgatcttgtggactggaggagcaaggctggacgagcaagctgcttttttgcttgtagcacacagatcagatgcagactttggtatttgggtggcctttgtttgagtgaaatcca

SEQ ID NO: 4274 - DNA, 676 bp, Triticum aestivum
  Clone ID: PAT_TA_4274
gcctgtttgtccttccacctcagtccagccttgtaggctaccatggagcaagtggttgttatgtgagtaccaaatttctggttgttcatcgattgctggtcttattcatgtttctgagcttcgcccatcatcgccatcaagaaattgcactggtcagttgatcatcgagtttggttcgccgttttatctgctcagtgtgttgtctctgcagtccagtgaggaagtgagtgttgtcttcatgactaatggtgaagcagtgacattaaaagtttcacagccatctgtgaaagcatcaatggcaaccactgcgtgttcaactaaatctgcaagtttcaacaggctttacagggcatgacctacaaacatgtgcactcccttcttctttgccggaataatgtcatactacttcatcttacttgtggcctatgttatatctattgatgacaggttcgctatagagaagtacctccagaagtgcattaacctagaacatgatgcattgccaatcaagcttgcagacggcaaggtctctgtcatgtctcgccatcacagggaatgacaacaggaccttctatcacaacgaactggtcagttccgtcatcacaaacatacatgagggctctcccggcccccctcctccgctcgcgtgacaaggcgtatcgtcaacgatcccgcc

SEQ ID NO: 4275 - DNA, 507 bp, Triticum aestivum
  Clone ID: PAT_TA_4275
agtaatgaacgttgtggtgggtggtggccttacgtgccaacatgatgccacgactttgtccctgggccagcctggcgcgcacgctgtcttctctgccatattgatcttcgctaaccgcaaacaacttcttcatcaagctgtaccaagtagccatgtttgtctaggttaagttcgatgcactagcaaggaaaccccttgttagcagcatccgattatgccctctagctttaactcgcgcgccgccagtgtggcgctgctggtagcataacactagcagcatttcgcccgaacgctgctacttatcggcaagttagcagcgttcccactctagacgctgctagtttcctctgacttggtggcgcataggtctgtaagatgccgcagacgtggagaatcactagcagggtttgatggaaagttgtgcgcggtgactgcctttggcaagttcttcatccttcagtttcgaaacaatggaaaacaaagatcaaaaaaaaaaaaaaaaaaaaa

SEQ ID NO: 4276 - DNA, 704 bp, Triticum aestivum
  Clone ID: PAT_TA_4276
tctctgcccaatctccatcgtcctgctactaccgccgccgtcggtgctgcctccgcgggcgcctcgtcctcttggtttctgatgctgccgctccgaggaaggttgccgcgccgctggtgcttagattcatggaggggaacagcagccacgccacgcggcatgcctcgccgtgccgcatggtggccgagaggcggccgccccatgctctgcctgcgccgtctcggcgtcttcatcgacaggaggcatctctgccggcctcaccccgtcgccatcgcctcccttccctacgagagcgacggatccaatagcttgagctcggatcgcttccaggtgcttgcggccgccgcccagcttgcgctcacttgctgaccttgaactctagccgcagcggatcgtccatgagtccagcttctactcgatcctggcgtccaggggtgtggttacgtttgcttcttctagacacactgccagtctctcacaatggaagagatcatgttatgcagtctcgcataatggaaaagagaagatgattttatgtcaattggactctacatggatggaaatgaaaacaccagaactaatataataccaaggctcaaaccagagttggacgacctcttatctctaaacaatagaaatgcagagcagtccatggaagcttccctacgctattaccgcaccgcttgatatactgaacttgattc

SEQ ID NO: 4277 - DNA, 667 bp, Triticum aestivum
  Clone ID: PAT_TA_4277
ccacgcgtccgcgtgacagcatcctcccccacggccccgggaaaccgattctccgggattctgctggattctgcagaggtccttccgtcgacgaatccagcggcggccggtcagcttgtttcgaaggctgacttggaaagatcaatgacgaaaaacaagcgacggctgatgagaggcgatgaagagcaacaacgcccttacaaaagagcaactagaccaagagccttgagtgaactcagtgagcaagtggtttcaagattgcgtaggagtgttgtgtccctcgcttcatttgatggtgacaccaagttacgcgaatgcacaggcatatgcattgaaacctcgtgttcagattccgaagctacaatcctgacatcgagacggttggttccacctacttggcctgcaagtttgacgattaaagtacgccttccaaatgatcagattgtcactgggtggattgaggatcctgggatatatgttgattttttcattgtcaacatcaaggaggtgtctagagttgatgccacaagtcttgaccgtgacatacagtttgagcctcatacgaaggcagcagctgtatgccgctgtttcagttctggatttttaacagtcacaagcggactaaatcttgcttccccaaccagtgagacaatcgtaagcacgtgct

SEQ ID NO: 4278 - DNA, 943 bp, Triticum aestivum
  Clone ID: PAT_TA_4278
cgcccggtttttccctcacccagacgcaaaatggctttctcattcctggttaattaagaaaaagaaagtgtatgtgtgaacggaggaaggaaggaaaaggggggatatatgaggggctgaaaaaagtgagatatggtagctgctgtggagtagctggaatattctctgaattcgtccttctctccatcttgtgatcttctccgtttggagcgctggagtgagctcgtgatgtctccattttaggacggaggagtgtgcaagtgtgcttcttcctcttattattatcatttcttttctgtttgcaccccagatttttccttttgctgctactgttgagctccaaatctgccttggttcatttcgtttttgaatccggagggagaaggggatctgtcatttctgtgctcggtggaccaaattcttgctcgagcttgctctttctcttgagattctaccgctcccttttcagtttcttggaggtaatttcttctgctgtaaaactctggcttgtcgaaggaaggacctcgtttttaaccagcgatgggtttatgggtttccgcagctgcctacattcagttcgcggggtgtaaattctcgcgtcgcgtcgtctcctgcttgaaccgggtgatcctgctggtggccacggcggtttggcaagagccaggctctgcggcggcagggcatggctctgccgtcccagcagccgcccggcgccggcgccggccgctccggctgccccgccggcctccccgccccggcggcgcccgcgcctgccgcgccccccgcctccgcagccatgcagagcatgcgcatggcgtacaccgcggacggcacgcccgtgtttgccccggtgagctctgcggtcgcgccgcctggttaccaaccggcagggtctgcagcaccagcacatggctctagcatgtccgctgctcgggcccccgga

SEQ ID NO: 4279 - DNA, 845 bp, Triticum aestivum
  Clone ID: PAT_TA_4279
gagtggctgcaccaaatccatccactggcctgcccgtgcatcactaaagctgggaaggagatgctcttgaggccagatcggaccgaggctggggcacgcgttccagcttcagattctgcgcccctagcagcgaggtcatgaggcaaagcggtcgcatgggaggccactggagaatatgataaatccgttttgctgagtggcgttgctctcctgtttgtgccactgggccgagagttgtgccgtcgggttcgacagccatgttcttcatagtgttcctcgtcgtctatggcagagtagtagggatggagagaccacgggtggaggcgtgttgtgggcttgctacttctgtcagtttccacctatgtaatgtgctacaactttgcaacattactacttgttgcacaccggttaattcgtcacaggaacaggatgatgagacacgactggttcctcgggaggcggaatcttcaacacctaaccgattgaggagaagatcttgtggagagtggacacataatgcatggcttcgaggttttggtggcgctgtaggatgtgggctgcagccacacaggacaggatgaatagtgcggccctagagtagaccatcagaaaccctagaactgggctactcgagaggcatagttttggggtttcgatggatctataggaggtgagctgcagttgcacaggaggaatagctcggccctagggcagaccatcaaaaaccctaaaacatggactgctcgagaggcatatggctttgaagtttcggtagagctgtaggacgtgaaatcagaatgagcttctagagcgtactctctttttgtaaaaaaaaaaaaaaaaaa

SEQ ID NO: 4280 - DNA, 499 bp, Triticum aestivum
  Clone ID: PAT_TA_4280
aggccggagcaggtgatcggcgcggctcggctggctcacgtcgaaccggcggcagcaatagttcctgaccttgataataccaacagcgacagcaaagatagcaacaacgacgacaacaccaccaccaacaacagcaccaccaacaacaacacgacttcctcggaggacgattcgtccaagaaaaccaactgattccgtcggcgtgcgtgcgtgcagattaatttgttgattctttttcgtttcttctttcctcttccattagtcactcgagcactgcaccaactcgcagcccggtcttgagttcagaacctgaggcagtgttgattttgttcattcttttattcgttacaattcattttttcttttcaacttcattttcggtgtctggaagcacttggatgtaaattacgcgcgcgcagaatccagattgatatacgcgctccgcttccttacacttttaccagggtatatatttgttaataaaaaaaaaaaaaaaaaa

SEQ ID NO: 4281 - DNA, 805 bp, Triticum aestivum
  Clone ID: PAT_TA_4281
gtctgcttgtcttcgcatcaaagaaagcaaaagaagcaagcgaggggattccgttcgagtggaactacgtcgtagaaagccaatatggcaatgagggtatggtggagggcaagtgcccaaatcgcggagagtcccctgccatggattccaagagccagtcgcttgttctggtgaacttcttcacgacggacccgaaccccaccggggtttgcgggaacaattcagcaccacttgttagcatgctaaagacctgccatgatctgtcgggcaatcggtggcccaactacatcgccgttgattactacatgaggagcgacggcggaggcgctcccttggccaccgatgtggctaatggccatctagtatgtggctgtgacaacattgcttactgcaaggccaactcgacattcggaacctgcgtgattcctccgcccccaccgccgtcgccgcccagggcgccggccaagggtacgagcccaggcggcgatcccagtgcggcggtggctcggcttccggccttccagtggagctgcttcctcggactgacgtccctggctctgctcttcctctcgtaagggcgctctgcttcagttagcggggtgtggcacttgtgctgcttctgccatcctgagcagaaattttctacttcagtttcatttgttggtcacgagattgctcgagctgtaaatcatcccttagcttgcagagaagttccacccgatcagtgagttgtaaatcaaatgtttcatttttggtatcctagggcagtcctgcctcgatcaggtcctcggaaaaaaaaaaaaaa

SEQ ID NO: 4282 - DNA, 1460 bp, Triticum aestivum
  unsure (1)..(1460): unsure at all n locations
  Clone ID: PAT_TA_4282
tccgtagctcgtacgtggcatctccatctcaccaacaatcttgtttagacaagcagtgtaaaagtgacagcaacaatgaccgtcgtcgccgccgccgccgccgccgcggcgcaggagctgcccgggcacgggcagaccgtgtgcgtcaccggcgccgccgggtacatcgcgtcgtggctcgtcaagctgctcctggagcgaggctacaccgtcaagggcaccgtgaggaacccagatgatccgaagaacgcgcatctgaaggcgctggacggcgccgccgagaggctggtcctctgcaaggccgacctcctcgactacgacgccatctgcgccgccgtcgagggctgccacggcgtgttccatcaccgcctcccccgtcaccgacgaccccgagcagatggtggagccggcggtgaggggcacggagtacgtgatcaacgcggcggcggacgccggcaccgtgcgccgggtggtgttcacgtcgtccatcggcgccgtcaccatggaccccaaccgcggtcctgatgtggtcgtcgacgagtcctgctggagcgaccttgaattctgcaagaaaaccaagaactggtactgctacggcaaggcggtggcggagcaggcggcgtgggagaaggccgcggcgcgcggggtcgacctcgtcgtggtgaacccagtgctggtggtcgggccgctgctgcagccgacggtgaacgccagcgccgcgcacatcctcaagtacctcgacggctccgccaagaagtacgccaacgcggtgcaggcgtacgtggacgtgcgcgacgtcgccgccgcgcacgtccgggtcttcgaggcgcccggggcctccggccggcacctctgcgccgagcgcgtcctgcaccgcgaggacgtcgtccacatcctcggcaagctcttccccgagtaccccgtcccaacaaggtgctctgacgaggtgaacccacggaagcagccttacaagatgtccaaccagaagctgcaggatcttggcctccagttcacccctgtcaacgactctctgtacgagacggtgaagagcctccaggagaaggggcacctcccggcgccgaggaaagatatcctcccagcggaactggacggtgcaacagcgtgatggtgctgaagaaacagcgcggttcacgtttttctgtaacgcggtgggacatcgtatgtggtctgtttgtgtatacattctatctaatatcgtgttatttaagtggactaagcaaatatggtaatgtatcggcttcgatgatcgacacttaaaagtgagctttcgcaaactattccttgggtttgttgcaagcattccttctttattgatgcaatgcagttgattgtatgtgcctgaaaaaaggggggccgtaccaatcgcctatatgatctataccgcgctacggcgtcgttaactctgactggaaanctgcgtacactaaccctgaganacc

SEQ ID NO: 4283 - DNA, 780 bp, Triticum aestivum
  Clone ID: PAT_TA_4283
tagggttgcagtttaaagaattgggaattacccgggctgggggtgccggtcgtcgccgagcctcgggccgattcattcctaagctatgtcttcagtcagcagcggagatgcctgcgggtacatcgataggagcaggagacccatcaaactttggtaacgggcagataggaacaacaagttagctccgtgcatatcaccattctgagagtccgacagatttgtgttgattgaatccacggccccagtagaacattaagtaccatggagtttatagtcattgtgagcaggatgtatcgaatacaacagatgaagtgaagcgacctcccaggagagagagtgaccgctgtgcagcgatgcatcttgtcgtcgtcgccgcttgcatagttctctgaatggatggatgaatgggtacagttctctgaatgtgaaggtgttcactaatgttctctgaatgtgaaggtgtcagaatgacagaaaatgtgtttgcttaaaatacttcagttcaacaaaaagctcccgaaaagttcggagtgaaaagctccatggtgtttcttcggctgcagcatgtacatgcatctctacaaaaaaacggatgattccattctctgcaaagtccattagacaaggtctaggtcccaagaccggggaacaatatggcgctccatttgaggaaagaggaattgaatggatatgaagagtatatgtttacttttcttgtaagtaaacctaccttcgatcctcaactgctccattaatgccccctagcatgtacaagtcccc

SEQ ID NO: 4284 - DNA, 606 bp, Triticum aestivum
  unsure (1)..(606): unsure at all n locations
  Clone ID: PAT_TA_4284
ttctccaccccatatgaagtactacttttctaaattactttgcagtattcttagtgagcacatgtatgtagttagtgtttactaattttcagaattgtcaagggttgggcattaagcatattaagtgcagggatcgtgcactcggcgtcgtccgtcgcggcacggcacccgcgttcgccccggatttctggctcctggtacatactcttcccaagttccccttggtggctaattctggatttttttttgcttaattcaaatctgaattaataattcagattttttgtttccttgattgaaatctgaattaaattttgcttcattgctctgtaacactgccttctaatccgaaaaatctgacagatatcactacacccttttgcgtatgaagcacatgtttcataataactagatgaactacatacatgctctcctttttattgattagttggtttagcccctaaactatcttatattatctaaaagaaggcaggcataattagttttcctgcaatttttgttagttctctgtattgttttcgttgattttttatctattcttcaatatccactcatacagtagcagtacatatgtacaantttttg

SEQ ID NO: 4285 - DNA, 677 bp, Triticum aestivum
  Clone ID: PAT_TA_4285
gcccgcccctcccaagcatccgcccacattcgccccgccgactgtccccccgccgcggctccccctggcgcagcgcctccctgggtccaaattggctgaggggatttctggctcaattatgagccgcctcgcttcctcaccggtgctaccgctcgatgatgaggaccttctccaagagatcctcatccgcctctctccacaaccatcctccctcccgcgcgcctcccttgtctgcccgtgctggcgcagcatcctctccaaccacaagttcctctgtcgctttcgcaagcatcacaggaaaccacctctgcttggcttcttcgcaaggtgtttaatcactaaaacgaccgtcttcacttccgtccttgactcgcctgaccgcatccctgctggtcactttctcgtgccgcacagccacaacccatccaagcggttgcgcttcaccggatgccgccatggcctccccgtccaatttgaaatgtcactcaattcccccatgccaacaggtttgattgtgtgggatccactcactggtcaacaacacatccatttgacaatgccaccagggctcaatggagacaaatggaagtgttcgaagagcactgtggtgagcgctggtgtcccactggggcgtgcgctcggggcgtgcttcgccatgtgcatggtgattgcttctc

SEQ ID NO: 4286 - DNA, 562 bp, Triticum aestivum
  Clone ID: PAT_TA_4286
ttatctctgtgttttttaaatttttttttaaaaactgggcagctcctacaataaattaaattaaatcaccaattgtgctcaccaccaccataaaacctttaaacagaaaaagaatggtattgtacacaagcagcagagacagaaattacagtgagagggggcactgtgattacacaaacaggtgaatactattttacaagggctggcacagacaggcccccatcaaatgaagtttactcctcctttgcccactccattactttgcaacatgttgggaaaaagaaactagacacatgaaaagaatacctagtacagtaacactatcatccccttctgctccccccaatgtgctgaccacaaaacaacatacaccccatctatctgccggctggcatctgcgcatatgtacaggtgaagcctagcaggcaggatctatcggtaagccgacggccggctcctctacttgtcatgtttagggaaaagcttggagagctctgtccgcggtgaccggcaaaacttctccgcctttgccctcagatcgctaagcttagcctcgtgccga

SEQ ID NO: 4287 - DNA, 722 bp, Triticum aestivum
  Clone ID: PAT_TA_4287
ccgtcatggtctatcggtcaaatgcgtcactccctggggcagaaggttatttcacagctatttacaccgactctcatcatgaggactcgctacttcgcactaccgcacagatgcttgaggataaggaccgtgaaaatcgtgccttgcgattggagcttttcaactcccggtctgatcactgggacactttgacccggtttgcacctgctgtgcaggctgggtatatggatatgcgggatctgtaccccgtgcggtctagtctgctggatcatatggattgtcgtgatgtagggggcatcactcctccccatggacctcttctgtcaccatttgttggtcccaggccacatctgtgtccctatggactgcaggctccacaggatcgactgtttccagatgatcacgtccagcttccaggacatgggggtaatctctacgaagattactacggagatgtttgagctgatggtagcaccactagtattgtaacagttatatcgtccaccgtcctgcgtgattgtgggatatgactgagctgatggtaccactttttggaggtgtagaaatataatgtataggagcttgggatgcctccgataagatgtaatcttcctttcatcgcagttgtacttcgtttggtcttgtactaaaccttgtatggtgtgtatgacgatggaataagtgtagcagtttctgtatttaaaaaaaaaaaaaaaaaaaaa

SEQ ID NO: 4288 - DNA, 671 bp, Triticum aestivum
  Clone ID: PAT_TA_4288
cgatggcgaacgccgggctgcgcgcctaccgggaggtgctgcggctggtgcggcggctgcctgccgacgcgcggccctactacgcgaagtacgcccgcgagaatttcgtcaactaccgccacctatccgccgacgacgacctcgccggcctcctccgccgcgcccatgcccactcctcctgggtcctctccaaggtaacgtcacgtcaaccgaatgcggtgctcgttctcactctccgcgtgttcatcgcgccatccattccattcgcggctcatgggaatggaatgccaatggatcgacctattcctgctacctatctcactgttcctggctgtgcaacgcgtggcttgcagtactccatcgacgccgcggaggcggcagggcggctcaaggagatctgcggcgagcgcggtccccactgagggaagaccgtggcagctgcccgcggcgcggtggtgcgtgcacgcaaggtgttcggctatatgcctctgtactggtttttaagttccctgcccgaaccagggtgatgtgccctgttctacctctactgtgttgttttagagctgggcgcttccatgtttccaaatgttctacagtagtggaaaacaagatcaacattctgcttctgacttggtaatgttctgagctaaaaaaaaaaaaaaaaaaaaaaa

SEQ ID NO: 4289 - DNA, 697 bp, Triticum aestivum
  Clone ID: PAT_TA_4289
cgtctcgcaagccgccaccagcgctgcgccgccgctgccgccgcggcggccggcaaggaggcggctgctcctgctgcgccaccgcctgcatccgcccgggaggcgcagctgcgacgaccttgatccgccggggggcggccgctccgacgatgtcgatggggggagcgtcgatcacatcagccgcgtccccgacgccgtcctcggcagcatcgtgtctcttctccccaccaaggaaggtgcccgcacgcaggtcatctcccgccggtggcgtccgctctggcgctccgctcctctgaacctcgcggtggactgtggacccaataaaagggactcgattccaaagatcctctctgagcatcctggccccgcacgacgcttctccgtccgcatcttcaccgactgcagcgacgacaagatcgatggctggcttagttcccaagccctggacaacctacaggagttcgagctcacctacatctgctggctcttctggcgcagcaacggggagaagttgggcctgctgccattgtccgtgttccgcttttcgcccactctccgcgtggccaaattcccccgcccccctttccccaggagtaacttgattgtgcagctgtccctgaagtttccgtgcctcaagcagctgaccctggaaaaggtcaccatctcggaggatgttctccagagcatgctctctggc

SEQ ID NO: 4290 - DNA, 1130 bp, Triticum aestivum
  unsure (1)..(1130): unsure at all n locations
  Clone ID: PAT_TA_4290
tggatttcgttatccgggtgatagcacagacgagcagatggatttcattatccgggtgatagcaaggaagctgaagagcatgatggacaagggacagacggaaaagagttgcaggatggacaagggatgaatgaaaaggagtaggaggaagcaagttataacaaatatggatctggtgcatcagagaataacattgctggaacacatattactgcaagccttacatcttctttcaaaaaggtaaaatttattagagaagaccaatctattgggcgccagagacgatcaagccctttccccttctaaaggaggtggtatattactggaagtctgtgaatccccttctaagcgggtaaattagtggaagactatgtatcatgggtacatacctgacatgtctgggtcatcttatttaaatgtaggacacaaaattaacctaggaactaaccttgttccagcacatctatattactactactcagtatctaaccttttgtgtgtgggaaaactcaggatgtaaactgatacttcgtatgaaggtaaaatatttgtgcactgaatgaactgagaatagaggtgatattattttttgtaaaaatctaagtttttcgatgacttctcccaaagacaccgcagccatcttaataggaaaacttgatcagacttacccagagtatgctattctctctctaacaataattaatttttgtaaggagacattaccgggatgtaaggagacttgcccatggtatgttttctctctctctaacaataattatcttgtgtactacttagataacttggtaaatggtttgtactgctcgatcacacatatcatatttatgtggtaagaaaggaattgttagctgaaacaaataatggtgtgtgttggtgtcatgtaggtgacggcaatggatgtcatgtagaaactacatattggggggtgggatattggttttctgaatttaactcttggtggataacttctcttttttatttggggaaagaattctttcacatcctggtatcatgagccaaattattttggagatatataaaatatattttcttaaaacgggggaaattttttnnaggaanttnttnnnnnaaacctggttnnaaccnttttt

SEQ ID NO: 4291 - DNA, 710 bp, Triticum aestivum
  unsure (1)..(710): unsure at all n locations
  Clone ID: PAT_TA_4291
ctcttcccctccttccacattctctgcttccgttccgccccccgaaactagggtttccggtcggaatcgccgcgaggatgccggccagcgccgccgcggccgccgcggaaggcgaggagaaggcggcggaggcggggggcagggagctgctgtactgcggcacggtgcgcttcgacatcatgggccggaaggtgaagggcgggcatgcagggcagaggcaacctggtgtcccccacgcggctgcgccctctcgtgggcgtggacatccgcctcgtcgcctccggctgcgcggcttgccactgtgttgctctgagtgctgacggccgttgcttctcatggggtcgaaatgagaaggggcagctggggcatggggacactctcttgcgtaacctgccaactgttgtttctgaactatcaaaatacaacataatcgcagcatgtgttggaagaaatcataccgtggtcgtaactgacgaagggaagtccttcccattgggggcaacnaacatggacaactggggaacggttcactgaagantggaactgtgtgtcccaatcccctgccttgttacnaaacgactaaagcttttgtggngctaanttacgtccngnttcataatccaggntctcaatacnacacaagtctcccantaggcaactggcatggancacattanntatccaantcaccgtatcataanntccanccc

SEQ ID NO: 4292 - DNA, 589 bp, Triticum aestivum
  unsure (1)..(589): unsure at all n locations
  Clone ID: PAT_TA_4292
caacttcccaaccctgacgtcccccttcgcttcgtgcggccatggtgggctcggatccggagcctgacatcgcccggctcttctgccactacaacgccctctacttcgaggactccctcggcgcgtgcgccgtctcctgggcggaggagccactcccctacggtgatacaagtggctgtgagtattatcctggcggcggtggctgtattgtacttctttcgaagtccttgtatgagtttcacacatactccgatctgaagaatgctttgctccatgagatgattcatgcctatgtgtgcatcaaaagataataacactggccaatagtaaccaatggtccaaactttcagaagttaatgaatacaaatcaattccaagctctgtaccagatcgtcnatcggcctcttggggggctacaacaataattacgccccaatggatatcnagaaagaaatgttatcaatacgaaatgtggacggctgtgggagattttgttaagatcaaccaaggtctgaggaccttcacatgatgactgcattgagagaatgggtgctaattcctcctgcccaaattcagcttgtcaatggca

SEQ ID NO: 4293 - DNA, 641 bp, Triticum aestivum
  unsure (1)..(641): unsure at all n locations
  Clone ID: PAT_TA_4293
gaagctcacttacatctcctttagtgctccacagaattatatgagtgatgaagtaggagacatatatagattatacgagaggaatcagtaccaccatacagagagatcatcatctcctctggcgaagaagagatgatgagggagggtgatgcatgtgttgcacttctgagttgcttgctccatggcctgatcgagaggggccacactctggaagaggagaacaagcaactgaggcatcaagtcagccggctgaaaggccaagtctcctcacttgaagggcaggatactgagagaaagataatgtggaagaagccggagaattctgccaccagcaacaactacttcaaggaaaaacagtttgttcacaacaatgatgatgtgaaggaagccatggatctcaacagctcggcatgttacagcaggcagcaattttctaggacaccgtctgtgaaatcaagagcaccaagggttccaaatccaccaccaagtccgacgtgcatccaaccgatcatcaaggcaaaaaaggaaggatccatgggtcctcctcctccaccnncacctcccctaccttccagnttactgaagagcaccaanngagtccaaagggnnnncagagtagttgagttgtaccggttgttagt

SEQ ID NO: 4294 - DNA, 713 bp, Triticum aestivum
  Clone ID: PAT_TA_4294
gagaaagttctatcaaatgaaaatgtcataaatgccatcattatgacactatctcacatcttgtcagaaactagtgagatcaagttcacaatgttgagagacagcacaaatgaagcagacagtaataatttggattatgttgacaaagtgacactacttgaaaataaagtgcagcctcattcatcttctggcccttgcccacttattcctcatccatcttctgatcctgagattgtggggcctaatgatgccggattcgatgttaagactgcagtgcagatgtgctcaccggaggactacgagcgacttaaatctgagaagattaatctggagacagaactagcgagatgcagtgaaatgatagaagatacaaagtgtaggtttagtgagatggagaaaaacctggaagagcttacatccaggttgtctgccagcgagaattcaaacagcttggctgagacgcagctgaagtgtatggttgaatcctacaagattcttgaatcaaggaaagttgaattagaaaaggaaatagaagtgttgcagtccaaaatagagactttaacagctgaactcggggatgaaagacaaagtcatcaggatgacttagccagatacaaagatctcgaagagaagatggaaaggtcgtaaacgagcagagttcaatgcatgtggaagaggttgaccgcaccaaatcaaagcaggaggtggaaata

SEQ ID NO: 4295 - DNA, 878 bp, Triticum aestivum
  Clone ID: PAT_TA_4295
cgggcccccacccgtaggctcccccgcgcctcccactcccgcccgcctccccccctcgccgtcgcggccccccccctgccggcccgtagccccccggggcggcggccggggcggggggccggcgtcaggccctggaggagccgcgcgggccggtgcgggcggcggggcgcctcggggcgtcggaggcgggcggcctcccgccctgacgctccacgacggaggccagttcagagggcgaaaccagaaagcggtggcgtgtcctacgcttgtgggcggaagcagcgaggttggtcgagcggtgattgtgaccggggtcagtagctgaaggaggctcgctgactggaacagtaggaggcggctcaccagcgcctcgaggggtcggagggagaggtcgtgcaggccagacaaaggagagcaaggacgatgaatattcaatcagacctatgttttcttctcgatgcacctcggcatgaggagtcgtgctaggcatcctggggtgattcaagatgctcaggtgtaccacactgcatgctacacaggtcaattgtgcaggttgctctaaaatacactaatttagacacgaccacttgtctgcagcaatttcttactctcagtgcaaacgtacttctttctttctttttatcaaatgcactcctgcttcacttcaactcccaactatagttgcatatatatatatatatatatatatatatatatatatatatatatatatatatatatctgctaccagactagctcatggtgtgggaagcatctcatattgttcactgaatctattgatgaatctgaagcaattcaagaggtggagcaaaaactatttatgcctataggttgtccgaactacacctttaattcta

SEQ ID NO: 4296 - DNA, 491 bp, Triticum aestivum
  unsure (1)..(491): unsure at all n locations
  Clone ID: PAT_TA_4296
ctcaggctcatctccggcgctgcggccaccccatctgccagttcgtcgagtccccccgcaccttcctccactctgtcgacccccgcgtcannntggtgtggcttttggcccttgttgtcctaccggccaggtcaaatatctatgtgcggtttggtttggtagcatgccttgctcttctttcaatgtgggttctgccgaatcatgtttggaaggatcaacttggaagggttacccttctttcaggcatcatattcataatgttgggatttggcttctgatggcgcgccttcgctagtccggacgagaactcctcccccatctgttctaggtgtgccaaatattcctagtgccttgagtggatattcttacacaatcatgaaactaggaccactgcagtttaccaggaaaggcccatcagtagcgagtacatcggcatgcctctcctttgcgatatagcaaagtgcaagtctctgcttaaccaccaccactcc

SEQ ID NO: 4297 - DNA, 1199 bp, Triticum aestivum
  unsure (1)..(1199): unsure at all n locations
  Clone ID: PAT_TA_4297
atgggctgcggctccatcgcgcgcaagtccgcgctcatggggtcgtccccgccccgagtggccgccgtcgccagccgctccgaggcaaggcgcgcctcttcgccgccgaaacggccttcggagcggcacgcgcatccacggctcctacgaggcgctcctcgacgactttgtatgtcgacgccgtctacatgcgcggggggaccagcctccacgtcaagtgggcgaccgccgccgccgagcggggcgagcacctgctcctcgagaagcccaccgcgccctgcgccgccgacctcgagcccatcctcgccgcctgcgaggccaacggcgtccagttcatggactccaccatggggatgcaccacccccgcactgccaagatgcgtcagctcgtcgccgatcaggacacaatcggagacgtcagatttataaacaccatggtcagctttctagcaaacgaagatttcctccagaatgacatcagggtgaagccagaccttgacggcctgggtgtgctcggtgatatcgggtggtactgcatccgtggaatcctgtgggcggttgactatgagctgcccaagaatgtggttgctctccgtcaccctgtcaagaaccaagccggcgtgctccttgcttgcggcgcgtcgctctactgggccgacggcaaggtcgccaccttccactgttctttccttaccaacctgaccatggacctcaccgtcgtcggcaccaacggtactattcatgtcaccgacttggtcatcccgtacgaagagaagtctgctccgttcagcgtcgactccaagacaaacttcgccgaactctctaccggatgggatccacatccgagcaagcatgttgtcaccacggacctaccccaggaggggctcatggtccaggagttctgtaggctggtgcagggcatcaagagatgccggtgtcaagcctgaggggaaatggccgggcatcacccggaagacacagattgtcgtggatgcagtngaaggcttctattgacaacggttttgagtccgtccaatgttgccagctaaaatacaacacataactggtgttcccacgttgtatcttccaagaccatgacaaatcctatttacgtgaaataattttgaacgatccttgtcatattggaggacaatattgcaatgatcaaattnagggttactaanaacaaaaaaaaaaaa

SEQ ID NO: 4298 - DNA, 1171 bp, Triticum aestivum
  unsure (1)..(1171): unsure at all n locations
  Clone ID: PAT_TA_4298
gnatgtggttgttgacacagnaaaccacaggnaaagcagctcctacaaaacggagggctcaaaaggagggtaaccataataccgttgaataaaatccatacaggcactatacctgatagagtccagcaggcggctcgtagaatggttggagctgaaaatgtaacattagctctagaattggttggctatgacgaagaagtaaagaatgctatggcttatgtctttggctcgacatttgtatgtcgaaatatggaggcagcaaaggagattgcctttaatagggaagttggcagtacaagtgtgactcttgaaggtgacattttccagcctagtgggctattgaccggaggtagtcgcagaggtggcggggacttgctaaggaaactccatgaattagctaaagctgaggctgatctctctgaccatgaggacaggctctctgttattgaacagaagatcgctgtgctcctgcctctgcataaaaaatatgctgagttgaaatctcagtttgaactcaaatcatatgatctgtcattatttcaaagcagagttgaacaaaatgaacatcacaagttaggtgaacttgtgaagaaacttgagcaagaactccaggaatcaaaagaagaattgaaggaaaaacaagtggagcataaaaaatgtgtatccactgtttctgatttggaaaagacaattaagacttatggcagtgaacgtgaaggtaggctcaaagctctagaaaaaaagataaagtcactgaaatcggaaatgcaggccatgtcgaagcaattaaaggcttatcaaagcgagagggagaggcttattatggagaaagatgcagttgctaatgaacttgcttcgcttgaagagcaattgataacttcgaaagctcagattactgcgctgtcctgaaacctggggcacacataagagcaaggttgctgccaccaagctagagtatgaccaagctgaatctgagctcaatattggtcgctccaaactgaaggaatgtgactcacaaataaacagcatctccaaagagcagcaaaaactgcagcagctactgggtgattcgaatgtcgaaaggaagaaaatggaaaatgaggttaagaggatggagatagagcagaaagattgctcttcaagggttgataagctaatggagaagtacagt

SEQ ID NO: 4299 - DNA, 534 bp, Triticum aestivum
  unsure (1)..(534): unsure at all n locations
  Clone ID: PAT_TA_4299
gcaaatagtatctgcagctgacgctcgccgccgcttcatcatccacgacgtcatggactgcttcgcggaggctgaaggaaagaggtcgcatgacccgggggactgcaacccccactcgccaccggctaccggcttccctgtcgacaacatccccgcgccggtcgtcatcgttggtgcagggccggctgggctggggatggccgcactgctcggcgaggctggagttcctttctagctgctcgagcggtgtagctgcggcggctccctctgggggcaccgcacctacgacaggttatgtgggcggcgccccaaacaattctgtgagctcccactcatgccattcccgaaaagcttccccacgtacccggcaagggaccagtttctggagtacctcgagtcctatgcaaggaggttcaacatcgagccacagttccgccaggccgtcgtcagcgccgaattcaatggagacttttggtggattcgcacaaaggaggtcacctcactaccaatgggcggtgagcaggccacgcacan

SEQ ID NO: 4300 - DNA, 593 bp, Triticum aestivum
  unsure (1)..(593): unsure at all n locations
  Clone ID: PAT_TA_4300
ctcctagccgagccacgcctccacccggagagatccacccaccagctgagctaagccagcgccagcgccagccatggtcttctgggagcgcgactggtggcgcaagtggtgggagaagcagcgccggcgggactgctccgactgcgagtgcagctggaccacggccatcgtctgcctggtcatcctggccgtgctcgggggcgccctcgccctcctcatcctcgccttcgccgtcgtcaaaccgcccacggccagcgccgacgacgccctcctcacacgcttcgacctcgccccggcccccaactccacgtccacggcgaggccgccgctccagctcctgtcctacaacgccacggtcaccgtctccctgcgcaaccccaacctgcactacggcatcacttcggggccgtngccgcggcttctccttcaacggcacccgcttcnacgaatccgggaaccgttccgacctcgactcngcgcacggaaggagacacgtgccctcaaggtcnggcgccgtcggccgcgcctgccaaactgccgggcggcggcgcggtgganttnccaaacaaaaggaggccgcgttttnacttgag

SEQ ID NO: 4301 - DNA, 1109 bp, Triticum aestivum
  Clone ID: PAT_TA_4301
gctcgcttctcccgctggtttgtgcccctgccctcctcctctcacgcccggagctcagatcgccgcggatcccttgccctccacgcagcggcctccccccctgggtccgcgcgccgtctagggatcccggctcctcctccgcggcgaccgatggctgctcttctggcgcccgccatctccggcgaggtcggtttgcggcttttactggcaccactaagctcaaatgttgtcatacgcacagccagttgtgcggtgggcattggtctgcctgtatactccacttacagggctatagaaaagaaagatcaagatgagaaagaacggctgctcctttattgggcagcatatggatcttttagcattgtggaatcctttgctgataagcttgtttcaagtgttcctctgtattaccatgcgaaatttgctatccttatatggctccagtttccttcaaatggtggatcaaagcatgtgtacagaagatacctgcgcccgtttttccggaagcatcaagcaaaaattgatagaatcctgaatatcttgtccaaggaacttacgaagtttgtgagcaaccatgaagatgaaattcgttttgtagagaacatggccatcaggggtgccacaacagcaaattacatcgtaaatgggcttgaccaacctggacaatcagaagaagttagcgtgactgaagacccaaatccaactccgacagaagagccagacacacctaggagttgaaacttgagcctgggtgccacacttgccagtctcccccccagatgtgtctggtgcggcagaaatgatcctttacaactgtgaatatgtgtttctgaacaagtcggattacgtttcaagcagtaggagtggatactggccacttgtatcagagtagtactcgtgttacgatgctaccaaagttgcagcacaggtttgtgggtgccgctcaggtttcggcgggactctttcaattcgcctgggagtcttacaatatacttgcagtctccgctctcattatcatagctattgcatagttcgctaattaccactgccccggaaaaaaaaaaaaaaaaaaaaaaaaaaaaaaaaaaaaaaaaaaaaaaaaaaaaaaa

SEQ ID NO: 4302 - DNA, 745 bp, Triticum aestivum
  Clone ID: PAT_TA_4302
agaaaaatctcacaggcaagtgaatcgatgaattaaactattgccgccaaatgtagcatataaagtgtgaggcatagtatatatacacaataaagaatcaagtgaggtatccatgaataatgtagctacagtaccgacgtttcagcagaagaaaccgaagaagcggcggttaagctaaggtccgcagtatgtacatacatgaactgcgccgtataatcacctaccaactagtagcaacggatcgatgggatgaaactggtaagaaaaaaaaaaatgccgtatgaactccaccgatgatgctttacaaattgcaaattgctgcagtggctcagacagatggagggaggagctcgaggaaaggaccaaaaatatctgcacaaatgattcactccacagctgaggaagtgtcatcgagcacgggaactactgctgcggagggttcgatgtgcgagaaccgtgcggcgcctatgagttgctccgggagctcatcgtacgtgtttgcctgtatgagaaaagccatatcgactaccaaactggtaactacaccaaagaccaatcccagaacgccattggctactgctgaggatccaatgtctacatcaacttcaatgtactccggaccgcggatatagctgcaatcaacggcctttcccaataagcaaggggtacttccaacgctttgtcgaactatccaagatccctgaggccggcccgggcggccgcttcgaaatcacttagtgaattc

SEQ ID NO: 4303 - DNA, 916 bp, Triticum aestivum
  Clone ID: PAT_TA_4303
gcttcctcttcctctactctatctactccgcatatatgggtggatctactaaccttcctcctggtttccatttcttcccctccgacgaagaactcgtcatccatttcctccgccgcaaggcggctctcctcccatgccgacctgacatcgtccctacgctgcctcagaatcgctacgatccatgggagctgaatggcaaagcacttcaagcagggaaccagtggtacttctttagccaagcaacacagagtaggacctcacgaaatgggtgctggaatcccatcggtgccgatgaggcagtaagtagtggcggttctcatgtcggcctgaagaagacactcgtcttctccattggggagccctttcaggcgaccaaaaccaactgggttatgcatgagtaccacttacttgacgggaatgggggtaccagcagttcaggtagttcacgcaagcggtctcacaagaagaaagaccacccagacaaagaatgcagcaattgggtggtgtgtcgggtgttcgagtcgagctacgattcgcaagtgagcttccacgaggaggacatggagctttcatgcttagacgaggtgttcctatccctagatgactatgatgaagtcagtttgccgaagaattagaacctttgctagcacatttgagagaatgggttttgtgcctaccatgccatctgatcatgatgatactcataagagaaacatctttcttaatgatcaaatgatctggtcggtattaaacctaattcactccatctagaccagagatgtaattattctcctccaagaaggtgcatgaaacaaatttaatatgttttgactactatggaatataagtgtgtaatggcctaatgaccactctttcaactagcaattactcaagcatttggtggtttccaaaaaaa

SEQ ID NO: 4304 - DNA, 647 bp, Triticum aestivum
  unsure (1)..(647): unsure at all n locations
  Clone ID: PAT_TA_4304
gcagcagcaagagggttgggcaagcggctgctgctccggggggccgcgctgtgccacgggagtagtaagctgccgccgctgccgtctcccccggccatggcggaaatgccgagggtggagacggccggcgatggccgcgtcgagcacctcgagaagttctcccactacgtcgctcggcagattgggttcgaggacgcgagcgagtgcccccacctgtgcaaggcggccaacaactacctccggcgggccgacaactgcatgacggacgtctaacggcctcctgggacggcgccccggaggcccgacgcgctctacgtcaagctgggtgggacgagctgggagagatgcatcctccgctacttcgccttccnactggggaccattccaccacccccgtcacccaggccttgtagcgtggacagcgccaacaaaaggaagtttaggaacggggttctccaagctaacaggaagcaacggcccgagcggatcacagactcaaagngaccctgtttctcaacctggggcacaaattaangcatcngaccgtgacgggatgacggcaggaggaggccactgaacgactgatggnccatgngcnaagacggtcccgtgttctctatggcgcgatggcccgaaaaaacttccag

SEQ ID NO: 4305 - DNA, 779 bp, Triticum aestivum
  Clone ID: PAT_TA_4305
ggcacgctcggccgcccgcgggccagaccgcacccgacccccgatctggttgaatccgtccaatccaaggagcactcgcaatcgcaccggcggcggagatgggcggcgaccatggcggccacggcccgagcggcggcgacttccggcagaaggtgtggagcatgacgggcgggccctactgccggcccgtccactggcgccgcaacaccgccatcgccatggtcggcatcttgccgcgtctgcatccccatcgccatgaaatccgccggagctcgagcaacgcccgcaccacccaagtccggccaatcccatcccagctttggtgcaaaaactttgggcaagaaggaatactgaaggatgtgccgactttcaaggataaagccagtttttacctttgttgtagccttcttttgtcataaccggtcctcagcgatcgaagctggaagaagtacgctaccatagcgttatgtaactcttgtgacttcttattatcacatacaaggagtgcatgtttgtttacgttatataacacttgtgaatacttttatcacatacaaggcgtgatttgttagcgattcaaataaactcgcgatgcatgagcgcctctatggatctactttaggatcaaatcctatggttatagacatcgtttgttctcctttttggtttcccattgtgtgtggatgttagtactggttttcttgtattcctgaagttatgatgctttgggttcatctcaaatatatgatcaaaaaaaaaaaaactaaaagtgttcttgg

SEQ ID NO: 4306 - DNA, 1144 bp, Triticum aestivum
  unsure (1)..(1144): unsure at all n locations
  Clone ID: PAT_TA_4306
ggttagctccgccccttggcacaccccgggatccgccccggccccgtcgtcctccccccccggcccccgccccccccctccgtgccgtccacttctcctcctccgccccgcccggatgcaacagcctacaggcgagatggagatgaagaaggcgcctctgccagcgcctgctttccacaaagagtacactcttcctagagcacgacactaccttgatcaacactattcactccgccctcctctctccaaggatgattactccaaaaaggatcctacaagcgagatggagaagaagaagaaggcgccgctgccaacacctcatttccacaaagagcggcctcttcctagagcagagcggtcccccgatcgacgctactcgccttaccctcctccgtccatggatggttgctctggaaagaatgctggatcttggcctcttcccccgatttactatgggcctccatctgaagcctttcatgtcgactggcgcaataaagacggggttgtggacatggagcattacagcacagagctgtttgcagcgatggacaaacatagtattttgtcggtgcaccgttgtacacgcccacagtttggaccaaacgtcagcgctgagtatgtgcttgatcctatatttgaggatacgttccttgccaatccccgttttagctacctgcttcccttgatcggccacaaagtatcttctgcagctgaggctcccaattcaaccacgcaggttggcacaactactggatactggcagtgtgatggttctatagaagtccctgtccgcgaagttgctgctttgaagatttctgacaactagccacctatgtgcccaaccaagttgctcccagaagatgaaaatcaagattttcatggagggccctgagtttcatattgagattacgaacccgttagcagtaactatgtattagctacatctaccctaggtgtgggccgcatcttcaagatcaatgcgcgcaggatatattaattttaacttggtgtctgcgctgcgccgcatctatctatctatctatctatctatatagtgcaagatatttataagcttggttcaggttgtgtctgagaaagagtggcaatctgtcacagaagatgccattcgtncttatatatgcat

SEQ ID NO: 4307 - DNA, 650 bp, Triticum aestivum
  Clone ID: PAT_TA_4307
gtccagctcgagaaacgcattgactgtttgacagtggcagtgagagctatctgctctctcttttccggttaggttggttgagtactggaggtgcgtgaaaggtggtttcgggtggcgagtgtcgcccggggcgcgcgccgccgcgcgtgcggcgcgccgcgggcgcgcgcggcgagatacaccccgggcgacacccccccggcggccccccgggggcgctacaccccccgggccccgccaacaagagaacaaaggccgccacccccctgtgtgctcatccgcgcggggggcgcacacagcggggggggggtgaggccggcggactcggcctgctcctccgccgcgaacgcgctcaaacagcgaggcaagcgggcgccaccacccgccgcgctcaacgaccgcgggggaacaactccttctctccggcgtcaccggccactgcaacgcaccgcacgtaatcactcctggcaacctcgcggccccgccaccccgcctccccgccccccgagtccccgcccccggccaccccccaccccccctcaaccacccagaccgccccggccacccccggccccacgcgcaacgccccggccccccccctccctcctcccccccccggcccggcactcggagtcacggggccaccgggc

SEQ ID NO: 4308 - DNA, 517 bp, Triticum aestivum
  Clone ID: PAT_TA_4308
ctcactggtttgttgatggttcagtggttccgttaaggaattgcaatggcgaatcgattctccagtggttcttctgcctgtgacactaggtctccttctgaatacctatgcaaaaccagtggttaatgtcattcaaccagtgatgccatttgttgctatggtgtgcacatcgctctgtattgggagccctcttgctatcaacaggaccatgctcctctcttcacagggattcctgttacttctccccatagtgactttccacattgcggccttcgttgtgggttactgggtttccaagttgcctctgttgaggcaagaagagcccgtttgcaggactatttctgtgtgtaccggcatgcagagctccaccctcgctgggcttcttgctacccagtttcttggaagtagccaggcagttcctgcagcatgctcagttgttatcatggccatatttggtttgactctagcatcatactggggaaatggtttgcgaatcagagatatcggttcgagattt

SEQ ID NO: 4309 - DNA, 1367 bp, Triticum aestivum
  unsure (1)..(1367): unsure at all n locations
  Clone ID: PAT_TA_4309
agcccgcccgcccgccatgtcctcctccgaccaggaggaccacgacgaggacgccccccttgtccgcgacccgtccccctcaccgtcgaccccctcgcgtccctcgagaagtaccatcagaccgccgtggtgccccgcgagtcgatcctgaggactgaggcggagtggctccgctcccgcaaggcagacctagtggtctcggatgttgttcctgtggtgtgcagggcggctgcagatgccggtatccgctcggtgtgcattgggaattttagttgggactccatatatgcagaatacatcatggcagctgggtatccacaccgatctattgtttggcagatagcagaggattattctaattgtgagactttacttcgactacctggatattgccctatgccggctttccgtgatgtcactgatgtgcctctagtggtaagaggtttgcgcaaatccagatctgaggtgaggaaggaccttggaattgcggagagcactaaggtggtcatttttaattttggtggacagccagcaggatggaaactgaagcaagaatggctgcctgatggctggatctgtttggtctgtggtgcatctgattctcaagaggttcctccaaacttcattaagcttgagaaagatacttacacaccagatgttatggctgcatctgactgcatgctaggaaaaattgggtatggaacggcaagtgaagctttagcatacaaactaccatttgtgttcgttcgcagagattattttaatgaggagccatttctgcggaatttgcttgagcaccaccaaagcagcattgagatgattagaagggatttccttgctgggcactggaaaccatatctactccgtgctctcacacttcaaccttcctatgatggcccaacaaatggtggccaagtggctgctcggatccttcaggacattgctgttggaaagaagtgtgcttctgacaaatttaatggagcaagacgattgcaagatgccatagtgttaggatatcaactacaaaggactcctgggaaagatgtaggaattcctgactggtattctcttaatggcacagaaattggtgcccatccaatcatagaaaatactgaaaaggtcaaaacggcagaatcatgctgtgaagactttgagatactccatggggacttgcaaggactaacagataccatggcctttttgaagagcttatctggacttactggaaatggattgaagaattctaaggngaaacccaaaaaaaaacngtnacatctgncctttacctggggaaaagganatatnttnccaaagacccctgnggggnaagtcacagggggagattgacactatatacgaagaatctt

SEQ ID NO: 4310 - DNA, 419 bp, Triticum aestivum
  Clone ID: PAT_TA_4310
acccgttggctagtggaaatcatctttctgtctcagaaggctctcctgaagcatgctaccaagctgaacttgacagaattgtagaagaaatatcatttataccagatgagaactatcttttgaagggtgtacagcttcagtctgttgttccagttacagaagtctctctggatgtcagtacagctgaaatgcagaaagtcacacaagaagtgttggcttcagatggagacctattatccccagacaagggtgagctaacattggagaggaatgatgtcctagctggtggtcagtgtcagcttgctgtctcagacggctctgctaaggaaagtgatgtagctgaagctgagaggatagttgaagaaaaggcaacaaaatcagatgagaattctgtacttaatggcaaagatatccagtct

SEQ ID NO: 4311 - DNA, 556 bp, Triticum aestivum
  Clone ID: PAT_TA_4311
caaaaacattcgggagcaaactccactggattctgattgagcagagccacatggagatgagcctgctgagaagccgtaccttctctccgctcccatcgacgccccggccggtctcctcccagcgccgccgccgccgccgacttccctccacaacattcttcccgccgcagcctcctccgccaagcgtggttgctgccccccttcgcctctccttgccccccttctcccccgccgcgtaaactcttcgcttcttatctgcagcgaggggacagggcgtgcagcagcgcaatgcggcagcggcaggagtgggtggaggactgggttcggagcaacgacacgctcggccgcgccctcccctgccgccccggcggcgccgccctcccccccgtcctcctcttccctgcccgttccgccagcgcccccgtctccgccgcctcctgcgcgcggtccagggccggctctccctcctcgccgctcgccgtggctgtccccctcgccggcctcgtgcggctgtccatccgtccgtgtgcctggtcgccattgcattcttcaaatt

SEQ ID NO: 4312 - DNA, 838 bp, Triticum aestivum
  Clone ID: PAT_TA_4312
ggcttcacggcattctattctctctctctcttccccttccttgctttcctctgcttcctgtccgcgcgtccgcgtccgtatcctttttgcgtgcgtacaaatataatactcgccaaatttctcggaaaggagccccttcccatccccgcttcaattcccacctccgaccaaccgattcttatccagtttctgcttctgccgattcgattcaattcaattcggcccttccttgcccgattggatttggattcgatccgctgttgctggttcgagcttccagcgggggacctggaatctggtggatctgatttggtttctccgctccgcttcactggtccgcagcaaatcggtcgctactccgcggattagcctctcttagttttccttctggtttcctaccatttcgatacgctcgtccggatctttggatgattccgatcgatttcgcacaaaaaccgccgatttttcaccccaaggacagcgattcctcgtagctgtggcggtggatccatggctggggagaagtcgcctcgcgctttctccatggaagagttaccgggccacctcatcggggaggtactgagctccggcaggctcgccgctggtgacctcgccaggcttgagggtacctgccgcgccctccgtcctctcgctgagcaagccgcgtcgcggttatgcgcagcgcgcatggcctgctccgtcattgggcctgcggctcgtggggagctcctcgcaagatgtggcggtagctggaagaaggtgctgaggttcctgcagtcagtggagcaatccttcgataccgtacatacctcgtccggcaacatgcaagtagcgacag

SEQ ID NO: 4313 - DNA, 970 bp, Triticum aestivum
  unsure (1)..(970): unsure at all n locations
  Clone ID: PAT_TA_4313
ggccagtgaagnaaacagtatacaggagtgcggcacggcgcgactggccgggaagcagatcggggagaggaccaacagcagtagccgctcatcccgtatcgatcgccgccggggggaggcagggttgcacgggggtcgtccgtagggggaggcataatggccttagtagggttgtctccgtgataaatttcacctttatggtcttttcaaactctctcacacttcaaaatggctgttcgcatgtttaggacaaaagtgggttcatttcagcatcatgtacgtggatgtgttgctttcagcacggagcgaccaaaacttgttacagtgggaatcgactttggatgcaaaaattcaagagttgcaataatagactccttggttccacatgttgttgacagtgaaattggccgtttcacaccatcgtatgtcacatttacacaacagaattcatatctaccatataaatggagtctacaacacttggaccctgttggtaactgtgttgcagttggagaactggcaaagccgtagaatgtggagacaaccttcagatgttggttataacataaaaaggttgataggaaagcaatttcaaggatccctctgtccaagaaatggggagaagggtccatttcagcattattgaaggacctggaggagaagcttgggtgggaatttgtggaatggagttgtctcctgtttgtatcgcaactgcaatcttccaaaaactgaagcatattgttctgatggaccagtttcatgatgagctgcaggcagtgataagtgtgcctgctttctttgatgaactgcagaaggagcacataaagtcagctgcacacagagcaggcttcaagctattgcaactaatagatgaaccaatagctgctgcgctttctagcataacaactgaagatggtattgttgttgcttttggcatgggtgcccggtcttatagtgccacaatccttcg

SEQ ID NO: 4314 - DNA, 1690 bp, Triticum aestivum
  Clone ID: PAT_TA_4314
gtgcggcgctcaggcggcggtcgggaaaccaagaagtactagcagagagggagctggcacgcgggtcccgaatccgtcggttaccacggactgccgccggcgatggctccctccgccgacgtcgccgcgcccgccccgacccctccgctggcgcccctcatcgccgcgcagctcaagttcctcctcaccaactccaggtctccccatcaaggtggtgcagatctggtccggatgcagcagcggccgctacgccgatcgcttcaccctcggcatccccttctgcctcgactacgtctactgggatttcttacctataatggcgatgcagccccagtcggcgccgcaggccgtcatattcgggcagcgcgatctccaaaaaacagctctggtcgattatgacgagtccgggaatgggggcaagagctgcttggcacactgggattaccgcgaccccggtggcctcctctgcctcgtggaggagctccggttattatacattgagtaccaaaagaagctggttgagaaagtggatgatgcaagactgaagtttgaaataagcacagttcttgctaaggaggggattgaagtctccgtggtatcatcaactggtaggtcagatgaggtgaaatttgctgtcccgcttctggatttagacctcaaaatgatggtgcctggatgtccttggaaacttccccaaaagatccatctgcaggccatatttccggttagcagtagttacctctctgttccttctgcaccaggactgaaactaacctcaactcctgatttgaagtcatttttctctgtggatggtgttaagctccctgcatgggtagatgggatgtgcatggctgagtatattcccactttagaagaagaccttaaattgcaggtcgtggatgcatcagcttcaatcggttgcaggagacgattcattgaggccctagctcctgctttcgggagaccattggaggctgatccgattttttgcaggaaagccacagttctttccatttcggggattttcacatttctggttcactttgtcatcccccttcaattccccaaacaacaacctatcctgactttgcagagttgtcagcactgtaattcccaaggtatacctatcacgtcatctccaaaaaacagctatccatggagtcctagatgggaagtgacagaaatggcggaacgcatctacgactatctcgccgacgagtgccagaatttcaagaagttatgcagtgatggtttccctcaagcaaagtagccaaggaggaagcatctctacccttttggcttgcacgctctgcccgtaaactgtagtcctcgactatttgtgtgacgagcgaggagcaaggaagcagcctgaccaggcagtagaatcagtccatagggcaagagagtgcttctatttggcaagtaaattgtgtacaatagcgttgttggtttgttgatgccacccctgctggtcatggtggttttgggggagaaatggcaattcagttcttcctgtcttgggagttgtgtacatatggatattggtcgttgaattctctccagtgtaaagtttgctgcatgtgacagtcggagtatgaactgtttcgttcttgagcatctgcgacaactcgggcgcgaactcgaagtaaatcagctgctttttttttatcaagtacttgtctgcataaaa

SEQ ID NO: 4315 - DNA, 595 bp, Triticum aestivum
  Clone ID: PAT_TA_4315
gcacgaggcgcgactcttcccatcgctggacctccaccagagctacctacccacgccggccgccccgccgactatactccggctgccgccgccgtcgccaccacgctcctacccggacgccgctccgagcgcctcccctccaaacgcgccgtattaacccctgctcttacaaccgaggcctacagctgccgccgtgcccgtaccttagcggcgtcaccgccgacgcctcaaccccccctccctcccccccaccccacatccacccatccacacgaagcaccacggcctctaaggcgcgttgcctagccacctccgccgttcccgttcttcctcgtcggggcatcgcgttcccgctgcccccaccccgtccgcagtgctcacccatttcgtcttgagatcggcagatggctattagctccaatggccattgtcaagctaatggtgcaaaagttctgcctggaaggggcaacaagagtcacgtgaaattacaggttaacaaagatgcagctcccagcgcctgtcggagggatagttcatacatcgactgactgcaaacttacctcagctgccactgaggtgctctaatatacgattt

SEQ ID NO: 4316 - DNA, 973 bp, Triticum aestivum
  unsure (1)..(973): unsure at all n locations
  Clone ID: PAT_TA_4316
ccgtcccctccccccccccctccccacggatcgctcctctcccgccgccacacccccacctcacccccgctggcagaggacagccgagccgccgcctcctggatccaccgcgcgttaggactaatatctgggactagcggatccatcggtccagcatggagccctcagcacagggagcgccttccacttccgcgtcgcttgaccatagccaatccctctatcggcctgaagattcagaactctctccctctgtcccagcactaaaccaccccccgtctaatcttgccccaatcccgccgtattttacccagtgcctcccggtgcctggttacacaggaataccacgaggaaggccaagaactagcaatacttccaccggtctcaacttctggcaggcctgctcttcagacttcctctgcagagttggatggcactaagcttgtctcccagtgtaataagttcctctcaagaaacctcggaaatctcagggcagatggcaccttttcgtgtttttcagaatggagcttcactatttcaaggtctcgtagatcgtgctcggaaaactgtacgtggttcagcagatgatatcggatggcttcagcgcactcaaggcttacctgcagctgaggatgggacgaccagatttttggagatccttgactccgtgagaaaaaatgagcacaagctacctgatgcggtggtgtatttgttagttccaggtttatttagtaaccatgggccactttactttgtgaagacaaaagcatacttctccaaaatgggtctggtttgtcacattgccaagattcacagtgagtaagtaaaaacgaagtcgacgcggccgcgaaaggaatacattgaagaaatatactggggatcaaggaaacgtgtgctacttctcggtcacagcaagggtggtgtagatgcggcagcagctctgtcactctactngccncaactnnaaaaacaaggt

SEQ ID NO: 4317 - DNA, 641 bp, Triticum aestivum
  unsure (1)..(641): unsure at all n locations
  Clone ID: PAT_TA_4317
ccgagctcagagtggaggcacgggggtggagatggcgtccagctcatcgtgtcctcctccgtcgccgcggctctcccacctcctccccgtcctcgtcgccgcggtcgtcctgctcggccgcggcggcgaggccaggcagccggcgccgctccacggcgtcgtgcggtccatggccttcgacgagggctacacccagctcttcggcagcggcaacctcgcgctccgccgcgagggcaagcgcgtccacctcgccctcgacgagtccaccggctccgggttcgcctcccaggacctgttcctccacggcttcttcagcgccgcagtgaagctccctgccgactatgccgccggtgtcgtcgttgcattctacctgtcgaacgccgacgcgtacgagaagaccacgacgagctggacttcgagttcctgggcaacgtgcgcgggcgcgactggcgggtgcagaccaacgtgtacggcaacggcagcaccggcgccggccgggaggagcgctacgacnnnnncttcgaccccacggacgacttccaccactactccatcctctggacccaacaccgcatcatattctacgtggatgnnnnccgatgagggaggtggtgaggacnnannnnatgggcgcggcgttc

SEQ ID NO: 4318 - DNA, 669 bp, Triticum aestivum
  Clone ID: PAT_TA_4318
aaaacatctgtcacatgcatatggaactttggctgaaagagtggctgcaattgcccagaatgaaggcttaggaaagcgacttgctcacggatacccattcttagaagcgcggggtcccggccgtgctcgccccgggtactgcgagtctgcggttgactttgttgcaaggagatgtcggcttgcctttcttgacacagatgctgcagggagggcattaccccggatcattgagatcttagcttcggagcacaagtgggacaaggcaaggcggaaacttgaacagcagaagggtatagaattcttggaaaccttcaagtcatcgaagaatgcacagttcagagatgggaaacataacgggcaatgactgaaaacataactactgtgaataagcgtggggttgtacaattgcgcaaaccagttatgtgattgaacttcaacaaagcaggctccagtacagaaattattcgatgcatgtgtgctggttcctgattatccttttgttttccctgtctacactgtggttacgtgccagatttgtagtgaaataagatcatcaccatgtcatagttggatatatatgagccgaggagctgggctaaataaggtggattggggtctctggaaagccggggtggaaaccatgtttaatcatcttatttctttgccttt

SEQ ID NO: 4319 - DNA, 496 bp, Triticum aestivum
  Clone ID: PAT_TA_4319
aggaggctgcaggcgccgagccaaaaagccactgccgagagagagagagatgtagtagagggcgtccgagacgtcccacgccacgccgctcccgtccaaaccccactcccgccccgcgccgcgcgatccgaagccccattatctaattcctcgccggatcgggccggcagatctcgccattgcccatttgccccgctccgccctcgtcctctgctcctcccgctgccagtgccggcggcggttgtgcggtactgttcggttcgtcgccggggaggctcgccaggggccggagggatgtggcggctgaagatcgcggagggcggggccgacccgtggctgcgcaccaagaacgcgcacgtcggccgccaggtctgggagttcgacgccgccgccgacgaccccgacgccctcgccgtcgtcgacgccgcgcgccgggagttcggcgtccgcctccaccagctgaagcacagcgccgacctgcccatgcgcatccagc

SEQ ID NO: 4320 - DNA, 862 bp, Triticum aestivum
  Clone ID: PAT_TA_4320
ccccagggccgccgcccccgctcctatcgctgcccctccaccgccaagcatgccgctgagcgtttccgccgaacccgaaagagcatgttggagtgccgtcttctgctctctgcaggcctgcatctctgagcccattagatttattcattacgggactctcgatgttgttcgacggcttttttttgagtagaggtgtgagggaaagggaaagggcaaggggaacgggaacgggagaagaaactgccggtgctgctgatgagcaaacgggagacaatgactctcctgccgccgtcgtcgatgtcggcccgcaccttgctgactgcggcctcgtccgcgctcgccccgctggctgtggccgtggcgtcgacgtggtctccgtggccgtctggcctgcgatccgggcctgcgtgggggtctaccgtgagctcgctcctcccagtcgctgtagcggcgctgacggcgacagcactgcgctcccggtggcctacagcttatctccggacttggtggtgctgtgtgctgtgcgtccccgggctcccgtcgtgggcgcctgccttcctttcttccggccttcccctgccgttccgatatacttagagcccctcttgataatcaaggtgaaccttaacgtttttactaattttgaccatgttaatgacggtcatgccatctccttccaaggtgatcttaccttctaccatgaccagtttgaaaaggcaatctgcaatgctgaccatggtacagttgaagtgcagattgggtaccgttaattgcccagcagggggatgctatccgttgtaaactaaccttttatatgtatgatattgctgtatggatcagctggatttaaaaaaaaaaaaaa

SEQ ID NO: 4321 - DNA, 395 bp, Triticum aestivum
  Clone ID: PAT_TA_4321
cctcccgcgtctcctctctcaccgcgggcgcctaggtccgagcggtctcccccgcctccttcctcgccgtgacacgccagcagcaggaacgccgcagccgacggccggcgacgggggcgcggccgcaaagggctcgtcgggggtcaggaggtgttcgcgggctcggcgacggcctgtcgtcatcgttgcatgatccagatattttcgaggatggcggcgagaagccctcgccgagccacctccgcatcgcatccgagtagctcgaagcatcgtccgggacagttcccttgttgtagcccagcttaccgaggtattactgctattagcaccagcaatcccatgagggcgggtgatggaaactcggaaggccaggatgcgccactcgccgaggggaa

SEQ ID NO: 4322 - DNA, 372 bp, Triticum aestivum
  Clone ID: PAT_TA_4322
gggtccttccagacagaatggagggtaaattgcttctgcacaaggactgcccctcatcattttgctcaactgtggatcgcaaggctgtagcaagctgccgatagaagttgtggattcataccccttattttgtctttataaaaatgaattttgtggatccaatagtgagctgccctatcttaaagagttgcagctcctactgcatgtaaagttttcagtgttggtttggaccatcagatagacttgctggagttgtttctcagatgctaccatgcaacctcaggaaatatataacattcctactgttcccaaaaaaaaaaaaaacaaaaaaaaaaaaaaaaaaaaaaaaagtaaaacaaaggaaaaaaacga

SEQ ID NO: 4323 - DNA, 988 bp, Triticum aestivum
  Clone ID: PAT_TA_4323
tcggcacgaggcaccaccccaccccaccgtcccgcgcccaccaccagtccaccgccgcacggccgagcttgcgtaggatccgggcgagaaaagctccgtccggtcgaagcccccaaggaaggacacaaagcccacccgccaccccgctccaccaccaaagcgtcgcatgcctcgctccctcgccggcgacctcaccgacccggagatggcgcagccctacatgaagaaggacgacgacgactccgacatcgagtactcgccatttttcgggattgagaagggggctgttctgcaggaggcacgtgctttccatgacccccagcttgatgccagacgatgctcgcaagttatcaccaagctattatatttaattaatcaaggagagtcatttacaaaggttgaggccacagaagttttctttgcagttacgaagctattccagtccaatgatgctggtctcaggaggctggtgtatttgatgatcaaagagctttctccatcatcagacgaggttttcatagtcacaagctcattgatgaaagatatgaacagtaagacagatatgtaccgtgccaatgcaattagagttctctgtagaataattgacggcaacctccttactcaaatcgagagatacttgaagcaagctattgtagacaaaaatcctgtggttgctagtgctgctcttgttagtggtatccacctgcttcaggcaaatccagaaattgtgaaaagatggagcaacgaagtgcaggaagctgtgcaatcaagagctgcacttgtgcaatttcatggccttgctcttcttcatcagaccagacagaatgatcgtttggctgttagcaagctcgtctctagtttgactagggggtcagtgcgctcaccccttgcacaatgtcttctgattcgttacacgagccaggtaatacgtgagtcaagcaacacccaaagtggtgatcgcccattttttgattatctggaatcctgt

SEQ ID NO: 4324 - DNA, 594 bp, Triticum aestivum
  Clone ID: PAT_TA_4324
cccttccccctccaccccggagcgaaaaatcctccacgcgcagccctcaattcgctcttctccgattgccccgacgtcgactttctctgtcggctgacccgtaccacgtgccgccgtcgtgccggagctccgccccgaagctagctgctaccagtcgcctccagcaagctccagttcaacccgcctgccgcctccacgccctcctcctctggcgccctccgtctgtggcacgccccgcctcgcccccgagctccgctccgtcctcgacaactgcaaggcctccgcctccgagttctgctcgaccctcatctccttcgactgaaagagatcgagccccgccgcacctgcaccgtctgcgacattgaccgcggcttcgccgagacgcggctgttcgtcgttgtcgtcttagacagcacagcgagatggagaaggaaagcttggctcccagtttgtatacaggccaaacattcatggatggttttgctgagatccgggatatcccctcagaatatcgttggaaagaaaacaagaaggagatgaaggcggatgaataccatggattaagttaccatgaagtgttgggcaaattcttgt

SEQ ID NO: 4325 - DNA, 617 bp, Triticum aestivum
  Clone ID: PAT_TA_4325
gattccaacgctgccgccgcgccgtagctcagcctcgccgccgaccaccccaacccctcaccacccacgcgcgtcggccggccggccaccgccgcccctgttcttcctcgccgggtccccgccgtttccactccgtccggcaatcattggccattgagggtttgatgctattcctgtcctattatcaatttctcatttggggaagatcgtgcgagatagaagagagggcggactggattgtaatctgagctctggtggatctagactggaagttgcatgagaaaaagttcagaaatttccatgaaagcttcgtcgtcgatggcaagcgacgcttcagggaacactgaccctggccaacagggtgctcgtttcagttccatggaccagtcttgctttgcaagacctggccagtcaatccctggctaccccccattctttggccctcagtcttccaacttttaccttcctgatgacagtgtggctaaagcgtgtgatccgttcgagccgaatcctcctcagaacaatcctgtggcagattgggaccctcaggccatgctgagcaacctaaccttccttgagcagaagatcaagcaggtgaaagatatcgtgcagtccat

SEQ ID NO: 4326 - DNA, 667 bp, Triticum aestivum
  Clone ID: PAT_TA_4326
agatataactgtggtggttggggaacaatcttttcatctccacaagtttcctctattatcgaagagtggccttctggaacgtctcatcagagagaaaattgagaagggagaagatagctgtgccattgatctatctgatattcctgggggagcaaaggcttttgaactagctgctaagttctgctatggtgtgaagtttgaattgacttcctccaatgttgtgcaccttcgctgcgcttctgagtatcttgagatggctgaagagatcgccgagggaaatttgattgcgcagacagagaacttccttacccagacagttctcaaaagctggaaagattcaatcaaggcacttcatacttgcgatgacgtcattgatcttgctgaaaaattgcaagttgtgaagaagtgcggagactcagttgcaactaaatcaagcactgatcccgatgtatttggctggcctgtcgcccagtatggtggtcccacacagagtcctggagggagcttcttgtggaatggtattagcactggagcaaggccaagaaattgcagttcaaattggtggtatgatgatgtgtcatgcttaagccttccattatacaaaaaggtaatctcagctatggaataccgaggcgtcaatcaggacattattgttggatcccttaac

SEQ ID NO: 4327 - DNA, 607 bp, Triticum aestivum
  unsure (1)..(607): unsure at all n locations
  Clone ID: PAT_TA_4327
cctntggtnttttttttttttgcctttttttttttggatcgttcaaagttgaggcgccatatattcattagaagtggaggcatgaggagggacactggtcgtacagaactaaggaacacatgacggttttattttatttagcgcgcgcgcgagcgcatgcggcggctagtggtactgatacgctgggtggtggtggtggtgatgatgattgcttgcttctcctcctcatcctcgtgctcgcctctgccggccggcctcctgtgcgccggctcagttgcagctgcagcaggagcagccgcacgcggtgccgcacttgcaggtggtgcagtcgcagccgccggtctccccgccggccatctcgaacccgccggagctccccttgtgggaggcggtgggcatgaccatggcggccgcgccggcggtggcctccacgtcggggaacatcttgcacccgccgcagccgttgccgcacttgcagccggcgccgcacccgcagttgccgccgcagcaagacatcctccttggctgtgggtggtggcgagggaaggaagctaaggactgagaggatgctgtgaggagtgaggaggctggtgtgcttggtgagttc

SEQ ID NO: 4328 - DNA, 717 bp, Triticum aestivum
  unsure (1)..(717): unsure at all n locations
  Clone ID: PAT_TA_4328
agatttttcaaagttgaggcgccatatatttcattagaagtggaggcatgaggagggacacactggtcgaacactacgcgcgaggcgtacgggtacaacggaattaaggtggaacacgagcgacggtggttttattttatttagcgcgcgcgcgggcgcatgctgcatgcagcggctggtgatcaaactgatacgctgggtgacgatggtgcttgcttgcttgtcctcctcctcatcctcgtgctcgcctctgccggcctcctgggcgccggctcagttgcagctgcagcaggagcagccgcacgcggtgccgcacttgcaggtggtgcagtcgcagccgccggtctccccggccgtctcgaacccgccggagctccccttgtgggaggcggtgggcatgaccatggcggcggcgccggcggtggcctcaacgtcggggaacatcttgcacccgccgcagccgttgccgcactggcagccggcgccgcacccgcacttgccgccgcagcaagacatcctccttggcctgtgggtggtggaaaagaaactaagaaccgagaggaggatgctgtgaggagtgaggaggctggtcgaacactacgcgcgaggcgtacgggtacaacggaattaaggtggaacacgagcgacggtggttttattttatttagcgcgcgcgcgggcgcatgctgcatgcagcggctggtgatcaaactgtcn

SEQ ID NO: 4329 - DNA, 707 bp, Triticum aestivum
  Clone ID: PAT_TA_4329
taggggccttttttttttttttttttgatctcgttaattaattattagcacatgcaaacgtttggaggagcagagacatcaacgtagaggaggcgccatgtattagagttggaggcatgagcaaggacactgctggtggaaaacacgggcgtacaggtacagagttaaggaacacacgacggttttattttattcagcgcgcgcgcgggcgggcgcatgcagcggctagtgatggtggtggtggtggtggtggttgcttgtccagttgtcctcctcatcctcgtgctcgcctcgccggccggcctcctgggcgccggctcagttgcagctgcagcaggagcagccgcaggccgtgccgcacttgcaggtggtgcagtcgcagccgccggtctccccgccggccgtctcgaacccgccggagctccccttgtgggaggcggtgggcatgaccatggcggcggcgccggcggtggcctcaacgtcggggaacatcttgcacccgccgcagccgttgccgcacttgcagccggcgccgcatccgcagttgccgccgcagcaagacatcctcctttccttggtgggtggtggcgaggggaggaaggtgaggactgagaggatgctgcgactgtgaggagtgaggaggctggtgtgcttggggtgtagcttggtagtttccaccgcctgtccagggtcccggaccggccggc

SEQ ID NO: 4330 - DNA, 975 bp, Triticum aestivum
  Clone ID: PAT_TA_4330
cagacgagtcacgacacgtcatatttagtagcggaggtgcggtcaaggttagctggtcttttattttttttttttttttttttttttttttttcattcaaagttgaggcgccatatattcattagaagtggaggcacgaggaaggacagtactggtcgaacacacgcgacaggggcatacagaactacggaacacgaacggtggttttattttattcagcgcgcgcgcccgcgagcgcatgcggcggctggtgatgatacgctgggtggtggtgaactggtggtgatggtgcttgcttgcttgtcctcctcatcctcgtgctcgcctctgccggccggcctcctgggcgccggctcagttgcagctgcagcaggagcagccgcacgcggtgccgcacttgcaggtggtgcagtcgcagccgccggtctccccggccgtctcgaacccgccggagctccccttgtgggaggcggtgggcatgaccatggcggcggcgccggcggtggcctccacgtcggggaacatcttgcacccgccgcagccgttgccgcacttgcagccggcgccgcacccgcagttgccgccgcagcaagacatcctcctttccttggtgggtggcggcgagggaaggaagctaaggactgagaggatgctgtgaggactgaggaggctggtgtgcttgctggttggttcccgcccggcggggctcacttctttttcgttttcttttttttttatggaaaatgagatcccacgctggggcgtgactaactgcgctcaactaatgatttaccattgatccgcgacatccatctattgctgaagaggaactgatatctccatacattttatttacatcggtacttgggtcttagcttgatgaaatacttccagttgttgtacttaatgaacatgaaatgatctgttcgttcgttggttcaggccttaaaatgatgcagactgttatatgtttag

SEQ ID NO: 4331 - DNA, 902 bp, Triticum aestivum
  Clone ID: PAT_TA_4331
ccacgcgcccgctcgtccccccttcccctcccccttcgccgccgcccgtcccccacgctcccagcgcccccacccgccccccccccagccccaagggcctcgatcgaggagcggcggcggtggacatgggccagatccagtactccgagaagtacttcgacgacaccttcgagtacaggcacgtggtcctcccgccggaagtcgccaagctcctccccaagaaccgcctcctcgccgagaacgagtggcgcgcgctgggcgtgcagcagagccgcgggtgggtgcactacgccgtccaccggccggagccgcacatcatgctgttccgccgcccgctcaactaccagcagcagcaggacgcggctgctgccgccgcggcgcagatgatgcccaagtgatcggccccagcgagggcagtggcgaccgggggttggaactcctgaaaaccccaggcccttttgatctctaaaagggcgatcgcactggtttgtctggtcaggatctagttgtgttggtggtgtccaccatgtgttcgtggaaatgcctgggaggaacttgcagtgtgttagtctgtgttattatcctggatactgttgaatgctacctgttatgtgatgctggtactgttggtagatctccccgtgatgatctgttagtgttaatgcttgctttactgttatctggttccttagattaggtgtatggtgttcatgtgatagtgaatcttatgtttagcaagaggatttggagcactggttatggatgatctatgcaccgtccagactaaaatgcacctcctttgcatgtttggtacatcatcaactgtatcatgttagtctgaagtgacaatttcgctgcgctgttgaatgtccattacagtcgaaaaaaaaaaaaaaaaaaaa

SEQ ID NO: 4332 - DNA, 798 bp, Triticum aestivum
  unsure (1)..(798): unsure at all n locations
  Clone ID: PAT_TA_4332
ctcacggtcagtgatgaccggtccgagtttacatgcgagtgtggacaattcgagcacactggaatgttgtgcagccatgttttgcgggtcatgaacatacttcttctggaggagatcccggtgaagcttattgcgaattgctggaccagggagggacatactccccttggacctggttcaacatcagaaggataattcagtgaaattgtcattcacatgcagacactcaacacttacctgaaagctatgcaggtcgtgcggacgggcaacgcgagtgccgaagcatttgaacacacgatgagcgcaccattggcagcgaagagggatggtttaggtttttaagaccataatgagagactcgaactgggtagattggtttactatgttggtgctgataatggtaaccaagataacagtgatggaatgcccttcaagacctagcgcctcctgataagcaacaagaggtcgacagaccaacaaatggcagcgaaaaggcggcttacgagggtctgagcaagtggagaagattctgtagcatatgtctttgagagggacataagcgcactacctgcctggacagagacgatgctccgaagaaaccagggaagcctggcaaatgcaaaaactgtggcatggaagaaaaccgccggatgacatgcacaatgccgcttggagttgcagaaatatgaaatctactatttaaaatgttggttatcgaggattttctggtgtgttcaagtaagcatttgctccacgcttgttcctcttgggttagagacangacaactgtataacaaa

SEQ ID NO: 4333 - DNA, 633 bp, Triticum aestivum
  Clone ID: PAT_TA_4333
ccccccgctcgcctcctcggccgcaccccggcccttcgtcgggccgctcccgaggctcgggcaagccagcaacgcctacccgtgcctgcctccgatcccagccggccgcccgctccgagcggggccggccggccgctcgggccgccggggcgggagctcccgcgccgccgtcgccgggcccccctccaggcgcccggcgcgcggcccggcatcctcccgccgccgctccccgagccggcccgccgcggcgggccggcgccgggtgccgtcccgcgccagcgcgcgccgcccccccggcgtcgtggtcctcgccccctgcctcccgccgcgcagcgcgccctcgctcgcggcccgcccccggcccggcatctccccgcgccggcgccgccagcccgaccctgtcctgccgctgcaccctggtggctcttcctccctgttcctgacctggatgccatccgccgctgcgcggtcgcccgcggccaagccgcgggaggagacgtccgcatgcgtcgcgtgcctttttttagctgctgcttgtttcttttcctgcctgctcccccgtctcctggtacgtcgtcgtccgtgtgcgtgtgtgtctttgtgaggccctcatttagcttccggtatactcca

SEQ ID NO: 4334 - DNA, 598 bp, Triticum aestivum
  unsure (1)..(598): unsure at all n locations
  Clone ID: PAT_TA_4334
gcacacactgcacgcatagcagtttccctttcagatttttcttcgattagccaccatgactgccttggccaagcccgccgcctcagcgccgaagccctccgctgccaagccgaaggcggccgccgctggcgcctcccacccgacctacttcgagatgatcaaggaggcgatcgcggcgctcaaggacaggaccgggtcgagctcggtcgccatcgccaagtacatcgaggagaagcacggcaaggccctcccggccaacttcaagaagatgctctccgtccagctccgcgcgtccgcctccaagggcaagctcgtcaaggtcaaggcctcctacaagctctcagacgccgccaagaaggacgcgcccaagcccaaggccaagcccgccgcccccaaggccgcggcgaagcccgccaaggacgccgccaagcccaagaagaaagcggccgtgaagcccaagaaggccgccgccgccgctggcacgaagcgcaaggcgcccgagaagaagacgctggtcgccaaggccaagaagtcgcctgcggccaaggccaaggcaaagccgaagaccgtccgctccccggccgncaagnnnnnccgc

SEQ ID NO: 4335 - DNA, 714 bp, Triticum aestivum
  Clone ID: PAT_TA_4335
ccatgggtttagtgcttcttggcaattaacatggactgaaatccaattttccattttgtagtgggctggccaggttcctaatgcaggcctgtgtcctccgtctgcacaagccgcgcatctctctgcctagcttcctcaccagttagtcgttcgatatatatagtcacaaattaactagttagagtatcttcagttagatgtagcaaaggttttggtgcaccttgtgctcttaaggaagagcgcggggttaaatagttaagggaagtgtttgagtcgctgctgatttttcatatgcagcttatgtctcccagaaaaaaaaactttttcatggggtgttgctccataagctcatggagttgcacaatgagtttagttagtcaaggatatttttaaacacatacattggggtgtccttatatttctctattaatttggtcgttgactatagttcccatcctcgtccccaacaccatgcatgctttgcatccatatatgcatcctcttcaccaactaaggcagccatggcgaggcccaagctcggatgaacacttacatacctgagacagtgacaatattatatttactatcaattcgccgcggatcttattatgtaatggctattatgaaatgcacatgcatatagcctccatttgagaagctaatgtgcgtacaaatgcatatctttgggacttgcaacacattggcactctttga

SEQ ID NO: 4336 - DNA, 660 bp, Triticum aestivum
  unsure (1)..(660): unsure at all n locations
  Clone ID: PAT_TA_4336
ctctgctgcggctcgcacgcgtcccatctcctccactcgttcggcatccacatcggccatggaacatttttggatgtgttgcataactcgtatgtgaaatgtggccttgctatggtggcattgtttgggcctggtagagatatactttttgatggtctaagagcgttcaagcaaggctcccccaacatgaattctcttgtaggatttgggtctgcagctgcatttgctattagtgcagtttccttgctgaaccctgaattggcatggaattcaacgttcttcgatgaaccgcatgcaggtcatgcttcttggatttgtacttctgggacgatctcttgaggaaagtgctaggcttaaggcatctagcgatatgaatgagctcatttcactcttatctcctcagtcgaggctagtcattacatcctcaagtgacgaccttccttcagatggcattttgaattcagatgcaataacagttgaaagttcctgttgatgatgtccgtgttggagaccagtataagtcctccaggagaaacatcctgtaatggaattcactggaggtnaagtttgtggataacaatgctacggaaatctnccggtacaaaanaaaggngccgtatttcggaacgtaatggatgccttaggttaagcaaacacggc

SEQ ID NO: 4337 - DNA, 904 bp, Triticum aestivum
  Clone ID: PAT_TA_4337
caacaagttattcagcagaaatcagccatggccgccatcgcaggccgcgcgtacgaggacttcgtgccgccgcacaacatggtcaccgagccggcgacccacaccctctccgtcgatctcaccgccgcagggtacaagaaggagcacatcagggtgcagctggtccgcagccacgggctagtggtcgtgcgcggcgagcgcgccgtcgcgggcaaccgctggagccgcttccgcctcgagttccgcgtgcccgacggctgcgacctcaagggcatccacgcgaggttcgagggcggcgtcgtgcgggtcaccatgcccgggctaaggaccgcggtcggcgacgtctctggtaagcaggtgcccccggcggccaaggctgatgcttccggcgttggagcaggagacaaggaagacgagaacgtgcagaaacacccggcggaggagcgcggggccgacgcggtcaaagatagtgcccgcctcgatcaaggacaagatagtggccgccttgatcaaggacaaggtacccctgccgacggcgtccggggagtggagtcgccggcgacgtcgtcaggccgcggatacagctacctccctgaacggagaaagcttgtgaccaccgtggttggcgcggtgctcgtcctgtttagccttggtatctacgtcaggtacagcttcggcccatgagctgaggcaagaagcgttgactactcgacgtcagatgagcgatgagcctaaacgatttggcgccaaaacgttgtgcaagtgcgatagtgctaagcgatgctcgggttgactcaattgtatcctaaacctaaactacagctgcttaagattcatgatgaatcatgacggcttccttaatctggtaccaacatgtactcacctctctctatataagcactct

SEQ ID NO: 4338 - DNA, 969 bp, Triticum aestivum
  Clone ID: PAT_TA_4338
gcggggagctggcctgccgccgcgcgccgccggagaggcgatccggcgaccggaggagagggtgccgccatggcgcggaagcacggctggcagctcccggcccacaccctgcagattgttgcaattactgtattcttccttctggtggttgcattttatgccttctttgcaccatttctgggaacacaagtccttgagtatgttgcgataggcatttatactcccatggcgttggctgtcttcatcctttacatccggtgcacaagtattaatcctgctgatcatggtatcatggcaaggtttgaggatggttttgtcgatgtacctgctaacagcgatggattggaaggcataaacttgccccagaaagcaaacagcgctattggaacacactccccaacatctacttgcagaagctctctagatggccattctaatcacagaggtacatctataggggaagcaaacgtaaatgtgagctcacaactgccgaagaaaagatcaagttgtttcctctttggtgggctcgtgtgtgctttatttgttatggaggactgccggaagcctgatgattcagagcaacaagctaatggcgaagaggctctgttttgcacattatgcaatgctgaggttcgcaaattcagtaaacactgcagaagctgtgacaagtgcgtggatggatttgatcatcattgtcggtggctgaataattgtgttgggcggaagaactacttcacgtttattgctctgatggcaatcagtctcctatggcttgcaattgaatttggagtgggcattgctgttcttgttctctgctttgtcgataagaattcaccaagaattctccaagaaaagcttgggaatggcttgactcgcgctccatttgctgtgattgtaggtgtattcacacttctgtcattagtggcctgcgtacctttggagaactttttttcttcacatgatattgat

SEQ ID NO: 4339 - DNA, 780 bp, Triticum aestivum
  unsure (1)..(780): unsure at all n locations
  Clone ID: PAT_TA_4339
tctccaccgccacaccccngggtttgaagcccacacacgcaacctctctcccatgtaaccggccggcatgagggtcgcagcgggagagcacgcagcccaccccaacagcagcggggagctggcctgccgcgcgccgccggggaggcgacccggcgatcggaggagaggggccatggcgcggaagcacggctggcagctcccggcccacaccctgcaggcggcttccggcggaggagtcttgtggtgttcgtggaggctgcgaggaggtagcgatggggatcggctaccgagcgagggcaagggcgccgatctcccatctcctgttagtattcactggcgcggccaccatcgactggatcttcaccccttcagaagatgtgccatgagttgatgggcagctagccagccgttgcaagagcattcagagatatgagctgctactcatacacagctcctacaaacctacagagccattgttctcctacctgggagcggataggaaggatttgggtgccggcaacatggggctgagaagaaaggaggatgtttgaggacaactagtgagcgtactacaaccgcagctgattcgtgtgtgttgtttgttcgatccaacccttccgtctgcagggcctggtgaagggaatgaagatgcacaccctcggccatgactttgtactctagctatactcttataaatgccacggatgggagggaagacaaggggggcacaggaaacactcgttgaaacatgggtgaagttgttattgtttctgaccttat

SEQ ID NO: 4340 - DNA, 966 bp, Triticum aestivum
  unsure (1)..(966): unsure at all n locations
  Clone ID: PAT_TA_4340
gcaaggnattgacagactgagnagctctttcttgattctatgggtggtggtgcatggccgttcttagttggtggagcgatttgtctggttaattccgttaacgaacgagacctcagcctgctaactagctatgcggagccatccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgcaattagaagggctgtgccagacgaaaatgaccatctgaatgacctccttcaggaagaggaagatttagtgagtgctcacagaaagcaggtggaagagaccctggacatgattaaagaggagatgaacttgctagttgaagcagatcagcctggcaaccaactagacgactacgttacaagactaagcggcatcctctcacagaaagctgctggaattgtggatttacaagatcgtctggcacagttccagaggcgcttaaacgagaatagcgtgctgctatattccgagtgcccttgatcacaagagcggcctattcgtccgctactccgtctccgagggtaatgaggaagttggggacagaggcagcagagtcgatctgcccccatgagctctgcaccgatgcggtctcgcctttgcgaacgccggtgcgccgatgcagttctgaacccatagatgcggcaaatgcagaactaggtggctagttgactgctgcttgccgtggccgactccgtagcatatttgtacctgagtcgttccatggtgtgcgtgtgcctcgtacttccattcaatccatgtgtatgtatatccgcgtcacatgagtaccctgctattgttcaccagcaaaatt

SEQ ID NO: 4341 - DNA, 788 bp, Triticum aestivum
  Clone ID: PAT_TA_4341
cgattgcggcgccggaacatgcaaagatttcaggtataccgcatatggaataagatctttggcagatgagcagagtcagctcatgacagaagccatgaatacctccgtggagaacccatggcgcctgccgccatcgtctcaaacgaccacattcccgctctcaagctacgctcctcagcttggagcaactagtgacctgggtcagaacaacaacagcagcagcagcaacagtgccgtcaagtccgaacggcagcagcagcagcagcccctctccttcccggggtgcggcgacttcggcggcggcggcgccatggactccgcgaagcaggagaaccagacgctgcggccgttcttcgacgagtggcccaagacgagggactcgtggtcggacctgaccgacgacaactccagcctcgcctccttctcggccacccagctgtcgatctcgatacccatgacgtcctccgacttctcggccgccagctcccagtcgcccaacggtatgctgttcgccggcgaaatgtactaggccggcagcgtcagttccgtcgtcgtcgtccctgttctccataagatgacagacactacactgggctgaagaacgccgccccggtctctgcagccgcaggtgacttaaactgaatggtgtgtggattgatctgctggcgtggtgtgggttccttcttctggcccctcgcgcccgtccacggtgcgtgcagcagtagcactagctgcacctcgaccctatatatgattctgtaatttaccagtatttgtcgtgtcggatt

SEQ ID NO: 4342 - DNA, 948 bp, Triticum aestivum
  Clone ID: PAT_TA_4342
cacgcgccgccgccgccgccgaccaaaaccctagccacggagaccccacccatggcggccttcaccaccaccgccgccgccgcccccgccgcctacgccgtcgcccgctcgcccgcaccgagcccctcgcagtgggcaccaacccgccgctcaccgccggccgtcgggctccggcgagcggccgcgccgcctcgccggggagccgcgctcctggtcaaagctaagaaggaaacattttctaccttcgacgagttattggagaagtctgaaaagcctttactggtcgacttctatgcaacttggtgtggtccgtgccaatacatggttcccatacttcaagaagtgcatgagaagatgagtgacaagattaacattgtgaaaattgatacagagaaatatacaagcattgcaaataagtataaaattgaagcattaccaactttcattatcttcaaggacggggaaccttgttatcgctttgagggagcgttgcctgctgaccagctaatcctgcagattgagagtgctttagaagctccaaagtagcatgtgcatgtattgccagcaaggaatttcgccccctgaaatagcatgtgtgaagaatgtcctccttatgggttgacctgccaactatgtgagacggtctgaaatctcggtgtacaaagatatggaagcacacacactttgatgcatctttgaagtatgttgcttctgtggaaattcttccagcgaccaagatctggtctcggacccaccccttgccccactcgcccagccacggtatctccataccccaaggcgaaatgtttagtgccgaagtttccgtccaggcatcggtggcttgccgcccttatgttccttgtctcccccgcgttggccggctttataatttatcatcgcctgttggcttggcccaaaaaaaaaaaaaaaaaaaaaaaaaaaaaaaaa

SEQ ID NO: 4343 - DNA, 720 bp, Triticum aestivum
  Clone ID: PAT_TA_4343
agctcgcaataccatttgtgggcagcatcgccgggtagaggaagaagagaagcggagcagcagcaacactgatcagaggaagctgcagcacagagccaacaaggaaaagcaaagtcttccatagcaacgatttagatctcaccatccctctatggaagccttccttgtcagcttaagaaatcatccgtcgtcctagtctgggtcttctccttcctcgcgcgcgcccctgcctgggcaccccgccgtgccgctgctgctggtgcgtcgcccttctggtatcacaccaagggacctggagtgcatgctatgtgatgaaacggcagagcccaagccgctgccactgtcgctcctggaagaaatcacaggtgatttctctcctcagcagcaaattggctagaggtgggttcgcggtggtttatgagggtatgcttgagaacaggtccgtggccgtgaagaggatgtccaatacgtatgtgtacgagaaggagttcctgcgagaagttgaatgcctcatgatggtcaagcacaaaaatgtagtgcggtttctgggatattgtgctgacacacaagggagtatggagaagtacgatggaaaattcgtcatggcagatgtacaacaaaggttgctctgcttcgagtatcttcctaaagggagtctgcatgagtatatcactgatacatctagcggacttccgtggagagacagatatcgtattattg

SEQ ID NO: 4344 - DNA, 1269 bp, Triticum aestivum
  Clone ID: PAT_TA_4344
tctggagcctggaatccaccccacccccactacccctgcccgctgctccggcactggggcggcgacctctctcgatcctgcgccccccggcggccgcggctctccggcggcccgccccgccacgccgccgctccccggcccccggatcgccccggctcccggccgcccccgcccccgcgccggcccagctcccccgatcgctaccgcggccggcggacgccgcggccgcgcccgccgagctccccctcgggccaccgcagagagggtactcccggttcgtgggccgattcacccccttggcccccgagcagctgggatccatcctcgacgtcgagcgcgccaagggcctctcccccgaacacctcgtcgcggcatgggatgactaccacttgggaagaggtcacataggtgtatcaatgtaagcaaatctttaccgtctcttgggacgaaaatcggctacatgcccatattttgttattcctttctggagaggcagtggatttgcagccatgattgtgcaaggcaagctggcacgcatgatctatacagggcttgaagactaaaaagcaagaggaactcaagcaagcccttactatacagtcactcatttcacagagtttgcagaaaccaaggatacagtgcttgtccgaggagacgttgtcttcaccagcaaactaaccgatgcagaggcaaagtgtcttttagagaccgcccactcgttctacctgaacgatgtgcggtacaagctcgtggagcgtttcaacaaggaaacacatgatttcgagttcaaagatgtccttcaggcgcttgaaatgccgtccatgtgagcagagatgtgaagccatcgtgcgacgacaaagcttcccagtgcggttaacctgaaagtactgccgagaatggaactaccgagttcttttctccccccatttttttggcagttgtatcctggaaaaacaaccctgagtcgatatcaccctgactttgctgagtggtcattcatcctagtcgttttgtcgtagccgtagcaaagaagcgaaccaagttcccaggactgctagagatgctctaagaagcagatccgggcaaagctttaataggcattccgcagctattttgctgtcgtttctcttggcctttttggctaaaattttcataataatatggtagaatcagaaacaagctatacttgtttcagatcctgatgacaattggcaaaatgtttgtttaaattatggatggaaaccagctgtgtggtgttttggtattttc

SEQ ID NO: 4345 - DNA, 2706 bp, Triticum aestivum
  Clone ID: PAT_TA_4345
agcaccatggccatcttccagcctcttttgctgagcaaccctccaactccaagtatggtgttgagcaaatgaaacctcaacctcaacagcccaagatggtcaggatgtattcagctgcctcccagcagcccatggactatgcacttaaggaaaccagccccttcctcggtggtggacagattgttggtggtcgggttattggtggtgagaagcatgctagtacttatgacttggtggagagaatgcagtatctgtttgtgcgtgtggtcaaggcacgggacttgcctaacatggacatcactgggagcctggatccttttgtggaagtaagagttggcaactacaggggcataactaagcactttgagaagcagaggaatcctgagtggaatgcggtctttgctttctctagagaacgtatgcaggcctctgtcattgaagtgttggtcaaagacaaagatcttgtcagggatgattttgttggcatggtgcgattcgatctgaatgatgtgccagtacgtgtgccccctgacagtccactggctccagaatggtaccggcttgttcataaggatggggacaagtcaaggggtgagctgatgctggcggtttggattggcacccaagctgacgaggcatttcctgatgcatggcattcagatgctgctacacttgaggatccatctgctgtaacacacatgaagtcgaaagtttaccatgcacccagactgtggtacctgcgagttaatataattgaagcccaagatattctcatacatgataagacccgctatccagatgtttttgtcagagcacaggtggggcatcagcatgggaggacaaaacctgttcaacgcggaaacttcaacccattttggaatgaagaccttatgtttgtggctgctgaacctttcgaggatcaccttattctgtcacttgaagatcgtgtagctcctaacaaggatgagacgcttggccgcataattataccattgacgatgattgataggcgggctgatgaccgcattgtccatgggaagtggtttaatcttgagaagcctgtacttgttgatgtggatcaacctaaagagagagaagttctctagtcggctccatctccgtctctgccttgatggaggatatcatgttctggacgagtctacaaactacagcagtgacctcagaccaacagccaagcaactctggaagccgtcgattggtctgcttgagcttggagtccttggtgcacaggggattgttcctatgaagacacgtgatggaaaaggttcatcagacacctattgtgttgcaaagtatgggtcaaagtgggtgcgaacacgtactatcatgaacaatccaaaccccaagttcaatgaacagtacacttgggaggtctatgatccggcaactgtcctgactattggtgcttttgacaatggccagcttggagagaggcatggggacaagccatccagtggtaaagatgcgaaaatcggcaaggtccgaattcgcctttcaacacttgaaactggccgagtatacacccactcatatccgctcctggttctgcacccatcaggggtgaagaagatgggtgaactgcacctagccatacgattttcctcaacgtcattggtcaacatgctgtacctgtactcccgacctttgctgccgaagatgcactatgcacgcccaataccagtgcttcaggttgacatgctccgccaccaagctgtccagatcgtggctgcccgtctcagccgtatggagccacctctgaggaaggaagttgttgagtacatgtcagattttgactctcacttgtggagcatgaggagaagcaaagcaaacttcttcaggctgatgaatgtcttctcaggcctgtttgccatcagcaagtggttcagtggtgtctgcgcatggaggaaccccattaccaccgtgctggttcacatcctctttataatgctggtgtgctttccagagctcatactcccaacagtgttcctgtacatgttcctgatagggatctggaactaccgttaccggcctcgctaccctccacacatgaacaccaagatctctcatgcagaagctgttcacccagatgaactcgacgaagagtttgacacattccccacaagccggagccaagaggttgtaaggatgaggtatgataggctgaggagtgttgctggaaggatacagactgttgttggcgatatcgcaacccaaggggagagagttcaggcactgcttagttggagggatcctcgggccacggcaatatttgtgctattctgtttcatagccgcgatagtgctgtacgtcacaccgctccaggttctcgcagcattaggagggttctatgccatgaggcacccgaggttcaaggcacaggttgccatcaacgccagtaaacttcttcaggcgactgccagcgaggacggacagtatgctgtgaagaagctaccatctggtggccttatcgttgtaatccctagaatactccatgtctgtcgctgtagctcgactcgccgtgttgttatttgtgactgtttgtcgttcaggacttccagtctgtccatcctattaggtgctggatccagaggaataatgtgctgacagcttatcatgacttgccaggtttgggaagcatcctcgatcgtttataaataccttgttgtgtatggcaaaaaaaaaaaa

SEQ ID NO: 4346 - DNA, 644 bp, Triticum aestivum
  unsure (1)..(644): unsure at all n locations
  Clone ID: PAT_TA_4346
ccgcagcccctggtcacccctctctctctctcaccgcaagaccggaaggagcggagccgccgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctgagaagaaagtgtcaagaactttgcaattgacttcctcatgggaggagtgtncgctgcagtttccaagactgctgcagctcctattgagcgtgttaagctgcttatncagaaccaggatgagatgatcaaggctggcggctctctgaccatacaaggttttgtgactgttttgccgcacatcaggataaggcttgctcatgtggagaagaacactgttaagtatcgtacttccactaggtttgaatttgttaggatacttcaaggattcactttaaaggaaaggaggactggaagggttgggaaccttctt

SEQ ID NO: 4347 - DNA, 652 bp, Triticum aestivum
  Clone ID: PAT_TA_4347
ccacgcgtccgcgcctcccgtctttactctttcctgccatcggaacccaagaccaaaagcctgtagcccctagtcgaccactggcttgtcggttggccgcaagcgggacggtgggggccgagtagctcataccgcggtggtcggtgatccgtattcggttcgcggggggccagtggtacgtgatggccagggtccctgtcccgtcccacgacggcgaggatgccgcggcccgcggcgcccacacagccggcacggtgcgagagcggagcgcggcgggggccgcgggctgccggcagccgggtgcgcggtgagccggcacgccgcccgcatcggccccacgcccctcctcttcacgctgcacggggtcctcgccctgcgccgggctcggtgcgcggtgcgcggttgcgttttcctgggtccggcgctccgcgccggctcgcggcccgcgcccggcgcggtccacccacggccccggggccggccgccggtcgccgccgccgcacgcagcctgctccctgtccgcctgcgcgctgggcccgcccagctctctggtgtccgggtacttcgattcgcgcgttccgttccaaccccccccggcttaagcccccggggggagcaaacctttcgggtttccggtttgccacatggttct

SEQ ID NO: 4348 - DNA, 616 bp, Triticum aestivum
  Clone ID: PAT_TA_4348
accattgatattgccctgtggaagttcgagaccaccaagtactactgcaccgtcattgatgctcctggtcaccgtgacttcatcaagaacatgattactggtacctcccaggctgactgtgctgtgctcatcattgactccaccactggtggttttgaggctggtatctccaaggatggccagacccgtgagcatgccctccttgctttcactcttggagtgaagcagatgatctgctgctgtaacaagatggacgccaccactcccaagtactcaaaggcccgttacgaggaaattgtcaaggaagtctcttcgtacctgaagaaggtcggctacaaccctgacaagttccctttgttcccatctctggggttgagggtgacaacatgattgagagggccaccaacctttgactgtaccaagggcctacccttcttgaaggttttgaccagaaaaacagagccaaaaagcctctaaacaaaccccggggttttccctttgggacgtaaaaaattgggggtttgaactgtccctttggcgcggttgacacgggttaacaatctggagggtgaaccttgggccacggttaaaacaagtaaaccttggaaacccaaat

SEQ ID NO: 4349 - DNA, 1277 bp, Triticum aestivum
  unsure (1)..(1277): unsure at all n locations
  Clone ID: PAT_TA_4349
ccacgcgtccgtgttgcacatgnnnaaagatggcaacattcatgacaaggatactgagagagatgataacatttctcggtcatggaagtctagtcatcctgtgggccgtggccggggtgattcttcttatcacccctcacagatatcacaaaaaccaccttctttgtatgggtatggtagagggaagccagacaatgaaatcacaggtttttcaggttctcgtggaaaatttacccctagttctggtagtacaaatgctggcagtactggatcttcacgtccattccatcttggtcggctggctggcagtcccgggggcccatcgggggttcggtccgaagttagatgtggtaggatgaaactgcttgacatatacagaacaacttcccatgttactgacttcaagatgccttttgatgtttgtgaggaagggtctgcatttatgcaagaagaaatgttggagccttcagcattatttgctccgacgactgacgaagcggtcattttaaaagcaattgacaaaggggaaatcataaacagtggtgtccatctgggttccaaagatgggtctgttgggaaaagtaatcctgatgtggtgccgtcaaaacaacctaaattaggtggtagagatgatcaacctggaagtgcagatgatttgaagggagaaacagctggaagtctcaggggtgttcctggaaatgttgattcgctgcgtacagagacacctagctatgttgttccacaaagatctcgatttattggagaccataggcttggcccaaccgactttccgcagcaaatgcccaatgtctttgatcaagaaagtaaagtagtcgggatgacaggtgttgatgagttgaccagtcctattcaaccttatcctaatccagaaaatctgtctttatactacaaagatccacaaggtcgaattcaaggcccattttctggtgctgacatcattggctggtttgaggctagttatttcggtattgatttactggttcgagttgcaaatgctcctcctgatgcgcctttcttaatgcttggcgatgttatgcctcacctacgagcaaaggcaagggccacctccagggttttgcaccacaaaatccagtgatttgcttatgccggagactccacctacagggaaatttgtcagcttccagtaccttacatagcggatcaacttggggtcggtggttttaacagggcgccccaccctgaattggcgggtcctgttaagggcttcaaaatccttttctggaaacactgaatct

SEQ ID NO: 4350 - DNA, 1288 bp, Triticum aestivum
  unsure (1)..(1288): unsure at all n locations
  Clone ID: PAT_TA_4350
gggggntttntttcattccctaccgcgatattccccctctctagagccaacctgggctgccgccccgccgccggccccgcccgctctagtgcttcccccgccccccggctgccggaacccgggaccggcaatgcccatccccaccaccaccatgtctctgctgccaccaacagcgccaacaataaactagaaccaaaagtcagcgcccccctcctttcctttctccatagccagcaagaaccaactctccccgcgcgagccgaccatggacagggacgccgggtgctactacctcggcggcggaggcggcaacgactgggacctcaacgccgtcgtgcgcttcgcctgccgcggtcgcgtgctcccgccgccgccctcggaggaccccttctcctgcttcttccccccgcccgcgcccgtcgtggaggaccacgggatgcctgacgcggcggcgttgctccctgatcctaccgtcgacgggggctctgctgccggcgacgagctctccatggccgttttcgcgccggccgcggcgctgccgttcttgtcttagacggcggcgcgcccgcagcacacagaagcagacagcggggccaacgcaccaagaaatggtcccgatcgcagcaagacgaggcggtgccgcctccgatgctgctgaccgcgggcgggcaaggccctgtcggcgaagggtcgagatccaagagaaagaagaaggtggtgaagaaggtggtgaagcgggtggcggcggacggcacgtcggcggacccgtgggcgtggcgcaagtacgggcagaagcccatcaaggggtcgccgtacccgcgcgggtactaccggtgcagcaccgacaaggcgtgcgaggcgcggaagatggtggagcgctgccgcgacgaccccaactccttcatcctcacctacaccggcggcgagcacagccaccccgcccccgcccaccgcaactccctggccggcaccactcgcaacaggcagcaggcgccggaacctgctgccggacagagcgctcccgccgccaaagccaaggaagagtcgtcgtcggcggcggcggagccgagcccagcgcagtcgacgtcgggcgggatgtccccgacgacgcccctgcgcacgccctccatggaggagtacaaccaagactcaaaattcgacgaggccgccggcggcgcaagtcaaccggccatggacgtcgagaaagaccgcgaggatgaactgctgaagatattggaggggtgcgtgcacggggggcaactcccgcattgtcgtcgagggaaacgtc

SEQ ID NO: 4351 - DNA, 750 bp, Triticum aestivum
  unsure (1)..(750): unsure at all n locations
  Clone ID: PAT_TA_4351
ctctcgcctccaccagcgcctccacgccgccgaggaacggagcaggaagtgacgccggaggaggacgctctgctcgtcgtccgccgcatctcccgcccccccagccccatcgccccgtgaggcctccgaggccgtggccttcgtcttcctagccctccccctccatgccggcttccaccagcggcggcggggggaggttgctgaacaagtattgattatgcatgaagaatgcctgcaaaacaactattcgtcgattgagaagctaaggaacacgcgtgctcaagcaaatgctgtttcccaaagtagaatgatggtaactgatgaaggcgatgatagctcggatgatagctcggacgatgacgacggcgatgaaccagccagggcagatgatatgtcggtggatgagccaaagccttgcaagcctgcccctgatgctgacgggtggactgttgtgccaccgaagcgcggcggccggggcaagaattaagcacagaagcaaaccttgccaacaaactgccatctgagaggaccgtttgcggccgaaggctttggaagcagtgattagcaagaccttggtcaaccatctgcctgaccgcttgacgccgttgagggcgtggaagcattttgaggcgtttggcacgccagccggtataacctggatcctgtcggggctggcccttggggggcgtgtgttcctcgctcgctcccttcgtgttccgcgcgccgcccccaaancccttattancaaaa

SEQ ID NO: 4352 - DNA, 691 bp, Triticum aestivum
  unsure (1)..(691): unsure at all n locations
  Clone ID: PAT_TA_4352
aaggtcccggcttctctattagattcaggctccaaacggaggacaaggattatcgttagcgtggtgatcgtcctggcggttgtactggccgcatgcggcttcctcctgtggaaatgcagaagaagaatcagagagaaactcggcgtccgtggcgggaaaaagagggcgggagccgcgctgatgctgcgccctgctacgatgaaagccaagcatgacctctcagggccgaagcagcccgatcaggaggtggcggagaacggcgacggctgcgagctgccgatgttcaccctggagaccctggcggcggccaccggcggcttcagcgaggccaacaagctcggggaaggagggttcggcctcgtgtacaagggcagcctccccggcggcgaggaggtggcggtgaagcggctgtccaggagctccgggcaggggtgccaggagttcaagaacgaggtgacactcatctccgagctgcagcaccgcaacctggtgaggatcctgngctgctgcatccatggccacgagaagatgctggtgtacgagtacatgcccaacaagagcctcgacgccttcctcttcnatccggcgaggcgagggctgctggactggaagacgagggctcccatcattcgaaggatcgcgccgggggctgctggaccttcaacgggactcgagcttccccgtggtgccc

SEQ ID NO: 4353 - DNA, 943 bp, Triticum aestivum
  Clone ID: PAT_TA_4353
gccgacccgcccgagatccctacagaacggacccctctcccctcccactccacgccacagatctctccctctccgcccccttcccctagctctgcacgccatggccgaggacgcccccaacgccggcgctgagtgacatccaccccgcgcctaccgaagcctccgccgacgccgctacacctccggcgtcggcagagaagtcctcgtcggagacggctgctcccggtcgctcagcatctggccgccgtcgcagcgcacgcgcgacgccgtagtgcggcgcgtcgtgcagaccctgtccgcgcccagcgtcctctcccagcgctacgggcggccatccctgagccccgagcgcctgagcgggcgccgcaagccagccggtccgatgtgcctcatgggccttcgccgccgcctcgggaggtcccgcctgccgccccccccacctccctggacgcgacgggatcggaggtcctccaggcctactccaaggagggtcagccgccgcctcctcgagctcgccaagtcgcgcgccgctgccgccgccgcaacagagacccccgcggaaccgagcgctgaagagtcggagggttcgtcggtgactgctccgcccccaacggaggagtaaggtgctgaccccgagccttgatccaccgaggagtgctgctattttggcatttcgttggggattatctattgttattactactactttattagagatgcctatgcgatggggaattgatgtttgttcatgaacctggtgccttgctacaaactttaagctattatcagcctatcaaggggtgcatcattgtccttaaggtgtgcatgaatgattcatcaagtcatctgttactggctgcaattaattgcaagcaagactgtaccaatgaatatccatagcaatggtgccaattgtatgcctgttcccttcaaaaaaaaaaaa

SEQ ID NO: 4354 - DNA, 605 bp, Triticum aestivum
  Clone ID: PAT_TA_4354
atcgctcgagccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatgagaagatggaactcatgctgtcccaagtgaagggcaaggacatcaccgagctcttggctgctggtagggagaagtttgctgcggttccatctggtggtggtggtgtggctgtttcagctgctgcccctgctgctggaggtgctgctgcccctgcagctgagtcaaagaaagaagagaaggtcgtggagaaggaagagagtgatgatgacatgggcttcagtctgttcgactaagttgtgggggatcttgtgtctgaagtatctattcttggccagggaactagaggcaatgatggttttaacctttatttagctgacttgggaaacgcttgcaagacaatggtttgaaacgcaattagaccctgggtgctggttgaatttaccggtgaaccataccttggtttcccattttggggctttaccatggttgggtccg

SEQ ID NO: 4355 - DNA, 674 bp, Triticum aestivum
  unsure (1)..(674): unsure at all n locations
  Clone ID: PAT_TA_4355
gattcccgcgggctcgcagatccaggcagcctcccaccgccgaaccaccacccgatgagccaccggcgagttgaggcatgcgactcctggcgcccgccgcccgcgcccgcgcacgcgcctgctctcctcctccgcgcgggtaacccgtggggccgctcctacccgccctgcgccttcgcgtctctctccgtccgtgagggcggggtcaaggcggaggatgtgggagaggagaaggagagaacgctggctcaggcggcagcggaggtctccgggacgaagggcaagatgccgccggtggcgcagctgctgaagcaccccctggcgctgctggcgctggtgcccagcagcgtcgcgctcttcgcggccggcgccggggcgggcgccgtcgccaagacggttaccgcgccgctcgaccgcgtcaagctcctcatgcagacacatagcgtgcggatggcgggtgaaagcacttagggaattgggttcgtgcaggctatggcagagatagggaaggaagagggtataaagggttactggaagggcaatcttncacaggttatccgcataattccatacagcgcagtgcaacttttctcatatgaagtttacaagaaagtattccggagaaaggatggagaacctactggttttgggagacttgcggcttgggcttgtgc

SEQ ID NO: 4356 - DNA, 574 bp, Triticum aestivum
  unsure (1)..(574): unsure at all n locations
  Clone ID: PAT_TA_4356
tccacccctagtgcggcgtccttggcaacccaagccagcagagggaagcagcgccgatccgcctccgccctccctcctacagtgctctaggcccccgatggcaccggcgcatgctcctggaggcggcgatgacgtgaccgtggcagagtgcccaatctgcatggaggagctggtggacaacaacaaccgtggacttgtcacaagattgcccggctgcttgcactccttccacgaaagctgcatcgcacaatggttctgcagggcggccacgtgtccgtgctgccggcgcgacatgccaacgtacagtatgtgcacgtacccgctgccatcttactacccggagagggtcattacgattgcgctgcccattccgcgccgtcctcaacaatgatgagatcgttcccctgtactgcacagcagggcagtatgaacattgctcagaatcaacctatttcaacaatgtattattgtggtgtaattgaacattgctcagaatcaaactatttttcgacattgtaatatgtctctgtgcttttttgaattgaatgaagacacacatttgaaatngaaggaa

SEQ ID NO: 4357 - DNA, 819 bp, Triticum aestivum
  unsure (1)..(819): unsure at all n locations
  Clone ID: PAT_TA_4357
cgccgccgccgcctcctcgtcctctcggtcccctctccttccttcgagtttgcttcagccatgggtaaggagaagactcacatcaacatcgtggtcattggccacgtcgactctggcaagtcgacgaccactggccacctgatctacaagcttggaggcattgacaagcgtgtgatcgagaggttcgagaaggaagccgctgaaatgaacaagaggtctttcaagtacgcctgggtgcttgacaagctcaaggccgagcgtgagagaggtatcaccatcgatattgccctctggaagtttgagacaaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgctgcaacaagatggacgccaccactcccaagtactcgaaggctcgttacgaagaaaatgtnanggggtctcttcgtacctgaagaaggtcgctacacccttgacaaggtcccttctccccatctctgggttcgaggtgacaaccttattgaaagtcaacaaccctgactggtacaaggcccaacccgcttggaggcattgaaccgataacgaacccaaaaggccctaaacaaacccctcgtcttccccttaaggtggttacaaaatgggggatttggacctgtgccttttggcctgttaaaacaggt

SEQ ID NO: 4358 - DNA, 457 bp, Triticum aestivum
  Clone ID: PAT_TA_4358
tcgtgagacttcaggttttgaactttttctccgccatgtttattattccctttatattcgacgagaaggtagacgggaccttcaaactgctcaggcattcaaaaaagatgaccttctcttctttggtcagagcgtagctggcacgaccttgaaaccattccggatgccggtcatcagggtctttcaaacgttgctggtcctgccgtgcttcctttgtatcatttgtcttcccatacacgcccaagaagcttaggaggttcacgcaaatattcttcgtaacgtgcatcacgtcgattgcagagcggacttctaggactttccaatattctagctcccaaaatatagatttcttcttccacatggctgcgtgcccgtcagctcccttcggaactgattgtccgccaggaccctttccaaagatgactttcaaatccttgaccatatcaaatacctcagc

SEQ ID NO: 4359 - DNA, 902 bp, Triticum aestivum
  Clone ID: PAT_TA_4359
tcgaccacgcgtccggctgctggcgcttcaggggggcttatagtcccaaagaaagaaaagaagagagagagagagacacagattaatgaggaaacttggccgtagtaagagtgaaagtgctgaatcgcaaactcaccggcaaccaggtttagttggcctgcttgaaatcttgagagcccaacttgagataacggagtccatggatattaggactagacagggactacttaatgctatggtgggtaaagtcggaaaacggatggacaatctcttgataccactggaactactgtgctctatatctagagctgaattttctgacatgaaggcatatcttcgttggcagaaaagacagctgaacatgctggaggagggcctaataaactatcctgttgttggatttggagagttaggtcgaaaagtcaatgagctaagaaatcttttcagaaagattgaagaatctgagtccctatccccatctgctgcggaggttcaacgtacagaatgcctacgttcactgagagaagttgctacatctttctctgaaaggcctgctcgtggcgatcttaccggggaggtttgtcattgggctgatggttaccatctgaatgccgcctgtatgaaaaaatgctttgcagtgtttttgacaccttaaatgagggaaaaactcccaaaagaagtggaagaaatccttgagcttctaaaggtcaacttgggcttttcctaggaattacagagaccattcttggatcctgctatgccttgggattaattcccgccggtttggttttacaggcgaagcaaggacttcttgaaagtggtgaattgagcatttgaggaaaataaacctttgaagggaacaggtgggcccacaaaaacgcttaaccccttaaaaggtttcg

SEQ ID NO: 4360 - DNA, 1634 bp, Triticum aestivum
  Clone ID: PAT_TA_4360
ccgcggccgcgcgcgcgcgacccgctcccccctcccccatcctctcctcgtagtctccgccggacgccgacgcccgccccctacctgcggcgaaaccccaggcgcggcggcggcggcgggacctgctcagatccgatgggggcgacggagccgcagtgggtgctgatggccacggggcggtcgccgaccaacatcgcggtgatcaagtactgggggaagcgggacgaggcgctcatcctccccgtcaacgacagcatcagcgtcaccctcgaccccgaccacctctccgccaccaccaccgtcgctgccagcccctcattcccatccgaccgcatgtggctcaacggcaaggagatcgcgttgtcgggcgggagattccagagctgcctgagggagatacggaagcgggctcgtgatgtcgaggacgagaaaaaggggatcaagatcaagaaagaggactgggaaaagttgcatgtccacatagcatcctacaacaacttcccaaccgctgccggtttggcctcttcggccgctggccttgcttgtcttgttttcaccctgggaaagctaatgaatgtgaatgaagattacggagaactttcttcaatagcaaggcaggggtctggaagtgcatgccgcagtatatatggtggatttgtgaaatggtgtatgggaaaaaatgacgacggaagtgacagcatggcagtacagcttgctgacgagtcacattgggatgatcttgttataatcatagcagtggtcagttcaaagcagaaggaaaccagtagcaccagtgggatgcgagacactgtcgaaacaagccccctcttgcagtacagggcccagactgtagtgccaagtcggatattgaaaatggaagatgctatcaagaatcgtgattttgaatccttcgccaggttaacttgtgccgatagcaaccagtttcatgctgtatgtttggacacgagtcctcccatcttctacatgaacgacacatcacacaggataattagccttgtggaaaagtggaatcactcagaaggaacaccacaggttgcctacacatttgatgctgggcctaacgctgtcttaatagcacggaaccgcaaaactggcacccttctccttcagaggcttttatacactttccccccacaggagaatgacttggacagctatatgctcggcgataaatcgatcctaagcgatgctggtttgcaatccatagccgatgtcgaggcccttccagcgcctccggagatgaaagctccaaaccaaaaattcaaaggtgatgttagctacttcatctgtagcaggcctggggccggcccaaaagttctcaccgatgagagccatgccttgattgattcagccacagggcttgcgaaaggagtgtaattttggacgacgataggtttcggtaacagtctttggttgagattaatgtagaattgtcacgttgttgtacactcagtactttcgtcattttgatcttgtactgtaccttcgatcttgtactatttccatcattttgtccctgactgttgtagccgcttaaagaacatgtatatttcttcaataaaagttcgtggaatgaattatcatttaaaaagcggcgcggccgccgcttcgtc

SEQ ID NO: 4361 - DNA, 686 bp, Triticum aestivum
  unsure (1)..(686): unsure at all n locations
  Clone ID: PAT_TA_4361
gtcgcctcctcctaaaccactctccctatccccgtgtccagaatctaccccccggctccaatggcagcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggattccccaggaaggaaggaatggaaaggaaggatgttatgacgaanaatgtttcaatctacaaagctcaagcatctgctcttgaagctcatgcagcccccaattgcaaggttttgggtggtgccaacccagcanacaccaatgctctcatcctgaaagaggttgctccatctatccctgagaagaacaataattggtttgacccgcctagaccacaacagggcactcggtcaagatttctgagaagacttggtggcccaagtttctgacgtataaaatgctaattatctgggggaaatcacctcgtcccagtccggtatcctgggtggttaaccctggcccctgtggaagaccc

SEQ ID NO: 4362 - DNA, 580 bp, Triticum aestivum
  unsure (1)..(580): unsure at all n locations
  Clone ID: PAT_TA_4362
cacgagaagccacatgaccctgctctgctcatgtatttcctcgactccggcggcggatcctacccggaggtcgtatcctgcgcacaggtcacgtggttccacagccaggctcggttcctcaatccagacggcaggatccctgagctggtattctggcacataccgagcacggcctacgtcaaagtggctccaaaggccacgagcgaggtcaggaagccctgcgtcggcagtctcaacgaggaagacgtggcgccacaggtggccgaatggggcatcatgtgtagtctaagcctaagctcatgcatgataagatagcgtttgttttctgtttaaaataagtacatgcatgcggtcgatgtgacgcgtccatgcagctagctagtgggacggtgtggcatgtttgcacacgatcccgtttcctttcttttctcccggacgtggtagacgctgtgtgacgcaaccgtgggatggcgcggtaactgcggatcatagcgagtcatccgggagaatagttagcctctgagctttgtaatcgcacgagnataaggnaatgagaaaacagaaagcgccaaaaaaaaaa

SEQ ID NO: 4363 - DNA, 635 bp, Triticum aestivum
  unsure (1)..(635): unsure at all n locations
  Clone ID: PAT_TA_4363
ctcgagctaccaataatacgcccatggccttcgacttcgaccatgagcgcctctgtgccctcaaggcattcgatgaaacaaaggcgggcgtcaaaggcctcgttgatgctggcatcaccgccatcccgtccatcttccaccatcctcccgagtcctttgccccattggcgcctttctccaccgacgttgccatcccggtaatcgacctctcgggccgacgatcggaggtggtcagcacggtgaaggcggctatagagaaattgggcttcttcttggtggtgaaccatggtgtgccggaggtagccatgtcgaacatgctatctgtggtgcggggctttcacgaggagcctgcggaggccaaggagatctactacacgcgggacgaggagagacaagtcaagtacagtggcaatgcggacctgtttcggtcaccggcagccaagtggcgtgacaccatgtacatcaatgacgcggaccggctagcagaagagatcctgccaccggtgtgcaagggcgtcgtgcccgagtacacaaggctcatgcggnaactggggcgcttcctggtcgggatagtgtctgaagcttctggggttgcagcgtggatacctgggaggacgaaaccgggttggcctaga

SEQ ID NO: 4364 - DNA, 798 bp, Triticum aestivum
  Clone ID: PAT_TA_4364
cctccccccgcccccgcccccaccccgtcccccgccgattcgattcgattcaagccgccccgcgcaagatgatgccggggtcagccccgccggccgccgggagcggcatgttcgtgccgacgcagacggcgggcacggtgctctgctgcatctgcggcgtctccatgcagcccaacccggccaacatgtgcgcccgctgcctccgggcgcgcgtcgacatcaccgagggcgtcccgcgcaacgccgccgtcgtctactgccccgactgcttctcctacctccagccgccgcgctcctggctccgcgccggcccggagtcccccgagctcctgcagatcctcctccgccgcctcaagcacccgctcgcccgcctcaaggtctcgctctccggcgccgagttcgtcttctccgagccccactccaagcgcctccgcctcaagctccgcctccgccgcgaggtcctcaacggcatcgtcctcgagcagacccaccccgtcgagttcgtcgtccacgaccgcctctgcgactcctgcgcccgcgcccaggccaaccccgaccagtgggtcgccgtcgtccagctccggcagcacgtcccgcaccgccgcaccttcctctacctcgagcaggtccttatcaagcatgggcaggccgcgctcgccatccgcgtcggctccgcgccccgggggcctcgacttcttcttcggttcgcgcttgcacgcttgccggctgggcgacttctttggaacagtcggtcccattccagaccaacacaggccaaacagttcgtttctcatgaca

SEQ ID NO: 4365 - DNA, 854 bp, Triticum aestivum
  Clone ID: PAT_TA_4365
gagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctttatgacaccaagggtcgcttccgccttcactctgtcagggatgaggatgctaagttcaagctctgcaaggtcaggtctgtccagttcggccagaagggcatcccctacctgaacacctatgatggccgcaccatccgctacccagacccactcatcaaggccaatgacaccatcaagctcgacctggagaccaacaagattgttgacttcatcaagtttgacgtcggcaatgtggtcatggttactggtgggcgcaacactgggcgtggtggtgtgatcaagaacagggagaagcataagggaaccttgagaccatcacggtgaagatgcgccaggcccaccagttggcccccggctgggccacgtggttccccattggaaggggcacccagcccgggggggagccctccccaaggcacggggattagggttcccctctttgaggaccacaggaaccgggaggccctttcccaactttttg

SEQ ID NO: 4366 - DNA, 556 bp, Triticum aestivum
  Clone ID: PAT_TA_4366
aaaaataacatatctgaactttgatctgacactacataatgcagctcatcttgtcttacaaagatgtaaggagaaaacgtaagaaaatatggtggcttataaaccttaaaacatacagagtgatctgattttatcaagccatcgcctcattacttccgacgagcccaacacatacaatacaatagcaagccatcgcctcattacttctgacgagctcaacacatacaatacaataacaagtgttctgaatctacacccccaatgaagtgaatgaaagggaatcgaaccgttgtaacacgccgtgagttcaataaacttggattatgaagatccattttcctgttgaaaaggaatagatatccctcaggccccttatagcttgctgcgattcgcgagttctttcttgagctgatccctcaggacccttctcagcaggttgtttgaagcagttctcgggaactcggggacgattttgacgtagctcaccttgaaaaggggattgaggttcttctgaatggctctctggaacttgctcttcagaagatttgcatcgcct

SEQ ID NO: 4367 - DNA, 806 bp, Triticum aestivum
  Clone ID: PAT_TA_4367
cccccctgcgaacgggtctgcgcttgcgtctgtcgctacgcagggctgcccgtccgggcgtgacggcgccgtgagcgcgcgttacgatctctgagggcttttggtccttccccccttttgttggagaaaatctgatggcttataacccttctaaccttcagtgcttagccgaattttagcaagccatcgccttattacttccaatgcgctcaacacatacaatacaatacacaagtgttatgaatctacacacccccaatgaagtgaatgaaagggaatcgaaccattgcttatgtaacacgccatgagttcaaaaaacttggattatgaagatccattttcatgttgagagagagagagagagagaggattccctcaggccccttatagcttgctgcgattcgcgagctcttgcttcagctgatccctcaggacccttctcagcagcttgtttgaagcagttcttgggaactcggggacgactttaacgtagctcaccctgaaaagggggttgaggttcctctggatggatctctggaacttgctcttcagaatatttgcatcatatgatgtggacctatcttttagcactgccaagatagccagttgttctggtcccccgcccgaaggtttgatgctaacagctgctgtttctagcagaccttcatcggctccattacaaacccgttcgatctccactgaacttgtcttgatccctccatgattcctcctggccgccgctctgcccggcccctgttaatgggccccccctcgccgctggccttatcgtggtcagcattgagaag

SEQ ID NO: 4368 - DNA, 859 bp, Triticum aestivum
  Clone ID: PAT_TA_4368
ccacgcctccgccacacacacccaccaccgccaccaccatcatcaatcacaacacccaaccatggcgtcttcactcttcatccttgccctcctcctcaccgtcgctgcaaccaacgcggccaccatcacggtggtgaacaagtgctcctacacggtgtggccagccgccatcccggtgggaggcgggaccaagctcgaaccgggccagttgtccacaatccatccacccgccggaacaaaatctggaaggatctgggcgcgtacgggctgcaaattcgacgccagcggcaaggggtcctgtaccacgggagactgcggcggcgtgctggcctgtcgtgccggcgggaagccacccgcctcgctcgccgagtacactctggggacaggcagcaatgctgacttctacgacatctccctcgttgacggattcaacgtgccgatgagcttcgggcccgtcggcggcagctgccgcgcggtcagctgcgccgcggacatcaacgcaaagtgcccgtcggagctgaaggtggacgggggctgcatgagtgcctgcggcaagttcggcaccgcacagtactgctgcccaccgccgagtacaccgtcgacttgcgggccgacaaactactcgcgtttcttcaaggggctctgcccagacgcctacagctatgcctacgacgacaagaccagcaccttcacctgcgctagcggaacaaactaccaactgaccttctgcccgtagatccgtcatcatcatccatatgcatatgcatgctaggaactgaatttcttcgatgaataagtctgtacttgacggaactggatggagtacgttcccatcacggaatgaagtagtttcccaaac

SEQ ID NO: 4369 - DNA, 635 bp, Triticum aestivum
  Clone ID: PAT_TA_4369
ctccaatcctccccgcgcgccgcaaacttccccaatccgatccctcgtctccttcccgccgaatccgccatggcgcccaaggccgagaagaagcccgccgcggagaagaagccggtggagacggagaagaagcccaaggccgagaagcgcgtgcccggcaaggacggcggcgccgacaagaagaagaagaaggccaagaagagcgtcgagacctacaagatctacatcttcaaggtgctcaagcaggtccaccctgacatcggcatctcctccaaggccatgtccatcatgaactccttcatcaacgacatcttcgagaagctcgccggcgagtcggccaagctcgcgcgctacaacaagaagcccaccgtcacctcccgggagatccagaccgccgtgcgcctcgtccttcccggcgagctcgccaagcatgccgtctccgagggcaccaaggccgtcaccaagtttacctcctcttagattgcctgccgcccaccgagtctcttgtcagtttggtttcgtttgttcgtgtgtcaacaatcgcagggggttagacccccctatacaaacattgtaaaatgagtcgtattttctaaatcaatgaattatcgtggtcccttgttacaaaaaaaaaa

SEQ ID NO: 4370 - DNA, 618 bp, Triticum aestivum
  Clone ID: PAT_TA_4370
ggcaatccacctagccgacgtgaggcctgggcacccagatcacgccgatgtctccaaccatgacatgctcggcactcttatccaaagcaaggaggaatctgtggcctccatggtctaccactacaagcatggtttctcgggcttcgccgccatgctcacccaagaccaagcaacaagacttgcagagtttccggaagtcatcagcgtgaagccgagcaggagggtcaggaccaccaccacgcggagctgggacttccttgggctcaactaccagtcctcccacacgccggccagtgagctgctccaaatgagcaacttcggagaggacgtaatcatcggagttgttgacaccgggatctggccggagtcaagaagcttcagcgatgtagggtacggaccggtgccagcgaggtggaaaggggagtgccagaccgggccggactggggcatcaacaactgcagccggaaaatcatcggcgcgcggttctacaccgctggggtccccgacgagtacctcaaaagggactcgctgtcaccgcgggaccactacagccacggcacccattgtgcttccaccgcagctggctcagccgtaggcgtggacggcgaggaggctag

SEQ ID NO: 4371 - DNA, 681 bp, Triticum aestivum
  unsure (1)..(681): unsure at all n locations
  Clone ID: PAT_TA_4371
ccaccacagctcctcctccatttgcatctcactcagctccaaggaagaagccgtcagccatgtccggccgcggcaagggagggaaggggctgggcaagggaggcgccaagcgccaccggaaggtgctgcgcgacaacatccagggcatcaccaagccggccatccggcggctggcgcggcggggcggcgtgaagcgcatctcggngctcatctacgaggagacccgcggcgtgctcaagatcttcctcgagaacgtcatccgcgacgccgtgacctacaccgagcacgcccgacgcaagaccgtcaccgccatggacgtcgtctacgccctcaagcgccagggacgcaccctctacggattcggcggntgacctgcgcccgctgctgccccatcgagtcgaccctgctagctgctgctgctattctcgcgctatgggttcgcttctgaattcagagggggtgagttggtgctccgtcgggcctgataggtagtggaaggcaatggatctgaatgcaatcgaaattggtgctttttgcaggaaatgatcctaatgaaaaggaaaatgacccgaactccgttataatgcccttttggcttggtcctgcccatcccaaaattaataacaagaaacgccattgggacctttttcctgnnaaacaaagacatcatactctccctcc

SEQ ID NO: 4372 - DNA, 830 bp, Triticum aestivum
  unsure (1)..(830): unsure at all n locations
  Clone ID: PAT_TA_4372
cgcagcctagcctagcactcacaatcttcacgcagctcgcccgagaggaacacatgggccacttcgccttcaactggcagggcatggaacccgcccccgccgcctccctgtccggcgccggtgctacgctgcctctccactccgtccagggcgccgccgccgcgacgaacagcgccgacgcctcgtactgcctcgacccggccacgtacgcgcccgcggtcctgcccacgatcccgccggccgttgcggaggtgggagccaagaggcgccaggatgcggagaacatcgcgctctacctcatccacatcctccacaagtgcgctgaagccatcgaggcgggcgactatgcggtcgcggccggcaagctctccgaggcgcgcacgatcctcgcgacgtctgtctcgaccaccactgggattggccgtgtcgccagccacttcgctgccgcgctggcccatcgcctcttcccggcgtcgccgcactcctccttcacgcaggacgcctcaccggagcgcgccggcgagctctaccgtcagttctacgatgcggggccgtacctcaagttcgcacactacacggccaaccaggccatccctcgaggcgtttgagggctgcgatcgcgtgcacgtcgtggatctcgccatcaagcagggccgtgcagtggccagccctgatccaggccctttcccgcccgcnccggggccccgcgtccgtccgcataaaccgcgtnnggttccggccccgccgtcgacgaagcttggcctccgcctggccgaagctggcgcgtgccatgaatgtgcccttttcggttcaaaagggcacccgaggaa

SEQ ID NO: 4373 - DNA, 863 bp, Triticum aestivum
  unsure (1)..(863): unsure at all n locations
  Clone ID: PAT_TA_4373
ctcgtgccgaattcggcacgagcagacatggatcaggcggccaggaaggaaccctagagccctccgctgccagtataaataggggagccattccgctcgcccgaaccctcctcagtcccctttcttccccccgaccgccgccgccgccgccgcctcctcctctcggttccctctccttccttcgagagcttcagccatgggtaaggagaagactcacatcaacatcgtggtcattggccacgtcgactctggcaagtcgacgaccactggccacctgatctataagcttggaggcattgacaagcgtgtgatcgagaggttcgagaaggaagccgctgaaatgaacaagaggtctttcaagtacgcctgggtgcttgacaagctcaaggccgagcgtgagaggggtatcaccatcgatattgccctctggaagttcgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctncaaggatggccagacacgtgagcacgctctccttgctttcactcttggagtgaagcagatgatctgctgctgcaacaagatggacgccaccacttccaagtactcaaaggcgcgttacgaagaaattgtgaaagaggtctctttctacctgaagaagtcggctacaaccttgaaaggttcccttcgtccccatctctgggttcgagggtgaacacatgattgaaaggtcaacaacctgactggtccaagccccaaccttgttgaagggctgaacagatcaataa

SEQ ID NO: 4374 - DNA, 836 bp, Triticum aestivum
  unsure (1)..(836): unsure at all n locations
  Clone ID: PAT_TA_4374
cggaatccatgggctcgggaaagaagccactgcgctgttcttggacatgaacaatcacgcttgtgaacctgatggcgtcacattcatttgcctaatttcggcgtgcagccattccgggctcgtgactgaagggaaacactggtttcacatgatggcacataagtatggtataactccaaggatggagcactatatcagcatggttgatcttttggcgagggggggtttccttgatgaagcctatcagtttatccagagcatgccaatgaaagcagatgttcgtgtatggggagccttgcttgcagcttgccgggttcataagaacatcgatttaggaaagcaagtagctaggatgatccagaaactaggacctgaggggactggtaactttgttctgttgtccaacatgttcagcgccgctgggagatttgacgaggcagcagaagttcgaataatacagaaggagaaggggttcaagaagagccctggctgcagttggatcgagataaatggctctctgcatgcatttattggcggggacagatctcatccacggtcacctgagatatatcaagagctggataacatnctggtagatattaataaaatgggttatcaggctgatacaagtttgttctccaagatcttgaggaagaggaaaaggagaaagcgcttctttatcacagcggaaagcttgcaataacctttggtgtccctacacttaatgaagataagacaattttggtacgaagaatctccgtggtgtggagaatgccatactgttatcagtacatgaacctagtccggaagaaggattttatcggtaaaaaagccat

SEQ ID NO: 4375 - DNA, 912 bp, Triticum aestivum
  Clone ID: PAT_TA_4375
atttgatactcttaaagaacgtcatgccaagagaaacccagaagatcttatcattgactatgacgatcaatttccaagtgaggaagatgaagaagctcctggcagcgacgaggacagtttggtcccatatgcttctgatacacaagaactaagtctattccatgagagtggagaggaggaagaggaacccatccgtgctgatcttggaggaggctggggccggattatatacagccccattcgaagaggaagacaagtacagatggatgtttgccgtgccaccaaacgggatgcgtctgaaggcgcgttcgagcgtgtggtggtcacacaaagcaagaaccctgctttgcatcttcaggcccggaagtcgctttggggtgacctttggccattttaggctacagattctccaagcttgggtgtagccacccttcggggggctcccaggcggtgccccgtggtctccgccccgttcgtgagggggcgggccggtgcgtcgtcccgcccaccttgcggcatcgtctgtggggcgttcgggcgtgccgcggccactctaccgagcccccgcttgcctcgtctcgcccgctgtcgcctgggggtcgcccttgcccatcttccgcttctgatcttcaacctgcctggttgcctcattttagggggctcccaatctgttcagcagtggactcgctccgtgaaagtagaatgtggcgttagtggtgcttctttcagtgttaacttttgcttcatcagtatttgtttttgaaaggttttgcttcttccatacatttatttatctgtaacagagctagtcagcaaacctcatctcaaattcttgatatcagggctgtgccggagttctgaggtttgaactctgcagcattggaacgctcttcgtcaacaatgtaactggtc

SEQ ID NO: 4376 - DNA, 835 bp, Triticum aestivum
  unsure (1)..(835): unsure at all n locations
  Clone ID: PAT_TA_4376
ccacgcgtccgcatcctgatcgcaatggcatcccccaaagcttgcatgtccacttacctgatcgccgtcctctgcctggtcaccggtgcgcacagcgccaaggcgttcaactacgtggacgccctcgacaaggcggtcctcttcttcgaggcgcagcgctccgggaagctgccgccgggccaacgcgtggcgtggcgcgccgactccgccctctccgacggcaacgcctccaatgtggacctcgtcggaggctactacgacgccggggacaacgtcaagttcggcctgcccatggcgttcacggtgaccatgctgtcgtggagcgtggtcgagttcggcggcgagatgccgcccggccagctcgccaacgccgaggcggcggtgcgttggggctccgactacctgctcaaggcggcgacggcgacgccgggcgcgctgtgggtgcaggtggcggacccgtaccaggaccaccggtgctgggagaggccggaggacatggacacgccgcgggccgcgtacaaggtgacgccccagaaccctgggtcggacgtggcgggcgagaacgcggggcgctggccgcggnctccctggtgtcccggcccgcgacccggcctactcgtccaagctgctccgcgccgcttgggcagtgtttgatttcgcggaccgatacaggggctcctacatggactcgcttaactcccggggggtgcccttttactggttctactccggcttcaaagacgagctccttttggccggcacggggcttgaccctgggtcgtcgccgttgcccgagcttgcaaacgtggacatgaacttaattaacttcaaccgg

SEQ ID NO: 4377 - DNA, 815 bp, Triticum aestivum
  unsure (1)..(815): unsure at all n locations
  Clone ID: PAT_TA_4377
ctcgctgccgtcggcccccgccccagcccctatttcctcaccgccccaccaccggacccagccggccgtcctcgggttcgaccaccacgacggcttgaagcttcagcctcaaccggtgaccatcgccgcgccgacgccaagacctcctccgcccccgcccacgcccgcgcgctccgccgaggacctcatcgacaggccaccctctgcctcctcccctgcccctcgccgcccccctcgccctccccgccgccgcccccgcccgcccccgcgcgctcccccgtgcccctcgtcgtccggcccccctcgtcctcctcgccgtccgcgctgctgtggcctgccgcccgtgcggggccttatcccccctccgctgcgtccatgtcctcgccggccgtgctgccgtccccgagctcccccgccgggcccctatcccgcccaagctccgggacgccatttctacctcgccgttgaccgcctccaagttcaagatgatggacactactggtagctcctaagtgttgtctcggatcgccacgcctcggatgcccattgccatatgtgtttcatcccgggatgagctctatgaattgcctacaaagaagaggcttacttaagacctgtattaacatgcttggcaacagatggaatcgtgataaatatgtgggtggggggggaggaacttttcttaggggctttagaaaaaacagtggattcgtcattggcaaaaatgccaatacaggttcttgagatgtntaaaanctgctgctcgcgcatggaagtcccttagtcctgncgataacanaatgcncannaggggt

SEQ ID NO: 4378 - DNA, 709 bp, Triticum aestivum
  Clone ID: PAT_TA_4378
gcggcatggagatgacgacgaggaacagcaacttcttcgtgatgctgcaaatgttaggccccgcttagtgattccacctccacctatgcctcctcgtcaaccactttggcattcggagttgcatcataacaactggatgagacagaacataaaccgttccgatatcgaatgggaggctattagtgatttgagggctgatatggctagacttcagcaaggtatgggtcatatgcaaaggatgttggaagcttgcatggatatgcagcttgagttacaacgttctgtgaggcaggaagtttccgcggccttgaatcgcttcattggggagcaaggggaacccaaggagaccatcgacgatggatcgaaatggatgaatgtgaggaaaggcacttgctgtgtatgctgtgatactccgatcgactctcttctgtacagatgtgggcacatgtgcacgtgctcgaaatgcgcgaacgagttggttcgaagcggagggaagtgtccgctgtgccgcgcacccattattgaggtgatccgagcttacttcatcatgtaactagatggtacgtagaatatacgaggaggaaaggaagaggaaaggcgatggaagctttctcttgcagcaaaggataatataacctggactatgatatgatgatgatgattgttcgattttttttgaacacattgggtggttgggtggttggtgtgg

SEQ ID NO: 4379 - DNA, 746 bp, Triticum aestivum
  unsure (1)..(746): unsure at all n locations
  Clone ID: PAT_TA_4379
ccgccgccgcctccgctcggttccttctccttcctccgagcttcagccatgggcaaggagaagactcacatcaacatcgtggtcattggccatgtcgactctggcaagtcgaccaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgacgcccctggtcaccgtgacttcatcaagaacatgattactggtacctcccaggctgattgtgctgtgctcatcattgactctaccactggtggttttgaggctggtatctccaaggatggccagacccgtgagcacgccctccttgctttcactcttggagtgaagcagatgatctgctgctgcaacaagatggacgccaccactcccaagtactcaaaggcccngtacgaggaaattgtcaaggaagtctcatcgtacctgaagaaggtggctacaaccctgagaagttccctttgttcccatttctgggttttgaggtgacaacatggatgagaagtccaccaaccctgactggtccaagggccctacccttcttgaaggctcttggacagatcaatgagccccaagaggccttaagacaagcc

SEQ ID NO: 4380 - DNA, 844 bp, Triticum aestivum
  Clone ID: PAT_TA_4380
ccgaggtcctcatcacagctcccacgaacggaaccaacaaatccccagccaatctcgtctccgatcgaccccaggctcgtcgaatcctcctcccccaccgcctcaagatgcagatcttcgtgaagaccctcacaggcaagaccattacccttgaggttgagagctccgacaccattgacaatgtcaaggccaagatccaggacaaggagggcattcctccggaccaagcagcgtctcatcttcgctggcaagcagctggaggatggtcgcaccctcgctgactacaacatccagaaggagtccacccttcaccttgtcctccgccttcggggaggcatgcagatcttcgtcaagaccctcaccggcaagaccatcacgcttgaggtggagtcatctgacaccatcgacaatgtcaaggccaagatccaggacaaggagggcatccccccggaccagcaacgccttatctttgctggcaagcagctggaggatggtcgcacccttgctgactacaacatccagaaggagtccacccttcaccttgtcctccgtcttcggggaggcatgcagatcttcgtcaagaccctcaccggcaagaccatcacgcttgaggtggagtcgtctgacaccatcgacaacgtcagggccaagatccaggacaaggagggcattcccccggaccagcagcgcctaatcttcgcaagcaagcaacttgaagatggccgcacccctggcgactacaacatccagaaggagttccaccttcaacttggtcttggctttccgtggtggcatgccaaatctcgtggaagaccctggcgggggaagaccaatactctgggag

SEQ ID NO: 4381 - DNA, 588 bp, Triticum aestivum
  unsure (1)..(588): unsure at all n locations
  Clone ID: PAT_TA_4381
cgactttttcggccggccgccgtgggctcgcgcatcggtggtctcctgagccggggcgtcaacgggtacgacatcaactacgtcgtcgacggcaggggcctgcgcccggtggcggttgtccgggatggcgcgtccggtagggcgatggagctgtgggcggaccagcccggggtgcagttctacaccgccaacgggctgagcggggtgagggggaagggcggcaaggtctatggccgatacggcgcgctctgcttggagacgcaggggttccccgacgccgtgaaccgcccgagtttcccgtcgcagatcgtccggccggggaaggtgtacatgcatcacatggtgttcaagttctccttctagtatagctagtggtagtgtggtacccgagcttggtcgtttgtcaggcaacacagccgctcttgtgttttgtgtgctgtctgaatttgatcggttgagcttcaatggaggaataaaagcttgcatgctgcaggttcaagctttttttttaaaaaaaaaaaaaaaaaaaaaaannnnnnnnnnnnnnnnnnnnnnnnnnnnnnnnnnnnnnnnnnnnnnnnnnnnnnn

SEQ ID NO: 4382 - DNA, 1376 bp, Triticum aestivum
  Clone ID: PAT_TA_4382
gctggtcggcacacccacccagcagctcgcccctcctctctccgtcttcctcttagatccccctcgcaatgacgctgcagagcgcccggctcgtcgccctttttccgtgctcgtgttctgcgggtcctggcctccccgggcgcgccgggcgggccggcaggtggtgggcggccactggctccgagctccagatgggggagggctgctgtctatcgtgacctacaccggcgccgccctcctgtccctggatccccaagggtcgagaggcgacgttgtccgtgtgatcttcgcctacgatatggttgctaacggcaagatttacaacgcagacctcggtgggatgatcagcccctgggccctcctagtcgctcctctccgcggctcggtggttgggccaccctgccggcacggtcccaccgatgggaccgccgcgctgcagggagttcgtccggacgagctcaaggagggggggatcaacatgtaggtcgtcgtcaggggtgcctcactcatgaccacgatcctctccgacacggggggcaacgtggccgcggtgccccgggcctacgagtggcgtgcgaggtatcgagctggcacctcctacgtgtgcgccttgacccgacgcggctcgacaaggcccgcccgcgccccctggcgccgcgcacgtaatggctcctggccggtcagcgccgcgggcacctccacggcaccaggggccaactgttggcgccccagtacccgctccacggtacgggacgcccatcccgacggggccgcccgcgcccgtgctctggccacgccctactacgaccggggcgcccggccgccggggggcgagcacctccgcgagggtcgtcggccggccagcagcaacggcagcaccatctacgtcaacgacatcgaccacgtggtcgacggggacgcgcgcgcgctgcgcaaggtcgcggccgtccgcgacggcgcgtccgggcgcgcgctggagctgtgggcggaccagcccggggtgcagttctacaccggcaacttcctccaggacgtcaaggggaagggcggcaagatgtacgggcagtacggcgcgctgtgcctcgagacgcaggggttccccgacgccgtgaaccaccccgacttcccgtcgcagattgtgaggcctggccaggcggcgtacaagcatgacatggtgttcaagttctccttctagctagagctggtcgacccaaggatgggcaccgctgtttaggcaacttcagtcgagtgaccggtctcctgatgttcgtgactcttttggtgtcggtacttggtaggaagatcagcaataatactctcgggtacgaggctcagttcttttgataggcaccaaaaaaaaaaaaagttatgaaatg

SEQ ID NO: 4383 - DNA, 770 bp, Triticum aestivum
  unsure (1)..(770): unsure at all n locations
  Clone ID: PAT_TA_4383
ggcgctcaccgccgtgtgcggcgcgctggtcccgtcgctgccgcccgacggccaccacctggccgccgacaaggccgtccgggacttcttcctcgcatccgccgccgacccgcccgtcccggacgaggtcgcgcagctgatgtcggcaatgtgtctccgggaggcgctgacgctggtgcggacggtgctgtggctgctgggcacgcggctggggacgctcgcgctgtgcggcgcgcggtgcctatcgtggagctccccgttcgtgcagcggttcgcggagatgccggtggaccggcgggaggacgcgctgcgccggtggagccgggagaccatgctcccgcctctgcgcctcttcttcctcctcgtcaaggtcttttgcctctacgtcttctactcctggaccgacgataactcggagaatcctcactggcgagcgatcggctacagcccgccaaccgacgagcctacngagcaagaagatcaggcaaacaccaagcggccactcgacgacggcgtggtcgagaccatccaccagaccgacgcgttccttccgaaccagcctcgcgaaaaagggcctcgggtgaccgangacccggcgcggaacgtgggcaggatcgaatgcgagtcgtcatcgtcggcttcggtttcggggggggcgtggccccgggtggtttcaagggcggccacaaagtggtgggcattgaaaagggaactactttacggcaggggataacacgccaatgaggggcccgcgattaaccagttttaca

SEQ ID NO: 4384 - DNA, 780 bp, Triticum aestivum
  unsure (1)..(780): unsure at all n locations
  Clone ID: PAT_TA_4384
cacgattgacaatgtcaaggcgaagatccaggacaaggagggcatccctccggaccagcagcgcctcatcttcgctggcaagcagcttgaggacggtcgcaccctcgctgactacaacatccagaaggagtccaccctccacctggtgctccgcctcaggggtggtatgcagatctttgtcaagaccctcaccggcaagaccatcaccttggaggttgagtcatccgacaccattgacaacgtgaaggcaaagatccaggacaaggagggcatccctccggaccagcagcgcctcatcttcgctggcaagcagcttgaggacggtcgcaccctcgctgactacaacatccagaaggagtccaccctccacctggtgctccgcctgcgtggtggcatgcagatcttcgtcaagaccctcactggcaagaccatcacccttgaggtcgagtcctctgacacgatcgacaacgtcaaggcgaagatccaggacaaggagggcatccccccggaccagcagcgcctcatctttgccggcaagcagcttgaggacggncgcacccttgctgactacaacatccagaaggagtccaccctccactggtggctcgccttgggggggggatgcaaatctttggcaagaacctaactggcaagacaataccctttgaggtgaggccttttgcaccaatgacaaacgtcaggcgaaaaatccgggaaagggagggcattcccccggaacaagaagggcttaatttttgctcggaagaaacttggggacgg

SEQ ID NO: 4385 - DNA, 926 bp, Triticum aestivum
  Clone ID: PAT_TA_4385
gcagcctacacacttatcctccaaactccccccttaattaaaattacaaggatctcgcgggccctgcaccagaggccgtagcacaaacaagcaccacctcctcctctgccatcgccatcgtgctctattcctcgcctagacatcgcctacacacttatcctcaccactcctactttgaataaaattcaaggtttcttgctggccttgcaacaatggcaatagcacaaacgaccaccatcttcttctctgccatcgccatcatgctcttttcctcgtcaattgttgctcatactagcggtgacgttgatggcaagccgaaggcagccgatttcgtgacagaagcatgcaagaacgctacagccaacttacgacaaagaaatccacctcacagagaaattctgtgtctcgaccctccggtcggacaagcggagcgagaaggcaaaggaccttcgtgacctggcactcatcggcgtagacatcctcaaagcacgtgtcatcgccgccaatggtaaggtccaaaaaatgttgcacaaagccaaaactggcacgtcgatggcgcgccgcctcactttctgcaagctggactatgacgtgacggtaagcatcacgaacgtctgcaccgccttgctgaaggacttccgtggccctaacggcggtgacaacgatggaccggcatcttttatgctccctcaatgtgtggagcaggcgaacaccctcaacggttactgcgggcatgagcttatggatttgcccggggcttcaagcgctgttcaacgaaaatcttgacatgagtatgctggcccaccttaacatgggcttgcttgaaccatatagagacgacgattcataatatgtattttagcccgagtggtgcatggtgcttcatttaaaaaaaaaaataatgagaggttggtacatcttattcc

SEQ ID NO: 4386 - DNA, 847 bp, Triticum aestivum
  Clone ID: PAT_TA_4386
cgaaggataatgcgcctgcaatattattttttgatgaaatagatgggcttgcagtaactcgtggccatggaagtaatggcatatctgttgctgatagggtactcagtcagttgctacaggaaatggatggtttggaccagaagattggtgtcactgttattgcagctacgaatcgtcctgacaaaatcgatattgcacttctgagaccaggtcgtttcgacagactgcttgatgttcaaccaccagatgaagctgaccgtgaggatattttccggattcatacacgcagcattccttgcagtcacgatgtcaatctaaacgaacttgctagactcacagaaggctacaccggcgccgacataaagctcgtctgcagggaagccgctgtagctgctcttgatgagaactctgacatcccagaagtagcaattacacacttcaagtcggcaatcgaccgagtaagtccatcagatatgcagttctaccaagaacttgcggccccgttccgccgtctcgttgatgaccccgattaccccaaaaccgcggggataccgacccgaccccccaatttgttttcctcttttttttccagtgggccatggggggagccggtccacttaagcgcttccccttctcctcctcctccccacctcgactcacccatcaatcggagcctgaattggggttgacggtgacagttgcagccttcatcctcccccgttgccgggagcctggttgtctctggtgtttccggcttctgccggtctagcggcgagtccttgtgcgtcgtgctcttgggctccgtcggccactgccgttcctgctgggtaataatttttatagggag

SEQ ID NO: 4387 - DNA, 1202 bp, Triticum aestivum
  Clone ID: PAT_TA_4387
ggaatgcaagccattagtgtgactcttttcatgtcatttctagttctgttgaccagaggaaaagatgtgcaatacagaaggcaagaggaagacaatacccagattctcacttatcaccgagttaataaaaccattgtgatgaaagatggagatgtctatgactgcattgatgtgaatgagcaatcggctttcaggcacccattattgaaagaccacaaagtccagatgcaaccaaattctttccctgtttggatggatatccaaacattgccttcagatgaaccatctatcattgagtgcccaacgggaacaattccaataatgtgtactaatggaagtggcaccatagcagcacatagttatgatgggcaattggagtcagcgggactcatataccaaggtgatgtatatggggtgcgtggtgtattaaatgtttgggagccaaaggtgaataaatatagtaaggattctagtgcaatgtgtgtagaaatgaaaagtggaggagaacaacatactgacagaattggtgctggtgttcgggtctttccaacattgagtggcgatacttttgttagatttcatatttcttggtatgatggcctatacaaaaagtcatgcattgacttcagttgtcctggttttgtgcaagttaaccatagagttggtcttggagcaagaatgcgaccaccctcttgttatcatgggaagccagacagtaatacacattcaaattttcaaggaccctgtgtctaagaactggtgggttgacttatgaacacctagcaattgggttattgggccaatgcctttattcgaattcccttaggaccaaaggggatgcagcattctggggtgggattgttgaggggccgactgcctcgtcaaactctccacaaatgggcagtggacattttgcttcggagggatacggaggagcggctttcgtaaaaaatatccagattgcgaataatgagaagggctattttgacactccaaataagtctcaagtgcggcctgaatcaagcgataaatccaaatataccgtggaaagatttgaatatagtaaatatgtaggtatgcgtatcttctatggtggattagggtcttacaaggcctactgacatgaactcaacaaatatatttaaaaaaaccactatgatcaaataagtgatggtgaattatgttcaaaaaaaaaaaaaaaa

SEQ ID NO: 4388 - DNA, 1317 bp, Triticum aestivum
  unsure (1)..(1317): unsure at all n locations
  Clone ID: PAT_TA_4388
gggcggtcggggcgaggcccttgtcggctcggtcggattcggggatctccccagcgccatggacggccgcgcccagccgggggggtgcgccctcgccggctgcgtctgctcggccgtcgggttggggggcgagttctcgggacaggccgccccgcttaaggttgacagctgtccaggcattgactcacccttggttgcgggatgaccaaagacagattccgctggatattcttgtctacagattaattaagcaataccttcgtgccactcctcttaaacgtttggcgctaaaggcattatccaaggctttaaaggatgacgaactcttgtatcttaggctacagttcgatctgcttgaacctagagatggagttgtgtcacttgacaactttcggacggctttaacgcggtatctaactgatgcaatgaaggaatcaagaattcttgagtttttgcatgcgttggaaccacttgcatacaggagtatggatttccgaagaattctgtgcagctgctataagcccttaccagctcgaggccctggacagatgggaggagattgctggaacagcttttcagcactttgcaacaggagggcaaccgagtcatatcagtcgaggagttggcacaggaactaaatcttgctccgacccattatcccatcgtgcaagattggtttagaaaaccagacggcaagctaatcttccttgggtttaccaagtttttacacggtgttacaagacggggggcaacctcaagacgcaattaagtaaaccatgctggaaaaaagattccttaacaagttttaccgcaaaagattgacagctgtcaactcattgacccccccttgttggcgccatcaaccacgaccggcttctctcgttttgcgtgtcaacatctttattctgcttttcctgagggtctcggttgctgtcacctttgctcctaaaggggcattacccgtggctttctttggttgttgaggcgctcggttcttaggctacaagttgatctgcttgaacctanaaatggagttgggtcacttggacactttcggacggctttaacgcggtttctaactgatgcaatgaaggaatcaagaattcttgagtttttgcatgccttgggacccacttgcataccggaatattggttttcaaagaattttgtgccggacttattagcccttaccagtttgaggccctggaccagattggaaggagattggttggaacaacttttcagcactttggaacagggaggccaaacccgattcttatcaatccgaggaatttggcacaaggaacttaaatcttt

SEQ ID NO: 4389 - DNA, 1084 bp, Triticum aestivum
  unsure (1)..(1084): unsure at all n locations
  Clone ID: PAT_TA_4389
gtaccggtccggaattcccgggtcgacccacgcgtccgtcagtttattcccacggaaaaagagaggaagacctttaaatttgaccatgtttttggaccggctgatgatcaagaggctgtatttgctgagagcctgccagtggtgaggtcagtgatggatggtttcaatgtatgcatctttgcatatgggcaaaccggaacagggaaaaccttcactatggaaggtgttccagagaataggggtgttaattacagggctcttgaagaactgttcaggatctcggaggagagaagctcatctgtctcgtactcatttggtgtgagtatcttggaagtctataatgaaaaaatcagggaccttcttgatgacaactctgaacatacatcaaaaaggttggacataaagcaaagtgctgatggggcacaagaggtgcctggcttggttgaagctccaatttctacaatagatggtgtgtgggagaaactggaagctggcgctagaaatagatctgttggatcaaccagtgtcaatgaactgagcagtcgctcccatagcttggttagggtcaccgttacgagtgagcatttggtgactggggaaaggagcagaagccacatgtggttggttgaccttgctggaagtgagcgcttggctaaaactgaagtagaaggagagaggctgaaggaggcaaagttcatcaacaagtcactctctgcactgggtgatgttattgctgcccttgcctctaaaaatgcccacatcccatatcggaactccaagctaactcatctgctccaaagctcgntaggtggagattgcaagacacttatgtttgtgcagataagtccaagctctacagattcaggagaaactttatgctcgctaaattttgctagtagagttcgagctattgaacatggcccctgctcgtaaacaagtggatccagctgaaaacttcaggatcaagccaaaggcccgaaagctcttgccttgaggaaaggaaaatgcgaagttgaccaaaggcttgccactggagccacttaagtttgcctttggggagaaaggcttcagaaacttttagaat

SEQ ID NO: 4390 - DNA, 657 bp, Triticum aestivum
  Clone ID: PAT_TA_4390
cgaccgcgtgcggcaactgcactgccccagcgaaaaaaggagtgagtcacggaacaaaaattctccgtcggttccgagcgctcgatcccagtcggcgcggcgccggatcgaatgcgggaggcggaggccgccgccgctcgatctggtatttgaagtggacaaggagctgatacgatctatagagggttgctgcgcttgtagttgtgggcaaaatggaggggagagttgctggcgacgtggagcttgattctgcagtgttccaagtgacattgaccaagaacaggtatgaggcaattgcttgtaatggagagagcgccgaatcagtagcatctggtcctttcgaccaactagtcctgcacttggaagatgccaaaaatttccaatcacgttcgtcaagtggctcttttaagctgttattgattggggatgcaaaaggctctacctggttcacaaaatccaccttagagagattcctacatatcataaattcgcctgatgcatccaaaacggcgaatgggattttacaggaaatgtctcagctggaggaaactagaaagtttcatgattatctacagtccaaggaacaacaaaatcttatgggtggtgctttgacaggtggtctctccagcaccactggcaaaccacagcagggaaata

SEQ ID NO: 4391 - DNA, 1428 bp, Triticum aestivum
  unsure (1)..(1428): unsure at all n locations
  Clone ID: PAT_TA_4391
gccagtctcccccttccccaacccacccgcccccgcctccggcggcgccgcagcaccggccacccccggcgccgcgctcgccgaccccccgcccccgcggcgcggccagcccgcgctcccccccctgcgcgtgcctccgagccacgccctcccgcggcggcccggccaccgccccctccccctgctcgctcgccgtcctcgccccctccccgcgccccgccatggccgacttccgccggccctgcagcgccgtctccgactactcctggtccgcgtccgaggatcgcaccctccccgcctgcgacgtccgctccatcctcaccggggccaaccccgccatcctctccgccgccaggtccgcccgcccgatcgccgggcgatgcatacttcgtctcaagggccacctccactccgtctgcagtgctaactgctatccgccggccggcgcccggctccccccggcccggctcggctcctccggccgcggccggggcgtccgcagcggccgctgcatccgcaccatcgtcgcccccgcccaccccgtccgggacggatcgatcattgtgtccgggagccatgatgggagctgcaagatttgggatgcgggaactggctcttgtctcaagacagtcattgacgacgacaagaagccagcggtttcctgctcaatgttctcacccaatggcaagttcatcctcgtcgctacgctcgatgactcactgaaactatgcaactatgctactggcaagttcttgaaggtatatagtggacatgtgaacagagcaatactgcatccagtctgcgttttccgtcacgaacgggaagtacattgttagtgggtcggaagataaatgcatatacatatgggacctccaagggaaaaacattcttcagaaaatggaaggccataccgacgctgtcatctcggtgtcatgtcatccaacagagaacaaaattgcttctggcagccttgataatgacaagactgtgagactctgggtccaagatggctgatgaatatgcagaggagaggataggtagacctgtgtgtactctatgtagaacgaacctacgcagcagcaagtgggatctcaaagagaaacttgctgctgtgttccatgggccgctcctggttgtatgtcaacctggaggttttacttaacttaggcttgcactgctttgttttaatacgagttgttcctcttcgaggttccaagtctcaacagatgagttggtctcctaacgttgagatgtgtttgtttggtgcccgacggctgctgtaaggtgccagatttggacctctttgttcacgagattgcagtgcgaccggcagttaataaaagcattgcaagccgggcagtttttagggttaatggataaacatatgtcatcagtaagattcagtatggnactgcacatcatgtataa

SEQ ID NO: 4392 - DNA, 807 bp, Triticum aestivum
  Clone ID: PAT_TA_4392
cttcctcagttgtgtaggtgtgcctagcttccagcaatggcgtccttgacaaatctcatcatactactaccacttctcttgctcgccaccttctctcctacaccatccctgtgctatgtcggtccgtctgccgcaggggtgcaggtgggcctagcttcagcaatggcgtccttgacaaatctcatactactaccacttctcttgctcgccaccttctctcctacaccatcactgtgctatgtcagtccatctgctgcaagggtacatgagggtgttacacagacatctgcctaccacacttacattgtgctcgtcaagccacctccctcgggtaccaacgaagaggggcatcgtcggtggtatgagactttcttgccgagctcacacatcggcgaatctggggagccccgtctcctccactcctacatcgaggtgttcagcggctttgcggcgacgctcacagaggctgagctcgacgcgaccgccaagaagctggggttcgtgcgtgcgttcccagatcggacgctgcatctcatgaccacgcacacaccagagttcctcgggctcaggaatggcaccggattttggagcgacgtaagctaccggaagggggtgatcatcgggctgctctttactggaaatgacgactcgtacgaatacggggggcacggaacacacaacttggtcactggcgccggcaactttcttaccgatgcgtcagaaccatggcgtgggcacgggcacttgtttccggaaattgttcagtggcccacaatcgcctgtccaaagtgggcaacgccccaagcg

SEQ ID NO: 4393 - DNA, 833 bp, Triticum aestivum
  Clone ID: PAT_TA_4393
gccatgcatgccatcgcggcgcctgccgcgcgctagaagtacagcgccccgagacggcagacggcaccgggctgctctggttcgcatcactggcactggcaccggcatggcgcgctccctgctcggcgacgcgctcctcttctccgccggcgccgcggtgggcgccgcgctgccggccacgctggcctcgccgctcaccccgccctcacgtcctcctgccccgacggtcctcgtcccgccgggggatccggctgccacgggggcgcgcgttcgacgacgacgcggaggcgacgtacacccggtggaccgtcccatcacgcgcgtggcacccagaagcgcggccaggggccccggcgcgcaccccggagctgccccggcggcgcccggcgcgggggcgcggcctcgccggtggctcgccgcgccgccgcccgccctggcccctcccccggggcgcgaccacgtgctgacgcggctcctcaagaacaaggcggactactgccgcctcaacggcgtgcagctgctgtacaacacggcgctgctccgcccgtccatggaccggtactgggccaggctccccgtcatgccggccccctgtccggcggctcccgcacccggagtgggtctggtgggtggacctcgacccccggcttaccgacatggatttccgcctcccgcttggccggtaaccgggcccacaaattttgacgtacacgggttggcccgagacctggggtacgaagagtcgagccccgtcttggaaaggccctcatctccgtgggcggttctttgtggctcaaactgtccatagaactgatcgacatttttttgacacg

SEQ ID NO: 4394 - DNA, 881 bp, Triticum aestivum
  Clone ID: PAT_TA_4394
gaaaaaaggaacaaccataagctatgtgccttccacaacttttacttctagtgttcatggtatgttcagaccaagttagtgcgatatcatggttacacaatccatatacttgggatatagctctatccgagaaacaaccatcctcggtatagcagcccgctactcatgaaggctggcatgaagagtaggataacccattatcgcaacctatacgtcaaacatcgttccatgaatctgtgcttaccggtggcatggcaacatttaatatatggattctgcaaaataagaaggaccaaataagctgcgtcagcaatatgggtaatcaaatacaggaatgggtgtatgacgatcagtaaccaccaataccgcgtgtagcctggacttagaaggttaaccctatctaaggtatggttgatagcaaatacacatttctttgatggaatggacggctgatgggtataaatcgactggatgcataaacttggaatgtgatggttttgtgcctgtaaattatgcccctattactccaggagatactatagaggcaacaggtggaaaaactaaggtcactatcaagatattcaagaacaaagcagacggtgactggtggctgcactttggatatgataatcgaaaccttacccgtgtcgggtattggcccaaaattatttttaaaagttaggcagaccatgcaaactacataatttggggtgggttcactggattatactctggggatgctagtcctgcaatggggaattggacactggccccggagaaaaatccgcatctgtcctaacctatcctcttcacctctcggatgaccaaggtgtctgggagcctgctgcaggccccaatggccttggagattataaatttca

SEQ ID NO: 4395 - DNA, 761 bp, Triticum aestivum
  Clone ID: PAT_TA_4395
gttgatgggagagtattgtctttacaagatcgagtagctgtcgctctggtaatgctgaactctggtgtgtcacctgttaccgtaggactatcccttggtgtgaacgagacaactgtctcgctggtaactcaggtgtttgtatgaagctatgtgcgagcgagcaatgcaccacttgcgttggccaggctccgctaaaatggagaagatcaagcgcaagtttgataagatccatggcctcccaaattgctgtggtgttgtgcatacagcccacatcaaatttggaatgcaaaactgtgaccatgaggagaatgatggcatcctaatgcaagctctcattgatccagatatgaggttcacaaacatttgtttggggctgccaggtagcatgatgaacaaattgagcgttatgcacgactctgatcttttcaagatgggcgagaagggtacttcgctgaatggtaacaagctgaaggtaacatcaggtggaggattagaaattggggaatacataattggtgatgcaagatatcctcttcgtccctggctccttacaccttaccagttggagaatgaactctcagattcagactccaaagtggaattcaacaggagacactctgcagctacagccgtcatgctgagggcgctggcaagcttgaaaggcacatggaaattgcctgcaggaaaaagggtggctttcaaatattaaccttggcatgcccttgccaaccggacaaggcctaatttgcctaacaaactgg

SEQ ID NO: 4396 - DNA, 782 bp, Triticum aestivum
  Clone ID: PAT_TA_4396
catctacctacctacgtgtgccccagctgctagcttgggggtggcctagtgtccagcgagcaagggaccaatggacgcgcttcgcctgcgccagcggcgggggcgcaggctcctgagcgacgaggagaaacagaccgcaagggccctcaccgcgggggccgacgcggcgcccgtgggcgccggcgacccccggccgcagcccgggggcggcggccgccacccccacccatcgccggcgtcccggcaaggccgacgcccccagccacccccaccgccggggagcacgggacgcccggcgccctggcggatgtgccggtcgaccgtgcgacgcaggcccagccgccgcgcctccacgccgctcaccttcttaccgtacacccccgccccagccacctagccccccccctgcgccaccgcctccgcgccacccccctccgccgccatcccacccgcgcccacgtcaccctgccctccctcgcccgcccgctcaccctcactctctcgcccgacccctcctccctcggcctgccccccgtcagcgcggcaacaatgtgagggtcccactggttcccagctagccggcattctggcgttcctcttcttccttgtcgacggtgcttgaagcattccggcctgcaaccttgcctttcggggcccgaccagttaaatcaacgcacaggtcgatggttgtccgcggtatccgcaggttttttctaacggggacttacttaacctttcacagtcgcccatgaagctttttcggcaacctggccattattccc

SEQ ID NO: 4397 - DNA, 766 bp, Triticum aestivum
  Clone ID: PAT_TA_4397
ccagatcgttctcgatggcagggaggagcacggaggcggcgccgacggtggtgggcggctacgagctgcgcgagcgcctcggcgggcggcccccggccacgtcggtgtggcgcgcggagcggctctcgaccggcgccctcgcggtcgtgaagcaggtgcggctggccggcctcccggcccgcctccgcgacagcctcgactgcgagctccgcttcctcgccgccgtcagacaccccaacatcatccgtctcctcgacgtcgaccggaccccgggctgtatctacctcgtgatggagctctgcgaggggggagacctggcggcctacattcagcgcgccggaggcagggttgaggagggcgtcgctaggaacttcatgagacagatcggagctggcttgcaagtgctccctcggcaccacgttgttcactcggacctgaagtctgagaacatcctgctctcttgtcctgacagcgatgcgatactcaagataaccgatttcggactgtccagggttcttcatcctgggggagatgcggagacagtctgcggcactcgtttgtacatggcccctgatgtcatgctatttcagaaatcgatgaccatgcacacttgtggagttttcggtgtaaacctgtatgaacttttggatggctatccaaccggttcgaggttgaagtaacgttcaaatgctttaatgcttaaacggaatccagaagctcctttccgattttccgctacgagtgaccccatattttcatccttgcc

SEQ ID NO: 4398 - DNA, 761 bp, Triticum aestivum
  Clone ID: PAT_TA_4398
aagcgtgtgatcgagaggttcgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccacccccaagtactcgaaggcccgttatgaggaaattgtcaaggaagtctcttcctacctgaagaaggtcggatacaaccctgacaaggttccctttgtccccatctctgggtttgagggtgacaacatgattgagaggtccaccaaccttgactggtacaagggccctacccttcttgaggctcttgaccagatcaacgagcccaagaggccctcagacaagccccttcgtcttccccttcaggacgtttacaggattggtggcattggaactgtgcctgtttgccgtgttgaaactggtgtcatcaagcctggtatggttggtacctttggtcccactggtctgaccaatggaggccaagcctggtgaaaatgcccaccagtcttttctgg

SEQ ID NO: 4399 - DNA, 787 bp, Triticum aestivum
  Clone ID: PAT_TA_4399
ggaaaggcgtctcgcctctctccgcgcaaccgagccttcgccctcgtcctccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcacgttccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctctgccttgaccgtatcaggaagctttcagacaactgcactggtctgcagggattccttgtcttcaacgctgtcggaggtggaactggctctggccttggtttcgctttcctggagcgtctctctgttgactatggaaagaagtccaagctttgggttcacagtttaacccatcttccccaggtcttccctttctgctggttgagccataccaacagtgttccttgtccaacccacttaactccttgagccacaccgatggctcctaaccttcttgacaatgagggccatctatgacattcgccgcccgttcccttgacattgatcgcccaacttacccc

SEQ ID NO: 4400 - DNA, 1994 bp, Triticum aestivum
  Clone ID: PAT_TA_4400
ccgaaacctcctcgcccagacatggccaccggcggcggcggcggcggggagggcggctcggccgcggccgaaggaggcgacgggggagcgggggcggggcccggccgcaggctcttcgtggcggtgcacgtgggcgcgggcttccacgctccggccaacgagcgggcctaccgccgggccatcaggcgcgcctgcctcgccgccgccgccgtcctccgcgagggcagcggcacaagtcttgatgccgtcgcggctgccattcgagtgctggaggatgaccccatcacaaacgctggccgaggttcaagtttgaccgagagtggtcaggtcgaatgcgatgcgagtatcatggatggaactacaggttcttacggagctgtcggagctgtgcaaggtgtaaagaaccccatccaagttgcattgcacttggcaaaggaacaaatgtcaggcccttcactgcttggtcggataccccccatgtttttggtcggcgagggagcatgccaatgggcaaaatgtaaaggaatcgacataatcgaagccacgtcggaggataataattggttagtgactgagaatgcaaaagcacagtgggtaaaatacagtgcgttgcttgctagtgccaaggaattggttaatcgctccactgcttctgcttcagaatctagttcaatacagttggacccatcaggagctcaagctgataatttgaacaatgcaaaaaagatcaagaaagaattcagtagatcaatcatgcaagatgatcaagattgtgtaatggatactgttggtgctgtatgtgttgatgagtatggaaatgtagcatctggcgcatctagtggtggcattgcactaaaggtagatggccgggttggattagctgctatgtacggctctgggtgctgggcttcatccaaaggaccatttggcacaccattcgtaattgggtgttgtgcaaccggagctggcgaacacttaattagaggatttgcttcccgtgaatgttgtatctcagcatcactgtcacagtctggccctgcttcctcctgcaccaaagttttgcgctcggtggtgcagagcagcagcgagatgtctcacgacaccggcgctgggctcttgctagttcagtctgaccttacaaagagaggggaatcgcctctactcgaagccgtcgagcgaaggatgacgatcagctgcccgtgttgttccccccttttttttcctgggaaacttttctgttatgttgaggggtgaacagattctgtgtgtgccatagataacttgttaatgggcgatcaatatgatatcccccatccattctgccccattgctgacaaaggatgccctgagcgacacatcgacaaataacttccaaactttgtgtatataatgatctcgtcgtacacaagaccttttgctaacctcaacggactgacgaacatgaaaaacatgtatcttttgcatcacatctattttagaaaaagaatcagcattacatttgcaactcaatatgtatcttttcaggtcacagtctggccctgcttcctcgtgcaccaaagttctgcgctcggtggtgcagagcagcagcgagatgtctcatgacacgggtgctgggctattgctagttcagtctgaccttacaaagagaggggaattgcctctactcgaagccgtcgagctcgttgccgcctactcatccccatcgtttggcatcgggtatttcgggagcaatatgaacagcccaaaggtttcaatgcttagggattcaagagcaccatccggctccgtccggcatttcgctacccgtgtgaatttcggtgcaccgtcgagcgaaggatgacgatcagctgcccctgtggttccctttttcttttcctgggaaacttttctgttgtgttgaggggtgaacagattctgtgtgtgccatagatccaaactttgaatatacgtcgtactcgtaactgataacaattcctggctttgatccagtcaaa

SEQ ID NO: 4401 - DNA, 771 bp, Triticum aestivum
  Clone ID: PAT_TA_4401
acgaggttccaaccaacagagccgatcacacacgctctcctcgccgccaagatgttcgggttcgggcaccaccacatggaccaggcgccggcggtgacggtccccaaccagatcttcaagatctactgtcgggcctcggaggactactgcctcgccgtccgcgactgcgaggtggtgctcgcacccggcaaccccaaggacgagacccagcactggctcaaggacatgcgcttcagcaccaccgataaggacgaggagggcatgccggccttggcgctcgtcaacaaggccaccggcctcgacgtcaagcactccatcggccagtaccaccccgtgaagctggtgccgaacaacccggcgtactaggacgcgtcggagctgtggacggagagcaaggacctgggcaagggcttccgctgaatccgcatggtcaacaacaaccggatgaacgtcaacgacctcaacggcgacaaggaccatggcggcgtgcacgacggcaccaccgacgagctctgggagtggatgcaggaggacaacccctgctggaagatctggacctggaccgatgcgaacgccgcccgtcgagttcggcgccactcaggtgaacaaactccaacgccatgggttggtgacccccccatgcatgcctagcgcgaacttttgtaggctcggctaggattacagcctaacggtccgggaacggcacctactggtttagccccaaattatctcagaggataacttactatccctggatcaagggacatgacg

SEQ ID NO: 4402 - DNA, 445 bp, Triticum aestivum
  Clone ID: PAT_TA_4402
gaaatcttcaaaaccttgaaatactgaacatgtccagcaacaatcttcatggtttagtgccaaaggagatctttagaattccaacactaagggaaatttatttatctttgaacaacttcaatggacaacttcctaacgacattggtaatgccaaacaactcagaaatctagaactctcttcaaatagtctatctggagatattcctagcactctgggtgagtgtgcaagtttggaagatatcaagttggactggaatgttttcagtggaagcatccccacttcattaagcaaaataagtagcctaaaagttcttagtgtttcccacaataacattactggatcaattccagtgtctcttggcaacctacaatatcttgagcaactagatctgtcattcaaccatctcgagggggaggtcccaaaagaaggaatcttcaagaatgt

SEQ ID NO: 4403 - DNA, 1027 bp, Triticum aestivum
  unsure (1)..(1027): unsure at all n locations
  Clone ID: PAT_TA_4403
gnnnagaagagttannaccttactcaanttaaccctactaaagggaacaaaagctggagctccaccgcggtggcggccgctctagaactagtggatcccccgggctgcaggaattcggcacgagccgcaccgagccactgcctcccgattctgcgctctctgccgctcccgtcctcccgatctcgccggctcgcggcctacctcgccggaagccgtcgcccccctgcccgccccgcccgcccggcgccactccggccaccgagctcctgccagccggcgcccgccgctcgccgggtgtcccgcgatgagcaagccaggcggcagcgctggcggagccacggcgggcccgacggcggcggccgcggccgccgcggctcagaagcaacgggcgctcctccagaaggccgacgccgacgtcagcagcctcgtcgacaacttctccgccctcatcaacatcgcccgcgtcaacgacccgccggtgcgcaactcgcaggaggcattccagatggacatgcgcgcctcccgcatggtgcattcagcggactctctgttgaaactagtatcggaacttaagaggacagctatcttttctgggcttgcttctttgagtgagaatgttgataggaggattgaagtgctcagtcaacagtcagaggagacagagagaatgctgtagaggattgggcaggaagcagcaacaagccttaaggagttggaggcacattactacttcattgttgtgcggactccgctctatgattgaggagagcagcgggcgcttaaggagcctgtgcaaggtcatggtccgatgtagcttgggtaaaaaatcatcttatactatctagttattttccaacgatgttgcattagccattgggataccgttctagttcttactcctgcgtcctaaccttcctctagctggttttcgaaaattgctcccatgtctgcttccaaaacaatgtccttttccgctttctcctatatctcccttcacttcctgctcattatctctgctgtatatccc

SEQ ID NO: 4404 - DNA, 837 bp, Triticum aestivum
  Clone ID: PAT_TA_4404
cacgccctgcacatccccccctccatcctcaacattcatttttattattatataaatctccaaaaaaggagccagagcaaaccgcaaatcgacccccgtggccgtgggaagcaggtcgtcgcctcggtcaaatccggcggcggcggaggagtcgtgggccgcaaggccgggctggcctgaccggaccgccgcgcaagtgacccgaccggcgggatccttcgggccggcgccccaggaggatattcttcgcgctgggggtgcttgatttggatgaaaggagcgcgccgtcggcatgggtaccccctcgcagggctcggctgccgtggcggcggcccgggtcgacctctgcgcgctcgacctcatgcccgtcttcgccaaggagatgattgccggcggggtcgccggtgctttctccaagaccgccatcgcgccgctcgagcgcctcaagatattgctacagactagaacaaatgagttcaggtctctcggagttctgaaatccttgaataaactgagaaaacatgatggtgtcttgggattttacaagggaaatggtgccagtgtgttaagaattgttccttatgctgcattacattatatggcgtatgagcgatacaggtgttggatcttgggtaactgccctacacttggcacaggacctgtggtagatcttttagcaggcttagcatcaggcgggactgcagtcttgtgcacttaatccttggacttggctaggaccaagcttgcattcccagttaataacccagatcaaccctagcaatgggtttgaaagggcccaatggctccaccattctatggaaggaaataaaagatgtc

SEQ ID NO: 4405 - DNA, 718 bp, Triticum aestivum
  Clone ID: PAT_TA_4405
gacgcgtctgccaatcgtgcgagcgctccgcttccgccgatccccgcgggccagcgataactccttgattttcgggttttttgaggaatccctgattttcggtttggtccacgcgaaagtgcctcccgattgagtcccggccctgtctttaggccccaagaagaacggcgagagaacagatccgcagaaacaacgttgcgctgccgctcctgccgtgcgctccccacccccgatccgtcccgagccgaccctgtcttcgatcgccgccgtcgagctcctctgccggacaccatggctccgtcagaccttccctcgcgagtgacggccctcttcccgaccagatcggcgacggggacgaccggtgatgaacacatgcctgccccattcttaattctcccgggcagtctgggatgcagatgccgtcgccattcttccgcacagctgagtacgcggaagtcgctgttgcctgcaactcaaccggctccatcgagttcccctgcgaagttgaggagggttcgttggccggacaatcgcatccttctgcttggcctttaccacagggtcgtcgccatcttcccgcaccacggaccaccttttcccgggttctttacggctctacccacgggtcagcaagggcatcccaccgcatgttctctttacatgaatagggaaagcttgataaagggtgttgggaatccctatattgaaatgcccctcg

SEQ ID NO: 4406 - DNA, 647 bp, Triticum aestivum
  Clone ID: PAT_TA_4406
gccctcgccaccggcgttaaagcccaccgcccagcccccgcgcccgcatatccatccatcttgcaggcttgtagccaggtagccagccaagaaagcagagcggcactcctgaccagcacagcacccttcgatttggcagcggccgggcgagggcgagggcgagatggaggggtcgtcgtcgtcggcgtcggcgtcgatgggggcggcggcgagggcggcgcgggcggcggcgaaggtgtgcggcaaggaggagaaggtggtgggcgtgcagaaggcgccggggagctgcccgtactgcggcggcggcgtggaggccacggacgtggaggccaagtgggtgctctgcttcctgccgctctgccttaagaacaagcgcaggttcgccatgcaccgactgcgcccgccgcctcgttacctaccctggcattgctcaagactagctgctgcttaattagccctttcttttccatactatctcattctccggcccctcggtttgattctttggagattgatcccaagaactggcgattttcgttagatgccagatcgaacaagctggaggtcgaacgatgtgctgtccggccggctgttttccgtgcctgccgatccttgacttggaaattctgccttgagcgttttctttg

SEQ ID NO: 4407 - DNA, 784 bp, Triticum aestivum
  Clone ID: PAT_TA_4407
gcggccacaacccacacttagatcgatggccatggcgatcaagagcactctccaatgcgtagtgttcctgatggcgctcatcacgacccacctgataccgcctgccgatgctgatgcgggcagcccaaaagttgccatggctagctcgggcgctggttcaagcttccggctggtagcccaccatgactatgcgctgcgcgacgacggcttcctccacgtccagagccggctggacgaccttcttccatcggaggcgaacgtcaccaccctccgcccaccagtggcctcgccgatcgatatggccttcagcgtggtcgttggcttgggctcgggcaaaggccggcacgactacaacctcaagctcgacgcctcggctgccccccgccggcccccgtgcagcccccgcagccccaggccgcctcaccccggccccccgtgcgccccctggccctcctccgcctcccggccgggcgccgcctcgccccggggccgccgcccgccgtacccctcggcgcccgcggcgcgcccgcgcgcctgccccctgtccggcgagcgcaccttctcgggcgtcggccgccatgggtaggagtgcctccccagcgcgccagactcctggcggcgctccggcttcgcgcgcgcgcactccggcctgctcttcagccggcgccgcgaccgcccggccgtcgccccccagggggaccacgccccccttccgtcgcacgccggtcggccggcccctgcccagccccgggtctccgactggcttttttttcggcggggcgag

SEQ ID NO: 4408 - DNA, 819 bp, Triticum aestivum
  Clone ID: PAT_TA_4408
gaattcggcacgagcttctcttggcccccttggtctcgagagcaagcaagaagacgactagtagccgctagctagctagcatgcagccgcacaagggatagataagagccgggcagacagagagcttcttcttgtccaagcttcagatcgattccggccaggcaaagacacacacacacatatgagatagtgaggggaaatttgctgctagttccaacaccaggctaccaaaagggaaagatttccctgttgccggtgagcagctgaaagggtgaatctgagcggcgatggcatccaattcatcggcggcggctgtcgcggcgctgttcgggattagggaagggcaccagcaggaccagatgaagccgctgctcgcccagcaccagcggcagcatgtcgccgcgccgcccagcgcgctgcagacagcggggccagaccaggcggccgcggcggcgccaccggtgaagaagaagaggaccatgccagaccctgacgcggaggtgaacgcgctgacgcccaagacgctgatggcgactaaccggctcgtgtgccaggtatgcaacaaggggttccagcggcagcaaaacctggagcagcaccggcagcgggcacaacctgccgaggaagctaaacccgaaagaccccgaccaagtgcaaccggcagagtcgaacctgtcaccggagcctacctactgtccaccacgaaactggccaagcgcagggacgaacctaccggccattacaaagccacttctgccgcaagccccgcctactataaaccgtaaatgccacaagctcatccaagcgtctaccacgccg

SEQ ID NO: 4409 - DNA, 1199 bp, Triticum aestivum
  Clone ID: PAT_TA_4409
ccttttatttggtgccctaagagaacattttgatcgatttactgcatccctaatatcggataggttctggaataaaaaggttcagattaattcatctgtttttggagcttacgaggttataaatattacctatccagggctgggacctgcaccaccagctatgtcatctcttacgtcaggtcctccaggaaatgaagaatatcctataaccgcagatgtgcaccatcagaagaagaaattagatagctggatcatcgtggtagttgcagggtcctctctggtactaatcatgggatgcattgcgctcattattttaatagtaaaatggaagaaatttatgcgctttcatgaagctggaaaccctgtgatcaccccgtcagttaaaagaagacatggtggcagatctcagtcagctagcttggtgagctctgcatcagcgtcaatgctctcaacagtggccacttgtgccgcatcagtgaagacattttcgcttgcacagcttgaaaaggctactgatggttttagttcaagaagagttttgggtcaaggtggatttgggcgtgtttatcacgggaccatggatgatggaaacgagatcgctgttaaaatgctcacaagagaggacaggagtggtgaccgtgagttcatcgcggaggtggaaatgctcagtcgattgcaccatcgtaatctcgtcaaattgattggcatttgcactgaacgtgcaaaaaggtgtcttgtttacgagcttatacgcaacggaagtgtggaatcccatcttcatggtgctgacaaggataagggcatgctgaactgggatgtcaggatgaaaattgctttgggtgctgctagaggcctggcgtacctacatgaagattcaaacccacatgtcatacaccgcgacttcaaaggtagcaatatattgctggaggatgatttcactcccaaggttaccgattttggattagcaagggaagcaaccaatggaatcaatcccatttccacaagggtaatgggcactttcgggtatgttgctccagagtatgccatgacagggcatcttcttgtcaagagcgatgtctacagttatggggttggcttgctggaggcttttatcagaaaggaagcccctaggcattttccgacaccatggatccttgagaaccttgtgactttgggcttcgtcccttttctaggcaaac

SEQ ID NO: 4410 - DNA, 528 bp, Triticum aestivum
  unsure (1)..(528): unsure at all n locations
  Clone ID: PAT_TA_4410
ccgaggctagggttccgatccgcatctcgccgacgtcgccatggacgacttcttcgacgaggacggcgagcagctcatggaccccgacgcccgctccccctcgcccgagcgcggggcgcagccctacgacggcctcgaggacgacctcgacgacgacggcgccgactggaaccgcgaccgctccccgacccccgtgcacggcggcggcggcgacgacgggtcctcctccaggccccggaagcgcctcctcaagaagggcggnggcgggaagggcgacggcggcggcggcatgcccgccgacgacctggaggactggggcgaggacgcggccgcggggctggccgacgacgacgtgggcggggacccggacgccgacaggaagaggaaggggtcctcgagcctcagggacctcgcgaggggcggcggcaaggacaagcatgagaagaagaggaggaaggaggacgtgggcatggtgagggagaagaggggctcgtcttcgggcggcaagggctccggcggcggacgcgg

SEQ ID NO: 4411 - DNA, 1154 bp, Triticum aestivum
  Clone ID: PAT_TA_4411
ccacgcgtccgcacaaatggagcctatgctgggccaggttagagtgcagaaccgcgccaggccaccacacgggagatgagctgaaccgtaacgggcctagcccgaagtggccacagatcgagaaatctcttcctccccccttcgtcgcaaggaaaaacctgctcaaacccctcatggccgccgccccgtcaccggcgccgccgcggatcctcctcgccggcgacgcccacggccgcctgcaccagctcttcaagcgcgtcaaatcggtgaaccagtcgacagggccgttccacgcgctgctctgtgtggggcagttcttcccgcccgaggccgccgagggggacagcccgccgggggacgtcgcggccgctcgggggggacgggccgccgtgcccatcccgacctacttcaccggcgactacggccccactgcgcctcgcctcctctcgaaggccgctgctgacgcccgaggattcaaccccggtggcatcgagatatgccccaacctattctggctcaggggcagcgccctcttcaacctccacggtttatcggtagcttacttgtcaggaaggaaagggttaggagggcctggctgctatagccaggatgatgttgatgccctgcgggctcttgccgaagagccaggaattgttgatttgttcttgactaacgaatggccagctggagtggtggatggcgctgatacttctaaggtgcctcctcaggtcttggatcctcaggggtatgatcctgttgttgccgaattggttgccgagattaagccaagatatcacattgcaggtactaaaggtatattttatgcaagggaaccttatgtgaatgattcctctccccatgttacccgttttattggacttgctaatgtgggaaacaaagagaagcagaaatttattcatgcgatttctcctactccagcatccaccatgtccagtgctgatattcatgcgagacctccaaatgctactttatcaccatatgctgctccagcaaaatctgttcatgttgaagacacttccaagcgtcctgctgaaagcactgatttgcaatattggccgtatgaagtcaagccggcacgaccagggcaaactgatggaagtctattgggttcaaaaatacatcctcagggtccg

SEQ ID NO: 4412 - DNA, 792 bp, Triticum aestivum
  Clone ID: PAT_TA_4412
tatgtacctacatagtacagccatggcccccaccgtgatggcctcgtcggccacctccgtcgctcctttccaggggctcaagtccaccgccggcctacccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggaactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagttcggcaaggcctaaacagcttactcacgacaggccatatataaagtgccattgcaggtttgtcaactctgacattgcttatggggtttccttctccatttaactttcttatatgttcctaagaatatgtgtatggccctgttcatgtccaacatggcttgagaaagcatgctcgtttgagaaggctaatcgggggcttaggaatatgaacgggacgccttatatttatacaatatgtacaaccatatccgttttca

SEQ ID NO: 4413 - DNA, 777 bp, Triticum aestivum
  Clone ID: PAT_TA_4413
cctccccccgccgcgtctttgactccatcgcctcctccctccccctccctcctcgtcgccggccagccaggtagttcgtagctccagcagccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaaggctgagcgtgagagaggtatcaccattgatattgctctgtggaagttcgagaccaccaagtactcgtgcactgtcattgatgctcctggtcaccgtgatttcatcaagaacatgatcactggtacctcccaggctgattgtgctgtgcttatcattgactccaccactggtggttatgaggctggtatctccaaggatggccagacccgtgagcacgctctccttgctttcactcttggtgtgaagcagatgatctgctgctgcaacaagatggatgccaccactcccaagtactcgaaggcccgttacgatgaaattgtcaaggaagtctcttcatacctgaagagtgtcggttacaaccctgacaaggttccctttgccccatctctgggtttgagggtgaccacatgaacgaaaagttcttcaaccttgactgctaccaagggcccaaccctgcttgaagccgcttgacccgatcaatgagccccagaag

SEQ ID NO: 4414 - DNA, 816 bp, Triticum aestivum
  Clone ID: PAT_TA_4414
gagagagagagagagagagagagagagagagagagagagagagagagagagagagagagagagagagagagagagagagagagagagagctcaactgtgtcagatagtgctttctggctgtcaccaggtcaatgccaaatgcccaagtctataaccttcccctttgggtcgttctaatctagcctggcccccaattgcatgcttttgaaataattaggagcagaagaagaagaagagaagaagttcaatctctctctatatatgatgcacctaccaagatcagtttatgaaaattctatatataatccaagcttttgaaataattaggagcataagaagaagaagaagatgagaagaagttcaatctctctcttgctctcttgtggaggaggaattagaagaaggatgaggggagtgagcatgttgactatggcgcgcgcggcgtgggcggcggtgcggtacgcggtggtggtgccgctgctgcagctggccgtgtacctctgcgccgccatgtcgctcatgctctttcgcgagcgcctttacatggggcttcgccgtcgcggcgctctggcttccgccgctcgccgtcgttaggcgccggcacccctagctgggaacaaggggggaccacgactggcggtgcccgtcgacctggaattccctgcgcgcgaaagggaccttgcccaatggcccctgggtcaaattccccatggtttaacgcagaagcagggtgtacctgtcttgttcattaggcgtcggctttccggccctgcggtggctccgctcctccaggcctggtgatacccagttgctggc

SEQ ID NO: 4415 - DNA, 722 bp, Triticum aestivum
  Clone ID: PAT_TA_4415
cttcaaatctcatgcatctagagggtctcgaatttctaacgcttcttgagaaattatgtgcggaagattgttgcttattggaacagttcatcgatttctcctgtctccaaaacctaggtgaagtatccattcatttttgcaaacagttgacagaagtgaaagggcttgagagtctggagtttctggaatcgttgagcatcgagcactgaacattgctaccgaagaagctgaatgcggcccgactgataagacggaatacgctaactacgatgacaccgatgctatcggcgtcagagatggggagccaatcaactgactgtcggcaaccgaaccgggagaagccccaccaccaccggtgatctgatccatggcgacgaaatgttcgagaattcgctgcatgcagtccacgttgtaaagggtctccatcgaatgtgagaagttaggcatcagaagatcatccagagttgcttgatcgagctgcatccctattctcttctctaaactcgacaaacaggacgggtccgccttgagaaatattgccgccttcagtaagctgaagagaaatctcgtcgaaactagacacttttgtgttggtagcaatctgtcgatctcttcaagtaaagttcgctggacttcctctgatgcttgagttcccaaagccaatggcatcagtctagcgcttagactgtttagaagcaccttgaaggcctattaaaacccgc

SEQ ID NO: 4416 - DNA, 1244 bp, Triticum aestivum
  Clone ID: PAT_TA_4416
gcctgccgctgctacccaggcagctgctgctcctggtgtatgtgctcgcccggttggtggttcctggagctcaagcaattaacctcattgggaagcaacggtgcttctattaaggcaatccaggagggcacgggtgctacaataagggttatatcagttagatgatcgagatcggcctttctatgtaactgacgatgagaggatagttgagatacagggtgaaacagagaaagttctaaaagcactgcaagcagtttctaatcatctccggaagtttttggttgaccatagtgtacttccattgtttgagaagactaatgccccagtaagtcaagatcgcagtgctgaaacttggaatgatatgccacatcattcaattgtttctacacaagtaaatcaacaacctgaagtgcgtgatgaatatgttcttccaatgaaaagggaccatttgtatcttgaacgggaaccgctggtagaacataacattcatcgctcaggtgtgtcattatatgggcgagatcctgccttgtcagcattacgaccttctggaatgcatggtgctggccctctacttacacagataacacaaaccatgcaaatcccacttacctatgcagaagatatcataggagtcaaaggagcaaacattgcatacatacgggcaaacgttggtgctgttgtcacaattcaagagagtttgggaagccctgatgatataactggtgaaataaaggggacgtcgtcccaagtacaatctgctcaacagcttatccaggactccctggctacgcacagagaacctgtgaggagcagttaccccggaggattagatccgttatataggtccagctacccgtatggcagctcggcctacccgtcatcatcgctgccatcttattctaacatggacgggagtggatattcatcgtcaggtcttggtggttacggttccacttaccgctacttaagatggttgctgtttgccatcaagcttgcggccaccctgtctccactcctgggtcatcgttgtgtatgtcagcaatagttgctctgctggcttcatgttcctcagggtggtactattatagtcgtatcgaatcggggtgtgtgatttagtgtctacttgatttgtagatgttcttatttcgaggaagtctgttctagtctttttgtgtgctgactgatttgatgataatctgcctgtgccgaaaggaatgtaaaaaaaaaaaaaaaaaaaaaaaaaa

SEQ ID NO: 4417 - DNA, 746 bp, Triticum aestivum
  unsure (1)..(746): unsure at all n locations
  Clone ID: PAT_TA_4417
acccgagactgcgcgcccgatgtctggccacggcaagcagcagcagctcctacgccacccagcgctcgccgccggccatggcagcggcagcggcatggggaggcgcaggtacctcgccttcctagccatcgccgccgccctggtcgcctcctaccacctcctccacgcgcccaccccgtcgtcgcgctaccacgcgctcttcctcacccttggctccaacgccagcgctgccgcgcacctccgtgcgctcacgctccgcccgcacgtcgccggcaccccggccaacgccctcgccgccgagtacgtccgcgccacgctctcctccctctccttccccacccgcgtcacgccctactccgtgctcctctcctaccccctccaccgctcgctctccctctccgcgcccggccgcgccaccaagtcattctccctcacccaggacacctaccccaacgacccctacgccgaggcggcggcggaggtcgtccccacctacttcgcctactccggctccggctccgtcaccgccgaggtcgtgtacgccaactacggcgacaggaaggactacgcctacctcgcctcccgcggcgtggacgtcgcggngaaggtcgtgctcgcgcgctancgggacatccactgcgaggacatggtgcggaacgctcgcgacgccggcgcccgcgggacgatatttataccgacgccaagacttttgggggcccccggccaagtgaaacgcagatggttcc

SEQ ID NO: 4418 - DNA, 819 bp, Triticum aestivum
  Clone ID: PAT_TA_4418
cttccctactacaatagcgatgcctgtggaacctgaggcagagctcaggagatataaggattcactgggcaagtattttgagaaacgaggaagagcagcagtatattttgagtgggtttcacagcagtctcgccatgcaaaccttcaggctgtccctgtaccattgtcaaaggcagctaatgttaagaagatctttcacctagcagcccaacgactgggatttgaattttctgttgtgaatccagatggtgatgctaaccaaggtagagaactgttaaggtcgcagtatgacggcaaatcgggcttgttttatgtagagctccctgatggcacactactcttgcatataattgacagtggtgagaagttccctgcccagtttggacgtgaggtattggcgggattgttaagcatggcagaccgtgcagactggaggaactgtaagctttccaaggaagaagaagttaagatggtggatgattttaagcaagggttccacgagtttgatcctgctgaatgacaacatgctcaagccacctatctcttggagttgatgatgcatgcctgatgtccatgacttcttaagctaagccactgagacaagtcctagcgtgtcccaacaggtgagccggccatgatcgaaaactgctggggattcgtggtttgtagctgaccgtacgtaagttggccaggtataacttcaagaaaggagaatcggacagtcacaagaaatttcattgatgaggaaacttggcagttgatgttggattccagcctttttttttaaccctgcctttgagtttggaccggtttcctttt

SEQ ID NO: 4419 - DNA, 706 bp, Triticum aestivum
  Clone ID: PAT_TA_4419
tctgggtcggttcgggttcggttcgagagagaggccgagtagctagcctagtctagggtttcggtagagaggaagggagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggccagcgcggcggtggcggaggctacggcggcggcggtggcggctacggcggccagggcggcggcggctacggccagggcggcggtggcggctacggtcagcgcggcggtggctacagtagccagcgtggtggcggcggctacggcggcggcggcggtggctacggctgccagcgcggcggcgactccggcggtcagtgtaggaactgaccggtggagccctccacttttcatctatttaccatttcggacgtctttcgtcatcaagttaatcttagtggcgaagccgtcgtgtcctgtgtcagtcactcttgagttcgcgtgcgccgttc

SEQ ID NO: 4420 - DNA, 736 bp, Triticum aestivum
  unsure (1)..(736): unsure at all n locations
  Clone ID: PAT_TA_4420
gttctcccacctcccaccgaaaccccgcacctcccaccttccaagcggcggcggcagcagcgtccatggcgcccaaggcggagaagaagccggcggcgaagaagcccgcggaggaggagccggcggcggagaaggccccggtcccggccgggaagaagcccaaggccgagaagcggctgccggcggggaagaccgccgccggcaaggagggtggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcgctacaacaagaagcccaccatcacgtcccgggagatccagacctncgtncgcctcgtcctgcccggcgagctcgccaagcacgccgtgtcagagggcaccaaggccgtcaccaagttcacctcctcctaggctcctgccttctttctctgcgagtccccctctttccttggtcctcgnggngtgatgaattggatgtacccttgagatagaataatgttcgaccggcaatctggagaaattgcgccattacacacggtaaatggaactggaggaacactggtcaacactgtgatttcgccggaaaatttgaagaaaagcttttggtgctgctttaacaaaaa

SEQ ID NO: 4421 - DNA, 796 bp, Triticum aestivum
  Clone ID: PAT_TA_4421
cggacgcgtgggcggacgcgtgggtttgaggccagcattccttgcagtgcacctgctgctgataaaggttatccggtcaaggagtctattattccttcaaatggaaagaagaggctagaattgcctgtgcagaaaaacatattgacaaattacttctgcttagcatcgcttgaggcaaaacggaagttcagggcacctaaggttacacccaagcaaaaaatgttgaatgaatcttctttgccgagccgtcagactgaacactctggcacccctgattcaattgaagacactagcttgccaatgaataatattcaattctctcagtatagttctgagcattttagctctgaacctcctcgagatgattcaattgatgcttctcaacgtagtactgggcgagccttcccctgggacgattcacatagtgtttcaccacactgtagttctcgtgatattggcaatggtcctctttctagggatcaacgcattgaagatgcagaggttgaggtcagttattgcaacacaagtccaatgccaataagtccttgcttagagaggacttcgcctgggatagcagatccatcattagtttctcacaacacggagccattgagaccagtgccacattatgctgaaagttatgtggctcctactgtaaggagttcatacttcaagaaggataagagggttttcacaaatcaagcagaaaaccagtttgatgatgatgatgataacgccgagactggcacttccactctttctggagttcaaccggggaaccctggaggtgttgtga

SEQ ID NO: 4422 - DNA, 749 bp, Triticum aestivum
  Clone ID: PAT_TA_4422
atctggatgttgctcttaacgccaaaattggagctgaggtgtctcacagggaagaaagggagaagttactaggtgctcttaatgaaacaaactgtgccctttccgatagtaagagcaagctttgtgagaacgaaatcactcttcatcagcaaaagcaagaagtagatcatctggaagagctgagagttgatatggagaccaaactcaagggctacgttgatgaaaatgatgtattgaagagggatcttgatgtcgcaactattgctaaaatgaaagctgaggagatccacacagaagaaaaggagaagctattgtttgctctcaatgaagcaaactttgctgtttctgagatgaaggaagagctggaccaactcaagatcaatattcaccagcaaaagcaagcagtggagtgtttggaaaaaataaaagttgacatgcaaactggactcaagggctattgtggatgaaaacaatgtattgaagaaggatctttgatgtcgcgactattgctaaaatgaaagctgaggagatcaccccagaagaaaatgagaagttcctgcttgcttttaatgaaacaaactttggcgtttttgagatgaaggaagaagtggaccaactcatgaatcaatttcattagcaaaaggcagccctggagagttgggaaaagttaaaagttgaactgccaactaaccttaggggctattctgttgaaaatgggccattaagagagacccggggtttttttttcg

SEQ ID NO: 4423 - DNA, 924 bp, Triticum aestivum
  Clone ID: PAT_TA_4423
gcacgaggccttcgtcttcgccgtacccatccccacaccctccactctccggcacccgcacgctcgccgcgccgtaacccttcttgccatgatgtcttcgtcgccgcccgccggcgccgccgacggcgacatggagacgctgcccctcgccgccgcctccgactacgcctccgtggcctccaccttcgaccccctcctctcctcctcctcgcccgcctcccctcccgcccccgccgcctcccccctctcccgcgcctcctcctccttcgtcgacccgccctcctacgccgacgtcgccgcctcctccccgcgctccgcctcggcctcctcctcctcctccccgagatccgcgcgcgccgccacgtccgagtactcctacatcgccgtctccgacccggagaccgaggccgaggccgccgccacctccctcgtccccggatccgcccccacctacatctcctacctcgtcaccagcgcccgccgcggcgaccaccgccgccactccgtccgccgccgcttccgcgacttcgtcaccctcgccgaccgcctcgccgagtccttccgcggccacttcgtgcccccgcgcccggacaagaacaccgtcgagagccaggtcatgcagcgcgacgagttcgtggcccagcgccgcgcggctctcgagaggtacctgtggcggctcgctgagcaccccgcgatcgggaccagcgacgagctgcgcgtgttcctgcaggccgagggcaagatgccgctgccgagcagcactgacgttgcctcgcggatgctcgatggcgcggcgcgtttgccaaggcagctgcttggggaggaggcgggtggccccgccgcaggacgttggtcaacccgcccaggggcgggagggacctgcttgggggtatttaaagagcctgaaggcgtcctatggccacc

SEQ ID NO: 4424 - DNA, 754 bp, Triticum aestivum
  Clone ID: PAT_TA_4424
cttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggctacggcggccagcgcggcggtagcggaggctacggcggcggcggcggtggctacggcggccagggcggtggcggctacggccagggcggtggtggctacggcgggcagcgcggtggccgcggctacagcggcggcggcggcggctaccgcggcggcggtggtggctacggcggccagcgtggtggcggggactccggcggccagtggaggaactgagcggcggcgcccttcagttttcgatctatttacaattttgtccgctttcgtcagccagttatttttaagttcttgtgtcaattcagtcttgattcctccgggttttgtcgttaaactcccggtgggggtttttgtaccgccaagctcc

SEQ ID NO: 4425 - DNA, 781 bp, Triticum aestivum
  Clone ID: PAT_TA_4425
cggacgcgtgggcgggtcgccggagggtgaaagcagcggccagcggtcctcttcccctcgctcccccccccggtatctcgaggcttctgcagaagcttctgccgaagttagagtgcagtccatctcgaaccttctagaagcctccagggccgcggccctccccgcctcctccagatcccggagaacgcgagcgggggatccacgggaccttcgacttcgagcacctgctgccagggatgccgagcatacaagaaccactgcattttaaacctcaagagcctaaagtagtcgtggcggagaacgagaacgacaagatggttgatgttcaggacaaggaggtcaccatggaaggcctctgctctgtggccgcttacgatcagtggacgcctctctcagtcccaggacagcgcccgaaacctcgatacaagcacggagctgccgtagttcaggaaaaaatgtatgtctttggtggaaaccacaatggccgttaccttggtgacattcaggttctggatttcaaaagtttgtcatggtcaaagctagaagctaaaattcaatcagaatcagctgaaccagcttctgttgctccatgtgctggtcattcactgattccatccggaaacaagattctctcacttgcaggacacaccagggagcatacagagagtctcagtgtaaaggagtttgatccgcaaaccagcacttggtcaattttgcgtacttatgggaagtcaccgagctcacgtggtggtcaatcagtaactcgtgttggggacacttt

SEQ ID NO: 4426 - DNA, 1287 bp, Triticum aestivum
  Clone ID: PAT_TA_4426
gtgtttgtcagcttgtatcatataaagcttactttggcaggggagggtgttgtggaagagatagacttagagccttctcttgccagattgatgctgaagctctggtgtcccttgagcatttatgcaatggtgtagtgaatgagctggccgagccagttgagagaactccagtgattttagttctggatactgaggtgcagatgcttccttgggagaacttgcctgtgttaaggaatcaggaaatgtaccgcatgccatcaatgagaagcatctttctagcattgactagaagcactaatcatcacaaagatgccagtgccatggcccctccttttcctgttattgaccctttcgatgcattctatctgttgaatcctagtggtgatttgatcagcacacaagaagaattttatcagttgtttagaaactatgagtggaagggaaatgctggggatgctccaacagctgaagagctcgtcttggccctaaggaatcatgatctttttctctactttggacatggaagtggaagtcaatatgtctctggaaaggaaattgagaagttagataactgcgcagctgctcttcttatgggttgcagtagtgggacacttcattgcaaaggcggttatgctcctcaaggggcacctttgtcttatttatttgctggttctccttctgtcattgcaaatctctgggacgtctcggataaagatatcgatcgatttagtaaagcattgctgaattcatggttgcaagaaaaatttaaggccgccaagaattgccctaaatgttgccgcccactaacacaagaatttgagtccacaacgattgctgcaaaggataatggtaggccaagacgaaaaggtacacgacaaggtcagaagcagcagcagacaggaagagatagatggcagtagtaactgcttgaattgcaggcccaggagaatagctacgcatataagtgaagctaggcgtgcttgcaggcttccgcttattatcggcgcatctcctgtttgttacggtgtgcctactatcatcaggaagaagtaatggtctgcgctttaatgggagactagcttatccccgcgtggcgccacgccgcgcccgtcgatacggtgcggttatatggattatgtttcttctttgtaaaacatgtttttattttaggacgccagatgatcgcatgaaaaactatggatgtagcaaaaagagatgggaggatgatgcatgtgaacaaacatgggaatacacattgacatatctttagtagggacaatttaaaaa

SEQ ID NO: 4427 - DNA, 752 bp, Triticum aestivum
  Clone ID: PAT_TA_4427
cacaccccgcgccacgagcgccaagggaaccccacccagacgagacaatcaccacgcgggctccgcgacgtacgtgcgtgcgtgcgacaaccggccatgtccaccgaggcgctgctggccgcccaaggcggcggcggcggcgatggggtggcgagccggcgcctgagcatcgacgacgcgctggcggagcacgcgggggagttcgggcggtggcagctgcggcacttcgtgctggtgtcggcggcgtgggcgctggaggcgctgcacaccatggtcatcatcttcgcggaccgggagccggccatgcggtgccccgcgggggaggggcggtgcggcgaccggtgcgccggcgcggcggccgggtgggagtgggcgcaggggagcgcgtcgtcgacggtggccgagtggggcctggtctgcggcgagcggtacaaggtcgggctcgtccaggccgtcttttttgccgggtgcatgatcggcgccggcgtgttcgggcacctgtcagattaattcctgggccggaaggggtcccttccagtgggccggtttccttaacgcactttttcgggtctgttaaccgttgctggcccccagctacaggggtctacggttggtcctccggcttcttcacgggctttagcaccgggcagaattggcctttgtgcctttgacctccgcacggaggcccatggggccctctcggccgtggaaccggccggattggtcagctttttaattttttcttgggcggg

SEQ ID NO: 4428 - DNA, 684 bp, Triticum aestivum
  Clone ID: PAT_TA_4428
tgagttttgtcatcgaaaggtgtttacataagtccaaaaattctaccagcttttggtacggcgcgtcatagaacagataagtgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaaattgttcttttccaaccgactttattcttttcacatttcttcttaggctgaactaaccttcgtcgtgcacacaaccattgtcctgaaccttcaccacgtccctataaaagcccaaccaatctccacaatttcatcatcacccacaacaccgagcaccacaaaatagagatcaatttactgacagtccaccgagaatcga

SEQ ID NO: 4429 - DNA, 263 bp, Triticum aestivum
  Clone ID: PAT_TA_4429
agaatcatagacttctagctcattggatcatagacttctagcttattggagctagttatacgtcgatagcttgttatttttttattctatatttgtgttacctgatgcgaactatttctgattgtaaacctgatgtgaaccatgtttgatcgcaatgtgccaggtttggctctttttgattgtattcatgatttgaaccatgtttacacaaaatttagtaatgctttgtttgaagcattgtataaatattggttatttattta

SEQ ID NO: 4430 - DNA, 698 bp, Triticum aestivum
  Clone ID: PAT_TA_4430
ggatccatccatacgcccctcgctgccgctgtatttcgtttccaccaccccatttgcccccggacccaggaggatcgtcggagatgtcggacaccgatgagcaccacttcgagtccaaggccgacttcggcgcctccaagacctaccctcagcaggccggcgccatccgcatgggtggacacatcgtcatcaaggcccgtccctgcaaggctgttgaggtctacacctccaagactgggaagcatggccacgcaaagtgtcactttgttgccattgacatctttaatggaaagaagcttgaggatatcgttccttcatcccacaactgtgacgttccccatgttgaccgcccaagattaccagctgattgacataactgacgatggatatgtaagtcttctaactgagagtgccaacactaaggatgacctgaagcttcccactgatgatgctctgcttggccagagcaagatcggatttgctgatgggaaggacctgatcctgtctggaatggccgccatgggagaagaacagatctgcgctgagaaggaaatcgctgatggcacgtaagccacttgcgcgtggctgtctaacctgcgatacttggtatctagtgctccatgggcgatcgggcaaccacatacatagcgcttaaagatatcttgcggggggaaacaagttttgcaccatatctgagc

SEQ ID NO: 4431 - DNA, 828 bp, Triticum aestivum
  Clone ID: PAT_TA_4431
gtgcattccgatcccgcaccgccgtccacgcatatcgagtagtttccacctcgccggagaagtagaagcaggatggccggaaggaaggccgccgacaggaagaaggcggtgaccaggtccgtgaaggtcgggctccagttccccgtcggccgcatcgcgcgctacctcaagaagggccgctacgcccagcgcgtcggctccggcgcccccgaatacctagtcgccgtcctcgagtacctcgccgcagaggtcctggagctcgccggcaacgcggccaaggacaacacgaagacccgcattattccgcgccacctgctgctcgccgttcgcaacgaccaggagctcgtcaggctgctcgcccgcgtcacccatcgcccacggcggagtgatcccccacatcaaatccgtgctgctccccaagaagtcccccgccgtcgcctgagaaggagcccaatgtcgcccaagaagaagacccccaccacgtcccccaagaagaaggttgccggcaaggagtattccggcaccatagactacctatcgcgacacccgttatggccgataggcacggtgagcgaagaggctcttctgacatcttttactatcctcacttcccactaaccctctactccccactacccctcgcttgcgttactactaaactctcgctcaattcctacacccaccctccttcgcctactccctccctttctacgtaccccggatcattctacaattcgccccatgcccctaaccccgtttcatctcccaacgcttcccacatacttccctctcccccccacacgtgccatcttccacccaccccttacg

SEQ ID NO: 4432 - DNA, 862 bp, Triticum aestivum
  unsure (1)..(862): unsure at all n locations
  Clone ID: PAT_TA_4432
gagaactagtctgagtttttttttttttttttttataaaattacccgttctttggtcctgtttcgcgcctgttttagacaactgaactaccactgccattgtcataccactggtgctacaatatagtaggagtatgtgccatgacatcacaaaaatttctacctaatcccaaggcttaagctaatctgagtactcacactgcagagacattcattcttctacctgccctaacattactaattactattcacaaatcacaatcaacgccaccagccatgagccaggcaggctaaaacatgatcctgcggtccaatctggatccgacggccgagatcaacgcggtggtcttctcctggagcacgtgcaccacgtccgccatggacggcctgagcccgggggtgtcgctgacgcaccgcatcgcgagctccacgacgacggtcgcctcatcggcgctgtatttgccggtaaaactccggtccaccacatnggccacgttcccctcgctgaccgngggacacaccaccgcggtaagacggcattccggtctcgcggacacggnctcccttccggtcaccaagctcgagcagcagcacgccgaanctgtacacgtcgntttcttgntagccacgccggtgcggaggagctgggggtcgacgtaacccggggagcccatgatggcgcgcccanacgaacttgccgnggcccgccgnggtggaaaaccccggagtgcgcgaagccnaantcgcaaaagcttggcgttcatgttgccgtnaaggangacgttggacccctttgttgtccccgnggatnaccgccggcttgttgccttngnggggggactcanggccggggncactggnag

SEQ ID NO: 4433 - DNA, 867 bp, Triticum aestivum
  Clone ID: PAT_TA_4433
cctcgccccgccgcgtctttgactccatcgcctcctccctccccctccctcctcgtcgccggccagccaggtagttcgtagctccagcagccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaaggctgagcgtgagagaggtatcaccattgatattgctctgtggaagttcgagaccaccaagtactcgtgcactgtcattgatgctcctggtcaccgtgatttcatcaagaacatgatcactggtacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcgaaggcccgttacgatgaaattgtcaaggaagtctcttcatacctgaagaaggtcggttacaacccctgacaaggttcccttgtccccatctttgggttttgaggtgacaacatgatccagagtccttcaaccttgactggtacaagggcccaaccctgcttgaggcgcttgacccgaacaatgagcccaagaggccctccggcaaggcccctgcggttttcccctttaggacctgtacaagaatgggcggattgggaacctggcccatgggggcgggtttaaaaat

SEQ ID NO: 4434 - DNA, 890 bp, Triticum aestivum
  Clone ID: PAT_TA_4434
agagagtcagcggcataggtgatgaacttgtcatggtgctccttgcttctgctggtcgtttttgcagcagagttggcactggccgcggttgttgatgatgcggtacaatttgatcccaaagacattaagatgaccataaagagcagaaatggggaaataattgactgtgttgacatctacaagcaaccgagcctgaataaccccttgctgaaggacctgaaacaccagataatgagggatatagccagcgccgtggctgggcaacaagatgggaatacacgggcgacgacggtggagcaggaatggcacaaaggcacaaggcaatgccccatggggagcatccccatcctaaggacgaacccctccgttaattacctcacaggaagtcttttcccatcgccgctacgtgcagctaatattagcacttggagtggcgctgccaatgcggccggccccagatacgagttcgccgtagcgattgctgccaacgggccgtacagcggagcgtatgtacagctgccggtgtggaagccggcgcgcgttcacggctcggagtacaccgcgacctacctccttctggccggcaccaaggacaccgaattcgaccctacacccggcgtattacccgccgatgtccccaatcaaaaagcagctggccttttttgttattcaaaaaaagacaccaatcctcgggtaaacataatttaatccggccgaatgccggtaagaattctgggctacaactttgaactgggggagggttcggttaaaccaagcaagggccttcgcccttgggcgcttagcatttggaaagggggccttccggggtagatgaaaccccgtaccatacttacctttgttgggttagaaaaagaacgcttggttggcct

SEQ ID NO: 4435 - DNA, 577 bp, Triticum aestivum
  Clone ID: PAT_TA_4435
cggcacgagcagactccctccaaagcagctcctcttcttcctcccaatcacactccctcggagaggagcggccatgtccgggcgcggcaagggcggcaaggggctgggaaagggcggcaccaagcgccaccggaaggtcctccgcgacaacatccagggcatcaccaagccggcgatccggaggctggccaggaggggcggcgtgaagcgcatctccggcctcatctacgaggagacccgcggcgtcctcaagatcttcctcgagaacgtcatacgcgacgccgtcacctacaccgagcacgcccgccgcaagaccgtcaccgccatggacgtcgtctacgcgctcaagcgccagggccgcaccctctacggcttcggaggctagatgcgtggtgtgctgtgctggtggcggccgtgtttctctgtgtgattgtgccgtggtggatgggatgtactccctgtcgtgcgtttgtgttcagtagtctgtaataccatcatgcgttcaatgaaactggtctgatcctgaattctgaccaaatgcttcagggacaaaatcggttatataagacatactgat

SEQ ID NO: 4436 - DNA, 973 bp, Triticum aestivum
  Clone ID: PAT_TA_4436
gtttcattggaaggaacacaattcactgtactaatgggagctgattatatcgtcacattggtcttactatgctttttgttcaatccttgctacctcaccttagttgaatcagtaggcgtggatggccatctacagatgaatcagaagaacaacacccttttaagacctaaaccgttttggtttccttggagagctaatttcatggatgaaagcagcaacattatttctcattatgcaatgtggcacactgagccaggacaattctattgccttcgagctggaatgaatatatgggcttcaccaaatctaaaaacctctcaagaatcttgagcatccttaccaatttaattgtcaagatggaggacactacaacttaattcaagtttgattccatatttccccctctttgtaccataacagagatattcgcttctttacatattggactaaagacttgaaatccaaggcgtgctacaactcacaatgcacgggatatgtacctgcaagtggagcgaagctggtgcctggacaagccatttgctcctccatcagtttatggcatacaagatcactacatgaggattagcatcaaccaggatccaaattctggagattgggtggtataccatcatgatttaaaaaaaccatcattctttgggactttttccaaaggagctttgccttggaacaaaaccgtttccaaccaattacccgggttgggaattactttgaagaaggcaaatgggccttccaatggggaaagggccattttcctggtttttaatgaaaagaataatgtgcttatctcaacccccttttagaaccaccccttccacactgggatggtcaagttagttgataggaaagattgttatgatgcaaatgatttatttcttgaatttaagaagggttatacgttcaactatggtggaccaggtggttgtgttggttgaaagcaaaagttgtattgtaa

SEQ ID NO: 4437 - DNA, 890 bp, Triticum aestivum
  unsure (1)..(890): unsure at all n locations
  Clone ID: PAT_TA_4437
gcttaccaagccgacaacccatacaatccaacgaagcgttaccagagacagaccccagaacaccacgatgaaccagagacgagagacgagaaccacataaatggccaagacgatgatgccactgctgaaaagagctggtagatgcaacaacaggggttgcgagactggcagaggtggcagcggagggaagacgaagccagtcaagctcccagagaccatcagaacgtcgagggccagcaccaagtagagcgcccgtgcgacgatcctgaacagaacatgaatcaaagtctagaatgaccctacaactagagtcaacaatctgaccaccagatatgagctgcatggtaagtcaaggaacacgagcaacagagggaacatgaaatgaagaagtgctaagagtgcctcgacgagctacagggaggggagtgccatcagccgtaagaacacgaacaggagactcgacaggtcgaacggaggtcaaagttgaagaatcataagtcatacgaaaagacgctccagtatcaagaatccatggggatgtacctgaatgagtnaggagtggtttctcaatgccggaagagtcggtcacagaacttgcagaaactgtcggggaagaatcccagcatcaagcaggcatcggagctgtgcaatctcacatgcagaccaggaccggacagaagaggtcgaggttgaagcatttgccgcgatgaacaggcgccacccacccatggaggcccaaggtggaggcaacatagagccacatgtggaggccccttggggagttgactataaaggggtaacgggcgggggcacagcccgaataggagttcatgtttagcgattagcagccttcgttggtgtgcgcaatagggggtcaaataaaacgcact

SEQ ID NO: 4438 - DNA, 947 bp, Triticum aestivum
  Clone ID: PAT_TA_4438
ccgcgtcgcgccctgcaactggtcctcccgcctgctcgtgctcccgccggcgccggcctcgccgccctccccggcgtccgccgtcatctcgccgtccgagtccgggacggcgttcccgctcttcccgaacaagaagcccgccaagtcgtccaagaagaaggaggcgccggccgcgcccgccatgaccgccgcggaggccgcggccgcggaggggcggcggtgcctgcactgcgaaaccgacaagacgccgcagtggaggacggggccgctggggcccaagacgctgtgcaacgcgtgcggggtgcggtacaagtccgggcggctggtgccggagtaccggccggcggcgagcccgacgctcgggccgtccgcgcccccccccgcgcgccgcgcgccgccgccgccgcccggcccggcgcctgcacccccccctcgcccgccgcctccgttgcctgctccactcgctgtgccccctgctgttcgagccgcccccggcgccgcccgtcccccgcgccggcgacgacttctcgtccctcccccgcctcaccgcgacagactcccgcctgcaactccccttgccgtgtcggccggccatttggtctgagctgttttgcacttgtctattctgatacagctgctctttccccttacaaaacccctacggcaacctttctaatctctgtcttgttagtatcataattcacatttggctgatcgctcagatattattatacactatatataatccaatggttactgttcaaattcaaaaaccttgataccactctaatcctcgttctgtatcgtagcactccacatctttcataacctagttatgtgatctcccacatcaatacaatatctaatgttatgtacgctacctataacatattctactttcctactatatacagctcttgactactcttctgtaatggtctagtcct

SEQ ID NO: 4439 - DNA, 817 bp, Triticum aestivum
  Clone ID: PAT_TA_4439
gcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgacttcatcaagttcgacgttgggtaacgtggtcatggtgactggcgggcgcaacactgggcgtgttggtgtgatcaagaaccggggagagcataaggggaactttcgaaaaccttccacgttgaggatgcccagggcccccaattcggccaccggtttgggcaatggttttcccctttggcagggggcaccaagccattgggtgagcctcccccaggggcagg

SEQ ID NO: 4440 - DNA, 838 bp, Triticum aestivum
  Clone ID: PAT_TA_4440
cttcggcctccacgtcaccgccgcgccattccacctcttcttcgacgacctcaccgtcgcctccgggaacatgaaggagttctaccaggcgcggaagagcgggcgggtggtgacggtgtccgtggcggggaagcaggtcccgctctacggcgcgggcgccaacctgcacagcaagcccaacaacggccgcctcggccccgcggtggtgcccgtcaggctggccttcgtgctccgggcgcgcgcgcacatcctcggcctcctcctccgctccaagttctaccgccggggcgtctgccgccttgacgtccgtgaggcccacctcggcaagcccgtgcccggcgtcgccgcccgctgcgagtaccacgacgggaggtgacggtagagcgttggtgttgtcgatatgggtgtgtttggttgggtgacgtggattgcaacgtctgaattcaggcgtgcgtggggaactgaactgatgactgattaagctgtttgtaggcgtgtgatagtgttcgtgtcaaaaggatttcctgatgtgaccgacccaattgagttgagtggattttggatcttggggacaacgggggctaagggcctattttttactctggaacaaattagaaaaaatatactctgagggcgggctccagtgttcctaaacgcgtctatatggaaggccaaatctgcattcccctatgcggcataattcaaactgctcatttgccttgttgaacaattgtgctttcgccacaattaatatattcttatatggtaaattcccccttttaccataatttgagataattacgcattttgggtcatggccacgtactggacattccct

SEQ ID NO: 4441 - DNA, 816 bp, Triticum aestivum
  Clone ID: PAT_TA_4441
gccacagcacgctccgcgctgacgagcacgagtttgacgcgcacgcggcggcaatggcgaacggcgaccaggacatggccaccgacgaattgatggagacggaggggttgaaggtccttgccgtggacgacgaccccatctacctccattccttgacgcagatgcttcggcgctgcggctacgaagtgacggccaagccgtcaccagcagatgcggtgagggaggtggagaagaacccgaacaggaccgacttcatcatgacggtcgtgcagacccgggggcgagggatggacggcttgggcctcctcaagcgtctcgggaaacgttacccagtcgtactcatgttctcgggcgaagagagcatggagacgagaataaggggaaatcaggggggcgcttgctacttgctggagaagcccctacacgacacgcagatatacttcctctggcagcatgttgtgcgatggaggctcaatgccgccgccgctgccacggcaaacgctaaccctcaccacagccaaggcgtccatctggatgacacgcagaggaagagaaggcaaggaatgaacgattccaacaaggggcaggggggcttttcgagggcggcctggcactggggaccaccaagaaggaaaaagcttgagtgggactgcagaaatgcatgaattgttcgtcaatggcggggacccacttaagacaacaggaggggcgtgaaaatcataccaaaaggcatgcatggcacaatacatgaatccttcccttgggacccttttttaatttttccatgcttaagctggtttggtttttaaataaatg

SEQ ID NO: 4442 - DNA, 731 bp, Triticum aestivum
  unsure (1)..(731): unsure at all n locations
  Clone ID: PAT_TA_4442
cgccgccgcctnctctcggttccttctccttcctcggagctccagccatgggtaaggagaagactcacatcaacatcgtggtcattggccatgtcgactctggcaagtcgacaaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcacccttggagtgaagcagatgatctgctgctgcaacaagatggacgcccccactcccagtactcaaaggccgttatgaggaaaatggcaaggaagtctcttcgtacctgaagaaggtcggcttcaaccctggacagggtcccttcggtccccactctgggtttggaggggacaacatgattgggagggtccaccaaccctggcctggtacaagggccctaccttttttgaggcttctggaccagatcattgagcccaagga

SEQ ID NO: 4443 - DNA, 634 bp, Triticum aestivum
  unsure (1)..(634): unsure at all n locations
  Clone ID: PAT_TA_4443
ggacagcttgacttgctccaaaccaaacgaatccggcggcgccgcggcgcgaccaccatccccacaatccattcccagctcgggcgtatcctagcaagcgagcgtcagaaaaaagatgctcttttagngggaaaacaccccccgtcgccatgctggtgctggcgccgggcgtcaggctctaaacccacctagggtttcggccggcggcgatgcgggccgccagtgcgccgcgctactccgtcggcgccggcgccggcccacgcgtccgcggacgcgtgggcggcgacgtcgaccccgaggccctcaccgaggaggacagcctcgtcggcggcggcgactccaactccgtggattgcttgcatggatcatacagcagctctttaagcctccacggtgtcagagttgacgacgagcactcggctcttgagaacagcagcaggcctcctagtcatattaatatcctaacaccacaagatgttgtgcccatcgaagtggcacggtctagattcctggacatcatcattgaccattttattggccagaatgttattgaggtgggagaaccctctctctatgactctatcctggccagcaatagaatcaacaaaagaaagcaacaagaggtacaatacga

SEQ ID NO: 4444 - DNA, 796 bp, Triticum aestivum
  Clone ID: PAT_TA_4444
caattcccttgctctctccctcaccctctctcgctcgcagtgcccctccctggattccctccttcgtccttgcttcgccaggggtagtagcgaggccctgcgcccacatacgtcatcctccggcgccccaagtcccgcgcgacgcacccagtctccatggccgcgcctcctcgccgcccggacccatcgtcctcaaccccgcctctcctgctcgttgactgcgctaccggagccctgcatcatgccaagcgtcgccggcgccccaaagtccacgtcatcgacctccttccatggcctcctcttcgccttgaagccccgcaccgtgggcttcttcctcgcgctccttgccatggtcacgtgcccttcgagccagtaggacgatgccctgcctcaccgccgttcgcctccggcgagcatctgcagaagctcctccggcctccccgtcctctgcttcgtctcctcgcgcccctcccttctacgcccacgccgtcctccaccagcagcgtcgccaccctcaccggacctcgttcctcagcccgcagccaagacctcaagtttgtcaagccgctgctctgcctctgccttgttcgagcggagaggaggacgcgcctttgctcgcccgctttgacccgtaccatgaccctgaatggctgggagtccgggacctctacgggcaaggggttttgcgtcaagtcccactacgacataaacgactacccgatgacccccaagggcttgggaagtaccaagcagtttttggtaccaaagggaaccccctaccgttgccaagatccaa

SEQ ID NO: 4445 - DNA, 2729 bp, Triticum aestivum
  Clone ID: PAT_TA_4445
aacaacgatcgaaagctgtaaccgaagcatttgttaggttgcgcaaagatggcctaatttatagggactaccgccttgtgaattggggctgcacacttttaacagcaatatctgacatagaggtggatcatctagagcttaaagaggaaactatgctgaaggtccctggttatagtagtcctgtacagtttggtgtgttgatatcctttgcctatcctcttgaagaaggactaggtgaaattattgtcgcaacaacaagaattgaaacaatgctcggtgatacggcaatagctgttcatcctgaggataaaaggtataagcatctgcatggaaagcatgccattcacccgttcaatggccgaaaactcaaaataatctgcgatgctgtgttagtggatcccactttcggtactggggctgtcaagattacacctgcccatgacccaaatgactttgaggttggaaaacgacacaacctagagttcatcaatatcttcacagatgatgggaagataaacagcaatggaggtgcacaatttgaaggaatggcaagatttgctgctcgggttgcagttattgatgcactgaaggaaaaggggttgtacaaggacacaaaaaagaatgaaatgaatttgggcatttgttcaagaagtaatgatgtagtggaacctatgataaagcctcaatggtttgttaattgccatacgatggcaaaggcaggtcttgatgctgtaaggtccaaaaaaattgagattattccgcaacaatatgaacaagactggtacagatggcttgaaaatatacgcgattggtgtgtttcaaggcaactctggtggggacatcgtgtacctgcgtggtatgtgacactagaggatgagcaattgaatgatctgggatcaaacaatgaccgttggatagtcgcaaggaatgaatgtgatgcaatgcttgaggcacagaaaaagtatccggggaagaaattccagttaaatcaagatcctgacgttttggatacttggttttcatctggtctcttcccattgacagtgcttggttggccagatgatactgctgatcttcgtgctttctaccctacttcagtacttgaaactggacttgatattctcttcttctgggtggcacgtatggtgatgatgggtatgcaacttggtggtgatgtgccatttcagaaggtgtatctgcatcctatgatccgtgatgcacatggccgcaaaatgtccaagtcacttggtaatgttgttgatcccctcccggtgataaacggtacgacactcgaagatctcctcaaacgtttgggagaacgtaagctggatccaaatgagttaagtgttgcaagagaagggaagaagaaagattttcctgatggcattgctgaatgtggcactgatgcactccgtttcgcactgatttcttacacttctcagtctgacaagataaatcttgatatcaagagggttgttggatatcgccaatggtgcaataaattgtggaatgccattcgttttgcaatgggcaagcttggcgatcattatgctccaccagcaaccattgttgtgtcttcaatgcccccggtctgcaaatggatactctcggtacttaacaaggctattggcaagactgtgacctcattagaagcatacaagttcgccgatgcaacatctgctatttactcatggtggcaataccagctatgtgatgtatttatagaagctgtaaaaccttacttcttcaatgactctcaagagttcgattcagcaagagctgcttgtagagatgccctatgggtttgcctcgacaatggtttgcgtctgctccacccattcatgccttatgtaacagaagaactctggcagcgtcttcctcagcccaaagattcttgcagaaaaaattccattatgatatcagaatatccatctgttgttaaggaatgggcagatgataaacttgaaagtgaatttggtattatcttggatactgtgaacaaactaagatctctgaagccaccgacagatacaaatgaaaggcgacctgcttttgcactttgtcgaggcgaagatattgctgccactgttcagtgctatcaatctctagtggtgtctctttcttctgtatcgtcacttaagatcctggcagagagtgacgaaactccacctgactgttcgactgctgttgtcaacaaagatctgtccgtataccttcagcttcaaggagctctaaacgcggaagtggagctcgaaaagctaaggaaaaagagggatgaaatccaaaagctacagcatgccctgtctcagaagatggaagcgtccggttacagagagaaggccccgcccagcgtccaagaggaggacatgaggaaactcaccgcctttttcgagcaactgcgggtgattggtgaagctgagaagaaactagatgcgtaaactggcaatgcttgagtcggctctctgtttctattgattggaaactaatggcatttttgtttcgaagctgatgtactgcacagttttttgcggatgctgatgctgtgatcacatttacagaaaattcaaatggagcaatgaaactccaatttcccacatatgccttacttttgtaaatgatgttgatccgcgagtgcgagtacaagtgacttactttttcagtgctcaaaaaaaaaaaaaaaaaaaaaactcgacctgcccgggcggccgctcgaaatcactagtgaattc

SEQ ID NO: 4446 - DNA, 879 bp, Triticum aestivum
  Clone ID: PAT_TA_4446
gcttagtctacttcggcgagcaattgctttatgtttcttttatcatgctcttcaaactagaggtgttcggttcttccctaccattcaagaggaaaatgactcaccggccaaagattttgtccatggtccagccaaacaaattctcaaaagtttgaagtcaaactccactgaagtaataacttctggacaaggttctagtttatgggatgatccctatattaatccagatcgctatggcgactcacatcctcacttctacacccgttggacgagagataattatgatgcaactggctgctacaacatggattgccctggttacacacgggtagatggcgctgttatagctccgggtgatgctatacatccagtttctaatgtccctgatggacctagacaatgtatcactctgagggtgctaaaggacaaaaaaagtggagattggtgggtgtattatggcttcaataaaagccccacaggtgtgggatacttcccaaggtcgttgttcagctacttagcagaaaaggcagacggaatgcaatttggtgcatttgttcaagctaaaaaagcacttccgactcctccaatgggcagtggtgcccttccaaatggtggtagggtcgcgccgcatcattcacagacattagattcattgaccaggatggaaatagcagcccgatcaaggaagacctggccatgttcgttactgatagaaaatgccacgctatcacccatattgtcatgctgcatgctattaatggggccctgaggtggatgagataagaagggatccttgagcttggatcaaccaaggtaggtggcaaataaaagggctgggttgaaaaaatattgaaagaggattcgctttttaccttaagc

SEQ ID NO: 4447 - DNA, 883 bp, Triticum aestivum
  unsure (1)..(883): unsure at all n locations
  Clone ID: PAT_TA_4447
cccgccgccgcctcccctcccttcgttcttcttcttcgagttgggtagtttacctctacccaccagccatgggtaaggagaagactcacatcaacatcgtggtcattggccatgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgctgcaacaagatggacgccaccactcccaagtactcaaaggcgcgttatgaagaaattgtcaaggaggtctcttcctacctgaagaaggtggctacaaccctgacaggttnccctcgtccccatctctgggtttgagggtgacaacatgattgagaggccaccaaccttgactggtacaagggcccaacccttcttgaagcgcttgaacagaacaacgagccccagaagccctcaaacaaccccctccggtttcccctccaagacgtttccaagatgggtggctttggaacttggcctgttggccgggttgaaaactgggtatcaaacctggggaatggtggcaccttttgtcccactgggct

SEQ ID NO: 4448 - DNA, 838 bp, Triticum aestivum
  unsure (1)..(838): unsure at all n locations
  Clone ID: PAT_TA_4448
tcatggtgctgatatcataaggtttactcagaggaatatattaaggatttatccgaagggtacaaggattaattcttctaactatgatccaatgaaggcctggactcatggtgcccagatggttgcatttaacatgcaggggcatgacaaatcgctaagattaatgcaaggatttttcagagccaacggtggctgcggatacgttaaaaagcccgacttcttgctaaagacaggcccaaatggtgaagtgtttgatcctaaagcgagcctgccggtgaagaaaactcttaaggtgaaagtgtatatgggggacgggtggcgcatggacttcagtaagactcatttcgacgcgttttctccacctgatttctacgccagggtggggatcgcgggggtgcgggcggactgcgtgatgaagaagacccggacgatcgaggaccagtgggtgccggtatgggacgaggagttcacgttcccgctgacggtgccggagctggccctgctgagggtggaggtccaggagtacgacatgtcggagaagcacgactttggcgggcagacgtgcctgccggtgatggagctgaagcangggatccgcgccgtgcccctccatgaccgcaagggcaacaggtacaagtccgtcaagcttctcattcgcttcgagctcatctagcccaatggtcagcattgtggaaggcctgtgggtattttattgtgtgggtggagtagtcatattgtcggattttaaaaaataatangggtaatgttctttggtagacctggacaagtcagggagtgtgttgaactggtgcctgctggcttagtactgccccagggg

SEQ ID NO: 4449 - DNA, 850 bp, Triticum aestivum
  unsure (1)..(850): unsure at all n locations
  Clone ID: PAT_TA_4449
ctcccacgtagcacccatggcggcggcgaagcccggtagtagtagcgacatcgacacggcggagctggaccgggtgctacacgcggtgggcttccagatcgagacggtctcccccgcgctgctcgccgggaggctccccgtcacggagcgctgctgccagccgttcaaggtgctgcacggcggcgtgtcggcgctggtgtctgaggcgctggccagcatgggcgcgcacatggcgtcgggctaccgccgcgtcgcgggcgtgcacctcagcatcaaccacttccgtagcgccgccctcggcgacgtcgtgctcgcccgcgccgtccccgtccacctcggccgctccacgcaggtgtgggaggtgaagctgtggaagatggacccgtcggcggagatgaagaaggggccgcagatcgccgaggccaaggtgacgctgctctgcaacctgcccgtgccggacaacctncaccacgccggcgacgccctcaagaagtacgccgccgatggcgctgcacctgcaccaaccaccaccgncaccagnaaactgtaaaactaattatgtgtacgatatgtctactagttaacccagaatttaggagttagtgcgtgttgggtacttgggttgatccgttcgtcggtcgatcacaaaaaacaatgttctgttcttgggtcggtttaattaggttggcccttcctttaaaaaaaaaaaaaaaaaaaatcgagggggggcccggtaccccaatttgcccttatatgagacggattacaattcaatggccggcggtttaacaacgccgtggactgggaaaaacccttgcgtttaccccactttaatccccttggcaaacat

SEQ ID NO: 4450 - DNA, 877 bp, Triticum aestivum
  unsure (1)..(877): unsure at all n locations
  Clone ID: PAT_TA_4450
caggcacggaaccaacaaatccccacccaatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagcagcgtctcatcttcgctggcaagcagcttgaggatggccgtaccctcgctgactacaacatccagaaggagtccacccttcacctggtgctccgcctncgtggtggtatgcagatttttgtgaagaccctcaccggcaagaccatcacccttgaggntgagagctctgacaccatcgacaacgtcaaagcccaagatccangacaaggaaggcaatccccccggaccagcagcgccgaactttgttgcaaagcactggaagattgccggaccttggcgactacaacatccagaggaatccaacttcaacttgtcctggggctgtgggggggcatggaaaatttctggaaaaccttaaccgggagaccatacctctggagggtggaagttcgaaccattgacaaagttaagggccaaatccaggcaagggagggctttccccgg

SEQ ID NO: 4451 - DNA, 928 bp, Triticum aestivum
  Clone ID: PAT_TA_4451
ccaagcccccatctcacctcctaaaaccaaagccctacctaccgggctagcgagctagccagaccccccttcccgtagatctctcctctccccgcgtgcccgccgcgccgagcaagcccgcccctctccctaagccaaagccctggcaaaggcggagcaaccgcggtggccggctggccagacctccttcctctcgatctccgctctccgggcgtcctcccggcggcgctccgtcggtgacgaccaaggcgaagctcgggcagctaatgtgtgtgcaccggccgcgctccgcgggggcggtggcgttcctctccgtcgccgtggcgtcgatctccgccgccgggcccaggctcggtcgccgtggtctccttcttctggccgctgctcggctccacggccttcttcctcgtggccaatcagcctgctgctccgggtctcggctgccgcccaccggcgcgggaggagtccgggaacggaaggtcatccatcttctgtcgccggggtgccgccccgaccacctcctccccgaggggccgggcccgcctgcaggtgccggcggcgcgccggagccgaagatccgaggagccgggggggagcagggccgcgcggccgcgggatgaccttgttcgccctggctagcgccggggggtagtgtggttacctgtatgggcccgcctgggagccgggggccgggcgccgggcgcccccggtgtgcggcggtgcagccgtggctagcgtaggactcctcccgtctgccgtggtctggtgtacaatagtaccatggaataaagatgtcgctctgtcaccccgcctgcgcgcagtacctgggtccccgggtcctccaatcttcttccgttttcaggtggagtcttcaactcttgatgctttgatttgatgccatgaaagcgagagatcagagctgaagacc

SEQ ID NO: 4452 - DNA, 650 bp, Triticum aestivum
  unsure (1)..(650): unsure at all n locations
  Clone ID: PAT_TA_4452
cccagacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaaaggatgaatgtcctcaccaacttctggngcatggacttcaccactgacaagctcangtccctttgtgaggaagtggcagacactcattgaggctcatgtggatgtgaagacaactgacaactacatgcttcgcatgtccgccattgcttcaccaagagacccccgaacaagtgaaccgcacttgtatgcccaaccagtagatcaacagatccccgaagatggtgagatatggcaaccaacttcagctgtgcttgaggacttggaacagtcatcttgggtgacgaagaatatgaagccctaagttttccttcaacttcctcccaggaaactct

SEQ ID NO: 4453 - DNA, 432 bp, Triticum aestivum
  unsure (1)..(432): unsure at all n locations
  Clone ID: PAT_TA_4453
ctcccacacgcgcacagtcgctgctctgcctgcgctcgcgagagagacagccgagccaggccagccagcgggcgacgcaggcaggcatggccacctccagcggcgaccagtcgtcgccccgcgcggcctccgacctcgccgtcctcccctcctaccccgagatgatcgtggaggccatcgcgtcgctccgggagcccaacggctccagccaggccgccatcgcgcgccgcatcgaggcggcccgcggcgccggcgtcgacctcccgccgtnccaccccgcgctcgtcgccgcgcacctctcccgcatgtccgccgccgccgagctcgtcgccgtcgccgggggcaagtacgcgctcccccctccaccggtcttttattaaccacatttaaaaaatgtcgaccgagttattcaacccttcttggatccaaatc

SEQ ID NO: 4454 - DNA, 630 bp, Triticum aestivum
  unsure (1)..(630): unsure at all n locations
  Clone ID: PAT_TA_4454
gaagccgcgacgctcaagcccccagacgccgcagcgccgccactccacccgcagcggcaaccatggcggtcggcaagaacaagcgcatctccaaggggaggaagggtagcaaaaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagacactgacactacatgctccgcatgtcaccatgggctcaccanagacgcccaaaccagtgaagcgcactgctatgccaagcagtcagacagacgatccgcgcagatggtgagacatgccaccaactccactggcatgaagacctgggacaatattcctagggatggaagggatgaaagcccctc

SEQ ID NO: 4455 - DNA, 838 bp, Triticum aestivum
  Clone ID: PAT_TA_4455
ggcctgccagctgttctacgtaccagctatactacgcgacggatgggcaatccaagtttttgatccttcagtcggtcccaaaggatgcagccaggatcagcaggctcgacacgagcttattgcgtcgtgcttacataatgcattgttcgggtgcctgcatgctgggtggccaacacgaaaggataactggtctaccatttcccctgttttatggataccacaattaccagggaggaaactggtaatttcgtcatgcacatcattaggtaccacgatggagagagtataccgatcaccaagaacaaccttgtgaaaactaaaagtacattctgcaagaagttatgaagctccaggggaacagttcatcattgccagccgatgcactatggtcagttcatgcccctaccgatggttatgaagctccaggggaacatttcatgcgacccatttagcgtgcccactacggacattcaatgaatattcattgtgtcaatccatgttgtatcgctatacatgactaagtgtgtatcgtacatttcctccaaaaccatctacctaaatggacaacctattatatttttcatgcgttatcattctaaaaaaaaaaaaaaaaaaatcggcacgaggagagagagagagaactagtctcgagttttttttttttttttttttttaaccgcacatactaattgaaagccgaaacacgtcgggaaccaggaacgatcgtcaccttaaacaacatgcattaatgcctgcttgaaaaatgaagagggaaaaacccgtgggactaccttattttttgggcattcttaaggtaaagaagtcccgtttcgaataa

SEQ ID NO: 4456 - DNA, 767 bp, Triticum aestivum
  unsure (1)..(767): unsure at all n locations
  Clone ID: PAT_TA_4456
tatgtngtcagcaactgtggcagacccccgagcagtcacggtgccaagccatccacaatgncattcatgctattattttgcatcaacaacaacaacaacaacaacaacaacatcggcaccagcggcaactccaacgacttcctccgcgacgccagcagcctcttctccggcaccctcccgcccgcccggcctcccccgccctccgtgaatggccgcccccgcccccgccgccgggagcagcctccacagcaagaccctcctcaagagcgagcagctctaccagtacatactggagtccacggtgttcccgcgcgagcccgactgcctccgggagctgcgcgtcgccaccgcggcccaccccatggcccgcatggcggcgtcgccggaccaggtgcagctgttcggcctgctgatcgagatgctcggcgccaggaacgccgtcgaggtcggcgtgttcaccgggtactcgctgctcgccaccgccctcgccctcccccgacgacggcaaggtcgtggccatcgaccttacgccgcgagagctacgaccagataggggcgccggggggtggaagaaggcccgggatggcgcacaagggtcgacttccgcggtcgggctcgcgctggccggtgctgggtccgcgcgtcgccgcccgtggcatccggggcctgggcccctgcgccgtcgtgcccgcggccgaggccaacttccaccactaccacgagcggctgctgcggctggtcaggggtcggggggctcatcgcctacg

SEQ ID NO: 4457 - DNA, 801 bp, Triticum aestivum
  Clone ID: PAT_TA_4457
cagccacaacccacaacatgcacaccggatcgagctcgcaagtgttcatcatgcccgctgccggccatgtccactaccttgtcgcgggaggctccggaggaggcgacgagcccaggtacccctggaccttcaagtccctgcacgaggtggacgccgtcgtccctgctatcgcccgtggcagcaagaggccggccgccgtccccggtggagcacaggtagagccctacgggtgccccatctgcttccgcgtgtttgccactgccaaggccgtccatggccacatgcgcagccacacggaccgcacctggcgcggcatggagccgccccggccgccgcccctgggcgaggcccgggcccgatgcgcggcgttacccgtacggtgtgcgaccgctgcaagatgccgttccagacgcgccaaggcgctcggcggccaccgcgccagccacaatggtaagaaaggctgctcctggctccaaagaagaggagctcgccgccgcccgaagaagctcggtaagcccgtcctgttcggcgttgattctgaaccttccggctcccgaagcagatcaggaacagggggaggagtagtaggagtcatcaacagatcgatcgagcagcttgctagtgttctcagttgacagttgctggagctgtgcttgcgtgtgctatatttggcgtttagccttctccgatattatattctgccttccttcactttgactttgtgtttcgagaacttggttgccaaataactcttgaacgaacgacccccgtttaattggaacataaattgaagagtgcact

SEQ ID NO: 4458 - DNA, 178 bp, Triticum aestivum
  Clone ID: PAT_TA_4458
tttgagctacaaaaattgatctagtagcgtattttcaaccaaccgacaaaaacaacatgtatctaatagaacaaagtactggaagacaaaaccaaatgcatctatttagatattggtaccttttcattcgacagtatatcttgcacatcttcattgtcccatattctactgcctctcc

SEQ ID NO: 4459 - DNA, 798 bp, Triticum aestivum
  Clone ID: PAT_TA_4459
ggaagccacagttcgaagcttcgaacctggttgtgatggaggtggtctttgatggaggaggaggtgctggcggtgccaacgactggaggtctcaaatcagggaagagattcgcgactctcgtgtctcagtactatcagaggctctgatgcaagcactgtcaccagacgagcccgagacattgactgatcttctgaatgttgctgtcagattagagaaaatgattttcgtagtagctattaacgaggttgattataattttaagctgtatacgagattggatcatttaaagaatgatcattttgaggacatatcatcagataatcattttgaggacatctcgttggatgatcattttgaggacatctcgttggatgatcattttgaggaaatttcatcagattatcaaatgcttgaaccctcaactgcgacgcttctgcgaggaatttttagtgatccacagagtcaaagcattcaggtacagagcaacctccacagggtgctatctggtggtaacacaaaagcaacagcgcctataggaaatgaagagaagccttgctgtgatgacaatgataggattagcgtccttcatgagagcatactccattgtatcatgtccttcatgccagcccaggacgtcgtacgcacaagcctgctattcccgaagatcgcccccattatggacttcagcgccatgccctgatatcgatattggacactttgatatggacagggtaaaggttcaacaggtttgccaaaaagtttgtgtttaaacggcggggcgaatggctaataaatcg

SEQ ID NO: 4460 - DNA, 494 bp, Triticum aestivum
  Clone ID: PAT_TA_4460
ggcaccgccatgaaccgcgtcatgagcggcatcgtcaccatgaccttcatctcgctctacggggccatcaccatggccggcgcattctacctttatgccgccgtcgcggctgcctcgttcgtgttcatctacacctgcctgccggagaccaggggccgaaacctcgaggacatggagcagcttttccgcacaaagtgatcgatcccccaacccgtggtcacttttttttttgaaaaatcaacccgtggtcacattgatattaacaaatctctggatttggatggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaccaaaaggaaagaaaaaaaaaaaaaaaaaaaagaaccccccgaaaaaaaaaaaaaaaaggcccccgggggccgggcccgtcaaaaaaaagggggccccccggggcggaggaa

SEQ ID NO: 4461 - DNA, 704 bp, Triticum aestivum
  Clone ID: PAT_TA_4461
tcgggtgcgggcctaggccccgggtctgcggcccgcaggaccgcgatcggcaggtcgctggtcgcgtctccgggcaccggcccgctactgacggtgacgcgggcggccacaacaccctggctgcccgtgctgggctccgtgtcatctgcttgcgcggccgccaaggactcgacggcggcgtccgccgtggccggggcggctgtggtggcgttcgtctgcaccttctccgtcgggttcgggcctatggcatgggtgtacagctcggagatcctacctctgcggctgcgcggacagggcgctgggctcggcaccgccatgaaccgcgtcatgagcggcatcgtcaccatgaccttcatctcgctctacggggccatcaccatggccggcgcattctacctttatgccgccgtggcggctgcctcgttcgtgttcatctacacctgcctgccggagaccaggggccggaacctcgaggacatggagcagctcttccgcacaaagtgatcaatccaccaacccgtcctcacattgatatttcatactcctaatgtcaacttgtgattggaaatagggcggagaggagggcccacagtgtaaagttttggggtggtggggggtaattttggattaagaaatctctggatttggatggtaaattttgtgatcaaacgctatacaacattatcaaaatgattctttcaaaa

SEQ ID NO: 4462 - DNA, 481 bp, Triticum aestivum
  Clone ID: PAT_TA_4462
gaagagcaacgcgacccgaggatgcggttctttttagggctcttagcagcaacgctcccaagcaagcgttgctgttaggctttgctttcaccgtttcttatgctccttgcttccctcctatcatcgacgacatgctagaacatcgatgctaaagtcggtgcgactataacgttcatcccccaggaaaagtgcaaagcaggttgcagcacgggatgcaggcccagggctaacgcgtcttgtcatgcgaagggcaaaatgttgctgcgtttgttgtgacaagaataatttttctactctagataaagtaataacgttttcatacatgattgctaatgtggtactgggttaacgacaaataacctgatgcctccttatgttgtgcggtccaccattgttactttggtcaccaatttcttccttgggaccgccaccttcacaataaacttgtgttttacttacctggttagattgccggggaaac

SEQ ID NO: 4463 - DNA, 902 bp, Triticum aestivum
  unsure (1)..(902): unsure at all n locations
  Clone ID: PAT_TA_4463
aacagtcaggacaaaggcaacaagatcagcagtcaggacaagggcagcaaccgggacaaaggcagccagggtactactcaacttctccgcaacaattaggacaaggccaaccaaggtactacccaacttctccgcagcagccaggacaagagcagcagccaagacaattgcaacaaccagaacaagggcaacaaggtcagcagccagaacaagggcagcaaggtcagcagcaaagacaaggggagcaaggtcagcagccaggacaagggcaacaagggcagcaaccgggacaagggcagccagggtactacccaacttctccgcagcagtcaggacaagggcaaccagggtactacccaacttctccacagcagtcaggacaattgcaacaaccagcacaagggcagcaaccaggacaagagcaacaaggtcaacagccaggacaagggcagcaaccgggacaagggcaagccagggtactacccaacttctccgcagcagtcaggacaagagcaacagctagaacaatggcaacagtcaggacaggggcaaccagggcactacccaacttctccgttgcaagccaggacaagggcaaccagggtactacccaacttctcacaacagataggacaagggcagcagccaagaacaatttgcacaaccaacacaagggcaacaangggcagcaaccaaggacaangggcaacaaggtcaacagcccangaaaaaaggcaacaaaggtcaagcaaccaagnacaaggggcagcaanccaggacaagggcagccanggtcctacccaacttnttttgagcaagtcanggaaaaggggcaccanccnagganaaatgggnaccacccagnacaaggacaaccccgggtcttccccaaantttttncn

SEQ ID NO: 4464 - DNA, 1820 bp, Triticum aestivum
  Clone ID: PAT_TA_4464
tgccgtgccggtactaatggggaggggacccacgcgtccgcggacgcgtgggtggatttcaaatgttcatttcttttgcaaagttgagtggttaacaatgcctgttacgtatccgtggaacttctggagagcccgaaaaaactgtgcaaccaccgggaaaccaagaccaaatatcctaacgacctaaagataccgggggaaacatatcaagctactttgcaaaagagaaaagaaaaaagaggcaacaacacctgttcctttttacacttttctttcggttctacaaggctgaagagcaggcggaaaccactcctgggagtaaggtcagcttcgacgatgtgccgccgaatgtttcaggagttgcaccaactgccagcaaagaggatgaagaacagtcttgcggatgcacacctctgttgacgaaagcagctgactgcatggttagtcgccttgcagacagtagagctggcggatgttgcccgtagcatatagccaatctttgaactgcgagtgaagggcgcttgctaattcctttttcctattttccgtcaagttgcagctcccgaatagtttttttagtatcttccagaacagcttgcttcttgctttgcgatgcctggataaatttcaggcaatggaaatggattgcattttgtaggctcttgtacttcatcctcaaaccaattaggaatcaaaaagtttgtgaatagatcaggatctacacaagtagcagattcggcttgaacatcagaaaccccagcaggatgggacaatgaatcatgtggatcaacgactcccaatacaaaaggttggtcccatttattggtagaggggtctacaccaacttgtgtcagatgctcacccaatcttggatagtaagtattaaatggagcaatatgtaatttatggttgtcccccacaataagaggctggtgatttactcccaagtagaagatgcactcacgacagttggcaatacagattcgttttgcagctgcaataatatgcactctttcacaatgctccacctttataaccttgccgacagcaccaagaacaacggtagtatcagaacatccatacacggtagcatacttcaccggtgctaatatataaataacggaatcatggcagttcaaaaccttcactgaatttcctttgacatcagatgcatgcttgacaacagaagttttggagaaaccctccacaaatgtagaatttctatggaatgcgggattggcaacagtaggtgtgctgttccttggatgacttgtattggcatctgccatggtaacatcaagatcagacgctatctgctggctcccttcctttgctgtagatttctcagtataaaactccaacgaagaaacaatattctgcaaaatccaatcatggacctgagcagcagatactggagcagccggcatgtctggatcagaatttgcaaaaaatgtggctgcctggcttagggatgttccttccgaaaaatgcactagaaatccaaggtgctcaaaagtctccattgttagtaccagagaatcatccccctccccctcaacagaatcagccaatagagtgagaatcggacgcgtgggcggacgcagataagataactggtgaatttcttcatctgcttgagaaggtataaagcgacggctattactgcgtacaagctggatcggagagagagcggacaggtagccgtcgaacgctgaggtggatggccagacgtcggcgacggcgggcgagtccttgtgcgggcgcggcacgaggcgcttgtacgactggatgtagaggaagagcagaacgtcgcggtgccg

SEQ ID NO: 4465 - DNA, 839 bp, Triticum aestivum
  Clone ID: PAT_TA_4465
gcgtaagagcaaaacgagatcggacggtcacccctccctagatgttccatgcacagtaactgccggtccatctaaaatatactatggttagttttagtataatccagtgtaggtggtggtagtgctttgcagaaagaaatacattagcttcagctagctgccaatgcaacatctctgttgtacctgtatgaagataatactagcaggagagtagcatcaaaagcgacatcataaccgctatctagagctgcagaaactagtgcactgaccactatggcactggtgacaattttgtttttgcatgccatattgcaaatcaatcctggtcagctcctgcagatattccactccactattatgggattacgccttctcattttatcatattgcctcttgttcaatgtttctgcaaaagtttcagcaatggaggcctttctgtgcgcgaaagatatcgggtcaacttcgcgactctggcgacaattctttgtgtttggtccttctccagcagatgatctggaaggctcgggcataaagaatcgacggggaaagcctcctagattgtgtgagtggccggtggttgagtgctgcattgcgtcaatcaaatctcgttcggtttgtgtttaaatgagaacattaaagctctcgccatgttgttcctttattttcctctttgaaaaggcgtgagtgatgtgctttgctgtgagataatcgaatatatcgatgagagtaacataacattttaatggtgttgcttttgtacgtagcatattctagtgctctgatagggaatccgtgatatggataccatgttatcaacttttgctttgggcagtcgcgga

SEQ ID NO: 4466 - DNA, 891 bp, Triticum aestivum
  unsure (1)..(891): unsure at all n locations
  Clone ID: PAT_TA_4466
gcgcagtgtatccagagagaagctgccactggtgatacatctgtgcgaaagccagatccagaatgagtcgacagagttgggagtagcgatacaacatctggaggctatgctttttgagcttggacggacaatgatgacgcttagaatggggccatctcctgtatgcatttttctactatgtcactatcacacaagtgattcacaaggccagcgatttgcttttcgctcagaatacgctgtctgcagactgaagccttctatttgtgacaccgtggaaactaaagatttttcggcggaacgccaaccggtggagagggcctttttaatagatcttaatgtacccgataggcgttgccgatcttttccacataatgtctaacgcctcttatttttactggccttattgggctcttatactactattcccctccttgacgatcttttatttaccttgttgttctctcctcttttgttttcctccctcgcgccgggggtgatggtattatttggggagtctcgtcgaggaaccaatcttgacttggggatttcgatatagcgttatcgttaccggcttcttcttaattcggtattgctcgtcgtccgattcccgtcttgcgtcctaggtgaatcgggattggtgaatttcnnnnnatgcggattgtgcgtattcgggttatctcgatagatggattagtttaaatccgtattgcgcgtatcgcggtattcctgtatttggtacatggggaatgggggaatcgcgctaattggtggaacttgggtcatcgcaccaattgcggattgtccttcacattggggattttcgggatatcttttctttcatctaatttcctctaccttggtccaatttccgctatttcctcattttcccct

SEQ ID NO: 4467 - DNA, 894 bp, Triticum aestivum
  Clone ID: PAT_TA_4467
ctgcaggtaccggtccggaattcccgggtcgacccacgcgtccgctcccccactgcagccacagctccggcgagagggaatcgccggttccggccatgcgggtgctcccgctggccctcgccgccgccatcttctccggtgtcaccgccatcctcatctacatctccggcctctcctcatatggcggcgcggggctctcggaggcggacctggcggcgctcgccgcgctgcagggagggttcagcaagtgcgtggatgctaatggtctaggactgcaagcgtttggcggagaagattactgtcgtgttgttatacagtacccgagtgacacggtttctaagtggacagatccaaaaactggagagtctgaagggttggcatttgagttcaatctctgcgaagctgtggcctcatgggagcaggttcgcaacagtaccacaatactcacaaaagagtacattgatgcattaccaaatggctgggaggagtatgcatggcgcaggatcaacaaaggaatccttctgaataagtgcaagaacagaactctttgcatggagaagctttcattggttctccctgactcatcaccctctgtacctcccccatctggtagctgtgccggtcttggttactctcgggatcttctttattccaaatctgggggcgagtcagattcctgcgtcccccttttcaattcctcagccggccttgctggcttcctgtcctgcgattaccctcatcccccccgggcggccgccctcttgcccattctctccctaaagttgggtcatctttccacctccccgtcccggtcttttctcatcgcgctttcccctgcataacacccccgcctgtatctcccacattttctgtctccgcgcgttccgctctccc

SEQ ID NO: 4468 - DNA, 671 bp, Triticum aestivum
  unsure (1)..(671): unsure at all n locations
  Clone ID: PAT_TA_4468
ctggatctggccgctcggaggcgggcaagcggcagcggcatcccctctggcgcggaggtggcggctcggggcgtcgtccgtggcgcgaggttgagctggggctgcgccggtgtcctgctctgtgtggcggtgttctccccgtggcggacgctggggtcggatctgggccctcctttgctcagatccatgagccttgagctcagatccgcgtcggtgtgctcggctgcatgccgcgacggcggtgctcagcggtgtgccgcgtcttggctggcggcgttgcccaagagttgggggtggtgtggttggctgcttccgggggagtctggtcaaggcctgatggctgggatgcgggtgtcctggctgggcttttttggcttgtgaacttgggcttgacgtggtgctgccttggcctaaagccttctgtttgggcaatggggggcaactctgcattgaccttgtggcgggctgtccttgaaaattggcttgcctcaacagcagggggggttggtggcgaggttcaacttgggtctaatgtgtgcggggtttataagcttattacattgtggagccacttctcccaatgggaagagatggggggaggacctctcatttttgtctcaattgttattaaaattttaaataattttaattctaaatttttgtaaanatag

SEQ ID NO: 4469 - DNA, 2409 bp, Triticum aestivum
  Clone ID: PAT_TA_4469
cctcccccccggcctccctctgccacctcaactcacatctcttcaacctcgccccccccgagacctcatcgctctttggaagcctggtacgcccgcacggccccaccgacaactctccgccccgccctcgccgccgccgggccccgcactggcttctccgcaccgccccgccccacgggcgcggctccgtcgcgccgtaacaccgccagcctcggtcccggcctccgccccccaccaccggttccccctcggcgaccccgcctccctcttcgccggcgacgacgaccgcgacgagcgcggcggccggatttttccctactcgggctaggttggttgatcccccctacaagtttggtagtagcgcgggtcccccattccaatcccctttccgcatacgctgcatagtaagcacgacgcggctgattttcccagccgtcgtgaccgactgctcctacttccttacagcctgctgctgaagaccgtgagtggtggtgggaggtcattcctatacggaggatcaaccggatttttcgtctatggctactgtctgttatactactatgcccgatcggatatgtctgggtacatgcagacctcttgcttctttgggtacatggcgtgcatctgctatgcattcttcctcgatgctgggtatggtgggcttccgtgccgccttgttctttgttcggcacatatacaagtcgatcaagtgtgagtaaagtgtggttggaggaagaagagcagcaagcagagttgtactcctttttggtgccgctaagaagtcccagtatagaaaaggttagctctcgcgtgcaacaggaagcaactagagattggcatgtttgagattaggccattattcgtaggaagaggtaatgaacctataaaatttcttgtcattgtgcgaccggtatgatgaaccgtctttcctttgatcccccccatgtattatgtgacgtccagacagtattactttgttgaaccataacagcccatataaatttctgtgcaagttcctagggcagaatggaaggggcattcccagcccttccaaacctggggccttttttaccgcatggtcttgtcatctaagctcacatcttcacgcattgctggttacattgccacctcgctctagttgccgtcttttacccttacaatcgtggtgcccttttctctgcattggtcgtcatctatgcactcacctcaggaattgctggttacattgcaacactctttctattgccagctagagggaacgaactgggtgaggaacttgctactgaccggatgcctgttttgcggacctctcttcctgactttctgtttcttgaacactgttgccattgcttatagtgcaacagcagcattgccgttcggcaccatctgtgtcattgtgctgatctggaccttagtcacattccctctactagttttgggaggcattgctggtaaaaacagcaagagtgaattccaagctccttgccgtaccaccaaataccctagggagattcctccgcttccctggtaccggacaacagttccgcagatggctatggctggatttttgcctttcagcgctatatatatcgagctctactacatctttgctagtgtttggggccaccgaatttacacaatctacagcattctcttcatagtcttcatcatcctacttatcgtcactgccttcatcactgttgcgctgacatacttccagcttgctgctgaagaccatgagtggtggtggaggtcattcctatgcggaggatcaactggatttttcgtctatggctactgtctgtactactactatgctcgatcggatatgtctggcttcatgcagacctctttcttctttgggtacatggcgtgcatctgctatgcattcttcctgatgctgggtatggtgggcttccgtgccgccctgttctttgttcggcacatatacaagtcgatcaaatgtgagtaagtgttgttggaggaagaagagcagcaagcagagttgtactcctttttggtgccgctaagaagtcccagtatagaaaaggttagctctcgcgtgcaacaggaagcagctagagattggcatgtttgagattaggccattattcataggaagaggtaatgaacctataaaatttcttgtcattgtgcgaccggtatgatgaaccgtctttcctttgatcccccccatgtattatgtgacgtccagacagtattactttgttgaaccataacagcctatataaatttctgtgcaagatacaatgaaaaaatctccggcccggacccacgtttctccagtgttgactccgcccagtcgatctgtaccgttctacttgtatcctatgcgttctggttataattgtcagattttgaaacagcaaaaaaaaaaaaaaaaaaaaa

SEQ ID NO: 4470 - DNA, 727 bp, Triticum aestivum
  unsure (1)..(727): unsure at all n locations
  Clone ID: PAT_TA_4470
cggaagctgagccatcccctcccgccgtcctcggcgcgagcgcgattcaattttcttccatcaacaactagggttaggagatctggagatggtggcttcggccaacaagacgccctcgttccgcgcacggccggcgaccggcgcgactaattcctctccagcggctgccttctctcctctccggccggtggcccactgcgccaacccaccacgacgacctcgttcccgcagggccggcgaccgaccggcgcggctaattccgttgcggcagctggcttctctctctccgacgtatggcgcaccgggccaatcctcctctccccatcgaattggtactggatccaggtccgaagttgctttgggggccccccgcgcaccaaccagtgctccaccctacactacttgcgatttctagtcttctgctggagccgccagccaccctccaccactgtcggctagagtaatcaccggcccgtagctgatctatatgccctcaggcctgcacgggttggtcaccattggactgcccgtggtgtcattactcacaacccgttctactgtgatcgtgaaggttccgccaggacanaaagggtgcttggtggcactactggcttctgcagttattaggacctatacactatgcattggaaggtctattataggactggagccatactattggccccacctatgcagtttaacctccttttgcttttgacgaacaagt

SEQ ID NO: 4471 - DNA, 638 bp, Triticum aestivum
  unsure (1)..(638): unsure at all n locations
  Clone ID: PAT_TA_4471
agcgcatcatttaagccaagcaagctgtggtcaatacaaatccaccatgaagacatttctcatccttgccctccttgctattgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattcgcagccacaaccatttcgaccacaacaaccatatccacaaccgcaaccacagtattcgcaaccacaacaaccaatttcacagcagcagcagcagcagcaacaacaacaacaaccacaaccacaagaacccacaattctttcacaaattttgcaacaacactgattcatgcatggatgttgattgcagcacacaactttacgcatgaagatcacagttttgaacaaatactaccacttgtgcaagaatgtgttggaacaactatggcagatcttgaacagtccagtgcacgccatccccaatgtgttatgctttaatttgttaacan

SEQ ID NO: 4472 - DNA, 536 bp, Triticum aestivum
  Clone ID: PAT_TA_4472
cggacgcgtgggcccggacacagagcccgtgcgctcgaacgctcgtcgaaaaaagaaaaactcgcggcagcacccatctctattcccgaactcgccggcgacgagtgacctatggcggacggcggcgagatggacgaggaggcgatgatgcgcgccttcttcccgacctcatttggcaaggcgcccacccgccccagcgccgcctcccactcctccaccctccgcaagccccaaaaccctagctccaacccctccacctctgccgccgccgaggaggacgatgtcggtggcgccgttgtcggaccccctaggccgcccaaggaattggctcctatccaggaggatgacgaggagggtggcggtctgattgggccgcctcggccgccacagcggccgtctgcgcacgcggcggtggaggacgaggacggcagcatggttgggccgcctcggccgccaccgtcgaaggagggggatgaggatgacgaggacgagggcgacgaccacgacgaggatgacgacgacgatgatatggatga

SEQ ID NO: 4473 - DNA, 359 bp, Triticum aestivum
  unsure (1)..(359): unsure at all n locations
  Clone ID: PAT_TA_4473
gcgctaggccgctagcaaagctctcggccaaacaggcatcacgcgtgctgtagcaccaccggttggttcgttcgccggcgacggcaccgcggtgatcagcgatgggggagttggcgtgggcggcnctggcggggcttntggtgccgctggccgcggtggcgctggacgccgcggggggggncctttgcgcgtgccccctctccgtgtncctctgctgccggtgttcccgctggttgccgggggtcgtcttggggtggccctttctgttcggtttctttgcctctgttggccttggtttctttggtcttgctcgttctctctcctttgtccgttttggcctgtcttgtcttttcgtcttt

SEQ ID NO: 4474 - DNA, 739 bp, Triticum aestivum
  unsure (1)..(739): unsure at all n locations
  Clone ID: PAT_TA_4474
cgcttatagtcataagtcgtccactcataagtcattagccatgtcccgtttatctgtttccatgctatgtttcctccttgctttgctaactcccgccaacctcacttcagccaccggcaatatcggattcagcctgcctctcgtgtccagccaccacaagctcaaccacacaaccggtgaaatcggggagctcttgctgcctgagggtgatgtgaaccccatgaacgtacgacccagggtagcccctgccggttggccgatgttcagtgtcgtcgtcggagtcggcagcggcagaggccagcacttctataagctcgcgctggacttcgtgggcaacctcacatggatccggtgtaagccttagcaccccagaggagcagcaggagggcccaatctttgacgccgccctctccccaaagtatgcgcttgtcaagccaacgagcatccactgcaagccccccttcgtcggccacggtcatgacaagtgcagcttctccggcaccacttcgctcgctgtcgtgcaagggtacctggccagtgacgtgttcacctttcggcgacaccggcaccggtcatagaagcttgggcggactcatattccggtgcgcacacagagcagatgagttctggaaccacggcgttgtcgttggtgccatgaagctgtccacgtcgttcaagttaccaccttgctgcgcacgggtttcgcccttttaaaaggtttctaactggcttttttacn

SEQ ID NO: 4475 - DNA, 730 bp, Triticum aestivum
  unsure (1)..(730): unsure at all n locations
  Clone ID: PAT_TA_4475
caaaggcaggcaaaaagcaaaaggtgggtggttcttccaaagacccccaaaccgctgagctagagaaacaagtgccaaaggcccctgatgcctcagagaatcgtgatgattctgccaatgacccaccgctgtaaattgatgccatcgttgtagaaccctgagcacagatatcaatccagctgcaacagatgacccgccaagtcccaagtcgccaagccctgccaagctaacgggagaagttcctcctgaaaagactattgaagatgtcaccattactggcacaggctatacaaagccaggaaaccctactctcttggcaaaacatagtgccaaagaagaaccatcagccgcagacaagggcaacttacaactggacctacagaactatgcagattttagtgccggtgaattgcacgcaagctacctaagccgcctgcacacaaccgcgatatggaagctggcttggtgaatctgatgaggcagaaatacgaggaagctttaagccatcaagaatccaaattgggcgagttaaagaaaaatatcaaacaccaagaggctaagatgcaaaaagctaagtcaaacttaatattttctttgaaagaaaatgaagaacttaattcaaaatttgcctccgaccgaaccaccctgngagactgaaaaggccccctttatggaaacatgtcgaaaatggtcaaggcccaactttaagccggcgaaaccaacaactttt

SEQ ID NO: 4476 - DNA, 650 bp, Triticum aestivum
  Clone ID: PAT_TA_4476
ccgagctctcgtatgtccctgtccccaatacgtattcccctccttcccctttcgctttaccttccgacagccggccgtgggcagcggagagatccagtgaaccagctagcgctcccctcgatctcgttctgttcccgtcgctgcaggctgcagccgtccgtcggcgtgaaggaggggcacggcaagcgagttggcttcaagattttgcccgctgcttgtctcatcagagcggtggcgccgctcccgtccgggatgtcggccctctcctactgcaagacagcctccgcctccttgttcgttttcgcgtcaaagatcgaggcttggagttgcctgtgatgggcacggtgatggtggagctcgggcggggataattgaggtgttgacagtggagatggcggcggcggcggctgggcgtcagccgccgcgagcgagaagggtgtcccccatccagcggctcttccaggcgtgtggcgtcgtctccggaacccctgcaccgttcccgtgcctgccgaggacgaggccagaagaggttcaatgaagtgaacaaattactccttacttggtttgcatgcaaagtcatatgattggggtgatattcatctaggtgacagtggcgccttattactggagcgaacaactactggggtgct

SEQ ID NO: 4477 - DNA, 1059 bp, Triticum aestivum
  unsure (1)..(1059): unsure at all n locations
  Clone ID: PAT_TA_4477
gnatganncgnttttggaaattnccctactaatgggaacaaaagctggagctccaccgcggtggcggccgctctagaactagtggatcccccgggctgcaggaattcggcacgagcacaactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctttacaacaacaggttgaacccatgcaagaatattctcttgcaacaatgcaaacctgcgtcattggggtcattccttttgggcaataatctgggccacaaagcgaatggccaggggtgccggaaccatggttgccacaactcgcacaacaattcttaaangggtccagggcggaaccctcccttcgggtggggctttccttttcttgccgnagcggggccaacaccaccacccccacggggtggcgcatttttggcgcctttttatnagcaccggnggggcaagggggtttttgtccaagggcanggnatttntcaancccaaaaanccagnttaaatggggggggnacnnannattgggg

SEQ ID NO: 4478 - DNA, 887 bp, Triticum aestivum
  unsure (1)..(887): unsure at all n locations
  Clone ID: PAT_TA_4478
cgagggtcgtctgggagcagcatttgtaccagnacctggaaggaaaattcttagcaaccgagaatttctaccataccttgaagttctttgggctccgttcgaagtcttttctttctgatttgatgctggctggagaccaattttgccatggggattggtcatcaaacattaaaagggagcactgttctttcaatgagggggaactgctccttttttgcttctcctcggcgtatattgtggccttactgcatgatactctaaaagtgcccatggatcataagaatgtgctccatcctgaagccgagaagatctcgcctcaagacaatataggacatggagagaggccggcacatgataacaagggtcagccgatgagccttgcgcctggtcgctgggagttgttcctgcgatggagcagcagtgatcgcatatgtaaatattcctgacctgtctttttaccagtggacattgtatgattccgacatgctgccctgctgaacaggaccgagtgtaagcaacccttttgtgagcatagttgcttaatgcagtcactggtgcatcacgcatgggttgttgaaattccgacacgctgccctgctgaacaggaccgagtgtaagatcaatgacttgggtttgctgcagtacttgtgagcatagttgcttaatgctctatttggtactccctccgtcccaaaatataagatcatttttttatacgaagatggtgtcaaaaatgatcttatattttgggacggagtgagtaccatattattacttgtaatgtagttggaagttgtgtgttgttgaaatcttcgaaatacgctgaatactcttgggtcatctccgaaacaagaccaatttttcaaaaaacaaaaaaaaaaactcga

SEQ ID NO: 4479 - DNA, 1034 bp, Triticum aestivum
  Clone ID: PAT_TA_4479
aggctccggtggtggaatgtctctgttccactatgggagaagaaattttgcaccgatgcttgttctatcccctggggtaagctatgcgaagccaagaaattgatgtcattgtacacaaacattgttgactgggatgattcggctgcattcgaggctttcaaagatgcaaaggaccgtttctgtgctgcatatcatggtcaaccttgttacatcccattgcctgacccagacatgtacattgcggcgcgcggcccagatgaatatatcgatcctgagttggttgctgatctggagaggtcacggcgtcgtgctcccagaagggacagcaccgccccaaatggctgggactccttcatcttcgcagacaagccagttccggccacaggatggggtgatggggaaacaaccaacaccattggccaacaatgctctgtaaactgggataatcatgtggaacagctcgttgaagcaaattgcaagcaaagctcggtgaactgggacagttacgtcagtcagcctgctgaaacatttgttcagcaaagctcaggaaactgggacgcgtatgtggaacagcaaggtcagacaagcggctggggggcgccgatcattccctgcacatccaattggggcatgaatggtgacccgtggaaccatgactatggctggggctcttcagctattcagacagattcatggggcgaccagaaagatagctactatgtgcctgacagccaggctcagggcagctcagacgggcactggagaaggcgaaacagccagtcgggcaggcggaacagcaggaacagagacagagggggtcccatcagctcaaaggccatgaaatccaagtatcaggcggacgagcacggcggcgcgaataacgggtggaggcactgccgggtgagagataacatgcagtactcttatgagcagcctggttatgctgcccaccagtcacttagcaatgtgagaaaggatgatgaagaccatttgggccgctttggaggtgccattttgcgggtgggaaatgtgga

SEQ ID NO: 4480 - DNA, 962 bp, Triticum aestivum
  unsure (1)..(962): unsure at all n locations
  Clone ID: PAT_TA_4480
aacaaattgatcgaagagctgcaaacggtaaccaagagaatggttgcacggaaatatgcacgtgagagagatgttctggtgaagaatttgctgttggcaatagataagatctctcactttgagtcagatataccgtttgtcgacaagcaaaataaggatgcagctttgcaagcaaaagactggcttttgaacaagcagagggagcagaagtcggtctcaatatatgaagatgctgtcctaaagtgtactgctttagacaactggattaagaggctagaattagatcaaacaactgaagggtcattactacaggattcttcgacgtcttcaagtggatacgaggagttgccagaggggagttcggttgaggaacaaacgaataaatttcccccaagatcagttcctacaggggagactcttcttgaaatttttagagtagagacaaacttggccttgataaagaccatcctggtctatgattataaaggtgctgcattagtctataaatctaagcaaggggataagagccgatttcgtaagaaggtgttccaattggctgtcaaaacataccaggaaaacccgttctgatttcatagattcgctcactctcacaggcccgactcggccaatgactgctgacggagagggctgggtcattaaactcgacgtgccggctgagtcaagttttggggtcgaggacccttgatttgtgtgacaaacttttcaaagcaacattgccactgagttctgattacattgacaggccccgatgcagcttattgtctatccgaggtggagttgtaaatatctcgtccattacatttagcaacgcccttcgttgcactggtcggtttattcttgatcgtcgtgtcgatgtcagtgctaaacagtttatatccgaggtgaacttacattgtcaagtgaagactatgatgtgaagttcacgctttttagaagtcaan

SEQ ID NO: 4481 - DNA, 651 bp, Triticum aestivum
  Clone ID: PAT_TA_4481
cccccgccctccctctccgtccctctcccccccccccggcgccccccccccctgcccccccccgccctccgcccccccgccccccccgcctccccccccccgcccgcccgccgcccgccgccccccccccccgcccgcccccgccgcccccggcgtcgcccccccgccccaccccctccatccgcccgcggacgcggcctccccgccgcccccaccgctggtcccgcgtgcgctggaacctcggggcggtcgctccgcgtcctgccggggctcctccgtggggggtccggctctgcgtcccgccgtggttccccgggaggttcgtcgttcctctttccccgccctctcggtcccccgtgcgttgctccgccgccgcccgcacccccgctggggtgccgctcggccctgcgtccgcgtgtggcctctaagcttgctgccctgcagttcgcgccccggggcttcggcggtttgcgtcccccggcaccgctgcctccgttcggatgcatcggcggcggccggccgcactgctatgttgccgctggggcagcgactgcttgtggcaaacaaaagcaagcagcagctgcagtacgcggcgcttgggcaggaggtgtttgcgtcagccagcaacggcagccatggctttagcaagca

SEQ ID NO: 4482 - DNA, 658 bp, Triticum aestivum
  unsure (1)..(658): unsure at all n locations
  Clone ID: PAT_TA_4482
catcatttaagccaagcaagctgtggtcaatacaaatccatcatgaagacctttctcatccttgccctccttgctatcgtggcgaccaccgccacaactgcagctagagttccaatgccacaattgcagccacaaaatccatctcagcaacagccacaagagcaagttccgttggtacaacaacaacaatttctagggcagcaacaaccatttccaccacaacaaccatatccacagccgcaaccatttccatcacaacaaccatatctgcaactgcaaccatttccgcagccgcaactatcatattcgcagccacaaccatttcgaccacaacaactatatccacaaccgcaaccacagtattcgcaaccacaacaaccaatttcacagcagcagcagcagcaacaacaacaacaacaacaacaacaacaacaacaacaacaacaacaacaacaacaagaacaacaaatccttcaacaaattttgcaacaacaactgattccatgcatggatgttgtattgcagcaacacaacatagcgcatgggagatcacaagttttgcaacanagtacttacccactgttgcaagnattgtgttgtcagcaccctatggcagatccctgaacaatcccagtgccaggccaatccacatgtgtgt

SEQ ID NO: 4483 - DNA, 681 bp, Triticum aestivum
  unsure (1)..(681): unsure at all n locations
  Clone ID: PAT_TA_4483
caagcaagcagtggtcaatacaaatccatcatgaagacctttctcatccttgccctcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcagctgcaaccatttccgcagccgcaaccatttctgccacaactaccatatccgcagccgcaatcatttccaccacaacaaccatatccacaacagcgaccaaagtatctacaaccacaacaaccaatttcgcagcaacaagcacaacaacaacaacaacaacaacaacaacaacaacaacaacaacaacaacaaatccttcaacaaattttgcaacaacaactgattccatgcagggatgttatcttgcaacaacacaacatagcgcatgcaagctcacaagttttgcaacaaagtacttaccagctattgcaacaatggtgtngtcaacaactgttgcagatccctgagcagtcgaggtgccaagccatacataatggttgtcatgctattattatgcatcaacaagaacaacaaccacagttgcaacaa

SEQ ID NO: 4484 - DNA, 715 bp, Triticum aestivum
  Clone ID: PAT_TA_4484
caccaacagctcaactccccccgcgtccgcccggatccctgtcgtcggcgagccggcaatggccgacgacgttcgcgagctccttctctcgaccaccgccgacgccgacccctccaccccgctatccgcgcccgacctccgcctcctcatcgaccacctccgccaccgctccgaccgcctgcacgcctccgccctctccttcgcctcctccaaccgcgagccgctcgcctccgcgctcctccgagccgccagctccgcggcctcgtcagcgtccctccagtcctccctccagtcggcgctctccccgctctcatcctccccggacctgtccgacctcaggtccctctctgatcgcctcgtagcggcccgccgcgagctccgcgagcgccaggagcacctcgctgccgcatcctccgtagcttctctctctgcgcggcttcgcgccgctcgcgcctcagccaacccccttgatgctgccgctgccgccgccgagctcaagcccctcctggtgaaccctgagggatctggatccggtggggacgagccagtcgtgtttgggcttcttcggggcgaatgggagcagctcgtcgacgagctgcaagtaggactttcgaaaaatgtggaggaatgcgtccagtttgcaccggatggaagggaaggtagcgggaaggctggaccgaaccgcaattcaagtgggacgccccggggtgaacct

SEQ ID NO: 4485 - DNA, 848 bp, Triticum aestivum
  Clone ID: PAT_TA_4485
gttcggcgacgcaaccatcccttccgttccgtcgtctcgctcctcctccccggcacgaacactaggcagaaagggttcaaatttcggcctgatccgggcgccgaacaccttgattccaccatccgaatccacttcccctttccgatcttctcgtcgctgttcgatctgccccttctctcgccgattcctgacaagatctgatccctcctctcacccatggatccgcgcgccaggtaccctcccggaaccggcaacggtcgcggcgggaaccctaactactacgggcgtggcccgccgttgtcgcagaacaaccaccaccaccaccagcagacgtcggcggcgcaccagcaacaatacgtgcagcgccagccgcagccgcagccgcagcagcaccaccaaaataaccaccagcagcagcaccaccaaaataaccaccagcagcagcatcaccaaaatcaccaccaccaccagcagcaacagcagcagcagtggctgcggcgaaaccagatcaccgcggccgggaccagcgggcccaaggtcgtggcgccacccccagcggcggtcggcaacgatcctagttcacaagattggaaggcccaactgaagcttccacccgcagatacacgattcaggacagaggatgttactgccaccaaagggaatgagtttgaagactattttcttaagcgtgaactcctgatgggaatatatgagaaaggatttgaaaatccctccccaatccaggaagaaagcattcctattgcattaactggcagtgatattcttgctagagcaaaaaatggaactggcaagacagctgcattttgtattcctgcactggaaaagat

SEQ ID NO: 4486 - DNA, 501 bp, Triticum aestivum
  Clone ID: PAT_TA_4486
cccacgcgtccgcccacgcgtgcgaaacattttaagggtaggaccaacgagaagagcaaggatgtcaccacacttgactggaatggggaaggaacactattagccacgggctcctatgatggccaagcaagaatatggagtagggacggagagttaaagcagactttattcaaacacaagggacctatattttctttaaaatggaataggaaaggtgattttcttctaagtggcagcgtagacaaaactgctattgtctgggatacaaagacatgggagtgcaagcagcaatttgaatttcattcagctccaacactagatgttgattggcgaaacaacaactcttttgcaacatgctcaactgataacatgatctatgtttgcaagattggggatccacgcccagttaaaacattcagtggccatcaaagtgaagttaatgctatcaagtgggatccaactggttctttgttggcttcttgttctgatgattggactgca

SEQ ID NO: 4487 - DNA, 775 bp, Triticum aestivum
  unsure (1)..(775): unsure at all n locations
  Clone ID: PAT_TA_4487
gttcagagagagagaaaggtgcagcgagagcgagagcgagagcaagggcatagccacggcaacaacacccggctccggtgcaggttcagaatcagatgcagcggcccgtgtaagctcccccgactccggtgcaggttcagaatcaggtgcagcggcccgtgtacgctcccccggctccggtgcaggttcagatgcagcggggcatctatgggccctgggctccagtgcacgggtacgccgtcggaatggcgcccgtgcgggccaacgtcggcaggcagtaccaggtgttcggcggagagcgtttcatggcccagcaatactacgggtacgggtacaaggaaggagcgtacggcgcaggtagcagcaacggaggagccgccattggcgacgaggagagctcgtccaacagcgtgccggcgccgggggatggcacgggggagccagagccagagccagcagcagaagaatcgcaggacaagcccgtccaatctggctagccgcgtgggcggcgcgcgttagcttctgcgtcctgtgtactgtaataattttgccgtgtcgatcccgccatggtttgtgtgtgcgtagtgcttacctaatgtgggcttgtcctctagtaattccgtaagtggctttaaccctaatggtggggctttggtccctctaagtaaaattcaatgtaactggcttaattctaatggtggggccttggcccctctaagtaaaaaaaaaaaaaannnnnnnaaaactcgagggggggggccccggtaccccaatt

SEQ ID NO: 4488 - DNA, 703 bp, Triticum aestivum
  Clone ID: PAT_TA_4488
ggtatattttgtagcgaataaattcatacccacaggatattccatgatgcgcgtattattggaggatcttgaataattaccgcgaaccattcaaaggaaacactaatgcaggaagtaattaaacggcaaaaattgcactggaaggcgcctctatataaacagtagcagaatgaaagcacaacaaccagtacaaaaggacaataggagaaggaaccaaagaaacagtaaagaacttttgctatggctccaatcaactcaaggtttctgtgcttgatggttcttttgatgatctcatccacttgcttgtcgagtcaagtatcagagatcaacataggtacatctatttcgaggagagcttatcaattatagaggatttttttttttggtttctgggatctagtagatatttataattagcacccgtttacttgaactcccagtactgcccataaaacaaaaaactgccatggtggtttgtgactccatcctggtatattgaattcatcataacttcaacgatgacaatgggatataacatactggtaaaatgttgggcctggttttggttgcacacttacatggggttttcataagaattgaagttaaaatagggaactggtctttcggttttgatgcacctattttttttgcttgcctaagggtgaagcaacgaatgccgggccgtgaaacctacagtacaatg

SEQ ID NO: 4489 - DNA, 857 bp, Triticum aestivum
  unsure (1)..(857): unsure at all n locations
  Clone ID: PAT_TA_4489
aacggctacctccccccatttcaaacccccctcgcgcacgccatccaatccgcccaccaatcacgcggatttgcgccgcgccagccagccgccgtctccacccagatccgtcgatccatcccgcccgcccccggaaccctagatcggacggagccctgccggccagcgatggcgccgcagccgacgccctccccccgcacgggcccgccgacgacgccgcaggcgtcggcggcggcgaccccgttccggacgcccgtctccaagcaccgccttcacttcccgcccgccacgccgcgccacgggggggccggcgccgccacggagcaccccgtcgaggtcatcggccgcgtgcgcaacctcatcgcctccgccgcgggcgcctccgtcctcgaggtccccggcggcgcgggcgggaccacggtcccggtccgcggcgacgcggggggcatctcgtgccgcgacttcagcctcgacggcgtctccgtttccgaggaggaggacctcgaggggttctacccgcgctttggcaggtccgggatcccaggcgtgcgggtcggggcccaatgcaccgtaatggcttacgggcctaccggggcccgggaagattcaaaccatggttcggtggggcaaggaagcccggggatcgtgtaccgcgcccccggggaaatcctctaaagggggagggggtttaggttctgtgcgctgtccaagtcggaaaaggaggaataantcttgtttattgggttttgcttttattcgcattattccaattcttatataattaacacggatgggggttactctctttctttatgtgtggggtacttaatttccgaaaggtgacccctccgtggtct

SEQ ID NO: 4490 - DNA, 576 bp, Triticum aestivum
  unsure (1)..(576): unsure at all n locations
  Clone ID: PAT_TA_4490
catgaccaacgctaaagtagctggagtgttaagcctcctagtccttgtggctatctcttcttgtccacgccatgcacgagcaggccatgcggtagatcactgcctcattgataaaaagaaggtgatgcgggactgttggcataacattgaaaagaactttggtgacccgttcccgtcacacgggagcatatgttgtgatacaataagagattcaaaagacatccactgcgtctgtgatcggttcaccgctgacgaactgactgtgatcagtctatccaagtttgctacggttacacataaatgcggcaacgggttgcacgcacacactcattatgcaggttaccgtgttcccatcataacgctgccacctccaccaccggaaggtgcctagactttcaatgtaagaccattctcgtaatggagaaataattgaataaagcaaagaatgattcgagatgaatggcatttgcaaagtgtatttgcctttgatgtgaataaaaaattggtcatagcctaaaaaaaaaaaaaaaaaactcgagggggggcccggaacccatttcgccctatagtgagtcn

SEQ ID NO: 4491 - DNA, 467 bp, Triticum aestivum
  unsure (1)..(467): unsure at all n locations
  Clone ID: PAT_TA_4491
ctttcttggtcacccaaactagtctctctcttcttgattaacttgccacatcagactttatgcntatgtggcaagcttaacacctgtaggagcaagtaaaagtaagtacaatagtgcgctttacatggcatttttgcatatgtggaggaaagagaggcaaggaaaaagtggagaagtgggctctcatgcaagagccagcctgtactacatggtggagcattgggagaggcacctgtatggaggtggtcaagaatcgggagactcacgccggtcgtagcgttgtagttaaaatgataatggcaagtcaaatcacggggccccacctgtgcagcagtaacccgttgtcaaatcacacagccctacgtttgcagcagcctactccctcgtcttctgtcgtcactgtcgaaccgactaggcggaactgccccgccgcctaccgcgtcaggtaaagcccccgcgtggacccg

SEQ ID NO: 4492 - DNA, 2285 bp, Triticum aestivum
  unsure (1)..(2285): unsure at all n locations
  Clone ID: PAT_TA_4492
cgtggttaatacctctatgcaggtgtcacacacggggctcgtgttaatcgtccaacccttgtagatactgaaacaagttggaggatccattgcagcgtagtggatgtggtctatatcgagtacattctgctgccatgcataacgatgaaatgtgtatggaggtttctccagtttaccgtacgaaggatgaaccatggctcctgccagggtcagcattgaaggctgacgagaggacaccagccaattcttctggaggtcgaaggtgttgcctacaacgaggcctatccgacccaggacttctttgtcgttaccaaagtctacagtaacgaatttgactaggttgctctcgaggaagtccttaaaatcctggcattcaacgtcggcatggcatatgtggtagaccaagcataagtcatgcacgcaaacctggatcacggcgggcttcttcctctcttcgtcctttagatccttctctcgtcccaggactgtggtgtactcaacatctagcccagcgacccactcatcatctgagtcttcgaacatgcgtctgaagcgagaaaggcatcctttcaccgtcgcggaagaacgggtgtagatgacgtcgaactcatcgccggtgatggttctaaccttgtactcaccgccgatcgtggagatttgggacgccatggatttgggaggagggttaggattagtggaactgccgtaatgtgaatggacgtgacgactaggagcaaaccaccatagtattgaaggacgtgcggggacgagtaggagcgaactgccagcgtgcgaacggcagggtagtggctttccattctcccatgatacgggcttccgagagcccttggatctgagatcgaacggttgcatggcgtgattctagacctatgggtgaatatcctatcctgaagggttattctgcaaattttcagcaacttagcatgcgaccgtttgatctcagatccaagggctgccagcagcccgtatcatggtcgcgcctaccacgaccgtcgcgtcgctcgcgcggtcgcgcccttggagatttaacacggtgcgttaggctatctgatgttggcatgtcatacatagtcatcacttagtcactcatactacaacaaggttggctataaggttggctataagtgtttttttttactcctctctatctctttcttcgtactccctccgtcccataatataagaacgtttttgacactagtgtagtgccaaaaacgttcttatattatgggacacagggagtactagtatttattgcattttccaaggagtgacctcttccaatgaaatggtgttgctaagtttgcttcatttaattagctatagactcaaaattgtcttttcacctaggtacacgcgcttagcaccgtttcttccttgggtcaccaaactagtctctctcttcttgattaacttgccacatcagactttatgcctatgtggcaagcttaagcacctgtaggagcaagtaaaagtaagtacaatagtgcgctttacatggcatttttgcatatgtggaggaaagagaggcaaggaaaaagtggagaagtgggatctcatgcaagagccagcctctactacatggtggagcattgggagaggcacctgtatggaggtgccgcggaaaaaatagtcacgcaccgtcaaatcacgcgcagccaccttgatagtggcaagtcaaatcacggggccccacctgtccagcagtaactcactgtcaaatcacacagccctacgtatgcaacagcatactccctcgtcttatcgtgtctatgtggaactgtctaggcggaactgccccgccgctaacctcgcaggaaaagccccgcccgtgggaaaagcatagtataagatttctaaatttaatatccatggccatggcttgcgccatggagcaaagcctctagaaaacggcggtacacatgtacggtgtatttagcacgcgttcgcgtcgcaacccaagacggtcggttgggtctggcacgctactctccaaatggaacgtgcgtcatattgcgtttgcacacacatgtngggactgcaatttaagaacccgaccataggacatcccccgtccccgcaagttggctagttagtanaagagagagacgagcgatagtactggagttatggctgttaacactcntnccttaacattcccngcacgacacggagattnatttgtccatcaagttaaccagacngcgcaaatgcttgattggttcgtcnacattcgtgnaggagtgttntacaanacgttattt

SEQ ID NO: 4493 - DNA, 686 bp, Triticum aestivum
  Clone ID: PAT_TA_4493
cccacctcccccctccgtgtccctcaagattctccctcccctccctccctcccacccgcgcccacgaccctagccattccacgcctgccgcaggggtggcatgctcgccacgttcctcgggactcgccggccggccttgaattgatggatcgtcgggcgcctccccctccttcctcgctctccggcgcctcgagcccccgctgccgcttcgatgcggcgtggagggcgctcgggacgcgcggcgccgcggccgcggcggccctcgggcaggcgctcggcgcgctgctcgccttcgtcttcgccgtcgtgggttcactggtcgggatcttcatcggcgccttcatggggatgtccaccgagagcggcatgctccggggcgccggcgtgggagcggtctccggcgcggtcttttccattgaggccgctgaatcctgcatcgagatttggagatctagcgaatccggaaaggatagctttctctttgtgctagacatcatctctagcctcttcagtggacgaattgtttgggagaagggcagtcccagactccagcgtgcagggcccagtgcagatgagtttaaatgaggaccaccttttctttgcccaccaatgaccctttttggaaaccggtttgcacgggcgggtatggccagaacctctgcatcacaaggatccccagccattcc

SEQ ID NO: 4494 - DNA, 682 bp, Triticum aestivum
  unsure (1)..(682): unsure at all n locations
  Clone ID: PAT_TA_4494
gttctccatgacatcgaatttaggaaaaatggactgccacatgccagaatccttgtttggcaaaagaaaaaacagaatagattggtcgtgccaactttcatgagaaccttcgtttcaaccactggatctgagctaatcgatggttatgatgatactcctacatatggtcacatgcctcagctacaaaggagtgagccgactgttgaagggtccaattcatcaaacatattacagtcctatctcagtcaaagtttccaatgagcatgtgaaagtgcctgttctatgtatgaagccttactaccttgatgcttggtgcctcaagtcctcactatgttcaccacaaagacaaagtaacaatcgccttttaaancaacggccaatccctcacacccccgggggcgcacccaacctctcggcgctcctggcccggcttatgccccgggcttagcgcttctgtgtcttggccatttcgccgcccccggtcctgtcttcgccgtccccgtccctgctgcttgcctccccccttaatacccggccactctcgcctcagactattaccgctgcaatactaagttttctcaagtttatgtcanaaaaaaaaaaaaaaanaactcctgccgaattcggcaccaagttgcccagtgatgcgggaacagtggttgcaagccgttggcccaaaact

SEQ ID NO: 4495 - DNA, 1466 bp, Triticum aestivum
  Clone ID: PAT_TA_4495
gttaactctccaacagccacatccatggagctcccctatctcgcgcgtcccctccctcgggcgcctccgccgcgcctcccgccctccgtcgtcggcgccccccgcgctgccgcatctcgccgcggctaattagccagtcgatgtgtttgcatttctacaacatatacatccatggagctcaccgctcacactctcctcctccctctggtacttgcggcgctcctgcacaccaccaccgccactgttgacgatgccacaccaggcctcaacggcggccttagcctgcgcatggttcccagccctggctggaacagtaccatccatgtcgacgacgacggcttccttcacctgaaggagccagttgggcacgacaccaccgcgcttcgaccgcatgtacgctttctcccagggaagtacaacgttgtcaccactgttgggacaggccatggccgccgcacgtacaccctcgcgatggagatgaccagcagcctgacgtggatgcactgcgcgccgatccaacacccgtttcagcaggtgccgccgccgttccacccgcggacatggccgtgattccgccacctcgcacccacaaaccgcctttgctcgcccccggagcacgacgtgtgcaacttacacctcgccccgctcgccggcatcctcgccctgggcaagacgtacccgtcgctcatctggttactgggccgtggcggttggcatcgcttctcctactgcctcttcttcccgcaggggaaccggcacgggttcctccggttcggcagcgacatcccggtcgacacgaggcacatgaagagcaccaggctgctctaccccgaggcgagcgcctactacgtcaacctcgccggcatcagctttggcaggacgcggctgggcggcaacctggcggaggtgttcaggcgccgaaagctcgcggatggcagttggcacagtggttgcgtgcttgacgccgggatgttctgggggggtacgttcatgatcaggcctgcgtacgacatcctggagcgcgccctggcggagcacggcaggaggctcggggtgccgcgcgtaccccgccacaacttcggtctctgcttccgcgcgacccgcgccatcttgttgcattggccgacggtgacgctgcacttcgaatccgagcaggaccttgtgctcacgccgaataagctgtttgtcctgcaggatcaagacatgtgcctcaccgtgacaccgaacccgcagattaccgtcatcggcccagcgacgcaagtgggcacgcgcttcgtctacgacctcgccgccggcagggtgtacttcgcccctgaaaactgcaatgccgacactggcgtctaggattgatcttctgttcctgtagcggtcaacccaattcgatgtggttaaccgtctgtctctgaaataaaaggaaaattaaactatattgagagtgcaataattaacaaacaaaaaaaaaaaaa

SEQ ID NO: 4496 - DNA, 564 bp, Triticum aestivum
  unsure (1)..(564): unsure at all n locations
  Clone ID: PAT_TA_4496
gcagcgtggtggccgttgaagaggagcttggtcgtcagatggagtgtgtctctggagtgcagcgcgacggtgaaccggcctcgtcactccccatgcttcaatggcgctcggccacacggccccgactcggttgctgagctccgtcccgcatagatcatcggcggcgagatcagccacgggtgccacagcgggctgtgcgccgaagagcggtaccaccgggggccctgcgccggccgcggcgtctgcagcgagccgtgccgcccccatccctttgacgagcgattgtgcctgcactcacacctgaggaccgtcgtctgctccgcacccacacgggaccagcagtcgatgccgccaccgcgcaggaactacatccagttcaactatggcatgcgtggttctaggtatagatgcatccacggtttgtgattcgaagttcgttgcactcgcgcttatgtgtgggcatgactacgaaacagggcactagtaacctgttgggtaacctgctggttctcatccaaaggcgcagcaaagaaccaaccccccaaccggagccttattaccncn

SEQ ID NO: 4497 - DNA, 1021 bp, Triticum aestivum
  unsure (1)..(1021): unsure at all n locations
  Clone ID: PAT_TA_4497
ctgcaggattgcagcttctggatgttaaacaagctggtggtgatgttgatggattaatgggcttatcgatcactctagatgagtggatgaggcttgattccggagtagtggatgaagaggagcagttcagtgaccgtacatcaaaaatacttgctgcccaccatgccaaaccaacggacctacttggtgaaggccagactgcagacaaaaagagcaggagatctggtagaagatggggtttgttggggaacaacttcacagttgctctcatggttcaattgcgtgacccgctacgtaactacgagccagttggcacaccgatgctttctttgattcaagttgagagggtttttattcccccaaagcccaagatatacagcaccgtttcagagaaaggtaacagcgcgcatgatgaggaggagcccaatcctgagcaggttcttgnataaagcatccgtcgatgcagaaaagatagaggaagactctgttccccaatttaaagtcacagaagtgcatgtggccggttttaagagtgagcccgagaggacaaaaccgtggggtaatcaaacacagcagcaatctggttcgagatggctgctaggagctggcatgggcaagggcagcaagcatcctctgatgaaatcgaaagccactgcaaaggccacgaaagacgcagctgttcagcaaggagacaccctgtggagcatttcttcacgtgttcatggagcagggacaagatggggcgagttaacaggatctaagcgggacccttatatcctcctcccgaaggataagagattccggggagggctttaccaattntaggtaggtactagtagttcttgtgtgccgaggggtggcgggtttgggcctttctggtggttcgcctgtgtaaccgaacctcgcttgaaattaatgttcctactcctcccatccatattaatagacgcatgctttgtgcgtcaattaatttggatcggagggagtactaaagtgccaaaaaaaaaaaaaaaaaactcga

SEQ ID NO: 4498 - DNA, 748 bp, Triticum aestivum
  Clone ID: PAT_TA_4498
ccagcccccaccctcgctggcgcttgggggtgcggccgcgcgaggcctagccgccgctggcagcggcggggccttcttggtcttcccgttcgggcgtgttggtgtggaccgtcgcgctgggccggagcgtggcgctagagccgggcgtcacggtggcgtggcgggcagttgcggagccgcggcgcttctgctcccccttggcgggcggccaggtggtgggcgagccttggtctccagggacggcgacttcgaggacagatctggggcaggcggcgcgggctgcaggtttctgcccctgccatggccgcggcgtatggtggagcgacgcagctgtggctggccggtggcgggggccgggatccagtggctacagcggctggacgacggtgggaagcgcagatgggctccttggggagcttccttggtggttagcggcggcccttgggatttctccttgccgggggataggtgtgtggtggtgcctcgcgtggagctgcgtctgccgcccagggggggcgacacaggggctggcctgtggggaggcaggctggagggatgggaggcgccgccgagctcgggcccacccgccgccgacaaaggggtgtgccggtcctggttccttcctttccacttcccccttttcccctccccgggggggctttggcgtttgttcaagcacgacgtatgttgcggtttcttaaaacgaggggcgtccgtgggccccaaaacaataacttttgcccgcttt

SEQ ID NO: 4499 - DNA, 847 bp, Triticum aestivum
  unsure (1)..(847): unsure at all n locations
  Clone ID: PAT_TA_4499
tccagatccgcccccttctctcttcccctcttcgatctgcccttcttccatttccttccctgaggcatgcattttctcttgtttttcttcctcacacaggcacctgcaccacgaactatatgcaaggagaggagtgagggtgctgctgggagaaaatggaagaacgggatgcacctgaggagcgaggggttgacatcttggttcctgcttgaccgcgttgcctatggatggtgagaaggagaaggaaggtgctgcaagtgccaggttggatggatcactgtactgctgtgcaacttcccctagcttcacattgcaagcccaatgattcttgtgcctaggatacccacataacacaggcgcatggtgctcgcaagtgaggaatggaggttgttcaacataggcacggaggaggaggaggacggncacggacagaggaggacagagcacctctcttctctaggttagtgagcagcatcaggaggaggagctcaagcacgaccaccaagaggcaccatcgcagcagcagatgagtctgttgatgaagcggtagcgtctcctctagaaggtgaccgtggcggcgtgcccgtgtgcggtttcgactaccacctcttttcgtctgcatttgctaaggaagagccggactttggaaaaaaatcttttcatttaaccaaataccatgttggttttttggaagaaccaaaaagcttattttatttttttcccaatccggagattttaacaacgcctttcaaagccataaccgtaggtttttgaatcaacctggggaaaaaactaaaattagcccccacacccagcagtataattttaccccccccgccgccccaaa

SEQ ID NO: 4500 - DNA, 652 bp, Triticum aestivum
  unsure (1)..(652): unsure at all n locations
  Clone ID: PAT_TA_4500
cccatccatcctttccccttccctcaaaaaaaaaaaaatccatcctttccccgcttctctgccactgcctctgcccgtctgccgactcgtgacggccggacctgccggcggccggccagaggcgagccgccgccaccgcaaggtatccatccgtccctcccgagtcccgccccgtcctctccaccaccgccacgccgtcctgacgattctccgcctcgcaccgcagcgcctccggaatgcctcaagggaggaggcacgggagcgcggcgcggaccgcatcggcgcgctcccggaccccatcctgcagcacgtcctctccttcctccccggcgcaggcgggcgtgcggacgtgcgtgcaggccccgcgctggcgccacctctggagatccaccaagggccctgcgcgtcgtgggccccgaaggggccggccccgttcagggccctccgcttgtcggggccctcccggccggccttgggcccccgcgccgnccccccgacgccgcccagaggtggcccggccgcttttgggggccgcggaaacgccggcccgttcccctgacccctttgcccgtagaggaggggctgcgggcctacccttcacaaggggctccttcttacttagccttggaaaactggcccttggtctcaaaac

SEQ ID NO: 4501 - DNA, 796 bp, Triticum aestivum
  unsure (1)..(796): unsure at all n locations
  Clone ID: PAT_TA_4501
acgaaaaaccccaatggtgaccgcagcttcgtccttagccatagtaacgatagcgaaagctggcgcgccctcgcgcccccccgcgatctagggcgaccccaaccccgcggctccgcggtgccgggagaacgcaaacccacaaccccaaacgcgacagcagcaacagccatagctattgttcttattgtcctcgtcgccgtctcccccggcccccccgccgccgatgccgactccgccgtcgccgcccggatgtgccggaagaccccgaaccccatgatgtgcatgctggtcctcaacgtcaaccccgccagcgcctagaccgccaaggaccccgccggcggcggcgtcgcgctccagatcgcgacggacacttctgactccggcgttgtcaacatcagcaacatcaacaagcgaagccaaggcaggcgcgggggagccgcggcagcgccgctggcccgatcctgtcgaggccaccaccaccaccccaaacacaccaaccgaaccggtcccgacgggttgggccggcgcgagtgcgctggttccagggccccaggccctgggcgacagctacgtgggtgagttcgcgtgaaggctgacaagaaatcacccccgcctgtcataggatagaagatcagtcgacggagtggtgtggcgtcgggactcatggccctgctcacccaccaggtgatcgatcctatgtaaatcattcctcgtgtgtgtgtgcgtgctcccttcaattattataagttggtcatgtaaaaaaaaaaaaaaaaaaaactcgaggggggggcccggn

SEQ ID NO: 4502 - DNA, 660 bp, Triticum aestivum
  Clone ID: PAT_TA_4502
ccacgcgtccgcccacgcgtccgcacgaagccggaaaaagggtcccgtccgattgaaccaacccgacccaacccacccgaccccccccctccccccgtctgtcagccggcgatcgccggagatgtcatggctcgcccgctccatagccacctccctcaacatccccgaggattcaggcgccgacgacgaccccgacgccgtccccgcagccggctcccctccctccgcgcgcgccccgccgccgcctcactcggccgcggcggacggcgtcaaggaggacctcaccgagctatccaaaaccctaaatcgccaattctggggcgtcgccaacttcctcgcgcccccgcccgggaagggctcgccctcgccctcgccctccccttcgtccgcggggggtcaatccgccgacgcggggacgccccctgagattgccgggatccggcgcgacttctcccagatcagcgccaggttcaggagcgggatctcccggatctcgagccacaaaggccgcttccgggttttcaacaataacttcaatttttttgcccctgtaaaacgtaacaagtaagatttcttcgagctttcaacacacaggcgaagattatcccaggttaactaacccgttaaattggaacagctaatgcatttaacttagcatct

SEQ ID NO: 4503 - DNA, 1219 bp, Triticum aestivum
  Clone ID: PAT_TA_4503
gaatgaggccattactgaccttccttatgttgctttctagtcctcaactaaatatatcttgatctcttaacagcttttatacatatcaaaaccttgaccgatgtggttatgtactcggtcaagtgtccctgaaaaatctgccagagtaaattgattcttagaaacacccatatccttttgagcagtaaggtacttcttgttaccaggtagtagtaatgcatgtgtcccaggacgatcttgacttacattttagcttttctactgccaactttttgggtcaactttatctgggaataagccacacatcctagggcacagtttacaagttacgaactattgatttcagtaccatcattaggccattacagacctttcttatgtcgctatctagtctacaacgcagtatatcttggtgtatctactctaacatcttgttttgtgcagtacacatatcaaaaccttgaccagttttgtatctaacttcttgtttcaacttttaagtgtccctgaaaatcagccagagtaggagtaattcttataaacactcatttatctgggctcatcattgctgtggtgcattggctatgcatatatattggggtgtcgttaacattttcagtgcaggaaatgaaaaagtacatcttgtttctgtgctcctttgctttttttttttgtgctgatttccacgaccatacagcttccacactgctgggctagcattaattctagtcagtgttctgtgtagaattattgaactaaatgctggctgcacccacctgttggtttgtacaacctcttcttcaaccttacaatctgttgcctctcgaatctccatcaccctcacgaacatcgccatcacgctcgtgatcatcgccatcgcgctcgtgatcatcgcctactacgctgtctgcaccgacttcgagtgagagcacggctcggaacggtgcactgctacgcgtcaccaccgaccgaccgagcacctcattctggcgatcttggagtgagagcgcggctctcgaggctgcactgctacgcgtcaccaccgaccgaccgagcacctcaagtcattctggcgatcttcgagtgagagcgtggctctcaaggctgcactgctacgcgtcaccaccgacggaccgagcacccaagtcatgctggtgatcttggagtgagagcacggctctcaaacgctgcactgctatgcgtcgccaccgactgaccg

SEQ ID NO: 4504 - DNA, 661 bp, Triticum aestivum
  unsure (1)..(661): unsure at all n locations
  Clone ID: PAT_TA_4504
cagttccagcgctcaccgcccaccagcgaatccccccaacccgaagcatcgatggcccccaaggcggagaagaagccggcggcgaagaagcccgtggaggaggagccgacgacggagaaggccgagaaggccccggcggcgaagaagcccaaggccgagaagcggctgccggcgggcaagaccgcctccaaggagggcggcgagaagaggggccgcaagaagggcaagaagagcgtggagacgtacaagatctacatcttcaaggtgctcaagcaggtccaccccgacatcggcatctcctccaaggccatgtccatcatgagctccttcatcaacgacatcttcgagaagctcgcctgcgaggccgncnagctcgcccgctacacaagaagcccaccatcnacttccgggagagtcagagcttcgtnctgctcgtcctccctggngaggctcgccagcacgctgtcttctaagggaccaaggccgcaaccaagttcacctcctctagaatccgctgcctgatctgcactaagaagaanggtagtgcttgctgggaaatagttgaaagctggcccatgcttttgtggcttcgtgattgaaagggttgaatttgccttgtttttgcaacctaggaattcgaggtaaaccgttcatttttgtg

SEQ ID NO: 4505 - DNA, 951 bp, Triticum aestivum
  unsure (1)..(951): unsure at all n locations
  Clone ID: PAT_TA_4505
atatcatacagcaatacaagtctgccaacagttgcctttcataaacaatagcttccatccattttaattcttctagttgagcttgcagcaaggtcagttgcatggatgagcactagcatctactctaccattcttctcctgttcttttccccacccaccactgctctgaccaacaacggctaaggtggcagacgccagaggacccatgtcattgatgaaccatgccctaatgcttccatcaactactctgtaattccactcagttaaagatcacatctgcgactcagtctctccctcggcactccgaagcgaagtgcatagtggtgaagcaccttacatgcgtggcccctcccttgttggtagacattccctcaagggacaaaccttgccggaaagtggcaaggtcaaagaactgatgcacaggtgccaagaatggcacatcaacagcacgccggcttcagttgggtcgacctggactatgacgccggcggtgaccgttcctcaatgcttgcaccccaaggctcaaggactaccgtggtcccaaaggcggtgaaaaggatggacccctatccttttatttaccccgactgtgtgggtaatgcatgcgcctttttccggctccggtgggcatgaccttgttgacttccctgggagggaaggcgttgtacaaaagaaaacattgagctcgacaagctgggcaacctcaatggttgccttgatgacaccatattgggatttcacccaaaattagtatttaccctttagaataataacaataataatgttgttgtgataaaaaaaaaaaaaaaaaaactcgagactagttctctctcgtgccgaattcctgcagcccgggggatccactagttctagagcggccgccaccgcggtggagctccagcttttgttccctttagtgagggttaatttcgagcaagggatncaannnct

SEQ ID NO: 4506 - DNA, 819 bp, Triticum aestivum
  unsure (1)..(819): unsure at all n locations
  Clone ID: PAT_TA_4506
gaggaaccctagccggtcctgcggacccttcctccccggccgccgccatcccctgcggcaacgccccctcccttctccgccgcctgccaccaccaaccctgctggccgcaatcgctcttcgtgtcgtaaccaccctccgctgcctgtgctattatgcctggcggcgttttgggtgaaataatctcaagggagccggaggcggaagaagagtcaatttccttctgcagtccagacagaaaggagatcgatttcggtttgtgcggcaagcgcagcccaaaaggattaatttttattcggagtctgtccgttgagaagttgtaatcagggccctcctccctttcctgtaataatctcccttttggaggagagccggcctcagtaataaatagaggattgggaggagtaggaggggccgtgcatcgatggaatataagttggcgtcccctatttatttttcgccgacatcgttgttgtgccggccaaaaaattaatatataggagtaagaggggttgtcacagacatcaataaggccagtttttgatcccatcaagggcaggcgttccgacttcaagtaaggccagtttttcatccgatcagccatgaagaatannaatgtcgtcgcagacgcaataaaacagctcgcaaggaagctagtgctggcaatggagaaggagacaggcttagcaagctgcccaatgacctactgctcaacattcttgagagggtggacacgcttgatgcaaaaagggtctgcgtcctgtccaagcaaaggcttaggttaaccaacatggcttcggaattttttcctagttttggat

SEQ ID NO: 4507 - DNA, 825 bp, Triticum aestivum
  unsure (1)..(825): unsure at all n locations
  Clone ID: PAT_TA_4507
cgcatcatttaagccaagcaagctgtggtcaatacaaatccaccatgaagacctttctcatccttgccctccttgctatcgtggcgaccaccgccacaactgcagttagagtttcagtgccacaattgcagccacaaaatccatctcagcaacagccacaagagcaagttccattggtacaacaacaacaatttctagggcagcaacaaccatttccaccacaacaaccatatccacagctgcaaccatttccatcacaacaaccatatctgcagctgcaaccatttccgcagccgcaactaccatattcacagccacaaccatttcgaccacaacaaccatatccacaaccgcaaccacagtattcgcaaccacaacaaccaatttcacagcagcagcagcagcagcagcaacaacaacaacaacaacaacaacaacaacaacaacaacaaatccttcaacaaattntgcaacaacaactgattccatgcatggatgttgtattgcagcaacacaacatagtgcatggaagatcacaagttttgcaacaaagtacttaccagctgctgcgagaattgtgttgtcagcacctatggcagatccctgagcagtcgcagtgcccagccattcacaatgttgntcatgctattattctgcatcaaacacanaaacaacaacaacacccatcgagccaggtcttcttccaacagcctttggaacaaatatccataggccagggctcctttcggccaatttagaaaacccacaggcccagggcttctgtccagcttaacaacttgccccaggtcgaaggaaataagaacc

SEQ ID NO: 4508 - DNA, 1097 bp, Triticum aestivum
  Clone ID: PAT_TA_4508
gacaaatcttccctgtcccgacgaaaccctaaccctagatcgccagcccgcccgccatggatctcctccagtcctcgtacgcgcctggcgacgcatcctcgccggaggacgagtcgctctccctccccggacccctccccgctccgcctcccctccaagtccgccgcccccgccgtcgatgagacagcgctcgcgctatccgccgccgccgcttccacctcccgtcctctcggacccctccctccacctcatccccttccccacgcgtcccgaccagctctgggcgcccgtcctcggtcctcagcacccccacgcgcctatctcatccgcatctggtcaccgtaaccacaagctcggtcatgtcgaagacgcagcgctcctccccttcctcttcgacgagcagtataacactttccatcgcttcggctacgcatctgacccctccggcctccacatcatcggcgacgcgcagccacaggcgcccgacctcgacaccgtctacaacctccctccttctgagcacaagcgccgccgcatccaatccagggaggaaaaccacgagcccctccccccagaggcccaaaaccctgcatccgacgagtgggtcgtgcacaacaaacagagtccctgggctggcaatcgggagggcccgcctgtggagctcacggacgagcagagacagtacgccgacgcacatgcggccaagaaggctgagaaggaggcacgaggcgaagggaaggagaaaacagaggtggtggtcaagagcaccttccatgggggggaggagaaggactaccagggacgatcgtggatcactccacccaaggatgccaaggcgaccaccgagcgctgttatattcccaagaggtgtgtacatgagtgggttggacacactaagggggtctcagcgatcagattttcccccaagtacggccatctattgctgtctgcaagtatggattgtaagattaaaatctgggacgtgcttgagtcgaagacatgtatgcggacgtacatggggcactccaaggcggtacgggatatatcgttctctaatgacggtagtaagttcttgagtgctggctatgaccggaata

SEQ ID NO: 4509 - DNA, 1426 bp, Triticum aestivum
  unsure (1)..(1426): unsure at all n locations
  Clone ID: PAT_TA_4509
cccgcgcctccacccgcccccgatccctactcccaccaccgtcgactccctccgccgccccagcctccgcgcgcccgcttcccctcacccgccccgccgccgttcgccggacctgcccgcggcggccgggggcgctgctcgcggttccagcgcggcacgatggcggcctccggtcctgagcacgcctacagcaatattttgaccggcctccctaggcccgagggtggtcaatacgggaaattctacagccttcccgcactaaatgatccaaggatcgataagctgccctactctatccgtattcttctggagtcagctatccgtaactgcgatggcttccaagttaccaagaatgatgtcgagaaaatcattgactgggagaacacatctccgaagctggctgagatacctttcaaaccggcacgagttctgctccaggactgcgctggagttccagcagattgtagatcttgcagctatgcgtgatgcgttggctaagttgggcagtgatgcgaacaagatcaatccattggttcccgatgggatcttgcgaattgaccactcggtgcaggtgggatgtagcaaaggtcgtccaatgcatttgcagtcgaacatggagctggaatttacccgcaacagagaaagatttggttttcttaaatggggctcaactgctttccaaaacatgctggttgtccccccaggttctggtattgttcaccaggtcaatctcgagtatcttggcaagagttgttttcaacacagatggcattatgtaccctgacagcgttgttggacactgattcacacaccactatgattgatggttcacgggtgctgctggctggggggttggtggtttgggatgctgctggctgcggtgctgggggcagccgagcagcatcgtcttgcctggggcagccgatgaccatggtgttgcctggtgtggttgggttcaagttgactggaaagctaaggaatgggtgtcactgctcccgaccttgtgcttctgggacccttgccctccggggggtggggggtggttgccgcctttggctaatgcctggtggcagtttcgcaagctggccttcatgtccgcccaccatcgtgtcctgtgccccaattggcgccccatgggccgtgnctggcgacatgcacacggatatttgggctgntgccaaccataactgntaatgacaacatattccactaaattgttgggacataagagctaancaaanagtactttnnatttggctgncttgnaggnnacttcttttgcccaaaggccataccnnncttnaagaanaaaaaatgnntnttccngcacaaantgtttanggttggggccangannnnnnangnnnaattntttnngnnncnnnnnnnnnnnnnnnnnnnnnnnnnnnnnnnnannnnnnccnnn

SEQ ID NO: 4510 - DNA, 931 bp, Triticum aestivum
  Clone ID: PAT_TA_4510
ggacaatgtcaaccaagatactatccaacttcttcgcagcggccatgacaattgcaacaactagcacaaggccaacaagggcagcaaccataacgagggcaacaaggccaacagtcaggacaagggcaacaactaggacaagggcaacaaggtcagcagccaggacaaaagcaacaatcaggacaaggacaacaagggtactacccaatttctccgcaacagttaggacaagggcaacagtcaggacaagggcaactagggtactacccaacttctccgcagcagtcaggacaaggacaatcaggatactacccaacttctgcgcagcagccaggacaattgcaacaatcaacacaagagcagcaattaggacaagagcaacaagatcagcaatcaggacaagggcgacaaggtcaacagtcaggacaaaggcaacaagatcagcagtcaggacaagggcagcaaccgggacaaaggcagccagggtactactcaacttctccgcaacaattaggacaaggccaaccaaggtactacccaacttctccgcagcagccaggacaagagcagcagccaagacaattgcaacaaccagaacaagggcaacaaggtcagcagccagaacaagggcagcaaggtcagcagcaaagacaaggggagcaaggtcagcagccaggacaagggcaacaagggcagcatccgggacaagggcagccagggtactacccaacttctccgcagcagtcaagacaagggcaaccagggtactacccaacttctccacagcaatcaggacaatggcaaccaccaacacaagggcagcaaccaagacaagagcaaccaggtcaacacccaggacaaggcaacaacccggacaaggccaccagggtactaccccaattttccgagcaatcaggaaaagaacaccact

SEQ ID NO: 4511 - DNA, 642 bp, Triticum aestivum
  Clone ID: PAT_TA_4511
ccctcctccgccgcagttccgtgccgtcctcccggcgccagatcctatcggaaccgaggtcgtccagtccctccgtcggcaaggcgccactgccatcttcatggactacccatcccgatacggcggctgcccgtcgctccccctcccaaagatccacgcgtccctaagttcgttcgtgcgtgaactggctggtgaccgaccaccagcgcaacatcttgctcatgcactgcgacgggacggtgtatgggagagcgccggtggagctgctcaatacttgctcgacgctcgatcagcggtcgtctcatctgaggacattaatctgccatgaatttgcaacaaggaaaaaaatcaggatgacttcaagattgagccgttcttttcaaaggtggagctattagacattgatgaaagccatggcgatgaggcagagtttatccatggagtcgatgaatatatcctagaatgcaacaacccatctactacattctagcccaaaaacaacaacgcttacacaggctttccatacattgcagcgtgacatgctccattccccatcgttctcagccatagtttggtgtattttctgcccggcaatgccaacaatgtatgtgttgatttaataaagcttcaccgtgcaagatc

SEQ ID NO: 4512 - DNA, 2107 bp, Triticum aestivum
  Clone ID: PAT_TA_4512
ttttttttttttacccagcgaaagttcttgggttctaatttgatagtcttaaacctctatcaataagctgcctctcttcggtacaaaacataatgtcttaaaactatatacataagttgctttccagtgttgtagcttcaagatcacataaaaagcaaagcaactattagtaaaagtacacctgcaacagcattataacattacttctcgtatcagagcttaatagggggaagcacccatcaatgctgtgacatgctgctgcattgttttagctgttcaaactgcatacaggcggataatctggttgatcttggcacgacaaatggggcacccccatttcttcgactcgggatcctccacgcacgacatgcaaccagccatgtgaccccccgtactccagggcccccccgcaggagcttccaatacaaagcgcacaggtaccagagggggtgttacctctgctgcctgctaccgccttcacctgctacgggttttgcggtgtttagggccgtacccccaccgtccgtgcgtggcatggttacctcaactggtgtgtaatctatgggcggatgctcaatggggccatcgtagaaggttccctcagcatgtgggggcccggtgggtgttgggagagttggcagtgcagttggtgttggaaccggaagtgcagttggtgttggggccgcccctgcctcaggtggaatcacaatcgaagggttgttgttttgacttttgttaggtttcgatgaactttgggcggccccccggccaggtacatcccatccgttgtatttgctgctgcttggagcatcaacctgtgcttggccactcgtttttgaaggcgctggagaatctggtgagccccatccgttgagagagctgttcgttgatgtcattggctgcacattgggcaccccctctgctatggctgattggatggaggcattgatagccatcgctaactcaagatcctcctcactgggagtcgactccgctgaaggtgccaaagacggatttggaattggatttggactgggggcattcactggtcgtgcaggaaccatgctggcaacctgtgccatgccacaacatgcactataaaatgatcgaagctgctgcttgtcaccttcataagccggtaaaagcttgtatctagattttgtaactttgtcaaaaattgtcatggaaggatcagccagattatactttggttcctcaagttgagatttccaaagtttgacaacaacacgaggtttagcagcctgcaattcaggatatatagctaactcaagcttgacaggtcttgtcgggttccgtgcttcacgcggtaaaatcactgcccaaatcttcctagtcatgaaccctggagcaaacgcttccaagaaaccaggaccataattctccctcatccatccagaaaaaagagaaatccgtccctctatggcccttacaacgttcacatgacccttttctctagccaggtcaagtgcggtattgcagtcatcatttgttatgaatgggttagctccatgtgagagaagtaaatggacagtcggatcaagtccttttttggcagcatggtgcaatgcagtcccagcgtgtgatccaggccgatatgcattcacatttgcacccagttcaatcaaagctttagccacattcagcagatcagggcgcatgctggcgaccatcaggggcgtcttcccttccttgtcaatccactcaacgcctgcgccctgcgcccggaggttccgaatcccctcgatgttgccgtagttcacctgctggtacagcagctcctccttggattgctgcatccccagtgggactcgccggacggtgcaaatttggggaatgaagtgggagagcggttcccttgcccgaaacagaggatttcggtaggggttgctccagctgaggatacagcaaggaaatcccaactagccgcagcccggaagatcgccggctaggggggacaagccgggaatccccacggcggcgaagagcgaggggctgcggttgtggatggggattggactggaccgcggccaggaagaaaattaaggaaagtatagcacaaaaaaactctgaaagatgatcaaaccaa

SEQ ID NO: 4513 - DNA, 636 bp, Triticum aestivum
  Clone ID: PAT_TA_4513
ggttccttccccaccattcccgtacctttgtttcctcttcccctacctagtctcgagtcctgaccgaccaatctcgacctacatccctactcttccaccgcgtgcgcgcgtggcctacaagccgccgccgtgcccatagctcacggccgccggctgacgccccccctcagacccctccgccctcgccggcttcgccgttcctgttcatgctcatcgcctccctgctgtcccggtcccgcccgcaacctttggccgtcggattttgaggtagtgtactgatgaagacagagatcgaggaggaaggcaccagagggtcctggactgaggaggacaaatccctttgtgcctctgtgctgggcttagatgccttcacatatctgacgaaaggtggaggtgccatatctgaaaatctcgtagcagcgtctgcgttggtgggcttgcaaaataaactccaggacctggttgaagctgatggtaaaagccttcgttggaactacgccatcttctggcaactctcccacaccaaatctggtgaacttgtccttggctggggtgatggatcttgccgtgaaccccatgataatggggggaactccacccctcgtgcccttattcatgatgcatcttcactgagcc

SEQ ID NO: 4514 - DNA, 1195 bp, Triticum aestivum
  Clone ID: PAT_TA_4514
caaacccccacgggtccgccgcagaagagaagggggaaacaggagagagaaaggcgaggaacttttcgttggatccttcgcttttggggacgaaggaggagaaggtctctgtccctctccacctccgcctcccttcttggctggagaggagcaggaggagaagatgttcccccctggcctgatccaccaccgcacggacggccccgggcccggcgaggtgccgcgctccggcggcgcgcccagcctcgtgctcacggcggaccccaagccccgactccggtggacggccgacctccacgagcgcttcgtcgacgccgtcgcccagctcggcgggcccgagaaagcaacaccaaaaactatcttaaggacaatgggtgtaaagggactaacgcttttccacttgaagagtcatcttcagaaatacagaatggggaaacaaactgggaaggagacgccggagcaatctaaagatgggtcttatcttcttgatgctcaaggtggaatgagcctgtctcccagagtttctactcaagatgcgaaagaaagtcaagaagttaaagaagccctgagagcacagatggagatgcaacgaagcctgcatgaacaagtggaggttcagaagcatgtggacatcaggatggacgcgtacacgacgtacatcaacaccctgctggagaaggcctgcaagatcgtctcggagcagttcgcgtcgagcggcttcagcgtctccgaccagagtctcccggagctgtcctccggcggcgtcatgtgcggcaccgccaccgacgcgctgagctcctccgtgttccaccagctctccgtcagctcgatcaacatgcacagcccggggggcaagccttctccgtcgggcatggaaggccagctgcttctccagaggtcacccgagttcaaacgcaagtcatcctgctgagatccaaattctgggtgaaaaagttagcttaatcgtctgctgtagccatgtcgaatctcggccgatctgtaaactgactcttgtttctcttgccactgcatgccaagaagcaaggttttttatcgattaatcgtcgacctatgtttatatatataatgcctaatgtgctgctagtcaagtgccttgattgatatgtcactgtttttattatttatcatggcattattatgatcctactagtaaacacatatatccatttgcccc

SEQ ID NO: 4515 - DNA, 794 bp, Triticum aestivum
  unsure (1)..(794): unsure at all n locations
  Clone ID: PAT_TA_4515
gnnnaggttgttgtnccnagctcgaaattaaccctcactaaagggaacaaaagctggagctccaccgcggtggcggccgctctagaactagtggatcccccgggctgcaggcacacaactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagcttcagcaaccacaacaacctttttcccagcccaacaacaattggcggaagcccaacaaccggaacaatcattcccccaacaacaacgggcattcattcaaccatctctacacaaacagttgacccatgcaagatactctggtgcacggtgcaaaccttgcgtaattggngtatcccttggcaatatctggcacaaagcgatgca

SEQ ID NO: 4516 - DNA, 571 bp, Triticum aestivum
  Clone ID: PAT_TA_4516
caaatacaaaatggcaaactccgccgccctgctccactcactcctctccaccgcctggacgccgcgccgccgcctcgaccgagcctcggccacgcggctcgccccgtcccccggccccgcctgccgctcccgccggccggccccgctccgtgcgcccgatggcgtcgtcgacgaccgcggcccgggcccgacgccgcgccgccggggctgaagaaggcattcgggggctttaccacgagtcgtcccgcccgggggaaaacaatcggggccaacacatgccccacgggttctaccaattcggggaaggcgccttcatgttcgaccaccggctggcccagatacggatgatcgaaggaggcccttcgctttggccgctgtcccgaacaatccgacaaacaaacccaaaacaattggtggaggtggaatgcgaaaattggtggaaacttcagaaacccgggctaaccaatatttgacgcccacagcctcttggaatgacaatttggcgccccacgcccacccttacagaaggaaaagtaccctcccgggttgccaacagggttcctacacaaag

SEQ ID NO: 4517 - DNA, 814 bp, Triticum aestivum
  Clone ID: PAT_TA_4517
cataactagagcacaaggaatcaaaatccaataagtagtacctaacgcaaatccaccatgaagaccttactcatcgtaacaatccttgcgatggcaacaaccatcgccaccgccaatatgcaagtcgaccccggctaccaagtacaatggccacaacaacaaccattcccccagccccaacaaccattctgccagcaaccacaacaaactattccccaaccccatcaaacgttccaccatcaaccacagcaaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaaatgattgccaggtgatgcaacaacaatgttgccaacaactggcacagattcctcagcagctccagtgtgcaaccattcataagggtcgggcttccattatcatgcagcaggaacaacgacaaggcgtgcagatccgggggccactggtttaactcgttcagggtcaaggcataattcaaccttaaaaccaat

SEQ ID NO: 4518 - DNA, 688 bp, Triticum aestivum
  Clone ID: PAT_TA_4518
ccccacacctctccccccccccgctgcctctctgcagcgcccgggcactccctccgtcgtcgccgcctactgtctcttctaaagcttagccagcttcccctccgtccaccagcaccaaccaaatggctcgcttcgccgtggtcgccgccatcgtcgcgctcctggccatcaccgcggccgcgcagcgccccaggccggcccccaagatggccccgctgccgccggccccgacgcggcccgcccccggtcgccacgcctccgaacgcatcggcccccttcgccgatggcctctcccccggctccccccgccccgccccccgacccccccaccggccctccttccgccctccgcggtcgccggagcacccgcgggcgcgcccgccggcgcgcccagcggcaccacgcccgccacttccgccgtttacgcctcctcccccccccccgccgccgcggccccggcccccgcccccgcccccccgccctcgtggcctgcagccggccgccctcgcccgccccccgcgggcctccctctctgttttccgctgttctgctgtctacgcgacgcgtttcttgtggcggcgctgcggggggcgtgacatgacatgaggttggcatgttatcttgccacatactgtatgctcgagaatcggtataatggaattcttttatttggttaaaaaaaaaaaaa

SEQ ID NO: 4519 - DNA, 1108 bp, Triticum aestivum
  Clone ID: PAT_TA_4519
gacccggccgggccacgatcttctccagcagcaacaactccgctccgcaccgttgtcgtctcctctccccggccggagatccacgccacaccgccgcgcccctccgcccggctctcggccgctgcttccgcgatgcagttcttcggcgggtcgtcgctgacgtccgtcgcgccggagtccagcccggcaccggcggcgcctccggggacgggaacgggctccaacgcccaggtgatctacgtcttcaaccgcaacggcgtgtgcctgctgtaccgcgagtggcaccgcccgctccgcacgctcgcccgcaaccaggaccagaagctcatgttcggcctcctcttctccctgcgctccttcaccgccaagatcgaccccacctcaacagaacacgcgaatcttggggcgccactactgccaggtcagggatgttcatttcatagcttcaagacaaacacatataaattgaactacatggagagcccgtctggtataaagcttattctccttacccatccaaggactggtgatcaacgagatgcgctgaagcatatttacagcctatatgtggagtatgttgtaaagaatcctctgtatgctcctggcagcccaatcaagtgtgaccttttcaataaacatctcgatcagtatgtgaaaacattgatttgatcccattcaggtttgggaggaggtgcatgctccacttcatttgaaggcgaacagtaggcactttgtgttctccgaaactctgagccgtggaacagttcgctgtgtggtggcatctctgtgttatttggtttgataatcactatttgttgagaagttgttgcttcaaggacgatacagacttgtcttgtgccaaagtggtcctgttgaatctcactgtatttattgtacacttgcaccctgcattgatggtcttcatgtgtacccactgcaatttgatagctgtacactctgatcacagtccctgtaatttgcacccttcgtcatgatggaccccctcaacaaatggaatgccctctcatatcccgtgttggatgatatccatgagttttctggttatagatcaaatatttttttatttatccaatagtatctttcctat

SEQ ID NO: 4520 - DNA, 610 bp, Triticum aestivum
  unsure (1)..(610): unsure at all n locations
  Clone ID: PAT_TA_4520
gcacgagctcgacccctcgtccgggcgagccgaagtccaccaccaacccatccccccacccccctcgaccgcctccgcgccggccgccgagatggagaccccgccgccgccgccgcgctggccgccgggcttccgcttcagccccaccgacgaggagctcgtcctcttcttcctcaagcgccgggtcgccgccggccgcccctccccctacatcgccgacgtcgacgtctacaagtcccacccctcccacctccccgagaggtcggcgctgcggacgggggacaagcagtggttcttctgcagccggctggaccgcaagtaccccaacggctcgcgcgccagccgcaccaccgccgacggctactggaaggccacgggcaaggaccgctccatctgcaacgccggccgcgccgtggggaacaagaagacgctcgtctaccaccacggccgcgcgccgcgcggggagcgcaccgactgggtcatgcacgagtacaccatncttgncgacgcgctcccgccgcccgcacggtgccgngagtcctacgccctctacaagctcttcgagaagagcggggacggacccaagaacggngagcagtacggngcgccc

SEQ ID NO: 4521 - DNA, 632 bp, Triticum aestivum
  Clone ID: PAT_TA_4521
ctagccaggtgcaaactgaaaactgcaatggcgaacacaacaagatccatagctattgttcttattgtgctcgcggccctgtcctttggtttccctgccatcgatgccgacgccaccttcctcgtcaagacatgcaagaagaccacaaacgccttgttgtgcctggcagtgttgaacgtcgacccaaagagcgcctacgccaccaccgagcacgaccttgccagcatcgcaccgcagatcgcaattaacactgctgaccacaacgtcgaggtcatccacaacttagccatggatgtccaaggcacacctgagggaggcgcgttgaacatctgcctcggggcctatgttgatgccgccaacgacctagagatcgacgctcgccccggttttgatggcgggaactatgtcggcgcaaggaatctcgtgttgggtgccaagggcgctggtggtagatgcgaggatgcgttcaagggggatcaacaagaagtccccggtgacaaacatagatcaacagatgacagagcgttgtggcgtcgcaggtgaactcattggccttcttatacacaagtgatctgtcctaaatgaatctcttctcatatgtacaatcccccgtcaataatgaatgagcaggt

SEQ ID NO: 4522 - DNA, 659 bp, Triticum aestivum
  unsure (1)..(659): unsure at all n locations
  Clone ID: PAT_TA_4522
tccgtccccccccccggaacctgccctccctcctccctttcctttctgaccgagcgagagggtgtgagggaggcgtggcggcgctggagcgcgagagagagagagacatggcgggactcaagctcaagctcatggtgccaccagcattcctgtgcttgcttctactggtcatgccaccactcctacttccccctggatgtgccgccactcgtcttgatcccacccaagggccatctgagggcaacaacaagacctgcacggagctgagcaagaggagccccatcctctactgcgagcaccacgcatgcgtcgacaactgccgtatcgagggcttccccgagggagggttttgcaactggctgcgctgcctctgcaagaggccctgctgaatgtgacgatgctgcttcaggatgttgccagtgatgcagctagtaaataagtaagatgcatcaaagtgttgatgtgcattttcgcaaaagaaaaataagtggtgatgcgcaagttgtaaccgcaacaaacttccttctctaatactatttgtcaactcccagttgcaagctaaaaaaactcgagggggggccccggtacccaattcgncctatagtgagtcgnattacaattcacttggccgcgtttacaacgtctgactgggaaaaccc

SEQ ID NO: 4523 - DNA, 716 bp, Triticum aestivum
  unsure (1)..(716): unsure at all n locations
  Clone ID: PAT_TA_4523
gngtttttgnnccctccctcctcctttaccctcactaaagggaacaaaagctggagctccaccgcggtggcggccgctctagaactagtggatcccccgggctgcaggaattcggcaccaggcaagctccatctcattctctagaagctccatctcaaggtaggattagccccagcacaacacccatcaaaccatgaggactagccttcttctccttgctgctcttggtgttatctctgtcatcaccacaccggcagtagcgctcaaaagcaaatggcagccgatcaagaacatcaccaacccacatgtccaggacctcggcacctgggcggtggtgaagtatcgtatggtgtccaacagcaggctccatttcaaacaagtggtaagcggtgaggtgcagagaatgactgagggcatgaactaccggcttgatgtccaagtatctcggatggatcacaaggatgccatgtacaaagcaggagttctcgaggaggacaaaccgctcagcaccattcgcaagcttgtctccttcgccaaggccaaatgagccatcgatctagagcattagcgatttgtgtgtaataagaaatttgaggactatttacctcttttcacaatcgaataaatgtgcctttttcatacaagagtttggaaggtaggggaagagggggataaagttctaataaatcttcttgagtaaaaaaaaaaaaagttct

SEQ ID NO: 4524 - DNA, 1174 bp, Triticum aestivum
  Clone ID: PAT_TA_4524
cgcgggtcgagataaaggtccctttctgccgggcgtccctcgcgcacgcctgaccagatcggcgccccagttcaagacaagtgttgcgatgccgtccagccttctgaaattggcgggccctcgtgtggggcctctgtttcagaaggagcctggcaagctagatgaatgaggggcgctagcctgcatgggttgtgtagtcctcctgcgtgcagatggaagattgagcagtggaacaacgcacccgggtatccttccctggttgttggctactgtacattcttgcggctgaaagccatgcggcgtgtttcgggttggtggtactgcaacgtcccgtgaccgtggtgggggtacgggagcgttcgttgagttctgtgtttgatgccaactggaattctcaattacctcgactacggctaaatttggcgatcaagaccaagcgctttcatcttcctattaagctccgcctctgccttcatcgacactgacagctgttgcccataccggtggtcaaaagggaggtgctgtccctgatcatggctcatccaatacattgccatatggaaatggctcaaagacagctaaatttggcaatcaacaccaagcgaatggcttttctgatgaagttcgagctgggcagtcatcgaggcacacagctgctgccaatgggggaagacatgaacgagttggtccccctacaacacatgaaaaaatcccaagtgccagacatggttatggaggaaagcaacagggcagatctgctgggaccgaattcagttcaagaagataagttggtagcttgtcttgaggttgttcgattggtttaatgggcggtgaagtggcaaatcatgtccaagttggttgcgttttggtttcaaatggctgaagatgctgctgaattcattattcaaaatttagctgtgcaccattgctttatagcagtgcctgcctgcattgctctttaccttattttggcaagttgtcctgaaatcctagcccagaatcagaaaaatactgaggaagttttgcaaccgtgtatgtggtgcacacttgaattgattgtgtcgaatgtccgtggttacgtgccgaagatgagtactagctcttctattatgatgtccccatacaaaactagcatccattataaatgttcgcttgttagtgagaaaaaaaaaaa

SEQ ID NO: 4525 - DNA, 815 bp, Triticum aestivum
  Clone ID: PAT_TA_4525
gccccgacgagactgatgaggcaggagcgagcagaagacctcaccgccggcgagggttcgtatatccggacaagcgcactccctcatcgagcgacggtccggcagatggccctccatgcccgcctgctgcgccgcggctgcgtccccggctttctcaggatctgccgcaaggcgccgttccctgggctcgccggccgacgccgtcgacggcaggtatgtgggagcactccgccttcctcaggccgcgccgcccgacgccctccacctcgatggaagctgcccgcttcctccagcctctcgcagatggagatctgccggccccgcgccgccaccgcccaggaaggagctattcctccgcctctccggcgcgtgggagtccgccgtgcaggcgcttctcgagctcgggagaggcaccgatcagagaaggaaggcaaaagggagatcatctacattaatctcctgtcaagtattggaaatcccaagtatttcatgagcaaagcacctatggtacaacttgcatgagaaggatggtaaaagtgagttcaaaagggagatcatccacaccacttgcagatcagcgggagaggaacattcaatagagagatagggcaaaagggagatctttatgccacataaacttgcagatcagcgtgaggaggacagatatagggccaaaagaggaactctatgccggccatagatcaacatatacctttggtcacggtttgggctaccaggaaggatggacaaggggggactgggggaagaaccggcggaccgaaaggcaagggaaatcgcttgttggcgcccaatgg

SEQ ID NO: 4526 - DNA, 949 bp, Triticum aestivum
  unsure (1)..(949): unsure at all n locations
  Clone ID: PAT_TA_4526
ggtcccccggcgccaggaggaggcgaagcagggagcaatgtcgccatcgacgaagaaagagagggcggcagaggccagggcgagctcgtcaaaaccgatcgtcgcgggggctccccaggttcagcggcggagggtgagcggaggcgggtggacgagccgccggatatccttctacgcctcccgcgtgtacttcctgctcatcatcctccagatcccgctcttcagggtcccttgtagagcaggcacatgcactacacctattcaaattacatcttcacagttggtctcaaatgagatattcccaccatctgttgtgaaggccatgctctaccctggagctatagtgcgcaacctcactacaagcatgcgcatgacatttccaaggtggagtgacctgtttgacatatacaatctgacaagaagctaagaatgcttcagcagtaattgatctacagcgtctagagatgcttgctggaagctacttctgtgttgctggagcactcgttggcatcattaatcctgggaggatgatcttgtttggtacgtttttggattatctggggtggtacgcatgatgcgatctttcggcaagcttaaaatcagtgatctaacagaaccagtatatatttatccaaccattttaattgcactgtattgttcattcatgacagtaacatacaatttatagaagaaggcgattagcagcctgtataattcgatcaccagccaactgcaaactactgccaagtcaaaactgaggtcggccctgtctagtctgatggtcggccttgtccgttggtcagcctctcccgctgctgttcgccgccctcctctggtctgctgaacgtccccaggctcctctcggttctcatgtatcactaatactgtaaccattaatttttctcacttatatcgaagtctcacactnatatataattttgattcatcc

SEQ ID NO: 4527 - DNA, 472 bp, Triticum aestivum
  Clone ID: PAT_TA_4527
aggccactttggtgcaatgctcccagagagtctattggatgtcaaccatatgtgcctaagttgtgggtaaactccaaaatggtgagatatatctcctgtcagttggtttccgtcaaggtaaagtccagtcaaacttgtacaggtctttaagctccatggaactgagacattgaacatattcagagacattacaaaagctctgagactgccgccggtacatatattcataggcaaaggtccagaaagggagttatcagccagattaaggccgactatgttcttgagatctccaaatccctgaggaagagatcccgttaatttgttatcattcatgttcagacgttggatgttttgtaggtttccaaatgttttgggtattgagcccagaaattttattctcgtccaagaacaatgtttggaggttcaccaaattgccaatatcctgtgggatagagcctgttatctgatttct

SEQ ID NO: 4528 - DNA, 461 bp, Triticum aestivum
  Clone ID: PAT_TA_4528
ttccaaaatctcccggccgcgtccacttttcgagccctatccagttctattttctatacacttctcgagccccatccagttttgcgttcgtgccgctcgatccaatcctaccttagcttgcgaagacatggcttctcgtcaggatcaggctagctaccacgccggggaggccaaggcccgcgccgaggagaagacggggtacgtcgtgggcgcggcgcaggacaaggcgagggaggccaaggacacggcgtccgacgccgcgggccgtgccatgggcaggggcggcgacgccaaggaggcgaccaaggagaaggcgtacgaggccaaggacgcggcgtcggacgccaccggccgcgccatggacaatggccgcggcgccgcggaggccaccaaggagaagggctgcgaggccaatgacaatgccgccggcaccgcgcagcagaccgggagctacatcgccc

SEQ ID NO: 4529 - DNA, 1010 bp, Triticum aestivum
  Clone ID: PAT_TA_4529
cccacaaggaagccagacccgccggaagcgagagccgccgcgatgcagcaagcgatgcccatgccgccggcggcggcggcgccggggatgcctccgtctgctggcctcagcaccgagcagatccaaaagtacctggatgaaaataagcaactaattttggctatcttggaaaatcagaacctgggaaagttggcggaatgtgctcagtatcaagctcagcttcagaagaatcttttgtatttggctgcaatcgctgatactcagccacagaccactgtaagccgtcctcagatggcaccacctagtgcatccccaggggcagggcattacatgtcacaggtgccaatgttccctccgaggacccctctaacgcctcagcagatgcaggagcagcaactacagcagcaacaggctcagatgcttccgtttgctggtcaaatggttgcgagacctggggctgtcaatggcatgccccacgcccctcaagttgaaccagcctatgcagcaggtggggccagttctgagccttctggcactgagagccacaggagcactggtgccgataatgacggtgggagcggcttggctgatcagtcctaagaaagctacgagcttgtgttttaggccgcagaatgcatgtatactaccacccggacaaacagaggatcgtccctgtgcccttgaatgataagtggccgtgatcttcgcgtggatgatgatgagtagtagttgttatgtttgccttggcttttcggattacaacagacgtagattattatcatctgtgctgtgcttgactttctgcattcatcataggtcttgtatccagtttacatggaataataggtcccagttgtttgttcctcgtggtggttgttgtctgccaactagactagtgtaaaatcctgaaatggtggtaagatgtttttctcctattagatgcttatctccagcagttgttgctacgttgcattggttggtgttgaagtagcatgattaattttcctagt

SEQ ID NO: 4530 - DNA, 818 bp, Triticum aestivum
  Clone ID: PAT_TA_4530
tttttttttttttttttttttttttgtggccaaactgaaaccagtctccaattcaaccactcttttgctaaccaaccaattccatccatcaagaggtagcagctacaccatatacttaataacaattcggtagcaaaatggctatagggctaaaacaataacaaatcggcaagcattcgggttgggggaactctcatgctgtcatgtcctttttccccacccacactctaaaatacttactatcgccctcaacattgccctcatcaccctcgagagcagggcagagcagaagcagagctcagacgttgcagtggaggcagtcgcatgacctgggcgtgaaggagcagaatccgaaggggcggttggggatgttgcagttgatggcgtagcagcacggggagaggacgcagacgcccctgggcccgccgcagcaggtgcagggcgcgcagagctggaagctccccagcccccgccgcgtctcgttcagcacccccccgctgaaccccgaccccccccccggggcccagcgccacctgcgcacccgccccctccccggcccccccccccccccagccgggcccatcggctgaatgggggccgccgccggggaggaggcggaggagggggaacagcggccggccggtggagagggggctcccccggcgggcgccgggcgcagcggggggtagggcggcgcgggcggggaggcgggctggcccgggcgggcgacgggcctcctcgggggttggggcggtagacgccgccgggaggggtgggctgggctggggagtgaggtcctttccgctcgtgccgaatcg

SEQ ID NO: 4531 - DNA, 1521 bp, Triticum aestivum
  Clone ID: PAT_TA_4531
aggaattcggacgtcgcctcgtcgccggcatgtgctcgccataggtcaccgtcggcctcccatcttcgatggcgccaccccccattaggatccacgcttgaaggccgtgaacaaggcgcaccggcgacataaatcaggccgcggcggcagtgttcccgtcgtgacgtgagcttctcccggcagccgggcagctcctcgacgtccatgagctctcccaccttggcctcctccaccagcatctccatcgggtgcctctcgaagcctctgcatgcctttttcaaatcggcgtcaccacaggcggcggcaacgctgagacaataaacattggtggtaataggcttcgttggcgatgcgaataccgcaaccaagcctagctaggcctgcagcgcgagcatccgcgtggccgtcattgtcaacgcggcttccgagtccgcgacgaggcatgcacgactccagatgccgcgctgttcttcttgtcaggagaagtcgatgcggtggccttggtgatctgagcttggatcgtgagcaaccgcgcgaccgtggtcgatgcggagccgggcgtgtcaagggatggcgatagcgcgcgcaccgtagtgcaaccgctgtccgtcgagaggctccgcgggggtcggtcgacgtcggaccccatggacatgagcggccagaataccttacgcaaggagctgaagctgttggcgcagtggcggcgccgaggccggttgttcgtcatcctatcgaatgtgcggcggagcagcttcggctacggcagctgctgcgcccttggccgccccttgaagagcacgagcccgccgctgcacgggttgcactccctcggcatggtccacgcgccgagttttcgacctcgacctcgcccaaactgccagtggcggctgcggtccgcgacctccccgattatgccctgacatctcacattccttccttgcctccatctcggacggcagccggcagcgtcgccgtcgtcgtcttcaccttggtgcagccatctccttcttggcttgaacacacactggataatttcaggcttgcattcattatttcttttgctgatcaccttgctctgctttttctttgagaaagaccaatgcggcttatatgcctcatcacactgtatacccaagttatgacattatccaagcagcagactttgaagcaagcccggtcctttttctgatttcagcaacccagtgatggatcaaaattctgatatgttctaactatttatctgtgttggtggcagcttttaaacaatgtcttcacacatcaacgatttttacttgtaagcacatgccaattcagtttgcaggatttttacttgtaagcacatgccaattcagtttgcagaatgaagtcttatatgacattgtgatttgcttacactcaacacagctatagcaaaatgacatacggattgtaagtgattagtcagaatcagtgacatctggttagtaacctgatataatgagcaaaaaaaaaaaaaaaaaaaagtcgacgcggccgcga

SEQ ID NO: 4532 - DNA, 362 bp, Triticum aestivum
  Clone ID: PAT_TA_4532
ggcctcaattaaatcagcacataaaaaccggtgattcagaggtggatggctcggaagttgagcgcaggggttttgcagggcacccgatgtgcaagttttgtagaagcccattttatggagagactgagctagatacacatttgacaagagaacattattcttgtcacatatgtcagaggcagcacggtgggcaggatgattatttcaggaactatgatgacttagagatgcatttccgaagagaccatttcttctgcgaggacagagagtgcttggagaagaagttcattgtctttcaaagtgaagcaaagcttaagaggcacaatgcttgggagcataagaagcgcatgcctcatgcacag

SEQ ID NO: 4533 - DNA, 2032 bp, Triticum aestivum
  Clone ID: PAT_TA_4533
ctcctcgggagcgtcgcgtctggtcctacccaaggccgccacgcaacccggcatttccgccacttgtgatggcggcggcggcgaggcaccggaagggaggaggaggacgagatgctgctggacgacggcgacatcgaggagagcccccgcgacagcttccgcgactccgacgacgacgacgccgaggcggaggaggggcggggcgaggacggcgacggggtcggctccttcgagtcgcaccagtggccgcagagttaccgggaaacaactgacacctacacaattgctgcgtctcccatcttcggttacctgggtccttcaaccagcaaatactcaatcgatggtggccgcagtggcctggcttctgacctcaggctgcctttcatctcggataagctagaatctgtcaagagcctgcggcgacatcttcttggttcagtcagagatgagaagctctcatttcagtatactggagagatctacgtcggtcaagggtgcagcgtgacacagacagtcttcaatggtattaacgtactcgctggtgttggccttctttccgctccgttcacaattcatgaagctggatgggctggtcttgcagttctgtctgtttttgcaattatttgctgttatactggagttcttctcaaacattgtttcgagagcaacggcgggatcgctccctatccggacgtcccggtggccgccggcggtggcattggccgctggttcgtatctatcatcgggggtactgtatcggaggcgtactgcgtggaattcattatactggaaggtgataacatgacatcaatctttcctgacgtcaatattaatttgtttgggattcatgtcgacagtaaacatttctttggagtgttaactgcactggtagtcctgcccacagtatggctgcgagatctgcgagtgctatcatacctttcagccggtggtgtgattgcaactcttgtggtgtttatatctgtcgctttagtcggcaccactgaaggtgtagggttccatcagaccggggaagcagtaaagtggagtggcatgccctttgctatcggtatttacggtttctgctactctgggcattcggtatttcctaatatctaccagtcaatgtctgatcgcacaaaattccctaaggcactttttatatgcttcgtaagtttgcacagcgatatatggctcgtttgctattattggctatctcatgtttggtgacaagactctgtcgcaaataactttgaatcttccaaaagagtcatttgcctcgaaagttgctctgtggaccacggtgatcaacccgttcaccaaaatttgccttgttgttaaacccattggctcggagtttagaagagttgcgccccgaaggatttttgaacgaaacaatcgtctctattatactgaggacgagccttgtggcgtcaactgttgtcattgcatttcttcttccattcttcggtttggtgatggctctgattgggtccctgctcagtatacttgtggcagtcataatgcccgggccttgtgcttcttgaagatcgcacagaataaagccacacgcccgcaggtgattgcaagcgtggctataatagtggttggagtcatcagtgctgccctcggaacatactcctcggtggctagcataatcggatactactaattcttccaaagcaatctcttcgacagctctcagtaccgtcactcttggcaagagtttttgctgtgtatcatcgaattttaccgtgctctatgtacatccttcgacctagtatagtcgatttataaagactgcatctctagcaacaatgcactactgttaccatttagctgctgctatatcatttggtgtaccatatttctgccaagccctgcggtttaaatattgcctctttttagggctaaaaccaactttagtaacccgaaatattgtttgttgctattcatttatttttaggggaaacgtcaactttattaatccgaaatattgcctgttgttccgcaaaaaaaaaaaaaaaaaaaaaaa

SEQ ID NO: 4534 - DNA, 698 bp, Triticum aestivum
  Clone ID: PAT_TA_4534
gcgtatagacccaacgagatccaccacgataaacacgcgcaccattcgttcccactgagctcgattccgacgcggtcgcacctcacctggctggaacccgcatcgaggtccacaccgcccgccatgagagaggaggtcaggagctcgtcggccgcgcccgcggacccgccgctgcgctcagactcgccgcccgccaccccggtcgccagttctgccggtgcttcatctcctcccgcgcaaacaaatgtagctaccatagattggttaggcagcgagcagttatctaaagttgggtcatcgtcccatgttgcttcacatgctgcccagccttctcttagtactaatgctgttggagctgctatggatttttcgcaaccatcatgtagaccatgggaacgaggagatttacttcatcgactggccacatttaagccttcaacatgggcttctaaaccaaaggctgctagttcactggcctgtgcccaaaggggctgggtgaacattggtgttgacaaaattgaatgcgactcatgtggcgcacatctgatatttactgcattgacatcctggtcccccgctgaagttgcaaatgctggagaagcctttgccgaacagcttgatgcatcgcaccagaatgattgtccctggagagggaatagctgtgctgatagcttggtgcagctccacttcacaccatc

SEQ ID NO: 4535 - DNA, 379 bp, Triticum aestivum
  Clone ID: PAT_TA_4535
ctctgcttttctccttctccatggccatgccagtgccctccttgagctgacagagcaacaagcctctcgccgccccccttcccccggtctacgatggcggcaatgccggggccggcgaggctggcccttgccgtgctggcgctcgcgtcggtgctcccggcgtaccgctccgacgacctcaacaccgacgcgcaagcgctggaggcgctgcgcaaggcggtggggcggtcggcgctgccgtcgtggaacggcagcgcgcagacgtgccagtggcagggcgtggcctgcgagaacggccgcgtcgtcgagctccgcctccccggcgccgggctcatgggcgcgctcccctcgggcgtgctcggcaacctcaccgcgctcc

SEQ ID NO: 4536 - DNA, 1166 bp, Triticum aestivum
  unsure (1)..(1166): unsure at all n locations
  Clone ID: PAT_TA_4536
cgagcgtgccgctgcggtgccctgtccccggtccggtttggtgcagggttgaagaattcatgcacgcatccatatttggagaagaatagggcgtttaggggctgctggaggaaagagatcagaggagagagagagggaagaagagatagcgtgagagagagagagacaaggcatggaggaaatatatatggagcatgtaggtgttgctgagggaagagttgagccatatgtctagaaaatattagcatatacgatggggtattatctggtggccgattgctattctagaagagaaatcttgttatcgaggcaagtagttgctttgctaactcttaaatcctttatcttcggttgtatgattatatattgctgcactttcaatcttatttatcctccattgattcatgtgctatttgagaaggacatgttgtcctcgatattccatttgttgaaggacaagttgtccttgataatccatttgttgatggaaccagtctgatatgaggggagctcatgtagatgcatgagtttattgtgttgactaataatccagtgatcctatctttgattcaatcacatatccttgccatattggtgtcacggcaaacatattgtaccggtcacagttcaggtatgggactgtctgggctctccgttaaggtcggatcttgttcgggaacgtgtcggtgatggatccgtaggagcgatcgacataagtaggtacaggtgtcctgggcttagtggctaaaagagctctcctcttcgggaacctgtgtggttctagtcggcgctgtcgacgccggggtacccctcttaagagcgtaaaagtgtgaaatttcgcccctgtgactcccgggttgggaagcttgcggtcatatgtgatgccaataatttccttatccgttttcgaggctattcctttttcacatctcccgtaaaacatgttccaatgattattaccctgtttattctttggattcagtctgtctgttgatctacaccatcataccattgctcctgttgaatagtgaagtatctgcttgctgggtatgatttatggtacctgcccgggcccccgctttcaaaangcacccnngtaacttangttgtcaaaaaaancccnctaaaaaaagggggcaatgggggggaaacatnaanantttttt

SEQ ID NO: 4537 - DNA, 269 bp, Triticum aestivum
  unsure (1)..(269): unsure at all n locations
  Clone ID: PAT_TA_4537
gcacgcacgccacaggagagaccgaccgcgcgcgcgcgctcgaacacggcacggcggagccgccaccacctgagattctggcgcccggacccacctgccacccgagacccgccaccccgccacctcgttgacaatggcggtggcgcggctgcgctcggcaaccgcggcggtggcggcccggctccancccgccccccgcggcccgccgccgcctcgaggacgggnggccgcggcggttgcccctnnagtttttcctcngggggaggcat

SEQ ID NO: 4538 - DNA, 707 bp, Triticum aestivum
  Clone ID: PAT_TA_4538
gctccccagccaggccagcccgccagtgccccacgcgcgccaatcggttttggaaaacttcctcaatttccttctccttcttcttgtccttttcctttccattggcgggggcggggggaccccaagggtaaacgatcccatccaggcggaggagcagccccaggtggccgtgcctccccaagtggagctggcaccgctcccagaagtggaactgcccccccaacctgagctgccccaactggagctgctgccggcccctgccgtgcagctgctaccccagcccaagccggccaaggccgaggtggggcctgcccccgtggcccagatgccgcccaagccccccaagcccagggggtacctgcggtcgaagcccgcgctgcccaaggtggagctcccaccaaagcccgaaacgcccgccggtcccgtcttccactccccagagccgcatacgccgaccgtagattcgccgccggtgcctgagacgaccactgttactccgatccacttgttgcacccggttgccacgccatgagaactgcgcgtccccatactgttatgtcttcctttcttgctcatacttgtacctgttgttgtgttgtgtcgataatctgattgcttagttgtggtcttaagctagtgttgtgactgatctgcttatatattggctttgccagaaaaaaaaaatcgcaccctttaaaaaaaaaaaa

SEQ ID NO: 4539 - DNA, 606 bp, Triticum aestivum
  unsure (1)..(606): unsure at all n locations
  Clone ID: PAT_TA_4539
cacgccggaccggccttctgaacactcctgaagaaatagcccacgcgtctaatgaagttccagaagtacatgttgatccccatatggctcctacttatgaatctgctgaagaatggaatgatgaaacaactgttgatttgaccataaatgggaatggaccagatcttctctttcctggaagagaagcggcagaatcaaacgctgtgcagtacctgtcacaaaaatgtcccgatgctagtcgtcactctagtttaaatcttcctacggagggcgtaacacatataccaggagcaggaagtatcactaatttgcaggcagcaaatggatcgaatattcctcggcctcgcattgatttaaataatacagcgggtgatgctgcatcagttccgtcatctggggttgtatcaagtgacacggagccaagaaaaagtatggcactacaaggaccttctggaaatgtcaaggnccgtttacccttcacactatccaagtggacactaattcccaagtggcatgaaatatggtcanattnagatgaagagatcattgntgcgactggaatgcnccaacaaacagaagttcatcaactagcagtnttacatagaa

SEQ ID NO: 4540 - DNA, 1045 bp, Triticum aestivum
  unsure (1)..(1045): unsure at all n locations
  Clone ID: PAT_TA_4540
attgtgttctattaaatganttntgcgtaaggtcgtctggcaagacaagtttttcacaggaaccatggtgtatatacaacaagatgccggtacataacaaaggcctctttgcaagtggataaactggtcggaaagtaaattcaaggtacaatagtgctcagaagtacagcaaacgtctacactcagaccaacaactggatgataattctcttgcgcagcggtttatttcctacaagaacggctgtggccccgcaggaaccaacactagcgtacccatgcacaggtcgacagccgatgtgatgatactcatggagccgatgcctttgctgaatccgagttccgcccagctgctgctgccgcgttgcgcgatctgggcactttgcttgccgcgacgtgcagatgctggcatagaggccttggtgccccggtttccctctcgaatccccgcacacagacaaatcctttccagaagcactgctgtatttcttcagttgttagacctttgaatatggagggcactgaagttccaaagtagaccattcgtctttccaacttccataactgctcccttgcaacgtatatgggatcgtagctagatttgtggtctgcaaatacctcattaacttgaaaataagtgccgttcagtgggaaactacccttcgtagctgttcgacacggaaccagaatggtggctctgacatatctagattggttttcccgctcaagcacacaatactggcacttctcattattacaaaatcgatcttccatcggagagtcagaacatggtttgggggccttgatcatttcatttatgtcatcttgcatccatatcgtcaataggtaagggcttggatcgccagtttcccgttgatcaagtcctagctgctgcacaagggagtgtgaatctggaatttcgtaaacatagtgttctgtccgaagcctgcgcacgttctttagtttagggacaggaattgaagctgatccagtgctaacagcaacaagtgctttcgcgcccacgcgtccgcggacgcgtgggcggacg

SEQ ID NO: 4541 - DNA, 989 bp, Triticum aestivum
  Clone ID: PAT_TA_4541
gctcctctcaaggcagttacaattcgcgtacggcaacgccaactgtttccaccccgccagtgccagtgccagtgccacctccaattctgcccacccaccttccataggttcgagatgaagcagaccgtggtcctgtaccccggtgccggcgtcggtcacgttcgccccatgacagagctcgccaacgtctttctcaagcacggctacgacgtcaccatggtgctcgtcgaggagccccttaagttgtcagactccggcaccaccgtcatagagcgcaccgctgcctccaacccgtccatctccttccatgtcctcccgtccatccatgctccagactttgccgcctccggccaagcaccctttcttactcatgctcgagctcttgcactattacaacgagcagttcgaagcattcctctgcgccgtcgaccggaaaagcttgcactctgttgtcctcgacatgttctgcattgatgccaccgacgtttgcatgaatctcggtgtcccgccgatgccagcgtctcatctcatcaaggaactactggagcaccccgaagatgagatgttcaaggccatgatgaacatctggaagcgcaatacggagaccatgggcgttctcctgaacacgttcgagtcgttggagagtcgggcggtgcagtctctcaggggcccgctctgcgttcccgaaaggatcctgcctccgatctactgcgtcggtccgttggtcggcaagggcgccaaggatgaggaaaaagtagagaggaaagaatgcctcgagtggcttgacatgcagcccgaccgcagtgtcgtgttcttctggttggggagcaagggcacgctctcgacagagcagctgaaggagatagccattggctttgagaggtcagggcagcggttcttgtggtccgtgcgcatgcctgcaggaagcgacaacccagagaaatacttggaagggttccctgaaccggaacttgacgcgctcctgcctc

SEQ ID NO: 4542 - DNA, 857 bp, Triticum aestivum
  Clone ID: PAT_TA_4542
tgggcccgtatcccttcgtctaccctccgccaatgactgcacataatacatctctggcaatgtatggcttctcgtggattgtacttcttgttatggtcctcctgttcaagcttttcaccgcaactccaaggaagtcaactgcctcgccgatagtttttcggtgtctacacggccgccttgcaattggcatcattgcagcaattgcatgccttattggattcacagactttacaattgctgatttatttgcaagtgcactagctttcttagcaactggatggtgtatcttatgtctggccatcacatggaagcgtgtggtgaagactctggggctgtgggactccgtccgcgagatctcccggatgtacgacgctgggatgggcgccgttatctttgcgcccatcgtgttcttctcgtggttcccctttgtgtccacgttccagtcgcgcatcctgttcaaccaggccttcagccgtggtctggagatctccctcatcctggcggggaacaaggcgaaccacgagtcatgaggaaacctcatccatccgctgggtgtttttgttgtacatttctggacttgaattagggacaagcggcggcgtgtctccgttggtcctttccgcccctgagtaggggcatgctgttcgctcgctcgtcgtctgtgcgctacgccccgctgtgccgggtcactattcgctcgccccgcgcctgtgggcttgcgctgccggaggcgtgtggatcctcggtcggcgcccccccgtagttctgagttgctggatgtaatttggatcctctggtgattttgtgtcgcctggtagcagtaatcacagcttgagtaaactagtggctaactcttg

SEQ ID NO: 4543 - DNA, 791 bp, Triticum aestivum
  Clone ID: PAT_TA_4543
aggaattcggcacgaggcggacgcgtgggcaaatttcccctcttccccctccccacccctcgatctgatctcgattcatctacctctcctccccgaatcctcaattcgacaccagatccggtcctccctcgccgaggcctctctattggtaccgatttcgccccgtatcgttgattctgtgtgttcccgagattagggtttcgaggcgctgaaatcgggtaccgattggctcgattgaggcgggatttctccaggggaggctggtctgtggttgattggtggctctgagatcctattattgcggttcttttcatcgaatttgcgcgatttgtttgctagggtttcgtcgtttccctcccgtccaaccctccgtcgacccctcatcgccagagcattatgttgcatcaagaaaatagtgaggtttatgtgaggcaccactccgagcagcttgcgtgtggcaatctgaggggaaccgatgatgggcgctcaaacttccttcctgggaaataccatattgcaacagaatggaataccacagcttgtctagttaatactgccagtgctgttaaagaagtgacagtcgatcatcataagagacctgcctctagtggtttcacagacatgttggactgcaaacggatgaagcaggaagagcaaactgtatctgagaaagataatgcagcagatgctgacataaatgttccagagtatggatcatacaagacatgggagagaatctccgattcaccagcgtacggtagtgaggaaagtgaggatgaaggtgtagatcc

SEQ ID NO: 4544 - DNA, 841 bp, Triticum aestivum
  Clone ID: PAT_TA_4544
cgatcatttccatggcggacggggtcggctccggcaagtacttcgctgcatttcacctgcttgacgactttcctgctgcagtcattgtcgatgattttaccggtttcttttcggagaggagctgtcagttaagatatggaaatactagggctcgtgatctagcattggttcgcatattagcgttgtgtcaaaatgctatttcgcatgcaaatgcaaagcttggaaccattggatcttgcaacctctttctctctgatgtacatcaaggtgacaacccaaggtgaatcaggaagtacttggctgcatttcacctgcttgacgactttcctgctgcagtcattgtcgatgattttaccggtttcttttcggagaggagctgccagttaagatatggaaatactagggctcgtgatctagcattggttcgcatattagctttgtgtcaaaatgctatttcgcatgcaaatgcaaagcttggaaccattggatcttgcaacctcttgctctctgatgtacatcaaggtgacaacccaaggtccctgttcatctacaagagatggataggttccatatatacaatccaaggtgacggcttaggttcatatctactcaagaacattagcactccacaaagtggaaccaaggaagcaagagcagctaaatactcaatagctttacagtaccttgttcttgaggaaatcaaagaataatacgttgctatttatttgaatttactgtgcgagattttaggttcagatttccccgagctgattgtaaatcccaaatcttaattcctactttggtaagattttcaattcagattaaaaaaaaaaaaaaaaaa

SEQ ID NO: 4545 - DNA, 719 bp, Triticum aestivum
  unsure (1)..(719): unsure at all n locations
  Clone ID: PAT_TA_4545
gtggaaaaaaggtatgcacactgcaggcactctgcgggatacacatggaagacgaacctgctggtcaggcacgcttgattacagagatcttaggtactccagttgtaagattacaaaggctgggattggtggtcctctgcttgactttaatgggagatttattggcatgaacttctatgataagaaaataggaaccccattcatatttagggactgtattattcgagtgctggcaaattttgtggaaaaaaggtcttttgatgaagttggcagcgatagaccaatcaggtggcctgtgcccataccgtgttggcgccatccggacgatgagctcaaagattcgctcccacctggccatggggaaaaatctgggatgttcggattctcatatgtggatggagttagagtcgacaaccattagatgtcctgtgctcttgctctgctctgcgctctccatgtggtggtgaacctgtttgtttaagccgccaggaagttatctcttatctagccatgtcccagtgtttggaccagtattttagtgttacttttgtgagagtgaatgtaactcatccggagctatgtggtgttcgctagtttctgtcgtagctgaacattttcttcatcttcgggaagcatttgtatgtgcaagcaaacggagtgactgtaattgttcatttgtattgtgattgttgaaatttncnacgtgtgtnccgnattac

SEQ ID NO: 4546 - DNA, 1838 bp, Triticum aestivum
  Clone ID: PAT_TA_4546
cgtccgcggacgcgtgggcggacgcgtgggcgcagaagcgtctggctccctgtagaggagaagaacctttgccccgccgccgccgccgcgcgctcagcctctctctctctccctctctctctctctctctccttacccagccgcctcgtgccctcgtcctctcccgtctccgaccgcgccgccgccactaggccacggccgccgccccctccccaagcctcgcttcgctcccgcggggatggaaagccccgatggttcctcattgccagactttcttgagctccagcgcacccgtgttctctgcaaggccgatgcccccactcatacagaagggtttcaatactcgggtgcttttgctgctatgggagttgatactagtgtctcagttgagaagttctgcaagaactttaaaatcgagataaatcgacttacagatgaggatatggagtttgatatgattggcgttgatgcatcgatagctaatgctttccggagaatcctcattgcagaggttcctacaatggccattgagaaagtcttcatggttgacaatacctcagttatagcagacgaggtcctttcacaccgactaggccttattccacttgatgctgatccaaggctttttgattatatctctgatgatgtcccaaatgaaaggaatactattgtgtacaaactgcatgtttcatgtgaaaagggttcccaaaggctgtcccctaagtcgggtcaattggagtggttgccagaaggcagtcaattaactatggcatctcctgcgcaatctggggacaatcagaggacctacacatcctttggtcaaagccaacagaatacctctgaaaggcctctcggtgtgaagtataatgacataccaatcgccaggcttgggccaggacaggctattgagcttgaggcacatgctgttaagggagtggggaaagttcatgcgaagtggtctccagttgctacagcctggtacaggatgctccctgaggttgttcttctcaaagaaattaaaaatggtgatgcagaggagctagtgaaaaaatgcccagttaatgtttttgacattgaagacctgggaaagggggagaagagagcagttgttgcaaagccaagagcatgcaccctttgtagggaatgtgtcagactggctgatgatcaagtagagctacggcgcgttagagaccacttcatttttacaatcgagtccaccggatctctaccgccagaggtgctcttcacagaggccgtgaatatccttgaggagaagtgcgagcgagtgatatccgaactttcctgagcccgatataaagttttcagtaatgttctgatgcagtttttctgttactgtgttgtgttgaggctgttgtgttgaggacgaaggcttagtgtactagtataggttactgtaaaacttctgtgtccaatactctggagtcacattcagctaatttatcaccgagccggtatatgcagctcctttcttcggcatttcaagtgccctgagagcgagactctctcctttcattggaggaacttggaaactcagacggggccgttgggtctggaatttgggctgctgattgaatctagtgtatttttgcatgcaagcaccctagggctagttattgtagtacacaaagcccatggtttttccttcttgtaaaagccacggaatggtgggtggatgacttggccattagattgcagatccaatggcccgtattggagttaccaagttttcgccgagtggtatgtttcttcttcaaaaaaaggtgtgaatcaataacttgtgttctaaacatgatgctggaggcacggtgggggagaaa

SEQ ID NO: 4547 - DNA, 700 bp, Triticum aestivum
  Clone ID: PAT_TA_4547
gcacgaggctctcccctcccctcccctcccctgtaatctctcctcttccccagacccctctctgttcctctcattggatcggaaagaagagagattgggcggtgacactccacctccatcgatcccctcgagacctaaccagcgtacgccctgccccgatccgggccaggcgcgccgaccggccgcccacccatcgcccggccccccccggccgcggccgccgcggcggcgcccacccgccccccgccggaggcgactggcgcgcccagctccagcccgaggcgcgcggcaggatcgtcgataagatactggagactctgaagaatcgtctgccagtatctgtgtctgtggcgccagaggcactgaacgaacttcaaaaaatcgctgcgtggttcgaacaaaaggtctataccgaagcaaccagtcagtatgattatttacggaagatttctctgaagttgctctccatggagacgcagagacagcaggctgctggaaatgctcagctgattccaaatcaaaacaaccctgcccctggactccatccacaaggcagtaatgaagcacaaacatcagcagttcccttgatgtctcagcaacaggcccggcagccaaatgcttctacatctgtaactgcaggggcggctgtggctaccagttctgtctgtgaatcttttgaatgtgcagcaaacacagcaga

SEQ ID NO: 4548 - DNA, 580 bp, Triticum aestivum
  Clone ID: PAT_TA_4548
tcgacccacgcgtccgcacacccggtgctcacaacgctgccgtcgcctcggtcacgcgccgccgccccgcttctccccgccgccccccctccctccccagccggcgtcgttaccattgccgtcccttctcctttctcctcacctcctccgttcctcccctgccatcggtggggtcgctgccgccatccttcccaccgccgccgtctccgtcctgctgccccgacctcacccagaaccctagctcgccctaggccgtgtttccgctgccgattggtccatccgtgagttgtttgctcccgtttccgcgtcgtcgtctatgagtctagcagccgaatcgccgtcgccgtccccgtcgtcgtcgagcggcagcgacgatttcgctgcgctcctagacgcggagctggatctcgcctctgccgtcgactccgcctctgcgggcgacccctccacatcacccacaagcagcgacgacgaagaggacgacgacgaagacgcggtggccgatgtagaaaccgtggagcagagcagtgccaaaaggcgtaaagtgaaggtgcaataccaagatcgagaaacggcaata

SEQ ID NO: 4549 - DNA, 663 bp, Triticum aestivum
  Clone ID: PAT_TA_4549
acactaccctcctccttgtaccaatagtagccatccttctcactgccaccgctgccaccctggccaaggcccctgcccccacagccaacaagccgacggcgtacgaaatgctagggcgatatggcttcccaccgggcatcctcccggagggagtgcatgactatgagcttcgaccgaacggctcctttgaggtacacttctccgatgaatgcaaatttcgtgttgacggccaatacgacgtccactacagcacccgggtcgccgggaacataaaaaatgacacgatcagcggcctcgaaggcattaaggtgaaggtctttattgcgtgggctagcataaaggaggttggccgcgatggggatgagcttaggctactcgctgggatcatatccaagtcattcccggtcggcgatttctcctctagccctaagtgtaactgaggcttgactccaagatcgacacaagtcttcgatcacgtcgcttgacgtttccttctttcttcgtaggattgatgatgcacgttgctgcttgttttgcaatcccgtgccatcttaccaattaatgtactcccattgtagtttgggccgggactgaatgatatatataaagaagtgccatttgttcatggttgccggaaaaaaaaaaaaaaaaaaaaaaaaaaaa

SEQ ID NO: 4550 - DNA, 746 bp, Triticum aestivum
  Clone ID: PAT_TA_4550
ggcccaggcgcaatgaatggtgatgatgcggctctcctttactcttcttcctccaccagcccaccacttccatcctctgctctggtggtttcctgttccgttccgggagtgttcttccttgacagggagcggcggccgccatggcgaaggagaccgagtactacgacgcgctcggcgtcagccccgccgcctcggacgacgagatccgcaaggcctactacatcaaggcgaggcaggtgcatcctgacaaaaaccccgacgatccgcaggcgtccgacaagtttcaggctcttggagaggcctaccaggtcctgagtgaccctttgcagagaaaggcctacgacggctatggcaagaccagcatatccagggacaacattctagatggtgctctggtcttcaccctcctgttcgggagcgagctgttcgaggactacattgggcatcttgcaatggcaaccatggcttcctcagagatggccagcggcgacaacggcagcgccgagaagctccaggacaggctcaagggtgtacaaagggaacgagaagagaagctagctagattcctcaataaattcctctcgcagtatgtgagtggtgacatggagggattcgctcatcgtgccgaatctgaggcgaagaggctttccagcacttcatacgcactggacattcgtcgcaccatcggatacgtttactcccgacaagccgccaaggagctcggcaagaaggccatgtacctggga

SEQ ID NO: 4551 - DNA, 764 bp, Triticum aestivum
  Clone ID: PAT_TA_4551
cggtccgaagcggccgggtcgacgggggcgcggcaccagccactgaagccggggcgtctcagccggctccaggcgaggacttggaagccgctctgccaggcccgccgccaggaactccacctccgtctgcgatcacccagcaggagactccagcttctccggctgcggctccagaagatgatctgcctctgcctcctccccctccactgacccagcatgaggaggatggaacgccagaagatgatctgcctctgcctcctcctcctccactgccccagcaggaggctggagcgccaggttcagcgccagaggcaggagccgtcgatgacaagtgggcaggaggtggcgatgacaagtgggcgggaggcccggatgacaagtgggtctagtggttgcttacggcgtggaactgaactgaactgaactggttgtacatagatgctcggtgggccggggcctgagatgacaagtgggcgggaggcgccgatgacaagtgggtctagtggttgcttagggtttggaaatgaactgaactggcctcgttgtacatacttgctcgtagcgtcccgtgctgaaaaccctttctgcttgccctgacagacttggatgtagagggggtggtggcagtagccgttgttagacctgatgatgggctgcgtttcctgtcgtatgcgatgcgtcttccggatgaaccctgtaagttctgggaggtcgccccgtgtgctgcctatggtaatcgcgactagtttcgatccttgtgtgat

SEQ ID NO: 4552 - DNA, 957 bp, Triticum aestivum
  unsure (1)..(957): unsure at all n locations
  Clone ID: PAT_TA_4552
ccaccaccgcctcggccgctgccgccccgacccaacccatctggcggagtacgcgccggatccgccgatggggagggctgtcgcgaccttatatcccctccagatggccttcttgcgccgagcagctgccatcgatttggccagcgccgatggccaccgttgctctgcccccttctccagctgtgtttcatctccccggcggtccagcgggtgcgtgggtgttccgtcttgcagcgcgggcggttatcccccggatccgggtccaccgtccttcccctctcctggatccgtctccatcgtcctctcggtgccacatccagggaggaggggtgtgctccacatctcancctccgacgcggcactgcggcttcctccccgacgcgcgtccgactagtggcagtgtggcgcgttcgcttgtgcagtccgcagctcgcaagcacccgctccggccgcgacgagccctggcagagccatcaacacccgcttgccggccatctccaatgccctgttgcaatgcggcccgatgcgtaccgcgaccacggacgtgcgtctcgctggcattagatgcggctcagtactcctgtgggtgcagtttgggggcgcgtcggcgacgacggtagcaacgcagtgcactccagtggtcgccgtggtgcagctcagtggctcgctcgagcacgggcttcatcgcctcggagattctgtagtgtgttccctggtcatgcagctcggtatcatgaagtccacaatttgctctcgatttttcataagaatttgatggttcacttctgtttagtaaaaagacgaggagtacactttcttttggatgtggttcattgtgctacgcgttggatcgaatactcccgtcagttttcctaacatcaacaaaatgtgtggcccactttgtgagataaaaaaaagaaaacatgcagttttgtaaaaaaaaaaaaaaaaaaaaaa

SEQ ID NO: 4553 - DNA, 1429 bp, Triticum aestivum
  unsure (1)..(1429): unsure at all n locations
  Clone ID: PAT_TA_4553
tccccttctctcgcacagcacaggagacggcggcggctactggacgtgactcggcaccattggtcgtcaacggcggcagccctggtggtactcgacggcggcggctactacatcccagctaggagttccccttcccggtccagcaacttcgagaaggaggcggcgagggcgagcagggagcggaagagatggagaacggcagcagcaaaggcgacgtcccggaggacgccaacgcccattgccctggaacacagtctgatgaggcggggaaggccgattcctgcgccggatgccctaaccagcagatttgcgccaccgcccccaagggccccgatcctgacttggttgctattgctgagcggatggctactgtgaaacacaagatactggttttgtcaggaaagggaggtgttggaaagagcacattttcagcccagctctcatttgccctagctgaaatggaccatcaggttggccttctcgacatagatatatgtggccctagcatcccgaaaatgttaggccttgaaggccaggatattcatcagagcaaccttgggtggtcaccaatctacgttgagtccaaccttggtgtcatgtcgattggttttatgctgcctaacccagatgatgctgtcatatggaggggtcctcgcaagaacagattgatcaaacagttcctcaaggatgttgactggggtgagattgactacctttgtagtggatgcaccccctggaacatcagacgagcacatctcaatcgtccagtacntacaagccaccgaagttgatggcgcgataatcgtgacgacccctcagcaagtctctcttattgacgtgaggaaggaaatcaatttctgcaagaaggtgggtgtgccggtgctgggcgttgtggagaacatgagtggcctgaggcaggcattcacagacctcaagttcgtaaagccaggtcctgcaggggagacggatgccacggagtgggcgatgaactacatcaaggagaaggctccggagcttttgtcggtcgtggcctgcagcgaggtgtttgacagcagcaagggtggcgcagagaagatgtgccatgagatgggggtccctttcctcggcaaggtgccgatggacccgcagctgtgcaaggcagccgaggaagggaggtcgtgcttcgccgatcagaggtgcagcgccagtgcgccggctctgaaaagcatcatcgacaagctgatcaaaaccaagtaagcagacagtgtttgtgcctgttggagaagtaccactagtcaaaaatgttacgatgatatctgggaagtctcgttgtacaattgcttgttacacgcccgagtggctttcactctgttcttagtttcctaaagctttttggcttgtgtatccgtgtttttttcagaaatattgagcgttgatgcgatagaggctg

SEQ ID NO: 4554 - DNA, 1884 bp, Triticum aestivum
  Clone ID: PAT_TA_4554
cggacgcgtgggggcggcggctactacatcccagctaggagcagcagcactttgagacggggagcagcggcggccggcaagagcagctcgtggagacgccgtgagcaccagggggaggcgaggagacgcaagaggagcaagagggagaggtggtggcggggcagcaggggcctccggggagcagcagggcgacgacagcggtggcggctgtgtcaggagtgagcacgggctagggttcatcccgattgagggagcaaactgtgtgttttagtcaaacagttcccctgccgggtacacggcgacgcaacttcgagtaggcaggcggcgagggcgggcctggagcggaagagatgggggacggcggcggcaaaggcgacgtcccggaacggcgccagcaatggcggcgctgcggcagacgccaacgcccagtggcctggaacgcagtccgagggggcagggaaggccgattcctgcgccgggtgcccgaagcagcagatttgcgccaccgcccccaagggccccgatcctgacttggttgctattgctgagcggagggctgctgtgaaacacaggatactggtttagtcaggaaagagacgtgttgtaatgagcacattctcagcccagccctcagttgggctagctgaaatggaccatcaggttggccttctcgacatagatatatgcggccctagcatcccaaaaatgttaggccttgaaggccaggatattcatcagagcaaccttgggtggtcaccaatctacgttgagtccaaccttggtgtcatgtcgattggttttatgctgcctaacccagatgatgctgtcatatggaggggtcctcgcaagaacggattgatcaaacagtttctcaaggatgttgactggggagagattgactaccttgtagtggatgcaccccctggaacatcagacgagcacatctcaatcgtccagtacctacaagccaccgaagttgatggcgcgataatcgtgacgaccccgcagcaagtttctctaatagacgtgaggaaggagatcaatttcctgcaagaaggtgggcgtgccagtgttgggggttgtggagaacatgagtggcttgaggcaggcgttcacagaccttaaattcgtaaagccaggtctcgccggggagatagacgccacagagtgggcgatgaactatatcaaggagaaggctccggagcttttgtcggtcgtggccagcggcgaggtgtttgacagcagcaagggcggcgcggagaatatgtgccatgagatgggggtacctttcctgggtgaggtgccgatggaccgacagctgtgcaaggctccccaataaggggggtggcgccagtccgatgcggcgcaaagggccagtgcaccggctctggaaagcctattcagcaaactgtgctgatgcaagtaagcgaagtacaagtctgcagatgttggaggatgatccctcggcgaatatagttgcaccatcgctgggtacgctcccgagtgcatttcagtctgtcctgattttcccaaagcaagctggctggggtttccctttttgtttcaagaaatactgagcgaaaatgtgaaatgaggatatattgccatgtctccgtaggtacaattgcttgttacacgcccggagtggttttgactctgttcgttcagtttcctaaagcctttggggcagcgccagcccgccggcgctgcagagcttctgcgccttgctgcgctagaccaagtaagcagacagtgtttgtgcctgttggagaagtaccactagtcaaaaatgttacgatgatatctgggaagtctcgttgtacaattgcttgttacacgcccgagtggctttcactctgttcttagtttcctaaagctttttgg

SEQ ID NO: 4555 - DNA, 776 bp, Triticum aestivum
  unsure (1)..(776): unsure at all n locations
  Clone ID: PAT_TA_4555
tcgcgccggtctgaacgaggcaagcagcatagaagcgaaacaaggccagtcgaaccctagattccgccgccgccgccaccgccgccaccgccgccgccaccaataagcccgagcgtgtataacgtgatggcgctgcgatcgcttattcgaaagatgccggccgttggtctcagatcgacgccgatgcccccccgtatggggcccgtccacgcgctctcgacggcggctggttctcggattatgtccgatggtgctcccggaataaatggccgagcgaagatttattccgaagatgagatagctgaacgacgggaggcaataaaacgcctgcacgcggagatcgagaaggaccgtgcggtgtctgaaaggtatctagctgagcacaggaatgtaatggagatgctggaacaacagagtgctgcaggagaagctgcctataatgcagctatgagggatattagtgaagcccgtgtaagttgtatgaaaacactgaagaacgtggctacggcatgcgatgttgttgcggttgcctgccctatgctgattgtccttatgatgatcactacatagtaacttactgtatgtttgttcggtgctatcatcgaactacctcccttcttatttattaggcctgcatgtatacctagattaatatcccaaatgatagggatttgctcttctagaatgcatatatgtcagagtgttgaatgcagtaaagtaaaagggggggcccggtacccaattcgccctatangtgangtcntattacgccgcgc

SEQ ID NO: 4556 - DNA, 891 bp, Triticum aestivum
  Clone ID: PAT_TA_4556
tcgaagcctaaggacgcccggcgccctcaaagagagaagaaattccccgaaatggcggcgtccggcgagggagcgtcgctgccgtctccggcaggtggcgaggacagccgccgccgtcgtgtgagctacttctacgagcccacgatcggcgactactactacgggcagggccacccgatgaagccccaccgcatccgcatggcgcactcgctagttatccactatggtctgcaccgcctgctcgagctttcacgccccttccctgcctcggaagccgacatcagccgcttccactccgacgaatatgtctccttccttgcctccgcgaccggcaacccgaccatcctcgacccccgcgccgtcaagcgcttcaacgtcggggaggactgccccgtctttgacggactcttccccttctgccaggcctccgccggtggcagcatcggcgccgccgtcaagctcaaccgtggcgacgccgacatcaccgtgaactgggccggcgggctccaccacgccaagaagggcgaggcctctgggttctgctatgtcaatgacatcgtcctcgccattcttgagcttctcaagttccacaggcgtgtgctatatgtagacattgatgttcaccatggagatggtgtggaggaggccttcttcactacaaaccgagtcatgacggtttctttccacaagtatggagacttctttcctggaactggacatataactgatgttggagcgggtgaagggaaacattatgctgtaaatgtccccctgagtgatggcattgatgatgacaccttccgtgatctgttccaatgcatcattaaaagagtaatggaggtttatcagccagaggtagttgttctccagtgtggggctgactctttggct

SEQ ID NO: 4557 - DNA, 605 bp, Triticum aestivum
  unsure (1)..(605): unsure at all n locations
  Clone ID: PAT_TA_4557
gcacgagggcaacgcctaccccaaattcaggagctagcttagcttagccatcgatcgacaagcaagcgtgctagtgccacacgcttacgctttcttgggttcttgctcgatcatcgtcgtcggccgatcgatcgaccatggtggtgtggagggatagctatctggacctgatcctggtcccgctggggctgctgctgccggcgctgtaccacgcctggctgtggcgggccgtgcggcgccgcccgctctccacggccttcggcgtctactcggccgcgcgcaggctctgggcggccggcatgatgcgggacaacgacgacaagaagggggtgctggtggtgcagtccatccggaacgtcatcatggggtccacgctcatggccaccacctcggtgctcttctgcaccggcatcgccgccgtgctcagcagcacctactccgtcaagaagccgctgagcgacgccgtgttcggcgcgcacggggagtacatgatggcgctcaacttcctgctcccccccctccgcttccccctccccttcctctgccacacgctcaccatctgcttcctcaaccaagccagcttcctcatcaacaccnnntgcctc

SEQ ID NO: 4558 - DNA, 562 bp, Triticum aestivum
  Clone ID: PAT_TA_4558
gctgattgctactagcgggggactgaaccaacaacgcatagggataacagatgctgttgttgttgcctggattttgaatgccacacttgttgtgcccgagttagaccaccactcattctggaaggatgacagtgaattctccgatatttttgacacggactggttcatatcgtacctatcaaaggatgtaactgttgttaaaaggatcccttatgaagttatgatatcaatggataaacttccatggaccatgcggacacctagaaaatccatgcctgagttttacattgatgaagttttgcctattctgatgcgaaggagagctttgcagctaactaagtttgattatcggctcgccaatgatcttgatgaagaattgcagaagttacggtgtcgagtaaactttcatgcattaagattcaaaaagcccatacaaactttgggtaaaaaattggtgcgaagattgagagtcatgagctcacgatatgtcgccattcacttgaggtttgaacctgacatgcttgcattttctggctgttactatggtggtggtgaaaaagaa

SEQ ID NO: 4559 - DNA, 733 bp, Triticum aestivum
  Clone ID: PAT_TA_4559
atcatttaagccaagaaagcgtgctcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcaactgcaaccatttccgcagccgcaaccatttccgccacaactaccatatccgcagccgcaatcatttccaccacaacaaccatatccacaacagcaaccacagtactgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctt

SEQ ID NO: 4560 - DNA, 482 bp, Triticum aestivum
  unsure (1)..(482): unsure at all n locations
  Clone ID: PAT_TA_4560
atattccttcacaaagatagtgctgatactctggtttcttctctcagtatgaagcagatggagcttctctgaggaaggaaggaaggaagaagaagaagctcttgatttctttgcatggagaaggaggccatgggggggcatgtaaatataatgctgccactggagaacctgagctcggatctccccaatggtggagtcgtacttggccatgacaaggaaatctcaactctgcatgaagcgatttctgctctgagatcgaggcagaggcatctcaaccggaggagacgtgaggcgctggacaagctcatagacctgaaaggaagcatcagggtgttcttgggagtccttcgagcgatctcaacacgcaacatcaggttcaaacaggaatttactggtgtttctgccnatccaaccttcattcaaacaacaacatcaagnttaancaccattacngtcaacaaganacacncaattcaacatgg

SEQ ID NO: 4561 - DNA, 816 bp, Triticum aestivum
  unsure (1)..(816): unsure at all n locations
  Clone ID: PAT_TA_4561
ctgtctcggcctttggccgtgaccggcgatggaggcggctacgggcgtcgcataccatcttgaagcatcgccgttttgctgccgcacccttcctgtatggatctggctccaggggaaactctagatcctatgtgatcagacgttggcggcgccttggcgtcgtttcccctcttgagggcttcgtctttggagctgggcgttggcaaggggggccagtggcgggtgttgattttggtgttgaggcttctgtggcaacgatggcggaggcgagcaaagtcggaggcgtggcaacggttgcgatagtcggctcttcttcgngcgtgtcagtgggattacctcgggttgttttgttgcggtgaagtcggagctgcggtggcggggccctgtggcaacgatgacaggcagcaggtggcttgttcagtggtcttnccgcggcgccaacattgcatagttcttcttcggagctcttcattaaaatcggagctgtgttgccctcggcatgtgtcttcttgtgttctgcacggcctctactgtgaggatcggcttgacgttcatcttcgacgaagtcggagttacttgctcggagtttagggtgggtgatgatgcccgtaggggagcagtgacaacgatgacgtctgagtgcatcttgtcgaggccctcctcgttgaggcgtgtgtggagtatcatttatgtgccgctccagcggtttgtgacagttttagcacggtttcccgttaattaaccgggcaactctcttctgcttaattaatggatgaggcaatcttttggcttcgtttcaaaaaaaaaaaaaaaaaa

SEQ ID NO: 4562 - DNA, 746 bp, Triticum aestivum
  Clone ID: PAT_TA_4562
cacccaagtgttccctctcacccgattctcgaattcaaaatagtggaagtgaagagtctacagatgatgaaactgtggatgccaaagataatgggtttcatgatgcagagaatgatgtagatcaagaattagatgagcgtatactgagtggaaacttgagtgaaagcagtgcacgtactggtgctgacctctatgactaccaggtagaccctggtgattcagacgccgaacgttttgtcacagataaggctttggaagcaaagtcagatttaaaggatgctccacacagccatttaaatcaaaatggaacgataaatgtccagagattaccgaatggaaatgatccaacaaatctggcttccagtcatgagtctccattgtcaatgggagagattctttcgtctttggatgcaggagttcctttatctggtcctggagctgaacattctgcagataggcagtccatcaagtccaatgaaactcagttacatgtgaagcgttctaatatttggggacggagtaatgcaagaaagagccagcagtcagagtttgctgattcatcgggtgaagaagagcttgctatccaaagacttgagattgccaagaatgatctgcaaattaggattgcgaaagaggctagtctggaaagaagaaagcaagctctgcatgagcgccgttcggtgctggaacaagatgtatcacggttgcaagagcagctgcaggctgaaagggatcttagagctgca

SEQ ID NO: 4563 - DNA, 559 bp, Triticum aestivum
  Clone ID: PAT_TA_4563
gcgtcctactacgctctgcgctctgcgctctgcgctctgcaaaattggatcttggcttcatcacatccccggccccgccccgccttgccctgcctgcattccccgcagatcgattcgatccgcgcaagcaattgcaattgcagcaattggattggcatccgcagagaattgcgctcccctccgatccacccaattgcaattgcaatagcaatagcaattgggattgcagtccatcctggatcgccggccggccggccattgctcgcctggatccgccccagcagagcagagcagagcagtttcagcaggcagggagacgacatcagcccctgagtatgatgatggggaccgatgtgtgttcttcgcggatgctgtcgctgccccgttacgagagcggcgacgaggagctcaccgtgctgcccaggcacaccaaggtcgtcgtcaccggtaacaaccgaacaaagtccgtgctcgtcggcctgcagggtgtcgtcaagaaggctgttggccttggaagctggcactggctggttctcaagaatggtgtggagggggaaag

SEQ ID NO: 4564 - DNA, 1072 bp, Triticum aestivum
  Clone ID: PAT_TA_4564
cccacgcgtccggaagccctcggcccctcaccacctgttgaagttgagggcagcagctcgcactgtgaggggcttcggcgacggggcctattatgcacatgatggtgtgctactctcatggatagaggtcattcatggcttgagtgagtagccccaaaagcaggtggtatggcaagccgcgggaagctcagggcagggtcagcagcttcaacagcttcaactgcaccaatgcaactgtatgtctcttcagagtatgtactcagctcaaaataaaaatctcaagtgtatatcttctcgagacatgacatagatgaacactgacatgcttgctgcaatcccattattaaccatgtgcttctatttctctctgaattcgtattttgaacatggtgaatttctcggaatgtagtttcatctttgctatttatgtctttatatctgtgaatacatccatggtcaattagttttcttggtaaacataagaatttaggttcacatagacacccacttttatgttggctacatattagttacactgatgcactactcaagctttgctttccttatatggaaatttcatccatgaagtatgttgtaccagccctatggcttgctgaatattgctcttactaatccattgatgctatgcatattccacttcgcctgtctggggtaaactgaaggatgtgtcgttagctgatgaggttatccccactaaagccaagaaggtcaggcgcaactaaaaccaggaaggccaattgttgttaagtgctcgcccttttggaccttatcattttgtttgtggatgcgcgaaagaatgatgtctggatatgggagtgtctctttagatgtagatatagatggtacctgaagcaactaaaccgcgtatggggatttaacattgtctttggtggaaaaggccctcaattctcggccactgttctatttttgatttcttgcttggtcgtgtagatgtcgtgggtattgtagtcaaggtttctgatgtactcctgttccagccgcaaccatggcaaactgtgacacttactatgaatcataaatagttctctct

SEQ ID NO: 4565 - DNA, 1634 bp, Triticum aestivum
  Clone ID: PAT_TA_4565
attgccccctggcgcttccctccgctctcctcttccaagattggatcttcacttgatcaccttcctgcccaccccccccccccgccctcgcctcccgtacccaccttccctcgatctagctggttcgatcgatccgatcacccacgcaggcgcaaacaatcgcagtattgctttaccatacgcaggcttgccatgcgaatggcaatcccattccatccgggctcgtgcgctcgccggcgggccattggcctcctggatcgccgcccgcccatcagtctcccccgtccctcggagcataccacacgcaagaagggccttcaggttgaggggaccgatgtgtgttcttcgcggatgctgacgatgcccggttcaaatataggttagacggagctcacggcgctgccctggtacacgaagcaccatgtggagaacaacgtgctgaccaagcacacgatggtcgtcgtcttgggtaacaaccaaacaaagtccgggctggtcggcctgcagggtctggttaagaatatctgttcgtcagtgaatttgcctccgactgcttcttacgccttgtaaggatgataaagccctcgagaatatgatggatgctctaaccccttcctactgctgctgatgattattatcagataccacgagggcacagcttcccatgtctcagctacaacagaagaatctatccgttagccgatgcaggtatccccactcaaaccaagcaggtcagggcgcacctaaaaccaggaaggccaattgttgttaagtgctcgcccttttggaccttatcattttgtttgtggatgcgcgaaagaatgatgtctggatatgggagtgtctctttagatgtagatatagatggtacctgaagcaactaaaccgcgtatggggatttaacattgtctttggtggaaaaggccctcaattctcggccactgttctatttttgatttcttgcttggtcgtgtagatgtcgtgggtattgtagtcaaggtttctgatgtactcctgttccagccgcaaccatggcaaactgtgacacttactacgtaattcctcaaatgcatacatacaaggctgttggccttggaggatggcactggctggttctcaagaatggtgtggaggtgaagttgcagaggaatgccctcagtgtcttggaagctccgactggcaacgaggacgatgatgagatcgacggcggtaacaactcgttctgcggcagctttcacatgggagacaaagacatgaactactcaagcatcgagtaccagaagccaacaaagccaagggtccggcacacaaggccatggtcttcctgcacgacgacgtccagcagccgggccaacaaccttcactcgacctcgaagctgcgagcgagagtgaacctgacaaagcttggaacgcccacattatggagatactggaagcacttcaaccttgtgagcatgaacccaactccatcatcaggagcagctgttccatggggtccagcagcatttccagtcccagcaattggatgagttgcaggtgatcctggggttcatccagacggcaaagaggctcaagaccctgtacaagaacagctagcccagccctcctttctcagatgcatacatacatatgct

SEQ ID NO: 4566 - DNA, 628 bp, Triticum aestivum
  Clone ID: PAT_TA_4566
acctactccccggccctccacgcgaccgtccaccccgcgtcgtctccggccaccgccgcccgcggaaaccctacaccccgcccgccatggcggatccgccgtccgtggccgccatcgcctcgccgcagcccgaccagctcggcggctcagcctccgccccgcaaaactccaaccctaactccctcctgctccccccaaatccccccctcccccaccgtctccgacctctccgtcatctcctccccgcagctcgatccagccgcggcagctgcgggcggagggtccgcggacttcccgcctcgtccgcagcagttgcaggcgccttcgcccacgcaggcagtggccggcgccggaggctacggccagatccagcgctcgggttcggcttcccgcctcgccgctgccagccagcttccacaatactccgcggcaacggctaggatgtacggagggcagatgagcttctcaggtggcggagcgcagctggggcagcagcagcagctgccgccccgcgcgcccgcgcgggctcaggcgcggccggggggcaggctcgggcagggctgcccggctgccgcggccctcgcccggcccctgccgccttggatcgcacaccggggccttccagttt

SEQ ID NO: 4567 - DNA, 1100 bp, Triticum aestivum
  unsure (1)..(1100): unsure at all n locations
  Clone ID: PAT_TA_4567
gcccgttgcacaactagaagttatccagcgagtatcctgagcagctcgacgtcagcgagggccgcccttcgctcaccggccaaccgcccggcaccttttgagcgtacacactgcgaggctttgttagccggcgggagtctgcagtctgcttgctccggcactagctagctagctcatcccggccggccagcgacgtagcagcggctaggaagaagatgtcgagcagaaggtcgtcgcgcggctccatctccgacgaggaggtcaacgagctcatgtccaagctccagtctctgctccccaactctcgccgccgcggctccagccaggcgtcgacgacgaagctcctgaaggagacgtgcagctacatcaagagcctccaccgggaggtggacgacctcagcgaccggctgtcggacctcatgtcgaccatggaccacaatagcgccgaagcggagatcatccgcggcatcctccgctcgtgatcgtaccacagcgccggccggtcgatcggcgagagctcaaccgccaggacaattaagcggcggcggcgccatgggtctctccgccggccagccggacacgtacgagagctttgcttagctagggtatatatatcgtcctccacatatttaaatatgtaatgtctcttttctgctccctttctgcctagatctgatcgtgtagatcaaaaaatgtactgcgtgtctctaagcttcactccgtctgtactacgtagggcattagcttagctagcgttcctaccttggggccaaagcttatcctcgcgcgctggctgctgcttgagctaatctctcgatcgtctcctccgtgtgctgcccccgcccgcgcgcaccaccccccccccccccccccgtcctcctgtctgcctcttcccctcttctgttgtccctttcttgatctactactcgatctgtaaatttagttggtggcattggatcgagttgtgtcctctatagacaaccgaccgaccactactacggtactactactactacctggagcaaattaatatcatcgtcatgttgtaccaccccagctttaactttttgtngaatacgtactacgnagnatcaaattaa

SEQ ID NO: 4568 - DNA, 716 bp, Triticum aestivum
  unsure (1)..(716): unsure at all n locations
  Clone ID: PAT_TA_4568
tgtgaaccttactgacaatgatctcgcaaaaaccacctaaaaactttgggatactgcacttcaatgaattaagaagggaaatgaactttacagcacctagtacagggcatgacaaaattaaaaatggagatgacctagaaaactgtacaaggaaaagaaatcctagaacagaaccatgatgacttgaaccaccttccatcggtcagctctaagctacctgagctcccaggcccttcgcccgggcaagccactacagagatttttcctttacttggtcgtgtattttgacattaagaaggtgacaagcaccctacgcatcaaagatgactcataattgggtggtgnggggttgtacnagacttctcgccaacctggctagactcagtttcttgtgtatcatgagtaataggaacaagtatacagagccatactcctagaaatatgtatatattcttcatatatagtcaaaaggcgtttgctgcaacagttcctttgacgtgtctgtagttccaaggaaaaaaagttaggtaaagaaaaattgcagaacagaagttatattgcattctttttgcataaaactactgtagcgataaatatgtaattgtgcagtgctgcaagcattcaacagatcaaacatctgatcccttgtttctttctgtacttcaaatcctgctgagatattcaaagaaagatataacaaaaaaaaaaaaaaaaaa

SEQ ID NO: 4569 - DNA, 708 bp, Triticum aestivum
  unsure (1)..(708): unsure at all n locations
  Clone ID: PAT_TA_4569
cttagcccattctataagactaccgttaagagactaaagaaatatgatcttcctttagtaagccatgtgaatcacaatttttctgtgcatgcaatacacantgggagaagatatcatgtctgtctttgaacatgctgtaaaagttctatcacgcagagaagatctcacagatcccagtgaaaatggggcgtcgatttggcaagtggacagtgatcaaatggagcatgtattttcaacacttgttgatcaccttcagatacaagaagcatacaacatcttcattcttaaccccaagcctattgaaaagagtactcagtatggttatcggaagggcttctccgagtctgagatcaacttactgagggagaataagaccctacaagctcggatactccaatctaaaagggacccaaaactttatcttgatatagagaagggagtcaacaaaaggcccttgtatgaaaatcatcccctgtcatcattttcatggaccacaactgacaatgtggatatgggtgattggtcaaaacagtgcaaggaagccttaagtggttttgaactgttgaaggcaggaaaaagtaaagaggacattatttatgacaaagctgttcagatattacatggtgcaaaagatgagctgcatgatgttctagagagcgcactcatgtccagtgatttgaagggtttgcatgctgaatgccttacaga

SEQ ID NO: 4570 - DNA, 1482 bp, Triticum aestivum
  Clone ID: PAT_TA_4570
ccgcgcgtccgcgaccgaggcaacgaacctggggtttgtgttagggcggcggcggcggcggcggcggctttattcccgatcccgatcaccatgcccgtcgaagccgcgtcaagctcggatgaggaggaggaggaggagatggccgccctctccgattggcagatggcggcggaggaggggaccgacttcttccccgcttgggcgagggagggcacccccgttttgcccgaccgggtgcggcgggaccccaccggccgcacgcggtgccgtgacgacctacacgcgccccggtcgactgacgatgtgctcgctctcgccgcaccgtttcctgtgctgggttgactacttcagcggtgtcctgctatctgacttctcttccactagaggttccccgcccccccacttcgttccccgccccggggatgctccgtcccctggccccctacgggtctcaacgcacttccctgggaggttccgaagtgtgtccattagccaaggcaagatgcgctttgtccacattgacaatgacttccatgagacaatccacgatgatgatgactcgccatggcatcagcttcctcgcataacgagcccagggcagcggcatgagggtccccaaaaaatcaccatttggactttgaactccgacaaattcagttgggagcaacatgccatgatcaacctggatggtctatgggcgcaacgttgttacaaagctctggacatacagcagcgtcttcccgagttcccagtcgtcagtgtggatgacccggatgttctatgctgcctgttaagggagaaggaatttggtggcaaggggtggatgagcgtgattgacatgaagcttgcgaaactgcaggcatgtactcaatatatcaatcgacggtcctactgtgctgagtgcaaggatgcgggctgtgctgagtgtgtggatgacaaaaacgatttccctaatatgcccctacttccaactgtcttctcctccaaacaccttgaaaggccaactggggtggcattggacaacgacaaggttgcaactcgtctttcaagtaagtctgcaaggtttgttccaaagaggcgtaagtgtgcagcgtaaagacatggaatctggtgacatggtgttgatcactttggcgtcgctcctatcgaagatgatgtttgtgttaatgccttaatggtgcactgcaggcagaaccaagttaatagggcaaaatccatatatgtgatgaagatgatgtactgatgaatacctatatctattagagtagactatgcatgtttctggatcatctaatcatgatgtactgatgaatactcctacaatttctaagctctctttaattgggaagctctcatagctctatggtttagagttgtttctgcctgcacctttcagttgggtccttttgtgtggccaaatggtgttttttatcccctgatgctttattatatgagataaaaaaggacgccctttttttaacc

SEQ ID NO: 4571 - DNA, 621 bp, Triticum aestivum
  Clone ID: PAT_TA_4571
gaactcgccgtcgacactgagctcgcgcgtccttcgacctcctcttccccaatccccttgaccccccgcccctccctctcgcgcctccagcaccgcccctccggccctggctgcgtcgcctccgctggccttcgcattcccctcgccgacggccatgattgactgcccgcggctgcttcttgctgccgcgagctccgctcccggcccctcgtccgccgcttgccggaggttcaccaccgggtgcccaaccttctccttttcatgccgcagccgccttccttctttccctgtgcaatctgcatcctctggggcggggagccagtcgagcgtcgtggatgagccggaggccgtcgaatgggccatgcaggacttctacgctttgcgcaaggatgttgagttggccgtaaagcgtgtcaatgaagtcaggcaggatgctggactggaacagcttctggaggaaatcgcttcactggagaacaagtctggagatagcaccttgtgggatgatccttccaaggcacaggagttgcttgttgctctcacagagctcaaagagaaagtcaaacttcttaacgatttcaagtcgcaggttgaagaagcggataccattgtgcagcttac

SEQ ID NO: 4572 - DNA, 556 bp, Triticum aestivum
  Clone ID: PAT_TA_4572
gcaggaatataacgtcgttgcgatggttgtattattggggccaaagttgaagcacatacaagatcagatgcaagacgaagtaaagaacatgatgtctgtacaactgcgtcctcccacctccggtggaggccgctacgccgcaaggccacaggccctacaacccccagagccccccgctcgttgcctcttgcagcccattcggtcgcacggggactggcatggtcgcccggatagtggcggtgagcactgagtccgtatacaccttcctcaggcatcatctggcagcgcttgaaccgttccttggcgtcgccccttattcttcgtcatgaagctagcaagcagcaagcagctgctgagagtcaccggatcatgaaacctcggtgcagatgaataatggagccgtaaatcgctgaggcagacacagctaacgctgcggcgtccatcttacctgggccaatttcagggccaggctgtgtaaatgctgggttggttgggccaattcgtgttaactgggccttgttagtttgtgcaatttagggcccaaaatataagtgtt

SEQ ID NO: 4573 - DNA, 786 bp, Triticum aestivum
  unsure (1)..(786): unsure at all n locations
  Clone ID: PAT_TA_4573
actgcgtgtcagtgcgggcgagcgtgtcgtgcagctcgtcgggcgtctgggcgacgaacctcacttgcagctctctcctccactccttgttgttcgcgggaagcaggggagaagcgcactgcactaggggtggccggtgtcatacgttttttaagtagttaatcttgttatgtcttttttagtagtcatcttgttgtatgtttcagtttgtcgctgtgggggcgtgcacctccgcgctcccctcggggcaccgcgcgggcttgtgggttgccggaggttttcttgtctagagggaatcggcagtacccggatttcgcgtgtgactgcagcccacagtacagggacctgcagctccctctccctctcgtggaagtacatctctagcgaaaaggtgcctggaggtgggcgaggtcctggcctccgaactccctgcgcctcctcccttctgctgaagtcgttggtcgccggcatgatgctggaccaggcgacgagggcgctggatgggtcgtgcagcggggcagggcttgcagtctgcagtgtgcaatcctgtagctcggccctcgcatgcgtgcacttcatgttttttccttatttttcctaattttttattgctattgtactacaacgacggcgggcaatacaaccgatggttggaaatccagcggcggcgtacatgctcgcaattcggttggtcgcggcttgcggttcngctggtcgcaacttttgatgttggctacgtgtactgcatccctgcccacaagcatcactaaaacggaagctgcaccc

SEQ ID NO: 4574 - DNA, 662 bp, Triticum aestivum
  Clone ID: PAT_TA_4574
tcacgaggcgccggcgagtgcctgtgtgcggcgaggacgccacggcggcacgggccgggcgcgcgcgagggcggccacggcctgacgcaggggcccggccacgggtgtggcgcggccgcggccgggcggcggggggcgcttggcgcgactgcatcaacatcgacgactgcggcgtcggaggagccgctcatgccggagggcgaccctgtagagggccagcgccgccgatctgtgcggatgcgcgtttccgtcgcgggacgcgaagccagtggttccggtcgcccagtccagagcggggtcgaggccagacgctgatggcaagatgacgatgagcgccaccacccagttcagcgaagatggtaatgaagtgcacaaaagtgaggccacgaccaggagctaggcggcggtggactggagaatttctctctgttaattccgtctctctctcaataagtttctctctctactctctgtgttaactctcgcgctctctctctgttaatcctgtatgaagaatcaacggattgtgaatttcagactttagtgaaagcaacagattcagtgggcatgcgcgactgtatcctactggtgcatttaatctatgtagttgaactatatttggcactcgaagtgagtggttgttaaaaaaaaaaaaaaaaaaa

SEQ ID NO: 4575 - DNA, 1714 bp, Triticum aestivum
  Clone ID: PAT_TA_4575
cccacgcgtccgcccacgcttccgtggtacttccgctctccagggttcgtttcccctcggagccgaaaccctagccgccgccgccgacgaccgcgagcaggctcagatgggaggcaagtgcccgcaccgcaaggtcaaaaagcgccgtctcaactgcaagcaggtgcgccgcggcaagttcctcgtcaaagccgacgacgccgtctacgacgagctcgtcaagctggccgaccagggcaaggattccgagggcaaggcgcttcccgtcgacgaggacctccccggcatgggccagttctactgcctccactgcgatcggtacttcgcggatgagaccgtgaaggaggatcactaccgctcaaagcgccacaagaaaagggtcaagcagttgtctggaccagccccacacacgcaaatagatgccgatctcgctggtggaatgggaatgccggacaacggcttgaagctcatgtcttcctgaactttgtgatcgttgtttgatgtttttattgctgttgctatacatctgtaccaactttgcttgatttgtaacatgcaaatagtcgcttcggtcgaagaggttaggattatatatttctgtgtctgcctcatgcttgccagcttttatctacattgagaacgagttacctatctgcgtctgggacaaaatgtcaatgatttagcagcagattatgtactatgaattggaactcactagtggtattctcatgagcttgcattgcaccccgtaggttccgactcccccccaccggcgtcgcttccactccgtctgcttacctgcccacctacgggcacccgggccacccccctcctcgcatcttcactggcacgcgtggctcccatgtcatcgaggatatccacagagggtgcgtgagtgggtgcgagtgcccctgggcgtgccagtgagtcagactggcccagagcctggccctgagagagagggactcggcatctctgaagcagtcgtcctctccagggttcgtttcccctcggagccgaaaccctagccgccgccgccgaccaccgcgagcaagctcagatgggaggcaagtgcccacaccgcaaggtgaagaagcgccgtctcaactgcaagcaggtgcgccgcggcaagttcctcgtcaaagccgacgacgccgtctacgacgagctcgtcaagctggccgaccagggcaaggattccgagggcaaggcgctacccgtcgacgaggacctccccggcatgggccagttctactgcctccactgcgatcggtacttcgcggatgagaccgtaaaggaggatcactaccgctcaaagcgccacaagaaaagggtcaagcagttgtctgggccagccccacacacgcaaatagatgccgatctcgctggtggaatgggaatgccggacaatggcttgaagctcatgtcttcctgaacttcatgatcgttgtttgatgttttattgctgctgctatacatctgtaccaactttgcttgatttgtaacttgcaaatagtctctttggtcgaagaggttaggattttacattgctgtatctgcctcatggttgccaacttttatctaaattgagaacgagtgacttatctgcgtctgggacaaaatgtcaatgatttagcagcagattatgcactatgaattagaactccatattggtattctagcttgaaaacaagctatctgcaaaaaaaaaaaa

SEQ ID NO: 4576 - DNA, 847 bp, Triticum aestivum
  Clone ID: PAT_TA_4576
gcgcggctgcacccgacccctccccgacccccccccccccccccccctcctggtgccatggcgctgcgctctccctccagcacttcgcggcggaatctgggaccccgttattcgccgccggcggactctctgcctcccacctctcaggctggatccggcaatggagctagagctggtgttgctatgaaggtgaaggaggctgaacatatgttggcaaatttagaagaagagggagtggagatagatggcaacatagctagtattattaatgatgagatagctagaattaaagctgaagctgagagggagaagattatcaatgtgctgacaaggaacgggcggatggtactgctcactattgcatctgctgctgctgggctcgccctggcagcggctgctgtcggtcgcgccctcggtgcgcaactggccatgatttggggccaaccggagcgttccgcgtgcagggccccgctcctttggctgcgtaaaacctagccggcagcctccctagctcttcgcttccgccccctcgcttggtggtccgggctttgttgtctgttatgggttgtcctgtttactgggctcttcggcaggtaatgatgtaactcttactgttctgctgggtggcggcttatctttcaagctgcccatctgcactggtccaagcttgtgggtgcactctgtttatggtatgtaaaaccaagtgggcaatcttaggaaactactgttggctaattactgtgttttttggcatgtatactggtaacacaatgttgcggctctaagctgtgtggagcaggtgctccattaagtgtggtgaaaaaaaaaaaaaaaaaaaaaaaaaaaa

SEQ ID NO: 4577 - DNA, 419 bp, Triticum aestivum
  Clone ID: PAT_TA_4577
cgtgccgtagccatggtagaccatttggttgttcacaaacatcgacgagccggaggtgttggaatgcctcgcaatcagagaagctctagccctagcggatgatctttatatcaaaaaaatatctgtggcatcggattgcaagctagctgtggaggccagacatcatcagcgtatggagcagtggtgatggagatcaaacatcacttagtaattttattccatgtgtttttagtcatgagtttagaacctcgaataccgaggcccacaaactagcaaagcatgctttaattctcgggaccggccgtcatgtttggttaggccacctaggagaccttatcttcgtccatgtaaatgtgacggtttaataaaaagctttgggagtttgcctttaaaaaaaaaaaaaaaaaaaaaaaaaaaaa

SEQ ID NO: 4578 - DNA, 543 bp, Triticum aestivum
  unsure (1)..(543): unsure at all n locations
  Clone ID: PAT_TA_4578
tattggaatgtgtacttaaatcagtgagtactgaatcggaaaacaaggctcttgaagatgcacaaaatccttcaccttctagtgggacatcaaaaactctagccaagcctgcgacatcaaaagttctagccaagcctgagacatcaaaagttctagccatgcctgagatctgtggaacatcatcttcccctaaagaacaaggggtgctcactccttgcaagctttctgtggggcaggaagctgatgctaacggtgtagactttgatggatgttgtaacagctcctgtttcgcagtgtaacagcagtctcantcgggggagaagtgttgcatgtcctggagttgttgcctgaagctcaaggttgctgtagctgcagatgttggccccattgaagccttcttgaaggaacggggcccgaaattgatgcccactgtctgaccccggaccctggtttgtcccatgataatgttagttccatgaaagctgatggcagcaatgccttgtcaaccaggcagtgctcacagcatatcgacagccataactt

SEQ ID NO: 4579 - DNA, 1128 bp, Triticum aestivum
  Clone ID: PAT_TA_4579
ctccttactgaactggcaatacattactaatgaagaattagagtctccttactgaagcttggcaataacattactaaatgaagaaattagagtctccttactgaagcttggcaataacattactaaatgaagaaattagagtctccttactgaagcttggcaataacattactaaatgaagaaattagagtctccttactgaagcttggcaataacattactaaatgaagaaattagagtctccttactgaagcttggcaataacattactaaatgaagaaattagagtctccttactgaagcttggcaataacattactaaatgaagaaattagagtctccttactgaagcttggcaataacattactaaatgaagaaattagagtctgcttactgaagcttggcaataacattactaaatgaagaaattagagtctccttactgaagcttggcaataacattactaaatgaagaaattagagtctccttactgaagcctcgctcggacatttccccttgtagaaattagagtctccttactgaagcttggcaataacattactaaatgaaggtactcggatgatcttaacttgtggctctttttttctttttgcttgactgcagtatcttcccatttcttctgccataatcagatatcattctagagagcttgtcaaagaaaatataccatgagctagtgaaaagtattcaaatgcctatatactgaccacattcggacatttacccttgtagaaattagagtctgcttactgaagcttggcaataacattactaaatgaaggtactctggatgatcttaacttgtggctcttttttctttttgcttgaccgcagtatcttctcatttcttctgccataatcaaagattattctagagagcttgtcaaagaaataaaccatgggctaatggaaagtatatgaatgcctatatactgaccacatcgggacatttaccctaaaagagattagggtctgtttacttaagcttggcaccaacattgctaaattagaaataagacaaatggtggaccttgtttgtcattctcatcttttctattactaataattctcgttaatttttaaaaaaaaaaaaaaaaaaaaaaaa

SEQ ID NO: 4580 - DNA, 2082 bp, Triticum aestivum
  unsure (1)..(2082): unsure at all n locations
  Clone ID: PAT_TA_4580
atacacacacccagcgataaacctaaaaattcattatttgaatttttgcttcaggataaaaaaacatacgcaaaaagagaaacaaaatgcgcgcgggtgaggcgacatctcccaacgcggggagcggaaaatactcctaggcgggtttcgctgtgcaccttggggggcgcaggggcaggcgatgcctggtatcttggttctgcccgggggatccatctccgttcggcttgcgtcgcctctcctcaggcgcaggctttccccccctccggtctatcccccccgtccgctctacccgcctggctgagtcgcgccccccacgctcgactctccacgacaaggagactaatctccaaggagaacgtcaatcacgaagaatcactggggtcacgtcgtgaacaggacggacgcgcaggagatgggggtccccgccgaggacatgcgagacttccaccacgagcgatgtttgaggaagtccgatacggaggttgagaaggatgagcattcgaaatacaagatcccagctgcttgggcagaggaatgcaagaaaagggaaaggacatccaaggaataacatgggctagaggctagctaaaactcaagagggacaaactacagacagaccagataagagaagtacaaaatctatgagaacattcctaattctggagaagcagcagccaaagaatgcaaaccgactgtgaaaggtggaatgtattatgaattcagacaaaatactagatcagtaaaatcaaccatcctacattttcagcttgagaaatttagtatgggctacatccaagcatgacgtctacctaatgtcacattactcagtgcttcactggtcagcgttgagtggtgtggacactgaacttatgaatgtccaaggtcatgtggcaccaagggagaagcaccctggaagtctattagaggggttttctcagactcaagttagtaccttggcagtcaaggacaatttgctggtagctggtggatttcaaggggagctaatctgcaagcaccttgatcgagaaggaataagcttttgctgtcgaacaacatatgatgataatgctattactaatgcagttgagatattcaatactgctagtggtgctgttcatttcatggcatcgaataatgactccggtgtaagggattatgacatggagagattccagttatgcaagcactttcagtttgattggccagtgaatcatacatctctgagtcctgacgggaagcttgttgttattgttggggatgatcctaatggtttacttattgatgccaattcaggaaagactcttcattccatgaaaggtcatcacgacttctcattcgcatcagcctggagccctgatggccgaacgtttgctactgggaaccaagacaagacatgccgaatctgggacgcgaggaacctatcaaaagcagtccatgtattgaagggtaaccttggagccatcagatcaatccggtttacgtcggatgggcagttcctgtcgatggcggaaccagcggactttgtccatatctttgacgtgaagagcgactacaacagaaggcaagagctagacttcttcggcgagatatctgggatgtccttcagccccgacacagacgccctcttcgtcggcgtgtgggatagaacatatggtagcctcctccagtttgggcgtctgtataacaactggtaccatgacccgctgctttgaggcgaaagcggagcggatgtcgggcctgcatgtctgtccccccacagctgcactgaatctcgcagcataagttaggtgtcttccctgaaatcggaatttctcgagttgacctgcataattcaaattaataaatgttgtatccttgtatgtgtatataaacaaatacagatgcctatagcctgtgtgccggggtagagcgcacacttcatccttatatgtttaggttccagttagttgtaaggcatcttgactcaggtcgagtgacgctgtgaacattgtagtcgatgatggtgtgacttgtacgatgaacgacatccgcttcttgcgtcaaaaaaaaacctgcccgggcggccgctccgaannnnnc

SEQ ID NO: 4581 - DNA, 479 bp, Triticum aestivum
  Clone ID: PAT_TA_4581
cttcgccgccgcccccgcggccggcgtcttcgcgtccgcgcggccctccgtcgcgctccgccgccgcggaagcagcagaggggcctcctcctcttcctcgcgcgccggcgccggacgggtgcgcctcgtccgcccgctgccgccgccgcgcgccgtgggcggggacggcgggggggacctgccggctctggacaagtgggacatgatggagctcgagttcgggcggttcctcggggaggaccccaagctcaccctcgccaagatactgctcaagaagtcagaccccgatgcttcatccctcgatgtagagaaactagttgccagcaaaaaggacacgctggatgttattttgaaggagttcatggaggctaataagcaggacaagactgccaccgcaggagaggcaataagcgcgccaatgaaagacaaacagcctttgggtgtttcaaggcctgcactgagcaaaccaaagctggatg

SEQ ID NO: 4582 - DNA, 1505 bp, Triticum aestivum
  Clone ID: PAT_TA_4582
ggttaacctgagcacaatgagttgaaaggctaattcctcgctcgctccaacattcccagatagttcattcttggggaaccctgaatatgcgggccgccactagataattgctcatttccaacaccaacaccctccccagaattgccttcaacaccgtcatctccatcgcctgtgcatcatgacaggaaactgagcatagggttcataatcgcggttgctgtcgggggatttgcagtactgatgctaattgtggttgtgttgtgtgtgtgcctttcaaagaggaagggcaagaaagaggccggtgtcgactacaagggaactggtgtcaggagtgataagccgaagcaggaattcagtagcggtgtccagactgctgagaagaacaagttggttttcttggacggttgcacctacaactttgacttggaggatctactaagagcttctgcagaagtccttggcaaggggagctatgggactgcctacaaggctatactcgaggacggcacctgttgtggttgtcaagagactaaaggatgtcgtggcagggaagagggagtttgagcagcagatggagcttgttgggaggttgggtaaacattcaaacctagtcccgcttcgtgcttactactattccaaggatgagaagcttgtcgtctacgattacattgccaccggcagcttttctggcatgttgcacggtatcagaggtgttgctgagaagacgccattagactggaacaccagggtgaagatcatactaggaacagcatatggcatcgcgcacatccattcagaaggcggcgcaaagctcacccacggcaacatcaagtcgaccaacgtcctcgtcggtcaggatcaaaacgcgtacgtctcagactacggcctcagctctctgatgaacgcgcccgtcagcgcgtcccgcgtcgtggtcggctaccgcgccccggagaccatcgagaaccggaagagcacgcagaagtcggacgtgtactgcttcggcgtcctcctcatggagatgctgacggggaaggcgccgctccagtcgcaggggaacgacgacgtggtggacctcccgaggtgggtgcactcggtggtccgggaggagtggacggcggaggtgttcgacatcgagctgatgaagcaccagaacatcgaggaggagctggtccagatgctccaggtggcgatggcgtgcacgtcggcgccgccggagcggcgcccggcgatggaggaggtgatcaggatgatcgaggggctccggcactccgcctcggagagccgcgcctcctccgacgagaggttcagggagtccaacccgccgtcggtctaggccgttgttccctcgccggcttcctgtcaggagatcattggattcatttagctaatttgtaatttgagttcatgcatgccagcatggctgacatcaggtgcgacctcactgatcgaacaatttgcatcgagactttatcttggcaattgtagagattttcattgggggattg

SEQ ID NO: 4583 - DNA, 668 bp, Triticum aestivum
  Clone ID: PAT_TA_4583
aaattcggcccaagcggcacgaggaggggccgatcagatctcttctccgcattcccaaatgttcctcgtccgccgccgcctcctctccaccgctgcggcggttgccgctgctcgcggcccaccgccggtccgcgtcgccttgacggactcagccggccgcggagtcttcgctacccgccccatcgccagcggcgaggtcctccactcggcgcaccctctcgtgacccatccgtcccgctctctcttccacgaggtatgctaccgctgcctcaagaggaaagcggggaagagcgacgacttgaaagggggctgctacttctgcagcgacgcgtgccgggagcatgccgagggattccatggcattgagaagaaggcggattggtctttgttagatgaccactgtagttcacgtggtctcaagtacccatacatggtcaagcggctggcttgcatggttatatcaggagacgttggtgcagattgtcttgacattcttcagccagcccaattgcaccagggtacacttattgagatggacgaggagttcgaattgttgaagtccacttttaggaaggcagggtttcaggaagaactcacaacttttttgaccaaacaatggtacatcaatgtacttgcaagaatacgtgtcaatgcattccgtattgaat

SEQ ID NO: 4584 - DNA, 565 bp, Triticum aestivum
  Clone ID: PAT_TA_4584
tcaggcaaggccgatgaatgatcgccgtgacttgatgctgtagagctctaggtagatgtgacatgactgaaactcggacgcgtgggtcagaaggaagtgtccttgtatttcaggatggccgaagatggtttcggtctgttcctttagctgctgaatcttgggactcgtactgcatagttaatgagcaaggcaagactggctgatatctgggatggccaacgggttatgtgcgctgttaggaggagccgtaacgatgagttgatgcaacggtggcatgagtttgaaggtattgctcggatcattgtgtttactggtgatgaggaccggattgtttgtcaatatgtggctagtggctgctttctcttctagtagttgtccttataagattattatcagttttagggggtcatcccagttcatttacctgttgtttggaagattaaggcccctcccgagatccatatatttttgtatgtcttcttggcgttttgctcagaataaaatcatgcgcagggatgaccttcgcaagagaaacttgaaaaaaaaaaaaaaaaaaaaaaaaaaa

SEQ ID NO: 4585 - DNA, 1304 bp, Triticum aestivum
  unsure (1)..(1304): unsure at all n locations
  Clone ID: PAT_TA_4585
ccgccgccacctcgnntcctccgcgtccggtgcgatgccggnanaacccgtcgcatctgggcgagcttaccatcgagaagcagccgccgtgctttgacttttcccgtccttccctgcgctccccgccccctcctcggccccgccgcctccgggagaccaggacgccggcggcatgcggaacgacgccgccccaactggatccacaccctcctccattgcctgctctcgagccatcagtcctcggctcgaatcggtcttgctggtagccgtcgtcgccaaatcttagcttggccgcccgctgaaagatccagcacccttgcgcctctcaccgtcgatggcggtaggaatgacggagccgtgcatgtggcggcgcccatgtggtgcgagcagagcaaccgccttgcggagcgcctgcagggctgcagcacgccctgcctcgagcagcacgcatgggtcgtggctgagacatcagaggagcttcagcagaaggcggtgatccaatagtactccttccagtaatgtgtacagagaacgaggatgccaagccaaatttgttcaacgaggatttcaagtttgagttctgaagaccgttagagaattgaactggtggtgagttcaatgatatccaaaattgttggtcaaacatgaaaggatgcacattcgtttttgaagactgaaaaaacatttcatgaagcaaccttgaggtgccgccatggcaacatccatgagactataaagatcctgagggaaagagttgcgatgggccgatggcgcatctattcacaccatggacattcatcgcctactactgatgcgcccactctgaaggcaagcaaaagatgctattcctaaaggttgttgttgacacccaaaaagctcctcggtaaacatgttcctctccggcacatcacttggtggatctagaggggcaaccatcagcttatgaaaaagggcaactaaactggctgctattgttccttaccaagagctcttatctacatgcatgaatgttaaatctgtgtccaatggtaaagttggctttatcaggaaaaaggatcatggaataacatgcgagaacaatggatgatcgagtagcactcaagatggcaaggtggttgagatttacgaactgttgtatcttgaggactcatgatgcagttgtatgtcgatacatgtagatttatgactattgccatatcatccagtgtatctatctatgtatgtctccttaacttcaaaacatatttacgttgaataattatggtttaatacaggttctttctctattagtgactgattttatt

SEQ ID NO: 4586 - DNA, 600 bp, Triticum aestivum
  Clone ID: PAT_TA_4586
tatggggactcacatactcacttcttcacgagttggacgagagacacatatcatacagggtgctatgacatggactgccctggtttccagcttgttaaggggtcaaaaatcgctccgggtggcacaatacaaccagtctctcatgttcatggtgtacgtcaaaagattacaattaaagtgtttagggaaaaatccacgggaaattggtggatacactacggcttcaacaaggccccaacaccggtgggctattacccagcaaaattgtttgacaagttatcgaagaaggcgacccaaatttcaattggtagcgttgttgggggggagtccgtctatcccatcccctccaatgggtagtggattcttgccgtctgataaagctgcattaatcacagatatttcactcattggggaagatggcaggatgacaccttttactgtgaatacagacaggttacagagtaagagtagttgttactctatctcacctatccaaggtgcaaaatgttcctatggaggtccaggaggttgctcccgctagcttaagtagatcttactcatataagtacatggatgtggtgccgtgagtcatgtaaacgc

SEQ ID NO: 4587 - DNA, 626 bp, Triticum aestivum
  Clone ID: PAT_TA_4587
ttttttttttttaacctaaaacaagatacatatagtctgatataacctgaaacaggatacatatagtctgatatacactgaaatagaacaccattattctaatataacctgacacgggacacatgtagtctaacataacctgaaatatgagacatataacccgatacaacacataattattctactactctggttcctcttcagaattatcctgagagacatggctctccttcaaagatgccaactcttttggatcagtaacaatttctggtgcaacatcatgtcgacacgagatattgccttcaaaagtttcatctatggaaacattggtagcttcctcctcttgaaatgcaatatcatcgctagcatcatcttcattgacttgattccaaacctctggatcaaaaagatggcgatgcggagccttctgcacaactagccaatctcccctcatttttgtatcacgtacacagaccacttggctcacttgactagctagtacaaaggagtcattttggtaccacttgcttcctgtattaacactaacaaagtcgtcatcgatcctcacaggcttgttactctctaaatcataccattcacactcaaataaagcaacatgtcgatca

SEQ ID NO: 4588 - DNA, 1254 bp, Triticum aestivum
  Clone ID: PAT_TA_4588
cgcttcgcccccccatcgccccccgcgtgagtctacgagggcgaacgatggccgcggagaactactggaggtacgccgacgcgcggcagcagcaggccatggtggcggcagcggcggccgcggcggggatggccccggcagctaccgttgcgcaggcagcgacggccgcggggggcatgcagcagcaccagcaccagcaccagcaggcggcgatggcgcaacagcagcagcagcagcaggcggccgcgccgtctcttaagcgcgcgcgcccagactacggcgatggtcctggaggacaagagatggctggatattatccgcgggaaaatgcaggttaccactcacttagagacaatgaagcaattggagcatcttacgaccgctacttacgcaatgggatgccttctgtggcagccaatgaaccaagtagggcagttgttggtgccatgggtggagctgctatggttggtggtggaatgagtggatatcctgttgatgaccgccgtatgatgggtgtcgttggtatggacagcagagccatggggtatggtgcaagacctgagcctcctctccccccggatgcatccaacaccttgtatattgaaggtctgcctgcaaactgcacgcgcagggaggtttcacatatattccgcccttttgttggtttccgtgaagtgaggcttgtcaacaaagagtcaagacaccctggtggagatcctcatgtcctgtgtttcgttgattttgatagccctgcccaagctactatctcacttgaagccctgcaaggttataagtttgacgaacacgatcgtgaatcagcccatttaaggctgcaattctcgcgctttcctggtccgaggtcagctggtgggcctcgtggtaggcgttaagtcgtgcgggtcaggtggttggcgaacctactgtttatacgagcgatcgaacctgcttggtgtaacgctttgcgccgaattctccgccggtggctcgtagggttcgtcagcccatgttgtgaaagcgtgaaaaggacgatgcaataatctcgctgttcagtatccattagattctcgaggtcgcatgtgtgtctgctttagtatttatggtctactgtattttgttatctcgcggcgtgaccccagacaatatcagtcttttatcatgtgtaacgctaactttcttaaagcacttgctcgtttgtttagccgtgctagtaatatcactcttttcttcgtccaaaaaaaaaaaaaaaagccccta

SEQ ID NO: 4589 - DNA, 1451 bp, Triticum aestivum
  Clone ID: PAT_TA_4589
ccgacgccctcttgttcggcacccccacctgcacgtcgtcctcggctaccctacccgcacgcagactgcgcctcgcccccacgtcgcccgccgtctgacctgcctacgtgggcgaacgatgggccgcggagaactactggagggtacgccgacgcgcggcagcagcaggccatgggtggcggctgcggcggcggcggcggggatggcccctgcagctacctttgcgcggaccgcgacggccgcggggagcatgcagcacccaaccgcccccagcaccaggaagcagccaggccgtgatgtagcaacggcctgccagcagacggcaatcgtcatgcaggccaacagatgccccgctcttttaatggggtccgtgcagagggacttttccacagagactcaagaccaactggtggagatcctcatgtcctgtgattcgttgagtttgatatccctgcccgacaatgaatcaaattgggcaccttgcaaggttatcatttggacggacacgcatcgtgaggcaagccatatataaggctgcaattttgctggctgccatggtccgggatgtcagctggcgggcctcgtggtaggcgttaagtcgtgcgggtcaggcggttgacgaacctaccgtttatacgagcgatcgaacctgcttggtgtaacgctttgcgccgaattctccgccggtggctcgtagggttcgtcagcccttgtcgtgaaagcgtgaaaaggacgatgcaataatctcgctgttcagtatccattagattctcggggtcgcatgtgtgtctgctttagtatttatggtctactgtattttgttatctcgcggcgtgacccagacaatatcagtcttttatcatgtgtaacgctaactttcttaaagcacttgctcgtttgtttagccgtgctagtaatatcaactcttttcttcgtctaaaaaaaaaaaaaaaaaagctttcctggtccgaggtcagctggtgggcctcgtggtaggcgttaagtcgtgcggctctgctccgtggcgtccctcccgatggctcggtgcgatcgatccgccctggtgtatcgcttgccgcggaatgctccgccgctggcatcgtgccgttcagtctccctgatgtcgtgaaagcgtcatgtgtgtctgctttagtattcatggtccactgtattttgttatctcgcggcgtcacccgtgtctgcttcagtatttatggacgactgtatttagttatctcgcggcgtgacccagacaataccgctcttctagtatatatcaactcttttcttcgtctaaaaaaaaaaaaaaaaaaaaaaaagatagtaatatcaactcttctcttcgtcttcccatctgtccatatacctaggttaatatgtacatgtcctttatagtccctctgtttctaaatacaagtcttttttagagatttcagtaccaaaaaaaaaaa

SEQ ID NO: 4590 - DNA, 581 bp, Triticum aestivum
  Clone ID: PAT_TA_4590
gtaaaggcagagtgaactgaagatgggtctgagctcaagcctagcgccggtggcatctgcactgctcttcttgtgctgcttcaccgcccggaatgctgccgctgccagtggtgatggcggcggtggtctgaggctgaacttctactccgagagctgcccgagggcggagcagatcgtgaaggagcaggtgaggaggctgtacgaggagcacggcaacacggccgtgtcgtggctccgggccctcttccacgactgcaccgtcaagtcctgcgacgcgtcgctgctcctggagaccgacgccgccaccggcctcgtctccgagcaggcctccccgaggagcttcggcatgcgcaacttcaagtacgtgggcgccatcaagtccgctctggagcgggagtgcccgggcaccgtctcctgcgcggacctcctcgcgctggcggcccgggacggcgcggccatgctgggcgggccaacggcgatcccgatgcggacggggcggcgcgacgccacggagagccagtacggcgaggtagagcggtacgtcccgaaccacacacacggtgtcggcggtgctgtcccgg

SEQ ID NO: 4591 - DNA, 1319 bp, Triticum aestivum
  Clone ID: PAT_TA_4591
taggtgtaaaggccagtgaactgaaggagatgggtctgaggcctagcccagttgccatggcatctgctctgcttctgctgcgtcgctgcactgactgcaaccgtgccgccggcgcggcgagtggttggggcgacgctggtctgctactgcgatagcactccgagagcggcgcagaggcgtgggggagcatgagggggcgcggtaggagggagtacggggagacgggcgagacggcgctgtcgtggctctgggaccactgccccgtctgcaccggcaagtcgtgggtcgcgtcggtgcgcctggacaccgacgcgggcatcggcctcgtatccagcgtcccccaccgagcgtcggcttggcaagcgccaatgtaaggtggggcgcgatcaaatctgggcctgggacgcgaggttcccgggggacgttttcgtgcgcggacgtgctcgcgctggccgccagggacggcgcggccatgctgggcgggccggcggcgatcccgatgcggacggggcggcgggacgccacggagagccggtacggcgaggtggagcggtacgtcccgaaccacaacgacacggtgtcggcggtgctgtcccggttcgcggccatggggctggacgcggaggccgttgtggcgctgctgggcgcgcactcggtgggccgcgtccactgcaacaacctggtggcgcggctgtacccggcggtggacggcggcatcgagccggcgtacggcgcgtacctgcggggccggtgcccgacggcggacgcgagggaggacacccgcgacgtggcgtacgcgcgcaacgaccgcgccacgcccatggtgctcgacaacatgtaccacaagaacctgctcaagggcagggggctgctgctcgtggaccagcggctcgcgtccgacccgcgcaccggcgccgttcgtgaggaggatggcggctgacaacgggtactttggtgagacgttcgcggcggcgctggtgaggatgtcggagaacgggccgctcaccggcgggcagggggaggtcaggaaggactgcaggttcgtcaacgctaagtaagatcgagctagtgatcagtggctccctcgtggcaagacgtgatggtgtgtgtgtgtatgtgctcgtggcgtggggcactaaataattcagaggtgatgaagggaccatgtatcatgtgcgtttgcatgcttactgtatgagcatgcatgctgcctgcccgtacctacctgatggatatgagtatagttttcaacgtctggaacactgaaatctcgaaatggaattctgccgacctaaacaaaaaaaaaaaaaaaaaaactc

SEQ ID NO: 4592 - DNA, 620 bp, Triticum aestivum
  unsure (1)..(620): unsure at all n locations
  Clone ID: PAT_TA_4592
ccgcgcgggcgagtttgaaacctaccctctcccaacggtccggcttcggagcggtacgcatggcggcggcggcggcgagagacctggcggcgctcgacgcggagactctggcgctgctgggcggagggccggatatggcgccggtggccgtgtgcggcgagtgggagaccttcaaggagaacgtgcggccgctgaaacgcgggcggaacgtcggcctcctcaaccaagccctcaaggcgcacaccgaccccgcccagcgtgccgccctcctcgcgcgaacgcaggaggatgatcgaagcaaccgaagagtaccaaggggaggatccgcgtccagccatgggtagagtgcatcaaatgggttcaggagtcgttcccggccggcggggagttctcagggctggtcgtgatctacgagcagtgtgtgcgtgccttttggcacgatgagcggtacaaggacgatctccggtacctcaaagtgtggttagaatatgctgggaactgttcggacgctgaggtgatattcgaatgccggcgggatctctagtctggggagggccatgctgttttctacattcgctatgcatcgctaatggagtcgaagaacaagcttaagnnngctn

SEQ ID NO: 4593 - DNA, 423 bp, Triticum aestivum
  unsure (1)..(423): unsure at all n locations
  Clone ID: PAT_TA_4593
ggattcaaagctcaccatatcagcacggtaacttgcaaagttttccaccaatcatgaggacccgctgcatgttcctcctagtccttgctgtcactctcgtggttctgtccccagatgtggccgtgaaagtgacggcgggtaattgcagaccaataatcgacaagggtgactgtaacttggatgtatgcaaatcgcgttgcaacgaatggaacgggcacagtgtcagtcatgttgctacttgtgttcccgacggatgccaatgttatgtttgtttctaatcccccacacagggttaaaacatgatgtgactntgtcccaactaaatgtattgggagtacctagtttcgactggccgtcactgcttatctaaaacaaaacgacgatcataagacttagctgtatatcacaaatttgttactaata

SEQ ID NO: 4594 - DNA, 407 bp, Triticum aestivum
  Clone ID: PAT_TA_4594
gtcgtcacgcagaaggactcaaggttcttgtgctccgatcccttcatcgccttcgcgcacgtctcctccacggaggcaaacgccccgtgggagccaacgagaaggatgaggagggaggagaagaggagcctggctgccatggtgtgcgctcttgcttggttaggattgtgttgtggctggcttcggctcgtgcactggcaaaccttgaggaatttcatgcctttatgtagtcctccttccatccaaaattacttgtccagaaatgaatgaaaatggatgtatataaaactgaaatatgtctgaatacattcattctgtgacaagtgatttcggacggagggagtgcatctcaggaaatgaatgcgagaccaaatccgcttaaaaaaaaaaaaaaaaaaaaaaaaaaa

SEQ ID NO: 4595 - DNA, 1313 bp, Triticum aestivum
  Clone ID: PAT_TA_4595
cccacgcgtccggtcggttgcatctcctcctcggcccgatccagctccgccgaccgactgctgttgttctctctgtcttctcggtgcgtgcgtgggtgatccaagggagtgaagggggagcggggagtggagagttaggggggcggatggatccgtcgggcgcgttcgcgcggagctcgagcaatgtgtcgctggcgtcactggtgaggagcgggagcggcggcagcgggagcagccgcgggaggggcggcgccggcggcagccggaggatggtgcgccgggtgctccgcggcgtcatcaccttcatcttcgccatcgccggcctgttcctgggagccgtcaccggcgggctgatcggcctggccacggagagcggcctcttccgcggcaccggcatcggcgccatcaccggcgcgctcgtgtccatcgaggtcgtcgactcctccatccgcctctggcgctcccgccggtccgggatctggagcatcttgtacgtgcttaatgtgatctacagcctcctgacgggccggctcgtccgtgagaaggttgatccggcagtgcagcgggtggtccgcagccagatgaatgcagtggactcatcgcagttcagggaggcccctgacctcttcgagatcgagggaaccaacggcatgccgagggcgtccatcgagaaactgcccgagggcactatcaccgaggagtataaccggaatgccgtcggtgacctctccgggtgctcagtatgcctgcaggatttccagattggggagaaggtgcggagcttgcccgattgcctgcacgtgttccacgtgccgtgcatcgacggctggctgatcaagcacggatcatgcccactctgcaggaggaagctctagatcatcatcatcatcatcatcatcatccacgaccgacgacgacgaccgacgaggaacttctgaacttgtgtctgctgctattaggaaggaggtcttgctctgcttgctgctttgcatgctgtgtgtgcgcgcgctatgcctgtgttgctgttgctgctgttaggaggctgacatatctatagaacgaaccctaaatttatagagctcttttttttgccttcttttccttttgcgttttgatttttgatctctctcttctcccggtggatgtaatatagtagtatgtactaccaccggaacaaaaaaagcactggaccggcttgcgcttcgttgttgttctccggactgatgaactcctcatatcatcatgtaatgttatatatatcacactgctattgtcccttaaaaaaaaaaaaaaaaaaaaaaaaaaaaaaaaaa

SEQ ID NO: 4596 - DNA, 821 bp, Triticum aestivum
  unsure (1)..(821): unsure at all n locations
  Clone ID: PAT_TA_4596
tttttttttttttttttttaacagtaaatcactctccttttattcctttgttttcttctctcaacctaaaatgtttctcagaatgatatgtgaatatcaagagctaaaaattctataatcaaataatttaagaatgcatccattatgcattcgacattaaagttatcgtgtgtgacagacaccgggaacaaagacaatgatggcttcccaccaaatcccattttttattttagaatatggttgtcctaccaatgtgtacttgcaaggtttcttcctcctcactctccctcattccctctctcgaacactcttcctccctctcccggtctcccccctctctctggatcactctcggtctccatgttgtcttttcaacaaggctcgaacggttcagtagctgccttgtgagctggtcatcattgttgctgattgcacttgtgccgatgatgaggaaaaccaccaagggttgttgattctcttgatctcctccccgaggtcactgtggtccctgattggagtgttgttcattaacgtcacaactgcgccaagtccttcaagatgcaagctagggcctgagcatgatgacccgggagggggaaaggtatagtaagattggctgatcagccaagggcgcataacagggttcacagcaattgttaggagggccagaggcaggcaaggactcatcgtctggctccagcgagccgcacagaacaaggttggcggcatgatcagctcgcttgtttgtcttgccgcgtccagatctctcctccctcctattctccttcgcactgaactcccctcgtgccgaattncctgca

SEQ ID NO: 4597 - DNA, 1348 bp, Triticum aestivum
  Clone ID: PAT_TA_4597
tgaatccatggccaattcagataatttgctactggagaactgtatgccaagtgctcaaacttttgacagctcttcatcaacccggaattctgcagtcacccttgcagaggtcccaggcaactcgggcatgccatatatgcccacgagctccccacgcgtccgcccacgcgtccggtcaagcccccctgagatgcagcgtccagttctggacaccaactcatcgacacaacttcccaacatgagtgctgtgccttcggtgccaaaggctatgacgccaggtttaagtgatatcagtattccaggattcccagatctgcatgatctcataacggaggatgcaattaatattcctgtagagaacttcacaatgcctggtcctgagtgtatattccccctacctgatgaaggcagtgatgactctgttcccatggaccccatcgacactgatgagaccgatgacacccagaagcttccgggaataattgattccttctgggagcagttcctttgtgccagccctctctccatcgacaacgacgaggtggattcaggtctgctggacacaagggaagcgcaagaggagaatggatggaccaggaccgagaacttggcaaatctcactgaacaaatggggttgctgtcatccaaccatagagggtgaggtacctactcacagcgaccctctctcaaggcgccctggggtccaacctggtaataaaactagctcctatagtttatccttacgcaatcatactgaactgtgaaatgcctgtcgacagctggtgtgggaggactccgatctttttgtatctataagttttctggcaggcgtaaaaactaacgaccgtgcgttgtgtttctgctgtgctcgtctggttgcgactaacaccgactgaacccaaacatgtaaaagactaccagctcctcgcgctatccaggctcgctggcctctaaggaatccagaaaaatggtggtgtttggcacttgtgttgtctgtattgctgatttgtgggttaatcttttcgctgctgctggggccaaggcttgttctaggtgggggagctccctcgggtctgggcctcgtctcgtcgtggctcgcccggaaggagtccctcccgagagcggtatcttcctctctgcaaggagcccagctttcctcggaccacggcgaagcccgatgtgtgcacgatgtttaatttgctttcggtgatgttatgtttggtcgtacaacaccgaaacttttactagtcaagcagtattccatttgtacctgactaaacttagtcttaaactggacaagtttaatgactgaaagcctgtgtgcattcggacctgttgtgtttttaat

SEQ ID NO: 4598 - DNA, 897 bp, Triticum aestivum
  unsure (1)..(897): unsure at all n locations
  Clone ID: PAT_TA_4598
tcgaccccccgtcccgtcgtcgccctcgcactctgatcgggatcctccgctggggacggcgctctgctaccctgcccctgtgatgcgcgcccaaggcccgcccctcccgccgccgtgccctcgcgcggcgtgctccccttcaggcacttctgcccgccgtgaggcactgcaaggggggctggtggaggggcgggctgtgtgctcggttttcgtgaccatgctgatgagggtggagctgccattgaggcacatttggcctccgaggtatcaaaccctccaacctccattttctttaggatggtcccgagcccatctcaccttggtcttctctcctccatggattcgattgtgtgcatggatgaggaaagagtcattgcaagaggtgttggtggagacggaggttgagtgtgggatcgacatacacggcgtcatctataactgcctctatggcttcctcggcctccatgtcagcctccctgcttcactaacgcaaaagggtttgcagcgttgtgtggtgatggccctgcccctggccaatatcgatgctcataggagtgatctttggctatggaggcgtagcttcggatggtctacaacagtgtctggtttctctgctggctctaattatgtcacgtcatgttggttggcatacatttatttctgtatttggcacttctggttggctgatgttgttatgttgtccacgggaacacagtacttacgttggtgtctatgatagacttttgttgttctactgcctgcaccctgttcgtttagaagatgaagggggnatggatgcaaacttatgtatgcaatgcaggatgatcatggtagcttatgtaattgtcgctggtcttctgtatgaatgggntgnttngntatttttgtgttattttc

SEQ ID NO: 4599 - DNA, 1705 bp, Triticum aestivum
  Clone ID: PAT_TA_4599
tcatttcccacgcgtccgcccgtctcctgctctgctctcctttgaagagagaaacaacaacaaagattaggagctgctgattttgcctctgttcttcgtcgcccgcctctcagcccgatttggcttcgccggtgctccgattttgaaggatccagagagagatatggctcgttttcaggaatcaggaccggatctgctgaattccggcagcgatacgcggatgatggccgaagcccgcctccccaaggcgcgaaagccgtacatgataaccaagcagcgggagaaatggaccgaggaggagcacaagctcttcctggaagccatgcagctccatggccgcgcctggcgccgaattcaagagcacataggcaccaagacggccgtgcagatcaggagccacgcacaaaaattcttctccaaggtcacccgggactcgtccggggacagcggcggcagcagctccggcgacgggccgccgatccagatcccgccgccgcggcccaagaggaagtcggtgcacccgtacccgtgcaacctgaggagcgcgcagccggggaagcacgcccatgccgcgctcctgcgggtcgacaagcctcagctgtccatgtgtgagcaggggaatggctcgccgacatccgtggtgaccacctcgcagataggcttgggctccgagagcttcgacagcgacacctcgaccatcgacgttgaagagcgatgccccacgccgagcacggggaccgccgaggtcgctgtgcaagcgccaccaaccaatgatgctaagaaatccaagggcagtagtagcacttccgaagaagttggtttgtgacaacgcgtccgatgctccggtcctgaagctgtttgggaagacagttgttgtgaatgaatcgcgcatcagctgccagccctggtacctgcgacctgcaaactgccgcagatgtggaactggatacttcgtccgagacactcaccagtgcaccagaagcaaacacatggagcccatggctggcaaactcacagcagttcatgtactatgtccctcagggggcagttttcttcggctacaacaatggaagtgtgccgtaccccatgtcatcgagccccaaggcagatcaacagcaccagcaccaggcttctgaagccgccgccgagcttaggcggagggaagcgtcgtcgaacacggcctccagcagcgtggctgaaacaacagcccggaattctgcagaatcatgcactggagcggtcggcgacgacaacgaaatggtgcatgctgcaggtttgagagagcgtgtgagcccggccttcgtccagcagcgaggtttcatgccgtacaagaggtgcgcggctgagaccaaggcgatgcagccccaggctcccagggaggaggcggatagagagatgacgaggctctgcttgtaactctggtaggcttgaggtacagagtgttcattgggcgtctgtgatctcgccccattggtggaggttcagaggtcgacgttgacctatataattttggtgtagttgtagtaggatcgatcgccctgatgtaaattaattattgcacagctctcatcaatggcatggcaggagaatgccgcaaggccttcttagttgtactatgttgttcttgaccaatgaacttagcgccgatgccctacttgcacaatgtttaagcatggccaaatgaccgaaacttcattaaaaaaaa

SEQ ID NO: 4600 - DNA, 933 bp, Triticum aestivum
  Clone ID: PAT_TA_4600
atcacgttactcactgtgtatcaggcgtggaaggcaaagcagttttcagggccatggtgcttcgagaattttctccagataacatcactaaggagggcacaggatgtgaggaagcagctcctggagatcatggacaggtatcggcttgacgttgtctctgccggcaacgatctcaccaaggtaaggagagccatcgccgcaggcttcttcttcaactctgccaagaaggatccccagggaggatacaggacacttgccgatcatcagcaggtgtatatccacccaagcagcgccctctttcatcagcagccagagtgggtgatttacaatgagattgtcatgaccacaaaagagtacatgagggaggtgacagccatcaacccagcgtggctcgtcgagctggcaccgaggttctacagatccatggattcgacaaagatgagcaagcggaagcgccaggagaggattgagcctctgtacgacagatacaacgagcccaactcgtggcgcctcagcaagcgccgtgggtgatctttgtcggcgaagtaatttactgcagaggagagctgctacgtgttggcagcattatactccgtggtacatacaccaaagtgatgacaaaatacttgaacgctacctgaccactaagatcagattgctgaagcgctacttcctgattgctgctcagtacaacatattccaagtttctgtatactgctgattgccaagattatcgagagagtgaccacaacggccaagtcatgatgcataacacacaacaaaaagtggggaaaccggataaggggagtggggacatcttcctggaactcccgtcttgcgcttatattattaacattgacgacctgtaactatgttgctatacagtgatgatatttatatcaagactttgccagggaaagactgaagcagaag

SEQ ID NO: 4601 - DNA, 565 bp, Triticum aestivum
  unsure (1)..(565): unsure at all n locations
  Clone ID: PAT_TA_4601
gccaggataacgagctttgctcattttggcctgaaagttttgcctaagctcctggctctttctcccgcttcattggggaaattcagaaaggtctcaccagcgatgggaactgaaactgtgttgagaaaactgccggagctgctgcaggatgtattgagaaaggtctcaccacccatggaaactgaaactgtggtgagaaatttgccggagctgccgcaggatgtgttgatggacatattttcactcctgggagatacccgacctcatgcgtgcggcctctgtccgctcctcctgggcgctccgcgtttaccagcctctgcagccagcttaagctgtacaaacggcctcaaacgccttgcctcctcctacacctcctgaatctgctggtgagaatgtcgcttgtctctccagccccgcagagaagagggcctacaatttaacctcccggttcaaccanccgcagcaaggtnccttatggggcatcgcagggttggtattacggcggatgaaatctgagctacacttacatcggtcacgggcaaaaatgcctcccgtcgtggcacaa

SEQ ID NO: 4602 - DNA, 848 bp, Triticum aestivum
  unsure (1)..(848): unsure at all n locations
  Clone ID: PAT_TA_4602
gtaaatagtgccttcagaggtttgtacancaaacagactgagccttcggtatgcnctggggtatgantaagttcaaaatcagttccaatgttccaggggccattcccagtaagtttccactcgacatcagcagtgatatcctccacatctcctgaatgaatgattctctcgcactttagccgctcggcccatttccgatgatccgccacatcatcaatgtgagtcagaaacatgtaacgtgctccgccgagcttctcaagctggttcgctagtttcggcgtataccttgggctgtcaatcattatgttcccttccgggtgaactataaggtaagatgttgctccatatgagttctcagaatggtaaccacagaggtaaactccgggaagatcgtcgtcgatggggagagggaatgtgttctgcacttggagaatgtcttttgtaggcttgtcagtgtggatagagcctgtagggcaagagagcaaggcctgcagtgccttggttctgatttccccggaggtgggttgcgccgccacggcggactggtcatcgactctgttgaacacctccggagccatccacctgcaggtggcgcagtcgatgcaccggtgatcgacgaagaactcgccggacacgttctgcgggcgccgcctgctgtcgagcgccggaggaggggacacagtggcgcgtaccatagaggtggcccgtcggcgcggacgcaggtgagccggcggggcggcgagggatgcggcggcgcgaaggctgagcgccatggcgattgacgggtgaagttttcggtctctagtactacacctgtgagatgagccgaggcgagctgagctgagctt

SEQ ID NO: 4603 - DNA, 1492 bp, Triticum aestivum
  Clone ID: PAT_TA_4603
ggggagggatgtcttgtactccctgcgttccgtggtataggcctcctttgacattccactgtacactacctgccgtcccgaacgcctccctttatattctttattttctcttcttactccctgatggtgctatctgcggaaattatatatagtttcttttgcgggatgatccaataatatttctaatttgatataaggatacccatgccttctacatcttaaagagagatatataaagtaactacaatacatggtgtttggacaaaaagtaaaagcatcgatcatgatttcgttggacacagggactgcatatcaacctcgtccctttattctgggaatccttatatgtgaagtatgtgatcacaagatgctccttagtttttgtagttagctaggagagactcaatagctgcatttttggcctatacatcttcataccggattcgatagccatgcccaggtaaataccactcaaaatctaggatcccagtaacttcctcatactatccagttgcaaatctcactgattgcttactgtacatccgaaagagattcagttcgtctgaatcttctgattttgcgacatggtcgccagtgaatagcgcctttagtggtttgtacaacaagcagaccgagccttcggtatggcctggagtatggataagttcaaaatcattcccaatgttccagggaccacttccagtaagtttccactcgacatcagcagtaatgtccactacatctcctgaatggatgattctctcgcatttcaaccgctcggcccacttccgatgatccgctacatcatcaatgtgggtcaaaaacatgtagcgcgctccaccgagcttctcaatcttgtccaccagtttcggcgtataccttggactgtcaaccattatgtttccttctgggtgaactatgagataagatgttgctccatatgaggactcggaatggtaaccgcaaaggtaaacaccaggaagatcgtcgtcgatggggagcgggaacgtgttctgcacttggagaatgtccttcgcgggcttgtcggtgtggatcgaggctgttgggcaagagagcaaagcctgcagtgccttggtcctctcctcctcagagctgggctgcgccgccacggcggacatgccgtccaccctcttgaacacctccggcgccatccaccggcaggtggcgcagtcgatgcaccggtgatcgacgaagaactcgccggagacgttctgctctcgccgccggttccggttgccgagcgccgcgggggacgccgtggcgcggaccaccgaggcggcgcgtcggccggggcgtgggcccgacggcggagaggcgagggacgcggcggcccggaggctgagcgccatggcggtgagccggtgactcgactgaaaggagatagctagctagcgagtgacgggtgagctcttccgtctctacactgcagccacgtactacctgtgaagctgaactgagctcgtgccgaatc

SEQ ID NO: 4604 - DNA, 1088 bp, Triticum aestivum
  Clone ID: PAT_TA_4604
tgcagcctttatttccaactgcggtgcacgcaactttcgtttgcaagcccttgagatgcttgaaagcttagatgtaaaaattgattcttatggtagctgtcatcgtaatcgtgatggcaaagtggacaaagtggagactctaaagcgctacaaattcagcttggcttttgagaattctggtgaggaagattatgttacagaaaagttttttcagtcactggtaacgggggccattccagttgtcgttggcgcaccaaatattcaagagttttctccaggagaaggtgcaatattacacattaaggagcttgatgatgtcatttcagttgctaagacaatgaaacatattgcatcgaatcctgatgcttttaatcaatctttgaggtggaagtacgatggtccatctgattctttcaaggcacttattgacatggcagcggttcattcatcctgtcgcctttgcatacatatcgctacgaaagattcacgaaaaagaagaaagaacgccaaaatttatgaatcgctcatgtagttgctccagcaaaagaggaacagtataccacttatttgtcagagagagagggcggtttaagacagagagcatttatctaagatcagatcagttaactttaggagctttggagtctgccgtgcatggtaaatttagatccctcaagcatgttcctgtatggaaggatgaaaggccatcaagtattcgaggcggggatgagttgaaggtgtacaaaatttacccaataggtcttacagaaagacaagcgttatataaatttcaattcagtgatgatgctgaagttgctagatatattaagggccatccatgtgcaaagcttgaggtgatttttgtataactacaatattgccatcttctctaccttttgcaactgcaaactagttctgtgtattgagtttctgctgtactgtaatagattcccgtttatgtaacgtcaaccttggtacaagtcacaactttgtaggctttgtgatactgggatgtaaatttctattgaaggcaagtacatcttttgcgggaaacaattaacatggattgcgtaaaaaaaaaaaaaaaa

SEQ ID NO: 4605 - DNA, 505 bp, Triticum aestivum
  unsure (1)..(505): unsure at all n locations
  Clone ID: PAT_TA_4605
aggacgccaggccagataattgtctacccagcgagcatgaggatgaggaccaccagcctcctcctctgccaccggcgtcgttgctgccgtcgtctgcgccactgtcaaccccacacctgggtggaaatcctgcgaggacggccccaagatcgacgagctcgcaaagtgggcgctggcggagatgaagcaaggcctccagttgagcagcgtgctccgttgcgaggagcaaggcctaggcgctcaaggaatcatctatcgtatcctgctgaacgcgctcgaccgcaccggcgggacgggccactacacgacggacgtgtacgatgaggcggcgaccaaagtgcgcaagctcctctacttcggcactgccccgtgataggtagcggccgggctgggaggactatctagnggtgatgtgattaatcaagccagtgtttcccatgtgggtgtagtatcaagcatgtttgtcttttgtttcgcaccactaataagatgttgcaagaaaagc

SEQ ID NO: 4606 - DNA, 2795 bp, Triticum aestivum
  unsure (1)..(2795): unsure at all n locations
  Clone ID: PAT_TA_4606
ccacgcgtccgnnnacacatggtctagtcgaggtcccacagctgatggggatcttggtgtctccattnnngcacctggtggagcagtggcccctgtgccaacatggacccttcagtctcgcatgcttatgaatggtacttccatgtcatctccttctgcctgtggtggggttgctctccttgttagtgccatgaaggctgaaggcattccagtaagcccttatactgtgaggaaggcaatcgagaatacagcttcatctataagtgatgcgcctgaggagaaactgacaacaggacatgggcttttgcaagttgatagggcttatgaatatgcgcggcaagctaagaagttgccacttgtttcttacagaatctcaatcagtcaagtagggaagtcaattccaaaactaagaggaatatatctacgtgggagtaattcatgtcaacaaacgagtgagtggactgttcaacttaacccaaaatttcacgacgatgcgagtaatttggagcaattggttccatttgaggagtgcctgcagctgcattccactgatagctctgttattaatattcctgagtatatattgttgacaaacaatgggcgcagtttcaacattgtcctccaatcctgtttaatatcagtagntggccttcactactnatgaagtttatggcatggattgcagagcaccatggcgtggacccattttccgagtgccaatcacaataattaagcctattgctctatcaggagagccgccagtattgtcactttccaaactgtacttcaagtcaggtcatattgaaaggaggttcataaatgtgccaattggggcctcatgggcggaagttaccatgcgcacatcagcctttgatactcctagaaggttctttttggatactgttcagatgtgtccactgaagcgacctatcaaatgggagtctgttgttactttctcgtcaccatctatcaagaatttcagttttcctgttgaaggtggcttaactttggaattgtctatagcccagttctggtctagtggaaatgctagccatgaacctacctgtgttgatttcgagattgtgtttcatggaattttcattgatcagaaagtaattgcccttgatggtagtgagtcacctatgcgtattgttgctagatcattattagcatcagaaaggcttgttcctgttgccactctgaacaagatcaagataccttatcgaccagtggattctaacttttgtccgcttcccaccagccgtgatagattaccctctggcaagcaaattattgcactgactttgacttacaaattcaaactggaggacggtgctgaagtaaagccccatctgcccctacttaacaacagaatatacgataataagtttgagtctcagttctatagaatttcagattcaaataagtgtgtttactcttctggtgatgtctatcctagttatgtcaaacttccaaaaggtgaatacacactgcaattgtacataaggcatgaaaatgtgcaaatcttggagaagctgaagcaattggttctatttattgagagaaaactagagaagaaggattgcattcaattaagtttctactctgaacctgatggtcctatgactggaaatgccgccttcaagtcctctgttttagttcccggagaacctgaagcattctatgtgggtccaccatctagagaaaaacttccgaagggtgctccacctgggtctgttttagttggctccataacctatggtatagtaagctcattcaacaagaaagatgaacagcatgctccagcatcttatagcattttgtgtatcattccaccatcaaaggttgatgatactaaagaaaagggggtttcagttgaaacagagaagagtatttctgagaggttaaatgatgaggttcgagacaccaagataaagttcctttcgggccttaaacaagacaatgaggacaacaagtctgcctggaccgagcttgtcgcttctcttaagtctgagtatccaaaatatacacctttgcttgccaaaattttggaatgtgtacatcaggaatcaacctctgatgataaaattagccatcacaaagaggttattgttgcagctgatgaggtcgtggacagtattgacaaagagcaactagcaaaacttttggttttaaaacccgatcctgaggatgaagaatcacagaaaactaagaaaaaaatggaagaaacacgagaccagctagcagatgcactataccaaaaaggtcttgcactggcagagattgagtcgttaaagcctgatgagtcaaccgaggcatctgctaaagatgtttttgaggagaattacaaagaattaattaaatgggttgatgccaaatctacaaaatacggcactctgaccgttctacgtgagaggcgctgtggaagatgtggcacggcactcaaggttctaaaccgacatgattcaagaggactcttgagcaaccaaagaagaagttatatgatctgaagatccagctgattgaggagataggatgggcacatgtatcggcttatgaaaagcagtggatgcatgtccgctttcccccatctctgcctcccttttaattgggtatgcttaccatttagtctggcatcggtaggttcagtactttgtgtcattgttggatgcaacatttgtcatttcagggatcttccatttgacatttccattcttgaaatggtaataaggcatgcaagcgcggccacattggattatctgttcgtccaaaaaaaaaaaaaaaaaactcgagac

SEQ ID NO: 4607 - DNA, 542 bp, Triticum aestivum
  Clone ID: PAT_TA_4607
tacgccggcgccgccgcgttcctcctcccctacgccgcgtcactcggcctccgcaccgccacgctccacttcagcccctgcaagtcaaagcccctcctcctgctcacctgtgccgggcacggacccctcgctcccctccatcctccttcaactcccacctcgactccgtgcccgcggagcccgagcactggatccacccgccctacgccgcgcaccgcgaccccgccaccggccgcgtctacgcccgcggcgcgcaggacgacaagtgcctccccgtccagtacctcgaggccatccgcggcctccaggccgccggcttcgcgcccgcccgcaccgtccacgtctcgctcgtccccgacgaggagatcggcggcgaggacggccacgagaagttcgtccagtcggaggagttccgcgccctcaatgtcgggttcatgctcgacgaggggcaggcgtcgctcacggatgtgtacagggtgttctacgcggataggctggtctggaagctgatcgtgaaggccacgggggctcccggacattgg

SEQ ID NO: 4608 - DNA, 581 bp, Triticum aestivum
  Clone ID: PAT_TA_4608
gcacgagggcaacacatagccatagtgcgactgcctacgagtacgtaggtagacaaggcgagaatgaacaacacactaccagtaacggcgcccaccgcgcacgcgcccatgccgtcgccggcgccgaagcttggaggtgcaaacatcgccagccggtggcgcgagctccagggctcggactcgtgggttgggctcctggacccgctggactacgacctccgacaatccatcatatcttacggcgagctcgcatcggccgcccacgacgtgttcaaccttgagaagcggtcacctcacgccggcttctgcttgtacagccgcgaccaccttctcgccgcctccaccgtgacccaccctgagtactacaaggtcaccaagttcctctacgcgacctgcgggggatcaacggcatcgaggttggccacatccgtgccaacggtgaccaacgcgctgttcgtgcaaccgctgggaaaggccgaggggtccccctcgtccgacgggttcgggcgcggcgcggcggcgacgaacgagggagttacagcactggggaggcgtgacatcgtcgtggtgtggcgcggcac

SEQ ID NO: 4609 - DNA, 1854 bp, Triticum aestivum
  Clone ID: PAT_TA_4609
gtttctcctgctaagttggcggtggccgtgcgtgctcttgagccagcgggggcatttgcccgcccaccacgtgctgcggatgctgtctgccacggtggtgcgtctggctcccctcttcgtggagatgttcccagtgccgcgccctcttccggccctgcttccggtcggggtgtgggcggtggctccctctcgaccctctgcgggccggttggcgggaatcccgagtcgccccgctcctctgcgccgtgctgggcttccccccagagcgacgcggggtcctcctcctggaatgcctccttcgtctgtgaagcaacaacatcgaaggcctcttcatttcgatgacgatactacacccactgaaccacaaaaacctaaggtcccagcattggagaaacatttggttggccagcttagcaaagaggaacaaaatgcactcgaagcaaagttcaaggaagcttcagatgccgataaaaaggtgcaagagttggaaaaggaaatactggattccagggagaagactgattactatcgcaccaagatgcaggagttgattctctacaagagtaggtgtgataacaggtttaatgaagtctcagaaagtatgtctgctgataagcgcgaggttcaatccctttcggccaaatatgatgagagatgcaagaaggttggagatgtggcatcaaagctatcaatggatgaggctactttccgtgagatccaggcgaagaaattggaaatttataattctatagttaagctgcagaaaggggatggggatgatgagaagcttcaggagcgggctaatcagatacaatctgaacttgaggagctcgtgaaatctttaaatgaacagtgcaagagatatggattgagagctaagccaactactttagtggagcttccttttggttggcaacctggaatacaagagacagctgctgtgtgggatgaagaatgggatagatttgcagaagatgggttctctataatcaaggaactcacagtcgaagtggagcctcctgctgtaaaagaaagtcatcctgctgttgaagatggcaaagtttctagcaacggggtatcaacagctacaacaacagagaaagaagataacaagagtgataaaactgctgctgctgagcaggccgtagaacctgaagcaactggttcgaacggcaaagcagaatcagcaaaaaatcctcctgttagtcccgtaaagaaggcaacggatgggcatactaatgaacctggataaaaagccatccggggacaaatgctgactccaccacgtgctgctgacagtatgagcaacgatggagcatctgatcccctgttccgcgggagataaagccaataatagacattcttggggcccatcttttgatcatggtgatgataatgactccctatgggacttcggtgataaggatggtgagaatgtggtgattcagatctattctttgggccaggaggtcttccccccataaggacagggggttctacatctgctagtgcttttggcaaggagcagaaaccgatgtttgattctgtcccaggcactccaatggagaagccattctttgattctgtcccaggcactccactacagaaatccgtctttgattattccgtcccaagtacgccgatgcagaattcatccttcgactactctgttccaagtacaccgatgcagaagtcgctcttcgactcttctgttccaagtacaccgatgcaaagatcactctttgattcttctgtgcccagcacgccgatgcagaaatcactgtttgattcttctgttccaagcacaccaatggggaattcattctacgactctttcccgagcaccccaatgca

SEQ ID NO: 4610 - DNA, 1225 bp, Triticum aestivum
  Clone ID: PAT_TA_4610
cccacgcgtccggcgccctggagcggcacctcccgcctagcctcctcgaggccgaccgtgatgtcaagctacacttcatgcgggacatactcgcgcgctattggccccatggcgagcgaaacaaggttcataggcacaaagaatacaggcagaagatagtccacctctataagccacttcatcaagaattgtacagcatgcatccttcggctttcttcttaccaacatgtccttgaagcagtaagaaccaatacagaagaaagcattgcaagtataatgactgaaccaattgctggtgttttttcatttgctatgttacagcccaacttttgtgacatgctattggaggaggtagagaactttgaaaagtgggttcatgcaatgaaatttaagataatgaggccaaatacaatgaataagtatggtgctgtccttgatgattttggcctggaggctatgctgaatcagttcatggaggagttcatagctccaatttctaaagttttttaccctgaggttggtggaggaacattggactctcatcatgcttttgttgttgaatatgggaaagacagagatgttgaactaggtttccatgttgatgattctgaggtcacattaaatgtttgccttggcaagcaattctcaggtggtgaattatactttcgtggcatccgttgcgagaatcatgtgaactcagaaacacagcacgaggaaatgtatgattactctcatgttcctggacgagctgtacttcaccgtggccgtcatagacatggtgctagaccgacatcatcagggctcagaatgaatctgcttttgtggtgcagaagctccgtgttcagggagatgaagaaataccagatggatttttctagctggtgcggtgagtgccagcgtgaaaagagagagaggcagattcaatgcgtcaaagcgaccaagttgcatttcttaggggtgctggaggggcaatgatttaagtcatatttactgcatgtattttatgcaatcctgtattatattaaacatcctttgatcatttggaaacatctagtataattgttgtcaaatttccagctcgtatgtttgtcagtgtcattgcatcttatgtaaatctgaactttcctgctgcattgccacataagccatgggttttacttttatagtgtttcagttgtactggtgtataaagcatgagtaatgctagagttactgaacccccttc

SEQ ID NO: 4611 - DNA, 909 bp, Triticum aestivum
  Clone ID: PAT_TA_4611
agttattcatatcattccatccatccacttcacatcgtacctcgtacatgagatccatctacgtgtctacagcacaactcgtatttgtgtcatatatgcctcgaccaacgaacagcaaaataaattaaatgtcaacgacaaaaaggaaaaacctataatatatatgacggtttcttctaagcggccattctctgtatctccttccaggtgctgcgaaataacatcactatcctcctgtggttgcctgctacgtgtctacggcgaaggaccagtgttctcaaggctatatcactgcacatggacccatgggtctgtgttggcgaacttctgttgaacgtaccgagcatgggatcaggccgacccgtatccgcccgggtgcgccttctgccatttccaggccgttgcaaggctctcgcggaggtctgtgtgttgggctgtccagttcagctcgtcgcggatcttggccgggttgctgtatacttcggcgtaatccccgggtctccggtcgaggtagtcaaccttgatggtcgctccggtcgccttcttgcacgcttctacaaactccttcactgacctacctttccctgtgccgacattgtagattccaactttgttaggctcagctttaccaagagctttgacatgagcatcaacaagatctgtgacatcaatgtagtctcttacacaagttccatcagcggtagggtagtccgttcctcgaaccttcagccctggaatgattcccgatgctgcatcaaaacacgcaccagaaatccttccatgctcacgcagttcaggccttggagcttccccaaggcgtccctcagggtctgatccaatcacattgaagtatcttaagatcatcacagccatgttcgttttttagaattaaatatgtctcggacagga

SEQ ID NO: 4612 - DNA, 1848 bp, Triticum aestivum
  Clone ID: PAT_TA_4612
ctgctctttctccccggcttttgcccagggtgcgagtgagggactgggaatcaccaaaaccctaattttcaccccaattcgccccttccaaaccctaaccctaatacgctcgatgttgtaatcccgccgcgtttgccatggctctaggaggggcccgcggagcgacgaggacgagggccagcagggagggatggcgaacgggaatggcgtggctccgccgccgtcgcgcatggccggccggccgttgggggcggctgcgtactctgacaggcggctgcgcctcaatccgaacacggagcacaagccgcaggactacaccgacgtgcgcggcgaggtacgcggccagccgtgtacaggcgccctggagccggcacctccccgcctagcctcctccgacgtccggaccgaccgatgtgtaagctacagcttcactgccggacatactcgcgccgctattggccccatgggcgagccgaaacaatggtttataggcacaaagtatacaggcagtatgagagtcctcctctataagtcacttcatcaagacgttatacatgcatgcatcctccggctttctggttgccaacgtccctttaaggagtaagtcccgatacatattaacacacttcaactatctcgtttactgcaattccttttcctatttcgttagttttgttacaacctatgttaggcgcgagagtacttaaagaagtggggtgatctcaaaaaagttttgttaaaaagatctattagattaagaaagttccgtcccttgataggtattgtgctcctcttaatgatggtggccggataactatgctggatcagttaatggacgcagctcaatacctcccatgctctagaagttctggccctggggcttcgccgaggtcctttcgccgcttctgatgcttttgttgttgattatctgaaagtcataggtgtttaattaggtttccatgttaaattttccgcggtcaccttaattgtcttcctgtgcattctattttcatgccatgggttgtgagtatcatgtgatcccagtgacacggtcccagtaaatttatgaattaccccatgatcctagacgtgctgtatttcatggtgcccgtcctacacttcctgccagagcgcctcattcacggctcggaaggcatctaccttcgtggtgccgaagctcagtctgcatgtggaggaacagaaacccggtgggtctttcgagatggagcggtgaccaccatcgtgtttacagactggggcggtgacagcgcgccgtataaaacaagtaggcactgattcggtgcgtccaaggggccaagatttccgtcatttacggtggttggagttgaaatgattttagcaatgtttactcaatctttgttcgtcaggagacgattagtataatgttcgtcaaattatccggaaccatctggtaccagtacttgcatcttcccagtttcttggcttgacagcaccattgcaccgcaaaaaacaggagactgttttaacacaattatgcacaagacagtgatggcacctgccaccgcgatctttcctgcgaaattaggcttgcgtctcgtgtcgccgaagtccatgcctgacaagatccaagacctggtggtcctagcttggcttctgctccggggggttgttggcatgtgcggtcggctcccgcggaagaaaccaacaagaactcaacttcctcccctcctcctcctcctccggcctacgaatcttgcgagcagatcggcgcggcgggggacggaggcgggcttcgccggcgatttgggcgccgggcgagatcggtgtgcaacggtccaagatgggggagggcgggggcgggccgaa

SEQ ID NO: 4613 - DNA, 1160 bp, Triticum aestivum
  Clone ID: PAT_TA_4613
gacgttatctcttggcgcggtggcgcgaggctgcaggaggccagcccgggtttgctgaggtgatctccctgtccttggacgaggaggtcgacaaggacgcggtggtggaacttgtcgaggaagaagaagaaccggcgcaaggagaggaggaagaagcagcggaaggaagacgccgctgacagtcaggacaagcttcaggttgctggcacctaggagggacgggatagcaagatcagtgctcattgaagatggtgttgattccccttacccgacaacatagttctgcggaagcttcttcatataccaagacacttctccgtatgtgatatacacacacgcacgcagtgagcttttctctgcggttctggtgaccggcacatagggtttccattccatggtgttgccgatgagcaagggaaaggaaaacagcatcatcccacgttcttacattcagatttctgagcagagagatagtagtttgtaaggtctcggtcaaactgcagagctctgttaatgatgggggagcacttgttgtcagggttggctacggtggcggcaagataacattcatggaactggagctcacccggaggaggaaaatccgttagttcttctcgcgcccttcgtcatccatgataaagatcatcaatgcaaagccatcaaggttctttgtaccatggtctttgaccctgtttctgagatcagtttcaggtattaacgttgttgaagatcatcctcaacaactcctcgctacgcccactagctaacgaggaaggccccaaccagccgacggacgtggcggctgctgcagctgttggtgctctgggcgcgcaagggtagctcgatcctcctcctggtctagacactgcagcacagccgcgtcagccttggcggctggcgcatcacaaagagctacatgtagatgaactgcagcgacaattctggaactgcaatacaacgacatgatgaagagaagcatctgatagatatagcattaagattgcttgtttatttgatgtgtttggttcactttttatgaagaggagcatcgtatgtaatgcatcagctgtacatggatgtatgttatcaatcagagctcaaattcactggaaagggtgccacactacctggcaccgcaaaaaaaaaaaaaaaaaaaaaaa

SEQ ID NO: 4614 - DNA, 520 bp, Triticum aestivum
  Clone ID: PAT_TA_4614
gtttgtggttgctcggggaaaccattaaaggaaaacagcatgtcttgcagatgtgaatgcccagcaatgatccgtttgttgagaacagacgacaatgggtggtacatcacagagcaccgggttgagcacaatcactcattgtcaagcatcctagttcatggtcatggtcatggtcacaatcagacgacaatgggtgcttcaggcggcgtagaataacacatcctagttcatggtcaagtattgctgctcctagcagctgctcttgcaaatccttcctggaaatccttaccaacctagggtcgttgtgtactatccagttcctgtttgagacagggattactgttatgtgggtaacaaaaagctgaaatgtgaagagtggttcacagacagaaaatatgaaaagagaaagaggatttcttgacgaacctagcaatgtgtttgactggcagagatgagaagtgaacctcaagaagttctgtggagtgagttggtcctgggacaaccggacgccctgcaaacc

SEQ ID NO: 4615 - DNA, 767 bp, Triticum aestivum
  unsure (1)..(767): unsure at all n locations
  Clone ID: PAT_TA_4615
ctgggtccgccccccgcaccgtaaatccgtcgccgccggcctccaccgtctcctcccatgggcaccaaggtacccagccgcattccccgctcatcacacctgcgagtggttccacgcgtggctcggaaccagatgacgatgatctcgccggcgtgaacaagcgaacgcacgcgaggttcctcgtcacccacgccgaggccgggctcatcatgggggggggcgggtccaccattgctgccattgaggcccgctccggcgcccgggtcaggctctcccgccacgaccagctcctccccggcactgaccgcagggttgtgctcgtctacggcctcctcagccaggtcatggaggccatggagctactcctccaaaggctcctactctaccangttcagggtgaccaggcgtccgactctgaggccacgctagtgctggtggtgcctcagccctgctgcggcgcgctgattggcaaaggaggatctgttatcaagtcattcactgaagcttcagaaactgcaattcaggtctcaccacagaacagctcctatggcttcaacgacaggctggtcaccatcacagggcccttggataatcgattgcgagcagtatttctgataatattcgagctgctagaggacattcgttatttgtttccctgtgcagctgctatgccaaacactccaatgagatcacctgtcaacaaggatgcccaagaatctgtcactattagtgttgctgatgagcatatgggtgctgttattggtcgt

SEQ ID NO: 4616 - DNA, 668 bp, Triticum aestivum
  Clone ID: PAT_TA_4616
cggacgcgtgggcggacgcgtgggcggacgcgtggtcgtacgagggggagtgagagccagccacagtcagagagagtgaggagagggataggatagtgagagggtgtgaaggtcgtcaatggcgaggaggtaagaacagtgtggtgtaggatagaagagtgagcgacaagaacccatccaccccaccacacaaatagtgatctgcatcgcattgcatccatcctagatttttcttgtaggatctccgcttctttttcccccttcttcttcggttgatttttttacctctcttggagaagaaaacatatcatggaggtgttggggctcgccgccggcgaggaggctctgcagagagtgcccggcagcttctgattcatcttcttactttcttccttcgtagatgttataggacattctttctttcttcgttcattcttttgtactaggcagcatttctgcagagtccaaacattctttccaccactcaaattctttcctgcatatacagcagataatacagagattacattcttttttttttcgtttcttttcttctctcgttttctttctttggactgacaaattcttctatccaagaacgccaacattcccctgtttttcgatccacattcatccatccatccattcattcactgaagctcaagctg

SEQ ID NO: 4617 - DNA, 600 bp, Triticum aestivum
  Clone ID: PAT_TA_4617
caggatggtaaacacctgttcttggtctctgcacggtccttctggccccacgctccgcccatgtactcctctttttcggccgcctccttgcttgtctgccctccggacggggcgtccgtgcccccttccgaacccctcccgcccgctctcgcactagctcgagtgccctggggggttcgagagccttccgcgtgcttggtggatgtgcacgcggcggcgggcgcgcgggcggtcgctacccgtctgctccgggttccgtccccccgcactgcggcatgcccgatgccaggtccgaggctttggtctcgtgcctcttgctccggactgcaggctacctgggggcggtccatgcgtctacggaggtgctcgctctagctgctcgctcgctccgggtatctcccccccgggcggttgcaagcacgaggccttgcccttgagggtgttcacgttctgcgctccgccctacgcacgcatgcgcggctcgccccatgcgtggatggtttggttctgacgtttatgtgtgactgctgggttcctaattggccattcccataccacaattttcgttgtatgtatctcatgaacattatgctctgtacc

SEQ ID NO: 4618 - DNA, 874 bp, Triticum aestivum
  Clone ID: PAT_TA_4618
cggcaccacgcgaggggcgtccagctccggctcgcctcaaccctaaccccctgcccccctcccctcccctccggcgagatgcccaccggcgcctcagcgtgacgcgacccctcgtcggcggcgaggagggcgaatcgggggcggcggagggtgattcgagatggaggcgaggcctcggccttccggcgtgcggagggtgaccgccaagaagcggccgaggccggatgcgtcctccaacagcgcgcggaagctgcagcgccgggagattgccgcattccccgagcgcaccttcgccgccagcaccacgcgggagcggttccgcaacatccagctccaggaagaatttgatacatatgatcctaaggagaacagttcgctactaccttacttgaggaagcggtctgaaattatcgagatagttggagcccgtgatattatctttgctttatcacagctgggagtatgtgctgcgttcagtagagtgacaaaccagcggatttgctttctgaatggaagtccagatgaagtcatccgtagtttgttctataacaagaacaatgactcgcttataaccgtatcagtttatggttctgaaaatttcagtgctttaagatgcaggacaactcgaatcgagtatatacgccgtggaaagccagatgctggtttccctctttttgagacagaatcgttaaggtggccaggtttcgtggaatttgatgatgtaaacggaaaagtgctgacttactctgctcaagacagtacttacaaggtgtttgacttgaaaaattacacacttctgtatacgatatctgataaagatgttcaagagataaaaatcaaccctggtataatgctattgatatactctagaaaa

SEQ ID NO: 4619 - DNA, 728 bp, Triticum aestivum
  Clone ID: PAT_TA_4619
ggggacgggagcacagtgacacgagtcagcaagcagagcagccagccatggccgcctcgaagcttgaccgcaccccgagcatccgcgaacgcgtggaggacaccctccacgcccaccgcaacgagctcgtcgccctcctctccaagtacgtgaagcaaggggaaggggatcctgcagccgcaccgcatcctcgacacgctcgacgaggtccaggtctccggcggcaagcgccttcgccgaggggcccttcctcgacgtcctgcgctcctcccaggaggcgatcgtgctgccgccgttcgtcgccatcgcggtgcgggccgcggccgggggtttgggagtacgtcccgcggtcaacgtggcacgagctcaacgtcgaacagctcagcgtgtcggagtatctccgcttcaaggaggagctcgtcgacggccagcacaacgaccccttcgtgctggagcttgattttgagccattcactgccttaatcccacgtccgagtcgctcgtcgtcgattggaaatggcgtgcagtttctcaacaggcacctgtcttcgattttgttccgcaacagggattgcctggaacccctgcttgatttccttcgcgagcaccggcacaaggggcatgtgatgatgttaaatgacaggatacagagcgtgggaaggcttcagtctgtcctgaccaaagctgaggagcacctgtcaaagctcccagctgaaacaccatactta

SEQ ID NO: 4620 - DNA, 924 bp, Triticum aestivum
  unsure (1)..(924): unsure at all n locations
  Clone ID: PAT_TA_4620
ggcacgagctccgccccaaaaaagcgagcgacagccgacgcctccccctcctcctcctcacccacggcggcgagcgcgcgcggcgccgggggagccgtctctgcagccaccgaggcaagcgccggcctcggccacaccatttttgagcacgcgtaccaccacaatttctcgttggacaaggcataaatctcttgaggccatcaacaaactgaagtcttcctgcttccatcaatctcaaatgatggcaggtgtcacaaatggcaattcacacagtgatattcagagaaaatatcaagttgtggttgctgctacccgtgagatgggcattgggaaggacggagcattgccatggaagctgcctagtgaccttaagttttttaaggatctcacaatggctacagcagacccatcaaagaaaaatgctgttataatgggaaggaaaacatgggaaagcatacccactaagtttaggccattgcccggtcgcttgaatgttatactgactcgttcgggcagttctgattatgcaactgttgaaaatgttgtcacctgtggaagcttggattcttccctagaactactagcatccgctccctacagctcaacaattgagaaagcctttctaatagggggtggccaggtactgagggaatcgctaaatgcatctgcatgtgaggccatccatcttactgacatagagtccaccattgagtgtgatactttcattcctcctattgatccattggtcttccacccatggtattcatcttctccagttgtggagaacaacattangcattctttcgcgacctttgttcgcgttagaaagtcggcagaagaggctaatgactcaaatctcagtgaattaaccagcaatgatgctaagaagaaaaagtttgaaattcagattttttcatttctacc

SEQ ID NO: 4621 - DNA, 1545 bp, Triticum aestivum
  unsure (1)..(1545): unsure at all n locations
  Clone ID: PAT_TA_4621
caatggcacgctgggatgaatgtgagagctagcgccatgctgccaagtttgaagatattagctgtcaaggtccgattttcgcacgacaaggaggtcaagnatgctgcacacccttctcagatgctttcctcgccttgaaacacttcacatcatgttcattcaatccacttcacctgatggtgtacattgtgctgagttctgggagtctcagagctcttgcgattgcctcgaatcacatctgaagacgctcgtcctccacggattccagggcctggactgtgagttgttgttccttggttacatcttgaagaatgggaaggtgcttaagacgctgggaatggtttgtagaggcagtgatgatgtggtatcggagggaggccggatgacatgttctgttggcgagggcaatgcgccatcgggtggaagtagtggcagtgatgatgtggtggtggagggaggccctgtctcaggttctgctggtgagggcaatgtgtcatcaggtggaagcaccggcagccatgatgtggtaatggagggaggtcccgtgccaggttccgttagtgagggcgatgcgccatcaggcggaggcactggcagtgatgttatttacgtttgccccgcctcccctagctggagctttcagaacgccattgacttgtcagtggaggatcccttctgtgtgttgaggcgtgccagggcctggagggcttctcgagctgaggcatgagtagtttttgtttttcatgctggtggtatttcacatcgacatgtttacttgagccgctaagggtgtggtagtttacttattagttgtgcacttctgcataattttgcggtgaactgagaaggtagaatgaggccatgaaggtctggaagctatttttactacaagaagccaacactctttcttgagttctctattggggaagactaatgtgattctgagatgtggaagtgcccgggctgaaaattgttttggcctttttgtcttgtaaaagtagttccctactatcagatgcaaaattgttactactccgctgccctttcgctgacgccctgttgttatttcacgtctgtgggcttgtgctgggggctcgtcgcgcctttagaggcacctcctcacctccggaggcccccttcccttgcgaagctcgttcctcccagctgggggaggcaagtcttcgtgcggctgccaagtcacacaaccatcctcggtcaccgtctgccccgtcgccgcctcaacatggcgggccatctcctcacgcccctcagggctcgacaggggcgcatgggtctcctcagcgggcgcctccgctgagggctcggtggacgtcgtggcccctagctgcatcttcttctccttttggagggactcgccaggtgaaggcgagaggctcctcttcacatgcagatgggggcggctgtcgctgtcgctccctccggagggctcagcgcgaggcttgccgacgtatcctcccgccgggccaagcgtgtctcctccgcgcgaggctcgctggcctcgacgatggtgctcctcgtccgaat

SEQ ID NO: 4622 - DNA, 906 bp, Triticum aestivum
  Clone ID: PAT_TA_4622
ctctttcccctccgtccgtcccctcctaaaaccctagcagcccaggcggcggcctcccccctccaccaccgcgccgcccaaacccccagcctctcgccgtccggaatggggcgcgtcgacggagaagacaaggccgcgctctcccccggcggagacgacgccgccgatctctcccccgacgattcgccgtggagcgacagcgcctggtccgaggacgaagacgatgacgaggcctcgctgtcgttcgaggacagcggcgagggctctgacgtcgactccgacggcctggaggaggaggatgacgccgcggcggaagagagcgactcctctgaggacgaggttgcgccgcggaacaccgtcggggacgtgccgcttaagtggtacaaggacgaggagcacatcgggtacgacatctccgggaggaagatcaagaagcgggacagggagggcaaaatcgacagcttcctcagcagcaaagataacgatgatgactggcggctgctgtggcgtgtcaagtgaacacatgggtagagaaactcacatcaggtctcatcaaagagatcctaccggatggatctgtcgacagcaccactagacttgttcttggcaatgccctttatttcaaaggagcatggacagaggagtttgatgcatccaagaccaaagacggcgagttccaccttcttgacgggagctcagtacaagcatcattcatgtctagcacaaacgagcagtatctttcgtctcacgacaacttgaaagtactcaagcttccttaccggcaaggcggggacatgaggcaattttccatgtacatacttctcccagaagcaaatgacggtctttggaacttggccggaaaggtgagctcggaaccagagttcctagagaagcataccccaactg

SEQ ID NO: 4623 - DNA, 645 bp, Triticum aestivum
  unsure (1)..(645): unsure at all n locations
  Clone ID: PAT_TA_4623
cgaactcgccagagctccggcccctcgcccatggacgcgaccgatcggagatgtgagcgtggcgtcgtcggtggagcgggtcttcgagagccagccgccgctgccggggacatggggccaggtgacgctgcggtccatggccatctcggtggtcctcggcaccgtgttcggcttcgtcggcctgcgcatcatgatgaaggccggcatcatacaggcgctcaacctgcccatcaacgccctcagcttcttcttcctcaagtggctcatcaacctccagcgggccgcggggttcaccacgctgcccttctcgcgccaggagaacgtcctgatcctcaccaccgtcaccacctgcctcaacacagcaatatgcggtggctttgcaaattatgtagttggaatgacttctggtgtagccaaatcactgggagaaaatccagatccaagagatattgttgaccatataccgactggacgatggatgttgttccttttcctgattggtatggtgggagtgacagctagcgtgccactgaaccaggtaatccatcatttacatatactagctgaatgaacgtgcggtgcattgccatgaaataacgataaacacaanattaaattattgtaccgaatcataaatgtgtgcca

SEQ ID NO: 4624 - DNA, 1318 bp, Triticum aestivum
  Clone ID: PAT_TA_4624
gcgccctcgtcgccggggcacgccgcgccgcggaggcgggtgagatcgtggagctgagggagctcctgtgcgcctacagcaacgcggtggttacccgcgcgacgaccggcgccgcaggggccacggcggagaagctaaagcagcttttgggtaactccgcagcgttcatgtcggggctccaggcagaagacgtgctccccggcgcggcggcgaaggttgttaggtgggcgacggggctcgagaagaggctcgacgcggagctcgaactgtgggacaaattcctatcggaggcaatcgccgagcaccttgagaagaagaagtgcgacggcagcgcaggggacgaggacttcctggacgtcctgctgcggctgagggaagaaggcgccgccggactcgagctcaccgacgatcgcatcaaaagcatcatcaaggacataatagccgccggaacagacacatcgtccctcacgctggaatgggccatggcggagctggtcgggaacccacgggcaatggccaagctgcaggacgaggtaacccgggccaccgaaggcaaaccgaccatcgagggagacgacctgagaaggatggagtacctcaaggcggtgctgaaggaggtgctccggctccacccggcggcaccgctcctcgtcccgcaccagtcgaccacgacggcggtcgtgcagggctacgagatcccggccgagacgccgctcttcgtcaacgcctgggcgatcggtagggacccggccggcatggggagcgacggcggaggagtcccgcccggagcggttccttgggcggcggcggcgctgagggcgtggacctacgggggaacgactaccagctcctcccgttcggcgcgggtcggcggctctgccccggcatcggcttcgcgatgccggtgctggagatcgcgctctccagcctcgtgcgccacttcgactgggaactccccgccagggcgcgtctggacatgagtgaggcgccggggctgaccacgccgccgctggcttcgctgcgactcgcccccaagtgcagggggcagcagtagcagtgctcaagatggcaatattccccgtgggacgggtacccgcggagatttacccgtcatggagaagggacggggacaaattagccccatggtattgtctcatgggtactcgttagtctcgtgaagcggggatggatataaaatctccccgtggggactccatggatacccggcaacaatgccatgcgtactacaaatgcagaatatatagattaatacctacaaaaaacacacaattattttctaaaaaaaaaaaaaaaaaaa

SEQ ID NO: 4625 - DNA, 927 bp, Triticum aestivum
  unsure (1)..(927): unsure at all n locations
  Clone ID: PAT_TA_4625
ccccgcggtgggcgcgtgccacctcctccttcccgaccccaccgacggccgcctcaccctcatccttcgtcacctcgggcaccggcgcatccacgcgggcggcgaccctcttcgtcggcggctcaccctacgcgacgctcttctctagccatgtctacaatgaagggacagacaaggatggataggcctaggactcgcccccatggcctcacggaacagaaggggcaggaattatcgtaagcatttcatcttttcgacaacgcagactctggaaccagcgatgcctaagagtgaaatctttcgatgtggaccttgcgatttgagataacagacgggtgaatcaagaagatgattgctgaggttgacaaaaatggaaattagatcgattttttatgaggagtttgagcacagaatgggtgccaggaatttggagagggggacacaaaagaagaccgcacaaatgcgttagacagaaatgaaaaaatttcaaatgggaatattccgcgtttttgataataattcggattgcaaaacacttgggtgagaaattcccagtattgccacaaagaggcgggaaaaaaatggtgtcgatgagatagatgtaaacgttcatgacgcggttcaaaagagcgatggcgagagatattttggggagtttgcaagggtgatgaagaagacctggtttggctactaagcagggatggcatctgcgagcgtcttaatctttgtggagttgttcagtaaccaccgtgtgtttgcctgatgtatttactgttctgtttcctccgagtaatcctgttgaactctgtgtagttgtggtaacataatatcttttgcgatggaggtttccgcccgccccctcctgtcacccgggactangtaaacagcttnattaaaattcaccctggtnatcaaaaaaaaancccg

SEQ ID NO: 4626 - DNA, 873 bp, Triticum aestivum
  Clone ID: PAT_TA_4626
tgaaacaccatggcgtcccgcttcctctccgtcgccgctctgctggtggccgccgccgcgtgcgtgctggccaacacccagtcccccatcaacatcaagagcagcgaggccgtcgacgccgagctgcccgcgctgtccttcaagcactaccgctcctcccagagcagctactacctcgccaacaccggccacggctgccagatcaccctcaagaactggctgtacaaccccaaggtgaagggcggtcccctgcccaggaccttcgtactcgagcaggtgcacttccactggggcgccagcgacggcgtcggcagcgagcactacctcaacggcaacccctcttccatggaggtgcacctcgttcactggaacagcaaatacgccagctactctgaggcctccaccaaggccgacggtctggccgtcatcggcttctttatcgagggcattgacaactacaggaaccccgacttccagaagctcgtcaacgccatccccaagatcgttgctgaggaatccgagaaggttgaggttaacgccgacctcttggcctgggttgtcccgtacctggaggcgtccggctactacacctacgacggctcccttaccacctccccctactccgagaacgtcctgtggatcgtgtacgagaaccccatccccatcggcaaggctcagatcgctcccttcagggctattgagaaccacgagagcgagcagttgaccaccaacttccgccagctccagaacgccgacggtgtcgaggtgaggtacgtcgcgtaattctacgcaaagcgctcccgaaaccgtacctgatcgacaataaatcgacttgttattctttaaagagaactagtctcggagggggggccc

SEQ ID NO: 4627 - DNA, 567 bp, Triticum aestivum
  Clone ID: PAT_TA_4627
cggacgcgtgggcggacgcgtgggttgctcgctcgctcgctctttctcaaacctcgccggtcccgaacccgaagccccattcctcacttcaacgccgcgcaccggagcgcgcgcccggcttgccactctgaccggcgtggctggcgctccgttgctcccccggctctcgctataaatatactacacgcgtatccagccagccagccagccaaccattggaggagcttccatttcctctctgacttgccctaaacagcgatcctgccggctccaccgaccgtcctcaagctccttctctctctccttctttcttccctgctttgccccgtgccgagccagatggagaaggcgaggagtcttcaggtgccggcgttcgcggagtggaactactactaccactacgacgagccggcggcggcggcggcgtggtacgccatgccggagccgcaggcctgcagcgacgtgtggttcaagtactcgccgcccccgcacaagcccgcgcccaagaagcagcaagcgaagcggcggcggccggcggactgcgacagcgtgtcccgggagcgtcag

SEQ ID NO: 4628 - DNA, 726 bp, Triticum aestivum
  Clone ID: PAT_TA_4628
ccttcaccaccctccactctgcggcgaccactagcacgcgggcggatggggtgctatcctgcagatcgaggaggcgtcgaactttagatggaggaggccacaacctgcagctggctgcgcgccatggtcgcgcgtcgcgggcaacctccttcacgctcgacacctcctgagcgttggagtgaaggtcgactcctatgcactccgcagttcaatttctactgatccggtagctcctaaatccgtcgcgcacttatatccaaaggttcttgcgtgtgtgttttttcctacagagcattttctttagggcagtggagagcaccctcaccctgatccgatctgcagcagcacccgagtcctcccaaagcagccctggtccgttccagtatgcagtgccgggctgtgcaacgatggagatgccgaccgttcgtgaacacaacaccccggatcctgctgcacaccatcaagttcaacttctgttgaatcctgtaaagggagacttattgtgagagcaatcccctctataactttttttgttcaaaaatttgttagctacttcagcttcaacttgcctatgtatgtggctaccaaggtggcatgcattcagcctatgtatgtggccacatgtcgcgagttgctatctgactaaaatgatttatgtacactaggatctccatgtactgaacatgttaaaaaagatatctcatgtaaaaaaaaaaaaaaaaaaaa

SEQ ID NO: 4629 - DNA, 1501 bp, Triticum aestivum
  Clone ID: PAT_TA_4629
gcacgaggggcaagccaagcatagaaaaatggtgggaaagaacaagaaaggggaaaatgagagagagaggggaccgaacactaaaaaagactttgccttttctattccaagtctctcttcccccatccctgcttctcttcttctcctgcacagtccacactgttcatctcccctcccgtccccaaatcccaagctgaccaaccaagcccccgccccgcatggagtggacggccccgaagtccaccccgctctccccgccccacctcctctgggactggggcgacgccgccgcgccgggctcctccggcgaggcggcggggaggcgcgggaaggagaagcgggccaggggggaggcggccggcggaggaggcggaggcggaggaggagggggcgtgaggtgccaggtggagggctgcggggtcgagctccgcgacgcgaaggagtaccaccggaagcaccgggtctgcgaggcccacaccaagttcccccgcgtcgtcgtcgccggccaggagcgccgcttctgccagcagtgcagccggttccatgcgctgtccgagttcgaccagaagaagaggagctgccggaggcggctgtccgatcacaatgctcggcgccggaagccacagccagacgcattctcctttgcaccggcaaggctcccgtcgtcattggtgtttgatgatagacggcaaataagttttgtctggaataaagatccactcagccatgcaaggcctttcccatgttctccatgggacagcccatctgacttcaagctcccgcaagtgaaggaaataagagaggtatcaatcaatggacaagttcattttgataaatctcatctacccaatgctgttccagcactgagtcatgacatagctgagctgctaccaatgaaaggtccggacgcatctgtaaccgcttcgaaattaggtggagcaccggatcttcagcatgctctctctcttctgtcagctagttcttgtggattacctgatcctgtacagcaagcatcttgtctcgtccaattcactggtgccagccaaaacagccggggcccttcaccacatggagggagccctccgtcggcgtcctgtgccgaaggacagcccatggtgccatcgcctcagttcgtccgtttcaccatggatggcgccagcagtggttatgaatctactttcttcggcgtaaaccggatgaattgatgcgtgaagacgcacgagcatctgtaccattttggatctacagccaggaagagcttatgcaagaactgctcctgtcaactactaccagagtggaaaatctcactgttcatgttacctatatactcattgattaccttgttatttttccattgtacaaccctgctgccaattgttggctcgttttgaaaccattgttgatgaatctggacatgatttgtttcataaagtgacgacttgtattttttttttttaaaattttttattcttttttttttttttttttgggggggggggtt

SEQ ID NO: 4630 - DNA, 939 bp, Triticum aestivum
  Clone ID: PAT_TA_4630
gattcggaccagctccttcctcccatctccaatcgtcaaattccctggatctggatctctctgccttccttccttccgtctccttctccttgccgctttattcctctatcccgaccaagccaagcaccgccaccgcgacatccaagacgcccccacaccgtccggtggtgcgcgctggaacgccaggagggctgcgccgacccgtcaccgaggagctgtaccgtggtcgacgctgccaacgaaccccaaaccgtgcggcggccaacacctcccgagcgtccgcggacgggagctacggtgccagcggggtcgcttcccgtcgatccactgtaggatgctggccgcatatgccgccctggcgacggcctcggccctatggcggcgacgcccctgaaggccgacctggcgccgctgccgttgatctgacctgtgtccgagtctctgcagggcgcgagcggctccattcctgggcgtgccgagccgagggaacaagggcgggctcgcaggcttggatgggcctgcacgacggaatactagacgggcgtgctcgaggactgcagggcaatgggtaatgcggcagcgaagagctagtgattcccctccacagcaacgcatccaatggacgcgagttagatggcgagggccaccgtcttggcggaaaccctcctctccaccgtggatggacttttcctctgttgatttcgctgggaattgtcctcgattattaatgagttagctcgataggggaacggacggccctcctatttattatattaagaaaagcttctgagctaaaatgttaagaaccaaaatattctatttagtaggttttctcacaaaaaaatttagtaggttaaaatcctaattgggctgataacaaactgattcatcaatgaaattagtgggccttggatcaacttgaaatttttaatggggctg

SEQ ID NO: 4631 - DNA, 952 bp, Triticum aestivum
  unsure (1)..(952): unsure at all n locations
  Clone ID: PAT_TA_4631
cttctctcttgctcgcccgctcgcgttcaccacgaagcccaatcgcagcactctgcctcgtcgctcggagcaccgcgccatgcgccacccatggaagcaccccaccgcgcgccacggcgccgccgagctctgcttccgcgaggtcggcgacctcctcccccgccgcttcgctcgccgcgccgccgcctccgaggagctcgtaatgcgcctccagattcataggaagctcaacaagcacacaggatgcgtgaacacggtgggcttcaatgccgctggtgacaccctcatatctgggtcagacgatcagagggtaatgctgtgggattgggacactggtgcagttaaaatgcagttccattcgggccatggcgataatgtgttccaagcacggttcatgccttacacgaatgatcgcaccattgtcacctgcgctgctgatggcgaggtgagagttgccaagatccaggatggccgggatgtgcttacttcattgcttggtgaccatgatggaagggctcacaagttggctttagagcctggaagcccttatattttctatagttgtggcgaagatggccatgtccaacattttgatttgaggacagatacagccacagagttattcatttgcagaaagcctgtggctaaatcaggacactcctctcatgtccgtcttaatgcaatcacaattgatccacggaatccaaatcttcttgcagttgcggggaacaattcttatgctcgtgtctacgacatccgtaaatgcaagtcgggtggatcatctgatttcgctcagccatctgactgttattgtccaccacatcttattggcaataagaatgttggaataacagggttagcattctctcaccagnntgagttgcttgtatcttacaatgatgagaatatttacctcttccctaaaaatggnnngctgggacccgacccaaaa

SEQ ID NO: 4632 - DNA, 939 bp, Triticum aestivum
  Clone ID: PAT_TA_4632
gaattcggcacgaggcgagtaccggggcgggccactcgccccccccccccctccccctcccctcaggtgcttccgcgggactcctccgcctgcggccgcggcgggggcggtggcgacgatggccgcgcccgtcggggagatggtctgggtgcccgtgctggaggagggggtgttccggttcgacgcgtcgggggaggcgcgctccgccgccgggcccagcctgtcgttcgtcgagccgcggcggcggcaggagccgcgcgagggcggcgatcgtcccgcggtcgtgccggcgtgcgaggtggcggggaacgtccagaaggttgtgattaagcttccctctgggacgtctttctatggtacaggagaagctagtggtccacttgaacgaactgggaaacgagttttcacttggaacacagatgcatggggttttgggccagggaccacttcattatatcaatcacacccttgggtgttggctgtcctccctgacgggaaggcattcggcgtcctagctgacaccacacgacgatgtgagattgacttgagacaagaacccacgcgtccgactagttctagatctgcttaccctatcattaattttggaccttataattctccagctgaagttacgatgtcattgtcccatgcaataggtatttctcatctcataatcaatctcttcccctactaaatgtttatcagatgtacctttcatgtccagtgttttgaactttaatcatcatactgtatagaaactctgaaggtgtatatctctgctctagtatgaaagtaggtgtgtcttctatgaaattataattccattttgacaaagaaaaagtagacaagttatgggtctgtgtagcaaaatattcagttctaagtctaactgttttcgcattattagttggcacttggcactgtaaaatttttttgaag

SEQ ID NO: 4633 - DNA, 842 bp, Triticum aestivum
  Clone ID: PAT_TA_4633
gcggccgcgtcgtctgttcggagggagttctttgctatttacgaatactgtaataattttggtagattgcaagtaagatgataatgggatatgaacaaaaaacatgggtagattccaatttagattaaacagatatactacaaaaagcaagcgtgcggccaacaaggctagttcatcagcgacactgcagaatgttacagttgcatccaagaccaatagcgaccgacacatgcggagcaccagggaccagtttccctgaacaactccagtcaattattcatcatccccaaacagaaacgagaaaatgcctcaccctggcgcggtcggcaatcggaagggtgggcactcagccggccatggggtggttggcgacatactcgatggcgagcggcagcgagttgatcttgtcagcctccaagtcggggatctcgagcttgaactcttcctcgatcgccatcaccacctccaccgtgtccaggctgtccagccccagatccttctcgaagtgcgcctcgggggtcaccttggaggggtcgaccttggggtggcacttgaggacgtcgaggacgcggccgacgacctcgtcgcgggtgaggtgggcgtcgtggtgaggacattggccgcgcgagccacggcgcgagggcgaggggccggccggccgcggcggcggcggcgagaggggcccgccgtggcgggcgagagtcggatgtggcggaggatcgccggacgtcagtgcggccgccgccatctttcctgcccgcctctctcttcgctcgggattttgacctcaccgttcgtcggcctctctgctatgagagcgtctccctcgtgccctcgtgccg

SEQ ID NO: 4634 - DNA, 764 bp, Triticum aestivum
  Clone ID: PAT_TA_4634
gaattcggcgcgcgccgcaccttcctcgcctcagtcaccgccgccgctgccggcgctctccggttgcccgttgtttgtacaacatgatcccgtctcccgctcgaatcctcatcttcctcctacccaccccaagtctcatacccccgccacccgtcaggcggccgcacagagcctgggccggaaccgcccgctgcgccccggaggctgtcgccggcgggggcttcgtcgtcattgaggacgacctctctgaccttctgcagattctacctagggatttacgagataatctgcagaatgaaccgagaacggaccacctgttggaggtttttccacatttggggagacgacccgaggcacgtttccttggcaagtttggtggcccggccttgttggtttgccagatttcacagctagagttggaggaagctcagagagctgttggagaatttggaggtgacaaccgtgcaggaattgaaggtacattgcatagaatatctgccataaggagtagaaaaggaatggttgttggtttgacctgtcgagttggccgtgccgtcaatgggcatgttgatatggtccgtgatcttttaaactacaaagagagcattctgtttttgggaagacctggggttggcaagactactgttatgcgtgaaattgcacgtgttttagcggacgagttccagaaaagggtggtatattaaacaatgtaattgtagatacaagtaatgagattggtggggatggggacattcctcatgctg

SEQ ID NO: 4635 - DNA, 1312 bp, Triticum aestivum
  Clone ID: PAT_TA_4635
ccacgcgtccgcacccccctcgccgccgccgccgccgccacgcagctgccatggccgacaccgcgccggccgacgaccggccggagccctgccccgtcgccgcggacccgtcgccccctccgccccccacgccggaggagctggtggcccgcggcgtcgcgcccgtcaagcccgccttcctccgcccggcccccgtccgcgacgcccccggcgaggacggcagggccagcggcgccgtccccctcgagaagaagtccaagcgccagttcaggcgcgaccgcaagcaggaacaggagtcggtgttgcgtctttgtgtggcagttgccaaaagtggaaatgtggacgcttgcaaatttggtgcttcttgccgtttcacccatgacatagatgcttatttggctcagaaaccagctgaccttgaaggaacatgtccattcactgttctggggcagccatgtccgtatggactaacttgcagattttctggtacacacaaagataaccatgcaccttctgaaagtcacgagataaacactttgagtaaggatgttcaaaagctcttatccacgcccccgtataaatttcccagggccagtgagcagatcaaacatcttggtcttaaggaagtcatcaagattaaagcaagtgcattagctgaagatcggagcgctgatcatgataatccagacgtatcatgtgaactgaatggtgatgaaaaaactgaatcttcttgcaatgctgctgtgaatgtggaacatcgtccgatttcttcgcacaaactggataaattggggggagaacctttggatggtgactctgttgcaagggcagcaaagaagtcaaagattgaagttgttgaaattaacaaagaaggagctggtactcatgacactaagccggagcctgaagatcctaatttagttaatggattggaagtgccctcaaatatcccaagctcttgcagagttgacctagtcgcaacacctcatttacgtgaaaggaagataatagattttcgggagaagctgtaccttgctcccttgaccactgttggaaatcttcctttccggaggctgtgcaaaacattgggagctgatgttacttgtggagaaatggccatgtgcacaaatcttatgcaggggcaagcttcagagtgggctttgctgcgaagacattcatcagaggatttatttggggtgcaaatctgtggagcttttccagatacagtgtcacggacaattgaacttgtggataatgagtgttcgtttgactttgttgacataaatatgggctgcccaatcgatttagttgt

SEQ ID NO: 4636 - DNA, 1488 bp, Triticum aestivum
  Clone ID: PAT_TA_4636
gcactcgctctctcccccccccgcccgccgcttcaccggccgccgccacatctctctctctctcccccccctccccaccaaccgcttggagtcgttgctcggcatcgggacgacccccgcaaccccctgctaccacacctccccccccaccacggaggaagggggcaccagcggcgagtgcgcggcgccccgcaactccatgccgccattcatccgcgccaataacacagccagcacggagcagagccggcgccccagcgccgggatcaagcacgcgggcaggcaagccaggcagagagtaatcctccccctctgcgcccgtaccttcacccgggcggcgccgcggccaccgccaccaccctcctacgctccttgctagctagcgaccgtcgcgacgaccgagcccgccgagagcccactcctgcaccaatcgcacggtaaattccggcgcaccctgcactcactgccgcgtccgtccggccggccagatcgtttctgatcctcctcctcgtcgcgagaagagcaaagcacagcgcagccgcgtcgtgagcgaacgggggagcgccggcgacctctccccgggcgcctccgcgtgggacgcccggttcagctgcgcctccaaccgggtggcacagctgctgctggcgcggccctactccttctcgcagctggggatgctcgcgggcatcctgctgcagctcttctacggcctcctcgggagctggaccgcctacctcatcagcgtcctctacgtcgagtaccgctcccgcaaggagagggagggcgtcggcttcaagaaccacgtcatccagtggttcgaggtgctggacgggctgctgggcccgtactggaaggcggccgggctggccttcaactgcaccttcctcctcttcggcaccgtcatccagctcatcgcctgcgccagtaacatctactacatcaacgaccggctggacaagcggacgtggacgtacatcttcggcgcctgctgcgccaccaccgtcttcatcccgtccttccacaactaccggatctggtccttcctgggcctgggcatgaccacctacacggcctggtacctggccatcgccgcgctcatcaacgggcaggtggagggcgtcacccacaccggccccaacaagctcgtcctctacttcaccggcgccaccaacatcctctacaccttcggcggccacgccgtcaccgtggagatcatgcacgcgatgtggaagccggccaagttcaagtacatctacctgctggcgacgctgtacgtgttcacgctgacgctgccgtcggcgtcggccatgtactgggcgtacggggacgagctgctggcgcacgccaacgccttctcgctgctgcccaagacggcgtggcgggacgcggcggtgatcctcatgctcatccaccagttcatcaccttccgcttcgcctgcacgccgctctacttcgtgtgggagaaggtgatcggcatgcacgacacca

SEQ ID NO: 4637 - DNA, 714 bp, Triticum aestivum
  Clone ID: PAT_TA_4637
cccggccgcccttttgcaaattgcaaaagagagctccacgttcactcccatccgtgacgagctatggcggcggccgcgaccgaagcgacgatcctcgagctggacccttcgcacgagcgcgccggccgcgttatcgacgacatcgtgcggctggagaagaggatcttcccgaagcacgagtcgctggcgcgctcgttccacgacgagctcaaacgccggaacaccggcctgatctactcgacgtccggcgtcggcgacgacgaggaggtcgctgggtacgccatgtacacctgcgccaccttcctctgcgcctccatcaccaaactcgccgtgaaggagagctgccggaggcagggcctgggcgaggcgctgctgcaggccgccgtcgacaggtgccggaggaggcgggtccagcgggtgtccctccacgtcgacccggcgaggacggccgcggtggcgctttaccggaaggccgggttgcaggtcgacgccaccatcgagggctactactccgcgcagaggaatgcttaccggatgtacatggatctctagaaatcatcaggatcggagcatcaaggcttcttcactccgccggttgtgcggtcgttgagttcaaattgttttcttcttcttctgaatttacatgagagctgagcttatttactgtgaaatgtctgcgcttcaaatggccccaaataacatatctcggtaaaa

SEQ ID NO: 4638 - DNA, 672 bp, Triticum aestivum
  unsure (1)..(672): unsure at all n locations
  Clone ID: PAT_TA_4638
tttgagacagaagaatnagtgttaggagatacatggggacaattacaggaattagtgatcttgatgctgtccgttggccaaactcacattggcgctctgtgaaggttggctgggatgaatcaactgctggagagaggcagccaagggtgtcactttgggagattgaacccctgacaactttcccgatgtaccctactccttttccactcagactgaagcgaccatggccaacaggcttgccttctctgcatggtggtaaggatgatgacttgacttcctcgctcatgtggcttcgagatagtgcaagccctggtttccagtcgctgaatttcggtggtgctggtatgaatccctggatgcagccaaggctggatgcatcgttacttggtctacagcctgacatttaccaaacgatggctgcggctgcgttccaggacccaacaaagatgtcacccacgatgttgcagttccagcagccacaaaacatggttggtagagctacgccgcttctgcaaagtcagattttacagcaaatgcaacctcagtttcagcagcagtcataccttcaaaacatcaatggggccacgatccagggccaggctcagtctgagttccttcaacagcagctccaacggtgccagtccttcaatgagcagaagccacagcttctcc

SEQ ID NO: 4639 - DNA, 1183 bp, Triticum aestivum
  Clone ID: PAT_TA_4639
tttttttttttttttttttttttatgaaatatctgctggagaagactagaaagttttcagcatcattccagatttatgaagatcatgttccgacaacaccaggaatacagtgaatactcgttaaaaatacgcgctctgcaggttaaacaaacagcatgaacaaatgctcggttacgaaacaaaaagttaaacgagagcattgccttctcatctcattaaagttgtggaaaaaacaaagatcaatctccacatgacagtgacgcccagtattgctggccaccagaactccacataaacagccgctggcagcaagtgatatactccctggatatatcagtgaaaacgacggaagctaacttctggtcaagcgtcttcttcaatcatgattcagatcaagcgttgctcttctggtcttcgattttcttctggaacgatgtgaaccattgcttccaagccgcgtctccttgttgctcgatccaagacaagaaacagctgtctaacaggcagaacaagttcacgtacagcagttgatatcgcacgggaatgaagcgaaagtttgcgatctgcacagccggccagatggctccccctaaaaccagagcaggaatgatatccctcttcacatcatccttcacctgctccagactccttcctgaagcaaggcccacataagagaagaacagccccagatctagcggcccaaagaggagaccatccgctgcaacctttgaggctacaaatttgaacgaaccaggcaggtatcttcgtcggaccatacgatccaagtattcgtaccagtaatgtcccacaggtccaacaaaagcaaatccaaatgaacttgtgatgccgaccctcttccaatcaattttgaactctttatctttatcctcggggttcttggcgtggtggtggtgggagctggcggatttgtgggtgacggcctgggcgccgatgtcgccgagggcccagaggatgccggagctgacgacctgcgtccgcacggggtaggaggacagggactgctggtaccatcgccatagccgccgcatccctgcgagcgagccgaaaagattgacgggggagaaggggaaaggaaggaaggaaaggaaggaagtgggacctcccccctatttccttccgtgtgttctttgggatttcgctcgggtttttgagctagggttag

SEQ ID NO: 4640 - DNA, 559 bp, Triticum aestivum
  Clone ID: PAT_TA_4640
atcctgctaggcaacaccggcgaccacaacctcgagcagaccagtggtccgcctcaagtcacctcaccgccggcctccgcccctatcctctgccccaaagcaatcgacctcgtctgccaccctctcctccccgcctcatcggaagagaagagaacagggagatcgaccaggtcaggcgccggtcatggcggcgaccagatccgccacggccgtagccacctctctaaggctccgatcttggctgccatggaggtcagaacaacgtgccgagacaggatctaatctcgaccacgtgagaagacgtctgcctgctccacgccaccgacgccatggagcttcccccttctagcaggctagcatccattcttctttgatccactatgttgcccctccatcttcaacctctctgtagatttatttttgcatacttaatcatcaccctatagatgaattatcatttgtttctgccataaatgttgttcatattgttttccatatatttagttggtgtcacaacagtgatttgagcatcatgaaaatataggaataacccttaaat

SEQ ID NO: 4641 - DNA, 957 bp, Triticum aestivum
  unsure (1)..(957): unsure at all n locations
  Clone ID: PAT_TA_4641
cgtccgcggacgcgtgggatcgaaagctgctaccgtgcatcaggaaaacaacgataatgaccaaagggagcttcattttgtgttttttaggaaacctaccaaatttctcccttcagatgatggttccacggttggtgctatggaacttgaaaagactctcttaaaagatgatggagcaactggaaagcaggtggcagttggaactggtgagtttgaagaactaaaatgtggaattgttttgaagagtattggttacaaatcccttgccaatagaagggttgtccttcgacaaatacagaggagttgtcccaaatttgaggggcagagttctgtccagtgaatcagagactgccacggtggagccaggactgtacgtggtaggatggttgaagagaggaccaactgggattgttgctacaaatctccattgtgccgaagaaacggtggatagcatccttgaagacgacaggaagggcttgttcacggacccatctggtccgaaaaggcaaggccggcggggactacttgagattctggaacagaagaatgcccgctacgtgccgtttgatggctgggagaagatcgacaccaaagagaaggcggacggcgagctgaaaaacaagcctagggagaagatcaccagatggaatgagctcctggaagccgcaagggagggttgattgaagggcatcgaacggggctgctggttcaggcgtaaaccgaatcaaagaaacagactgcgaggcacaatctgaatactgaaagaacagcctatcacgtacataccgatgagccaatgaaagtcaagtgctaataatgcagtcttagcagtgaatcactcgtacgcatacacagtactgccaatcctggttaaaatccccaaaaggctcgaccactgcagccacatgaaacgattgtagtncctgaggagtagaactgctatatgaacttttgcac

SEQ ID NO: 4642 - DNA, 555 bp, Triticum aestivum
  Clone ID: PAT_TA_4642
tccctcgccccctcccctttctcctccgccgccgccgccgccgccccccccggtcgcgcgctgccgccccggccatctccgcgccgctggtgccgggaggcgggggacagctcccgcgcctcgcggccggccgggcggggccgcctgccgcccccggccccatgcctcgccggcccccgcgcctccccctcccccacgcgcgccccgcgccctcgcccccgcgtccttgcctccccctcctccggccgggccgcgccgccttcccgcccagccaccgcgcggcagcggccgcccccggctgctgccgccgctcctccccggctcccgccgctcccgccggccggggccccccgctcgccccggccgcggctcgcctcacctccctgttctcgttccctgtggctgatcttgcgcgcgcctcgtccttgtggccctcccggtccgccgtgatggcggcctgtggcgggctccatgtgcatcgcgtcagcggctgttagagggggccccgcgttgcaggttcagaaccaatttatatggatgattgacatatggatc

SEQ ID NO: 4643 - DNA, 817 bp, Triticum aestivum
  unsure (1)..(817): unsure at all n locations
  Clone ID: PAT_TA_4643
ggccgcccgctcctcctgtgcgagccttggaggagtatcggcccgtcagtcttgggatggtgatgcagggtccctctccgctgcgttctgtgctcctcgccctcgtgcttgtctcctcttcatgtgctcggttttgcgtcgaggtgcttgactgcttcgtcagtcgccggcccccgcccttctgctggccttggaggtgtttcggccggtctgtcttgggaggctagaggctgggtccgtggttgaagccaggagacggtgcgcaggggtcggccctgcccggcgcccggtgcgggcggccctccccgccgcacatgatggccatactccgtttatcacgagcaaattccctgctcctgccaaagacgtctcttgaaggataccatgccaaagtatctgaagagaacaaatgcgcttctgttgagatattccttaaggcgtctgggcacctggagtgcaccatgcagcatgttcttcctaggatgtcaccctgaaagaggaaaggttttcctgtgggacttgtctgaaggggtcctgaaagctacttgcatgcaaagcacttggtcaggcaattgatgttcaactcggttggcaattggacagtccaaaggctaccctggctgtcaaaaggagtccnggcaatntnagacggtcaantncctggcagcangcacaanaaagcatcntggacatacctctgctccgggcggctggggncaaaaagcacaaggntcccttnttaaagttggaaagccanatgggaanccaaaagcctccgggntttttttttnaccacaccccccttttncccttttta

SEQ ID NO: 4644 - DNA, 887 bp, Triticum aestivum
  Clone ID: PAT_TA_4644
ccaatgctcccaaaagtcaagggaaacattgcagctaaggacagatcaagttcaaaacccccttcaggaaaattaaacaaaaaagataaccgaaaaagaggtcgcgctgaggaggatgagcttgacccaatggatccaagctcttactcagatgctccacggggtggctgggttgttggcctgaagggtgtacagccacgagcagcggatacaaccgcatctggccctctgttccaacaaagaccgtatccctcacctggcgccgtgttgaggaaaaatgcagaggcggcatccggcggcaagaaacgcggtggtatgtctgcgatcagcaaaagaggggatggcagtgatgggcttggggaagcggattgagtttcttagtaagctttctctgcaagcaaccagtagatcctggtggctttcgctccttttggaagttgtttgaaacattggccgaccggtagctagctaaaaaaagaagcaaattatcagctgtaaattattactccctctgtaaactaatataagagtgtttagatcactacttacggagggagtacaaaggagcaagtccagtgccggagaggagaggctagtgcagtgtgagctcagctgaggtgccttatcggcgataaagctaatatcatgggggagtttccactcctggacaggctactgcagtgtaagttcagtagctcactatggtatgacatgcttgagttctgtgaattttgtactggaaactgtaaggtagaatgttttggtcatgcaatatgaacacttgattttctagattgacacggcgaacgagggtcggaccgggtgcttgatgtatgataattcatgtgtgcgctattatctacggaaaaaaaaaaaaaaaaaaaaaa

SEQ ID NO: 4645 - DNA, 1073 bp, Triticum aestivum
  Clone ID: PAT_TA_4645
aggaattcggccgaggaaaggccctcccctctctctccggggacttcgacggcgaagaagaagaaaaggaagaagaagagcgacgcagcgagcacctgcctgcctacggcggccagacgctaggggagctgcgtccggggctctgattcttcaccggcgatccgtagcgctcaccgcagccgtagcatgagttggcggccgccgatctcgcctggccgcctccttcttgtcgtccaattcgtcgccctctgctcgattcctggggctttttcttcgaggcttgtcacacttgataccattgatatatttaccactcatgaatggttctccagaccaactgtgtttttccgctgcagtggagataacaagacacatttgcctgacgtgaaggacgcaaacttgatatatacctttaagggtgaagaatcatggcagcccttaacggaacttccagaaaagaagtgcaagcgatgtggtttgtacgaacaggatatgtttagaaatgatgtgtttgatgaatgggagctgtgttctagtgacttcaaagatggcaagtacacacacttcaaggaagggcagttcaatgcgaccttcctgtgcccaaactgtactgtctctgttggtgatgctgcagcccatcactctagctcagaggtggaagccaaaaagacatctgttgctgttatcataatagtaagcgttctcgcttccgttatcgtcgtcctcgccttgttcggagcctacaagtactggctgaagaagaagagggagcgggatcagttacgatttctcaagctcttcgaggagggagacgacatggacgacgaactgggcctgagcaatgaactctaagatagcgaatacagtctgacgccccgatctccaatcatctcagattagttcacgtcgccgtgtataaaatgttcttcttctttccatctctcttttcagttttagcttcaaattcttgtgatgtacagcacctccaccggttgaaagacacaactctgacagcaacagcacaactctttggttcgtcgcacttttccccctcataagatcaaaaaaaaaaa

SEQ ID NO: 4646 - DNA, 703 bp, Triticum aestivum
  Clone ID: PAT_TA_4646
aggaattcggcacgaggcttttcccttttgtatgcgctctcaccaactgcactggactcaactgagatccatatatagcccggcaaccaccgctgcccctctcctacagccgaggggtgccgtgccgtgccgcgaggagagagaggaagggaggaagggttggtggttgcggataccgggaggccgccgggcattgggcttggaattctcggtcctttcgccaggacagcaggaccaaggaggcgagaggagaggacgacgggtacagtgagagggcgctgccggggtgtccccttctcctgcagccactccctccttcttctggagagaggagatgggcgagacggccatgggcgggtacgggctggacaagccgccgcgctgcagcatcagcttcgacacgccgtgcggcgccctgctgcgcgagctcgagcaaatatggacggagatcggggagcaggaacaagataaagatcggatgttccaagaactcgaggcggagtgtatgcgtgtgtatcgtcggaaggtcgacagtgctaatgctgatagaagccagctccgccagtcagtgatggccaaagaagcagagcttaaagctttagtggcttcgataggtgaaaatactacacaatttaaggtgaatgaaaagcatgcatcgttgaaagaacaacttgctgcagtgacgcctctcttggatgatctc

SEQ ID NO: 4647 - DNA, 1092 bp, Triticum aestivum
  Clone ID: PAT_TA_4647
cccacgcgtcggaagagaaaacaccacctcccccctcacccaccactcctacctcctccgacttagcgttcgctgagcgggcctcgtggttggacgcgccgggtagcagccggagcagcggcggcggcggcggagggagtccacaatgctgggcgccaggagcaaatctggcctggccgacgccaagggcgacggcaagccggaggggaaggtcggcagcaagccgagcggcaagccggaggccaagagcaacggcaagggcacgccaccgacacccaggggcgagacgccgccgacacccaagggcgacaggccgcggaagccggcggtccccaaggcgaatgccgcccatggcacgccgccgagcgcgccgcgcacggccgacaagtctcccaggtccgccgaccgcaagtcgcccaagggcgccaccccaacccgccccgccccccccacccctccccccccgcagaagcaggggaaggctggaaagccgtgtccggagccgcaggccgcgaagccgtcccaggagctccaggcgcagcttgatgccgtccaagaggcgctcaagaaggccatgggtcagctggtggagaaggaggaggagaagggcaaagttctggaggagctcgagtgcgccaagaaggtggccgatgaggccaatgcgaagctcaaggaggcgctcgatgtgcagagcaggaccgtggagatccagaaggtccgttccatggaaccggagcagccgagcaatgatgattctgcgcacggcgtggaagatgagctgcggaggaagctgaagagcatgcagagccagcaggaggctgacgccgccgcgctgcattcgacggtggagcagcttgagaaggcaaggtatgagctggccgatgcaattgatgccaagaactgggcgcttagccaggcagatgatgccatgagggcttgcgaggtgaacactcataaaatcgagctcctcaacgccgaggtggagcgcctgaaggggctgcttgattccgaggtggagagcaagtcgagggaagctgctgacaaaattgggaagcttgaggcagagaattctgtgttgaagcttgaactgga

SEQ ID NO: 4648 - DNA, 2339 bp, Triticum aestivum
  unsure (1)..(2339): unsure at all n locations
  Clone ID: PAT_TA_4648
ctggctcggctcgcctttaactaaatttaagctaagcggctctcgcctaaagcctccctccctccctctatacccggagaagaaaaggaccgaccgaccccaaaacctctcctgctctccctcgaggcctcctccactgggctctctcgtcgcctccccacccattccagcggttgacggcgggagtcggccagtgaaaatggaagggaacactagaggaggcgggcattctgaagcgttaaagaactacaatgtgggcagaacattaggtatcggcacatttggaaaagtgaggattgcagagcataagcatacagggcacaaagttgctataaagattctgaaccgtcgtcaaatgagaactatggaaatggaagagaaagcaaagagagagatcaagatattgaggttgttcattcaccctcatatcatccggctttatgaggtcatttacacacctacagatatatttgttgtgatggaatattgcaagtatggtgagctattcgactgcattgttgagaaagggcggttacaggaagatgaggctcgtcgaatcttccagcagattatatctggtgttgaatactgccacagaaacatggttgctcatcgtgatctaaagccagaaaacctgttacttgattccaaatataatgtgaaacttgccgactttgggttaagtaatgtcatgcatgatggccattttctgaagactagctgcgggagtccaaactatgctgcaccagaggttatctcaggtaaattatacgctggacctgaggttgatgtttggagctgcggggtgatactttatgctcttctttgtggcactcttccatttgatgatgacaatattcccaaactgttcaaaaagataaagggaggcatctatatccttccaagtcatttatctgctcttgcaagggatttgatcccaagaatgcttgttgttgatcctatgaagagaatcacaattcgtgaaattcgagaacacccatggtttcagaatcgccttcctcgctacctggcagtgcctccaccagacacggcgcagcaagccaaaatgattgatgaagatacacttaaagagattgtcaacctgggatatgataaagaccatgtgtgtgaatcattgtgcaataggctgcaaaatgaggcaactgttgcatattacttactcttggacaatcggttccgggccactagtggctatttgggggctgactatctacaatcaatgggtaggagttttaatcagtttacttcatcggaatcagcaagcccaagtaccaggcagtatcttccagcaagcaatgattctcaaggcagtggcttgcggccatattaccccgttgaaagaaaatgggctcttgggctccagtctcgagctcaacctcgtgagataatgatcgaggttctaaaggcacttcaagaattaaatgtctgctggaagaagaatggacactacaacatgaaatgcaggtggtgccctgggtttcctcaggtcagtgatatgttagatgccaaccacagctttgttgatgactctaccatcatggataacggcgatgctaatgggaggctacctgccgtgatcaagtttgaaatccagctttacaagaccaaggatgacaagtacctgctagatatgcagagagttactggacctcagctcctcttcctggatttttgcgcggccttccttaccaaccttagggttctatagtatggtgcctgttctggttgagtgatgaatagtgagacatatgaccgtcagcgatgaataagttggtgcctgttctggttgagtgatgaatagtgagacatgtgactgtcagagatgaataagtgatggtgtgtaaataggtggtgtgtttcatcttcgttttacccagtccctgacagcgaaccgtgttgtttgggtgactagtcctgtgtgaagcaccaaaagtgttgtttggggttataaacaagacttatatcctaaagggtcagggtgaaccataaattagacccccgttcccccgccccgcctgggaggcgactcgggggaaccctagcccgccgcgccgccaccccctctccccggctcccctgccgcgccgccgccggaggaaaccgccgggcgaagcccgcgcggcggacggcggcggcggggcttcccgctcgcgcgcgcggcgtcgttccacgacggcgaccgctccaggtggggaaggctcggcctccggcgctgcggccgtnnnggcgctccccggcggccctctgcttcgtctcgcgcttctccttctctgggtgggtggancgcactnnnnnngcnnncgattgnnnnnnaggag

SEQ ID NO: 4649 - DNA, 600 bp, Triticum aestivum
  Clone ID: PAT_TA_4649
aaacaatggcatccaaagcattggcagctctggtggtccttgtactcctcgccggcggcaagcttggccacgccgtgctggtcagcggccgtcccccggtttccactctgccgcacccatcgtcatccactactgctggtcaggctaccaacatgaacgccatggatggagcatcagcagccactactcatcgccaactcaggatcggagaaggtgaggaaaaatccatttctgtgaacagcctgccgacggtgcacatgagggtgccggttattatccccaaatccacctaatcccatgcagtacgtacgtgcagccaagctgacgatcgatcgacctcaacaacaaacatgtatcatgattttcagaagaataaaatagtcgcgaaaaaatgagaagaataagtcgtggagtaagttagttggctgctgtgctgtgttaccatggagaggctggaagttgtaagttctaagtgatggctccataattacgaatgtactctccctttttctgaaaaacagaaggtactgtgctggcgcacatgggacgggtctccaggattgaccttctttctttaaaaaaaaaaaaaaaaaaaaaaaa

SEQ ID NO: 4650 - DNA, 1314 bp, Triticum aestivum
  Clone ID: PAT_TA_4650
aaagtcaagtacgtggctagccttgtagatcctggtgaagctgttggtgtgatccttgctcaatccttaggagaaccttcaacgcagatgacactcaacactttccatcttgctggaagaggggacatgaatgtcacacttgggatgcctcgcatacaggaaatcctaatgaaagcatcagctaacattggcacgccttatatgaagtgccctgtgcatgaaggcaagaagaggaaggatgctgcacgtctggccgaaaagctaaggggtgttacgttggctgatgttgtggaaggaattgaagtatgcacagttccttttcacaacagtaatgggcatatttcgagtctctataagttgcatctaaaactattctcaccagactgttaccctcctgagtcggaacttacagtagatgagtgtcaagcatccttgagaactgtgtttgttgatgcaatggaatatgcaatcgaaaaacacctaaatttgctacacaaagttagtggaatccaggaaacaagggtaaaggacactgagaatttaccatcagaaggtcctgaagaatccgagggcagacctaccgacggtgacgagtctgatgcgagtgatggcgacgatgaaaatgaggacgacttgggagctgatgcagaaaagaggaaacgacaagagaatgatgagatggagtatgaggatgatattgaaagtgaagatggcatgaacagtgaccctgatgaagagacaaaacatgaacttgataatgaggatgatccagctgagtctggtgttgaatcagaagagaatgacgaaggacatttgtcagattccagtaacaagactgcaaaattagaaggcaggcttgcagctactaaactcaagaaagagagaaatgaaacggtggaaaacttgcaggagcagaagcaggcacaaataacccagaaacgcagcaaaaagttaaaactgactgttcatgttgaaagtgcagatttgaattttgaggttcactacatcttgcacaaggaaccacatattttactatcccagtttttgaacatgtgttgatctgactatactatgaatccatggggaacttgtatcatgccccccgtatgcttatggtttaaacttttctcctgctgttcaattgtgtcacggcaagcactgttattgcccagaagactttgaggtccctatttgtcagtggatcccataacaaaaacataggtctatgtaatgttatttggccagagaagaaaaagaaaggtgaaactgaacccaaaaaaaaaaaaaaaaaaaaaaaaagtcgacgcggccgcg

SEQ ID NO: 4651 - DNA, 1020 bp, Triticum aestivum
  unsure (1)..(1020): unsure at all n locations
  Clone ID: PAT_TA_4651
cgtccgcccacgcgtacgaggagaatggctgtgcagtacttagtggccaggatgcatttgttctgtgggacacctatggttatccaattgatttgactgaggtcatggcagttgacttcgggctatctgttgacatggagggttttaatgcttctatggaagaagcaaggcaaaaggctaggaatgctcgctacaaggctggtggtaaatctattgtcctggatgcaaatgctacgtcgcagctgcgcaatcggggacttgacagcacaaatgatagcccaaaattccaacacaaggtacatagcagtgtagtgaaagctatctatactggctcagaattcgtagccactgcgtgtgctgatgaaaactttggtctgtgtttggaaagtacaagcttttatgcagaacaaggtgggcagatctattacactgggagtatcgaggggccatctggatctttcactgtaaacaatgtccaagtgtttgctggctatgtcctgcatatcggttcatttctggaagggccggactcaaggcacttgtctgttggcgatgaagtgaaatgcaaggttgattcacacggcgtactctcattgctccaaaccacacatgtacccatatgctgaactttgctctaagggaagtacttggtgacactgttgatcagaaaggttccattgttcttccagagaagctgagatttgatttctcccatgggaaacctgttcagcccgaagatttgagaaaaattgagtatatagtgaaccaacaaataaaggatgagctggaggtatctgcacaagaaataaaattagctgacgcaaagcgcataaatggtctgcgagctgtgtttggtgaaatctaccctgatcctgtaagaagttgtatcanattggtcgcaaagtgggaagaatctgcttgcaaaccctgaaagcaaagaatggttatccatatcactgagctggtgggaaggacacacatttcaaacctagagatgctgcggcatttgccctcaatctg

SEQ ID NO: 4652 - DNA, 1070 bp, Triticum aestivum
  Clone ID: PAT_TA_4652
ccacgcgttcgcccccccacgcgtccacacaagcccgcacccgcccaccagagacacagagcaggcgacgcaccacccaggtccagctccggcgagatctccggcgacccttcgagatgagccgcggatcgggcgcgggctacgaccgccacatcaccatcttctcccccgagggtcgcctctaccaagtcgagtacgcgttcaaggcggtcaagtcggcgggggtcacctcgatcggcgtccgcggcaaggactccgtctgcgtcgtcacccagaagaaagtcccggacaagttgctggatgacaccagcatcacgcacctgttctcgattaccaagtacaccggcttgcttgccactggcctcacagctgatgcgaggtccttggtctcccaagcaagaaatgaagcagctgagttccgtaaaaaatggggatatgagatgcctgtggatgtattagcaaaatggatagcagacaaagcacaaatatacacgcagcatgcgtacatgagaccccttggtgttgttgccatggtcttgggttacgatgaagagaaaaatgctcagctcttcaagtgtgaccccgcaggtcacttctttggacacaaggcaactagtgccggactgaaggagcaggaagcaataaattttctggagaagaaaatgaaggatagcccccagttctcatatgacgaaactgttcagattgcgatttctgcattgcaatctgttctgcaggaagatttcaaggctaccgagatcgaggtcggtgttgtgaggaaagaagaccgtgtcttcaggtcactcacgacagaggagattgatcagcacctaacagccattagcgagcgcgactgagccatgagtctccagctgtcaatgaaccataaactgttattttgtttcatagccagccaagaaacattcagtgaatcatttcatgtgtagcaagaaggacaggcatccactctgccatgtattagttggatcatcctttgtgtggttgaatttgctacggtttaatttgatgttgctggcagttgcatgtttgggctgttttaaaaaacacac

SEQ ID NO: 4653 - DNA, 2196 bp, Triticum aestivum
  Clone ID: PAT_TA_4653
tccccaaccccgcacccgcgccgacacacgccgcaccccacgacgcgcaaacccgcacccgcccaccaggaggacacaggagcaatgcgacgcaccacccaggtccagcaccggccagcatcctaccgcgacacatagagagaagcggcggatcagccaggtgccaccgccggcaagtatcgcccttctgcccctagagcagcgagcaagcgcatcgggctcggtgtacatgccccgacaacgccatcttttctcgccgaggatcgccgctaccaagtcgagttcgcgtatgaggcgcgatccagacggcaaggctcacctcgataggcgcgcgccgccagcagcacgcccacgtgctcaacaaaaagcacagccgcaggcgagacactggccaggcccaggtccagatgcgcctagtcttccagcgccacttagagatgagcgctggatccggcgcggactagggcatccgagttacctgcttctccacgccgaaaatggactctaccaagtccagaaatatatgggggggatgagatcgctgggggtgaattcggtcgatgtcaaggactaggattgcgtagatgtagacacagcttagatactccaggacaacttggtggatgacacctgcatctcgcacgcaattgcggttaaaaagtatcagcgccttgcatgcaaccggccagcacagtttgttgcggaaggcgccttttggtctcccaacgaaagggaatgaagcagctatttttgcattacaaaatgtggatacagacagagttcatggatgtagtagctcaatggatgtcaggcaaagcacaaagatagacacatcgatgcagtaaaggagacaccagggctatcggcaccatgctctttgggttgatgatgaaagagaataatgctgagctctgccacgtgcgaccccaagagactgttcttttgttacaaggcaagccctgccacgactagaggcatgattcacgagatgaaattgatccggaaactcaaatttaggatgattcccagttaacatacgttgagtggtttatttgatttctagttagaaggataggcatcctctctgtcatgtatagagttggatcattcctttatgtggtagaatttgctactgtttaaaattaatgtcgcgtcttcctgtttcttacgacgagaggagattgatcagcacctaacagccattagcgagcgcgactgagctatgagactgtagctgtcaatgcaccataaactgttattttgtttcatagccagccaagaaacattcagtgaatcatttcatgtgtagcaagaaagacgggcatccactctgccatgtattagttggatcatcctttgtgtggttgaatttgctacggctatttctatcgtcttaacctgttctcagattatgtggtgccgcaacggattttgagattcaagtttgggctacacatgccgatgtgaaatatgataccactgctgtccgggaagcagttgtgaaagccatggaccgtttcaagggtctgccgataatggtattcagcacagacgaggcatcaaacaaggctgttatctatgcgggtgtacctgcggacgcacccaatgggttcaaggtgttggattggcttacgccttcaatcgcaccactcaaggggaaaggaggcggcggcaagaatggtcttgcccagggccagggaagtgatgcttctcgggtcaaggaggccatggagcttgctacccagatagcatcaatgaagctgagctgatttgttgagtactatatgtaaagtgtctgcttccttgagaagcagggtggaagcgtcgttccccatccctggcagcgacgacagcaacctggtaggttgagcgccaggaaatctcaggaccctgctggagttgtggacatatcgttgcaattggcggccctcacgccttggtgtttgttgttgttgttgtttagggtgattctgaggctgctgtgtatatgtaacacgacccgatgacatgtaacctggtggcctctgtatatgcttgctttctcattcttaataaagattggctatgatgagatgggaggcattcactggaaattcactgccgatggatgttactcatgcggagtccccttattgaacgcagcttgtggtatagaggcaaattttatgaaccatggaatcaaattctacagtcgat

SEQ ID NO: 4654 - DNA, 1419 bp, Triticum aestivum
  unsure (1)..(1419): unsure at all n locations
  Clone ID: PAT_TA_4654
gcgttcgtgaanattgagaaaattgaggatattagtgaaaaagcaaatagaggatgagctggaggtatctgcacaagaaataaaattagctgacgcaaagcgcataaatggtctgcgagctgtgtttggtgaaatctaccctgatcctgtaagagttgtatcgattggccgcaaagtggaagatgtgcttgcaaaccctgaaagcaaggagtggttatccatatcaactgagctgtgtgggggcacacacatttcgaacactagagatgccgcagcatttgccctcatatctgaagagggtatcgcaaaaggtgttcggaggataacggctgttactgctgagtgtgcctcacaggctatgaagttggcatcatctatcgatactgatataaatgaagcatctaaactggacggggcgacattggagaagaaaattgggtccatcaagaatacactggatgcagctgctatcccagctgcaaggaaagctgatctaaaaggcaatatctcaaagctggaggatcaacttaggaaggcgaagaagaaaatgggtgaagaaaatatccaaaaggctgtcaagactgccatagatgctgcagaagctgctctttctgaaggaaaaaccttctgtgttactcatgctgatgtgggtcttgataccactgctgtccgggaagcagttgtcaaagccatgaaccgtttcaagggtctgccgataatggtattcagcacagatgaggcatcaaacaaggctgttatttatgccggcgtacctccggatgcacccaatggcttcaaggtgttggattggcttacaccttcaatcgcaccactcaagggaaaaggaggaggcggcaagaatggtctcgcccagggccagggaagtgatgcttctcgggtcaaggaggcaatggagcttgctacccagatagcttcaatgaagctgagctgatttgttgagtaatatatgtaacgtgtctgtaaatttgtgaaggaggatggactggacgctccccctctttcgcagcgacgggatgatctttatgggttaaggtcgttgtgaaataacgattgggtttatcaattggacggtttgttttaacgaacgttccgaacctattaatgtttcctgttcttttttttgttgagactggtcttcatacatgtcaagtggctgcttgattggtcgttgtcaccctactttcacaaattgtgatacgtgaacataaaattattcccgaaaatcgactagaagcagtgtccgtttccacattgcaagatggtgtttaaggttcacagttgtcgtgtaattacagtttggtttatcaaatggagtgttatatttgacgaacgttacgaatctaataattgttccgaacactttgtcctaataatggttcatcacccgtggttcttgcc

SEQ ID NO: 4655 - DNA, 628 bp, Triticum aestivum
  unsure (1)..(628): unsure at all n locations
  Clone ID: PAT_TA_4655
tagtagtaccaccggagaagggggcaagcgcgcgcgacgcgacgcgacgcacgcgggagaacgaagccccccactcccttcctctcctcctcctccccgccccggcatcgaggctcccggcgggatgggcgcggggaatggcctgagcaacggcgccgcggccgcggccgaggcggcgcccgacgggaccacggtgttccgggccacggcctactcgccgctgcgcaccacgctggcgctggcgctctggctgggggccatccacttcaacgtcctcctcctcctcgcctccctcttcctcctcccccgccgcgtcgccgccatggtgctcggcacgcaagctcttcttcatgctcctgcccctcaatgacaagagcaggctggggcgcaaagatcgccaagattcataagncaagtacgtcggtggggtacttccccgtcactcctacaatgtggaggactacaanggcctgtcgaccccaaaaggagctttacgtgtttcggttnatgaaccgcaattctggtctgcccaatcggccttggggccctcctggaccttgttggattcatgccattaccgaagaccaaggttcttgcaagcaccgcggtgttctacactccgttcttg

SEQ ID NO: 4656 - DNA, 609 bp, Triticum aestivum
  unsure (1)..(609): unsure at all n locations
  Clone ID: PAT_TA_4656
gcacgagcaaggcaaatggccggcgagcatcagcagagccagggcgcggccaaggccctgtccaagggctcgccgtcgccgtcgttccgcctgcgcaacggcagcctgaacgcggtgcggctgcggcgcgtcttcgacatgttcgaccgcaacggcgacggcgagatcacggtggacgagctggcgcaggcgctggacgcgctcgggctggaggcggaccgcgccagcctggccgccaccgtcggcgcgcacgtgccgcccggcgcctccgggctccgcttcgaggacttcgagggcctccaccgcgcgctcggcgacgcgctcttcggcgccctcgccgacgacgccgaggagggcggcgccggcgggcaggacgaggaggagatgcgggaggccttcaaggtgttcgacgtcgacggcgacggcttcatctcggcgtcggagctgcaggaggtgctcaagaagctgggcatgcccgaggccagcagcctggccaacgtccgggagatgatctgcaacgtcgaccgcgacagcgacggccgcgtcgacttcggcgagttcaagatcatgatgcaagggatcaacgtctgatctgacgcacgatcgann

SEQ ID NO: 4657 - DNA, 888 bp, Triticum aestivum
  Clone ID: PAT_TA_4657
gcctcgtcccccctcccgcccgcggcacaggtggcatgggcatgtctcctggattccttgccaagcgttccagggagtctgcagctgcaagctttatgggtgacccgcagagcagtaacacttccagggagcaagaacatgttggtgctgcagcactactacctgacaagatacaagaagggcggagttcctattgcaccacaaatggcattgaggcccaacacggagcagcttccgttcatgatgtgagtggtcacagtgatgaaaacgggcacgcattcgtgggcaccaagaacggcatccatggtgaagaaaatggtagcaatggaacccttgatatgcatgacagcagttgccaaatggatgaaaacggacatggagttctggacatcaaagatgtcatcttcagagaacaaaatgtcagcaatggaactctcgatacgcatggcatggggtccgaagatgctgaccacgtcgtcaagtcacccgccgctcctgcccatgacggtctgcgatgaagattaaccacctcaaaatattttgatgagagtagcatggacgagcaatgaaagctgaaggtagataacccgaagaggagccatgggcaaggaagtggtagaagtggctgattggataggttacctgccattgcaaaaaattgatgatacagtagtagttttgcctcccctccaccatttttgttgtccctcgtggctcccacttgtcagaggggtggaggggtgtctctgggcctccacacaatttgcagaggctcagatgctcccctggtgccatgtttctctcccttgttgccattattgctaggtacatagcagagtgctaggcttaccttcttttcttttaccttgttagcttgaataaacaccc

SEQ ID NO: 4658 - DNA, 693 bp, Triticum aestivum
  Clone ID: PAT_TA_4658
ccccggtcgccccccgggtcggcgagaagggcctcgtgtactgcgtcggcggcgccctcctccagcacgggaccgcgcatccgccggtcggcccggaggtcggcgagtaggacttggtgaagtgcgtgtgcagcaccattggtcagaaaggagtagagcacctcctggacagccgccccgacatggccttcaaggaggagatcagcagggtcctgaacatcggcctcatctccgcgccctcgctgcccgtcaaccgcccggcgatgcggagcgtggtcacctccgtgcagggggtgcgcgccgacgcaaggcaaacgccggacaaggacgcgttgccccccccccatggctccgtcggctctgcctatcaggggacctgtgtgtaggtacaggtatgctacggagcgttgcacggttgccccccgccatcgctcgccgagctctagccatggaatcatggcccgtttacgccacaagttgccacgagttaagctaatcgggtaaatcgggagtgctgactttgaccgctgaaccgcttgttgccgacgcctcccccgccactggaacctggagttgatgtgtgctccggccggccggcaatggaggacaagtgggagttagggcatagctagctagcggcggtgttcttggttgtactagctgtctgtgggccgtgccattgattctggtagg

SEQ ID NO: 4659 - DNA, 722 bp, Triticum aestivum
  Clone ID: PAT_TA_4659
gccttctgtaccactagtagtggtactactacatctccgaagatctacagagatcttcatccccaactcggcggcagtgattgtttccaagatggccagtgatgaggattcactagatgatcaaaaccctagatcttggaccgttagcaacactagtgctgtgagttaatgctacctttactttcagaaaggaaagagtgtaccatgcacctaccgttttgatgttactatgtattctttttattttgatttctcagattaacaagacagaagaagcatccagcacggtccaggatcatcacccacaaaaagcagtagtgaacttcttaaaggatgagaataccaccaaaacgatccatgagcaatggcaagcaaaagctaaggttgcgtcgtagcctataagccggtgttatcccgactgagctttctattatccctaaactctcccatatgcctatagttaaatcattttctggccactcctcatgccagaattaatgttcttgaccttgtaaggccttttcttgaccttgtaaggccctccccttacgtttctcgtgccgccgggtgtctccaacctcacactttctccccccttctatccctcctgagctatctccatgcatattttgtctagcaatctagatgagacatgagagatgatattggaataaaagtctgtggtaaattaaattttaaaaaaaaaaaaaaaaaaaaaaaaa

SEQ ID NO: 4660 - DNA, 542 bp, Triticum aestivum
  unsure (1)..(542): unsure at all n locations
  Clone ID: PAT_TA_4660
cattcgcggcgctgtccgcactcatctcctctctcccgcgactctggatctcgccgccccttcgcctttgtccgcatcgccagcgcatcttcatctccggcggatgtagagatctcctcctccctccctccaccatctgtccgcatccttcgctttccctcccatccccagctctctggcgctcgcgctgctcggatgcgtgagcagattgaagcggcggccttccgtccagggatgagaaggaaggcaagacgaggcaggttcacatgcctgggaaggtccatggacgggatgatggcgggcaccgatgcgtgcttatcctgtagcctccactcttgtttttttatttagtatgagatctgtccccaacctcatttcctcatatggatgtgggttgtttatatattacgtggctatttatcagcatggattaggctgcgatatgtcccaagcttgtcttcccccaggattagagatggctggtgattagcatttaggctgagatttgtgnatttgttccttcacaaataatttctacatca

SEQ ID NO: 4661 - DNA, 1052 bp, Triticum aestivum
  Clone ID: PAT_TA_4661
gctctctccgctgccctcctcgtctcccccgcgctccccctcgccccccccgtcgccggcgtcttccgtcgtaccatgcagagcttctttggtcgcggcagcaggaaccaaaggacattccgccccaagaagagtgctccggcggggaacaacggcatgaagctgaagaggcacatcgacgccaccctcggcagcggtaacctgcgagaggtggtacgcctgccagtcggagaggatctcaacgagtggctcgctgtcaacactgtcgacttgttcaacccagcgagcggcccgctcgccaccctctcggagttctgcacgccatgctacttgccccaaccatgtctgccggtactaagtatgggtacaggtgggccgatggagtcaagatcaagaggcccattgaagtgtccgcgccaaagtatgtcgagtatctgatggattggatcgaagcccagctcgacgaagaatccatcttccctcaaaagcttggggctccctgccctccaaacttccgggacgtcatcaagacgatcttcaagcggctgttcagggtgtatgcgcacatatgccactctcatttccagatgattctcaagctccaggaagaagcacatctcaacacctgcttcaagcacttcatgctcttcacatgggaaagtcagtttatccaccgggttcaggtagctcctcccagggagctgatcgagcccatattagttggacactagccgagaagacaattgcagcttggtcgcgcccactgggcgtgcacacgtgctgagacatcttactggcgcgctctccaacttgggctgttgcgccagcagggccgtgccatcatgtgtgttgctggttttgcgagcttccccgccttgggcatgggctccctcctccttcttttcggggtgaggttggccttggctgctgtaccttctcactccctcccggagatggtgttgtctgccgcctgcccacgcgctcatttcggcggattgtcatttgattcggggaattctttcaaaaaaaaaaaaaaaaaaaaaaaaaaaaaa

SEQ ID NO: 4662 - DNA, 870 bp, Triticum aestivum
  Clone ID: PAT_TA_4662
gcacgaggcctcgtgccgcctcgtcccgcacctgtcccgcatcgagcgacccacccaacgccggcgccggcggtcgccctcggcaaccaccactcgagactcttctccgctgcccgagtccatcctccccccttgtaccccaggtctcaccaccaccaccaccaccaccagtcttcctcgtctccgacttgcctaacctaattccccaatcatgcctttgccgctgcccagatccatggtcctctcccctatctccttccatctccccgcccctatggatccatacgtcgccggcggcaccacccgacactccggccgtcccgattgggtcttactccacaattcggctcgtatctcgggacaccggaactcgaccaccgccggctgtcacacgatggagggccgccccatcgaggtgtccttctggctcgttgacccaccgggagtctcctacttctccgtccactgccctggcctcagtaaggacttccagggcgagccctacgttcactgcgcggaggccgctctcgtcctcttcagcgtgacctttctccccgtccctggccggagatccatccagcacttcgtctacagagccggcccgggggcgccctcgctggacctgattcccgacccggacaagatcagaagaggcgatcgatatggcctcttgccctgtggcgatgacaccgaccactacgccgtggtcttcctcgacaggaattttattgcctatgacaagccctggcgtttcaatgctcacgtctgcctgtcccccacatggtcgtgccgctgcgaggggcccttgtctcgcctttctgaagatgatcaggcattgctgcttaagcatggcacctgcaagccgccgat

SEQ ID NO: 4663 - DNA, 541 bp, Triticum aestivum
  unsure (1)..(541): unsure at all n locations
  Clone ID: PAT_TA_4663
gattacttccgcatccaggacggtctttacgacacctatgagaccgccggaaaacatgccaatggttgcatatgcaacctcttcctcaatgctcatcacaccgccaaagctgttggcaaactgcttgggtgctctgcatgttcatgtgctgctaaccctcgtgatcctcaggagccaagatcggaagataatacaaggcagaaagttcactgctgcgcttggccatgtgccgggagaactgcaagtggcaacaccccattggtcccaaacacagaccaagctgacggggaggccagcggatgcattcgcaagcttgcttctggtgctctcaacaccgtgcgtactgtcggtaaactcttcccttgctcatccttcccacccgttcatgatgatgtttctggcaagtcagtcctttgtggtgcctgcataagcaaggcacacagcaaaaacatgtgaangaagcacaaaattagagtttgatanggtggattatctataagaatgaagcatattgtnnaacaacgcaanccttatgtcaaag

SEQ ID NO: 4664 - DNA, 854 bp, Triticum aestivum
  unsure (1)..(854): unsure at all n locations
  Clone ID: PAT_TA_4664
ccgcacccgcccctcatggcctctcgctcgcggcggcggcggcggctcgccggggtccgagcctccgagggtgcggccccgtcgtggagacggcctaaccgttcgcagcgcggcgtggtacctgaccctgccccccgcctcaccggtcacgccgccgcacgcgggccaccgtcgcgccgggtcttcaccgccccacatggcccgttcagttccagccggttttcgccgctctcggcagcggtgacctggtcatatgctagttgcctattgagcgcgcgtgctttgctgcttccgtgtgctcctctcccaaggtcgaggtacttggatgagtgagtgagttcattggcttccccttccactctacactctccacctgtacgccccccctcctccctcagtttcgcagcagaatttaactatgagtgaaaataaagctaggccaatgtgcttttccagaagaagatcaaacaggcataggcacagcaatagcaagttgtaccactgtgtgtggtggacgaccttgtgggctcagatgtgagcacggcttcttgctgaccgggaactcctctatgatggcattgacccgatctagacggcccaggtccacgccgntactcctcgcttggcaccgcagctttaggggagaactttgccacttcctggtttggacaaggagagtaggaacagtttttgactgcctgacagactcggtacaatttgctaaaatttggttaggtcgatgtgccgatgtgtgtggggattgacatatgatgccatgcaattgtttagggtgaaagggagttgatttttaaaggttaccagaaccatgctttccttgcggaggcaaaaaaaaa

SEQ ID NO: 4665 - DNA, 492 bp, Triticum aestivum
  unsure (1)..(492): unsure at all n locations
  Clone ID: PAT_TA_4665
cccacccgatcgcgcccatgcagcaacccaaccgtgcatctctctctcgcactcgctcccccccccccgcgcccccccctccccccccccccctcccccgcccccacctcccccgcccgcgcccccccccccgcctccgccgccggcgcgcgccgcggcggggccccccgcggacgggccgccggggcgggggccgccggcctccgcccggcttcgggcggcgccgccgccgccgcggcgccccccgccgccgccccccagcagccgcagcatgcagccagcgtcgacgtcggcggccccatggacggcctcctcgtcttcgtcttctacctctcgcttcctatacgtggcggccgcgaccactctaattgctaagcctccccgccggatcggttcgccgccccgcgctccggaatctccgatctctctccgactctggctctgattcgattctcctccccggccggggcctcgccgtcgtaacgcgggggn

SEQ ID NO: 4666 - DNA, 1745 bp, Triticum aestivum
  unsure (1)..(1745): unsure at all n locations
  Clone ID: PAT_TA_4666
cgatgccgcaccagcggtccttgcgcacccctggcctcttaccggtctaagacctcgccgcggcccgagcctaacccctcagccccgccccggcgttacaacgcccacaggtctcgtctctctaccggtctctacgcgccttcgttggccgctgaccgcctccactcccccggggaacccgccgacccagggcatcttagacgactcggacctgctgaatctcagcgcctcctcctcctccgggccgcggtcgtctcttgaagggtccggcttctcggacggtcttaagggggatatgggcgtcctcggagccgcccgcaccctagggcagggagtcggcagagaggaccgcgtacgccacggccggtgaggcggccgcgggagcggcgtcgccgtggagggcggcctcctgatggtccccctccccctcaaggggctgcgccccgggcacccgctgcccctgccgggcgcgcgccctggcggacggcgtgttctgcggcgtgttcgaccgccgccgcagatgcggccacgcggggggcaagctggtgagggactacctccccttcatggtcctgagccaccggaacgcgctgctcctggcggacgcggacgcggacgcctcaagcgacgaccccgtgttcagcgacgcctcgccgtcgtcctccgcggacagcagcggcaactcgtcgccgcacccgtcgcacacgctgggggtgtggcgggaggcctgcaccaatgcgttcaagggccatggacaacgagctcaagctgcaggccaacatggactgcttcttcagcggcaccacggcagtgtgtgccatcaagcagggcaaggatctgatcattgccaacctcggcgactcgaggccggttcgtgcgaccatgtctcgggccgggtacctcaaggccagcacatgcgcaccgcccaccagcggcccggcctgcctgcagggcgcggtgagggtcaagaggtgcgaggggcgcgtgttcgcgctgagggaggagccgggcgtgatgcgggtgtggctgcccggcgagaacctccccgggctccccatggcgcgcgcgctgggggactcgaggctgaagcaccacggcgtcatctcgacgccgcaggtgacggggcaccggataagcgacgcggacctgttcatcatcctggcgacggacggggtgtgggacgtgctgagcaacgaggaggtggtgtccatcgtgtgcgccacgccgcggaagcagcacgcgtcgaaggccgtggtggaggcggcggtgcagaggtggaagaccaagtacccgtcctcacgggtggacgactgctccgcggtctgcctcttcctgcacgaccacagcgccgcagcggccaccaagctctagctagccggcgctcaggctccggccgttcgcctccatcttgtagtagtacatggttttccttcttttttgccggggttttgctttcttttttgcaaatacttttctaggtttgtccaagtgtaacatagtttcggctgaagaaaataactttcttatttgtctatgctgtgtgtctcccatcacactcacacaccaaataagaaatccacgccaaataatcgcaagtacgctccgctcgcgcaaaggcgcccccagttgaacactacatatgtttcccggaaaaaccgctatgaggntgcnctggtnaatggnaccttttttnccctganaggncganttggntaatntaggggaaantttggaanccngggaaa

SEQ ID NO: 4667 - DNA, 645 bp, Triticum aestivum
  unsure (1)..(645): unsure at all n locations
  Clone ID: PAT_TA_4667
cccaaactacatcgcgaacgcggtgcttcctccctccccgcagccaaatcgagatctctctcccccccgcccctctcccaccacacgccggccggccggccgcggcgacgacccaccagaggaaacatggcctcggcgctctcctccctccgctacggcgacagcctctcggtggtggccatctcgggcgccacggcggtgctctgcgaggccatctcctggctcctcatctaccgcaccgccacctacggcgccctccgcgcctccatcgagcgccactcccgcaagctcgactccatgaagtccgtctcctcgggcaccggcggcgcggccccctcctcccagccggcctcctcgcgcgccaagaagatggaccgcgtcgagtccagcctcaaggacgcctcgcgggagctctccctcgccaagctcaagtccggcgccgtcgtcgccgccgtgctcttcgtcgtcttcggacctactcaactcgctcttcgagggccgcgccgtcgccaagctgcccttcgcgcccgtcccgctcgtgcagcgcatgagccaccgcggnctcccccggaacgaccncaccgactgcgccatggtnctnctctacttcctctggctcatgagcatacggaccaacctncagan

SEQ ID NO: 4668 - DNA, 2189 bp, Triticum aestivum
  Clone ID: PAT_TA_4668
aaagagtattgaggaggagagggctgcagccacttcacttgctaataagatggttgagtctctaaaattccaggcagttctggttcgcctttatgaaggaaaggagcccattgagtttttcccaatatttcagaatttggttatattcaagggtggtgctagtactgggtataagaagttcgtctcggaaaatggcattcaagatgattcatattcagaaaatggggttgcactgttccgggttcaaggttcaggaccagataatatgcaagcaattcaagttgatgcggtggcaccatctctgaactcttcgtactgttacatactgcatgatggagaatacggtgtttactgtggattgggaacctaagctcgtcaatggaccaagagctcgctgagaggcaactagatgtgatcaagccaaatctccagtccagaatgctcaaggaaggatcagaatatgatcagttctggaagatacttggaataaaatctgagtactccagccagaagattgcaagagatccagaaagtgatgctcatttattttgttgtacttttttgaaaggggtgcttaaggttagagagatattcaacttcacacaagatgatatgatgacggaagacatatttattttggactgtcattcatgtgtctttatatgggttggacaaaatgtggacacaaaaatacgtgcacaagctttgagcattggagagaaatttctagaacttgacattccaatggaaaacttgtcacgagaaacaccactttatgtcatcaatgaaggaagtgagccccaatttttcaccaggttcttcacttgggattctgcaaaaacagccatgcatgggcaactcatttgaaaggaggctgtctatattgaaggatgggataaaaccaagaagagataaacctaaaagaagaacaacaacatcatcgcacactggaagatcaagtgtgcctgataaatctcagcggagaagtacgtctttcagccccgatcgtgtgagagttagaggaaggtcaccggcattcaatgcattggctgcaacctttgagaattcaaatgcccgaaatctatcaacccctccaccagttgcaagaaaatcatttccgaacgtgtggccccacgcgtggggtaaagccaccccagagagctgcctcgatcgctgcaatgtctgcttctttcgagcggcctagacaaactctgataccaaagtcaattaaagcgagtcctgaggtaaagaaaccacaatctgaagcaagcaaacccaagccagaggaagatgccaaggaaagtacccctgccacgaaggatgggcaaactgtgactccgacaatacaggaagatgtaaaggaggatcagcccgaagacgaggaagggcttcctacatatccgtatgatcgcttgaggacatcttcaagcaatcctgtcacagacattgatagtaccaggcgtgagacgtatctatcttcggcagagttcagggagaagtttggcatgacaaaggaggcttttgcaaagctaccaaagtggaagcagaataggctcaagatcgctcttcagctcttttaaaatgttatgctgtcaaatatgcactagttatgtcttgcctgttggtgaaagcaaggacgttgagattggttttcaaaggcaaatctcaaacacgaagatctctctcgcactcgtcgcaatgttaagaagagacatcggtaagtgtaagcctatctgggtcaaggggaccctcggtaggcgtcggaggggctggagcagtgagttttgagccgcccatgcccccgaattgtgtgttgtccactgacgaattctccatgtcgtgtgtcgggtcgctgcattggcggtctgctcacacacccctaattctttcctttccaaggtcaccggtttggttgtgagcttgcaacgctttttcgtcgcccacttgaaacctcaccatttgtttcattctttcatgctgtgtatggtttcctgacacaaataatgttacgtatatggtgtaagaagttaggtgatgggatgtgccggggcgagatccccttttgtcggaatacccaggcgacgaacggaagaaggcgtcttgccctcgaaatttgatattttaagtggtaattagtcgttcctgcgtgcaaattttgtaatcagatttacagtatgactttgttctct

SEQ ID NO: 4669 - DNA, 438 bp, Triticum aestivum
  Clone ID: PAT_TA_4669
tcgcggacgcgtgggcacctcgtaaggagagagacacttctcctccaaggaaggttagaaaggaaggagctcagaaagagacaatgagagctgggttgatgtcagcagaggaagttaaagaggacatcagaaagattaaggaggatgagaagctcaagtttgcagcacaggacccttcgttcactggtaaaggggcaaaggtagtgttccgagataaggaaggaaaaaggataaatcaagaagacatacagaaggcaaagaaagacgagaagccaaaggaaaaacatatagaatggggtaaaggtttggtgcaaaacgggcagaccaggctcgagtgaaggagcttgaagatgtgaaggatcagccatttgcgagaacaagggatgatcctgagcttgacggcatgctcaaaaacagactccgatggggtgatcctat

SEQ ID NO: 4670 - DNA, 619 bp, Triticum aestivum
  unsure (1)..(619): unsure at all n locations
  Clone ID: PAT_TA_4670
gcacgaggcctcgtgccgcctcgtgccgaattcggcacgaggcttcctctccccctctcctcttcctcctccacacgccgacgacacgcactccggccatcgatcgaccatggagatggagggcgagccgccgcaatcgcaccagctgctgctgcagggcatcagcctcgacctgcgcctcgaaacggccacggccacggccaagcgccagcaggggcagcgcggcgcacgccgtccggcatcccctccccctgctgctcccgcggccttcgacaacgccggcagggaggccttcgcctgcaactactgccaccgcaagttcttgagctcgcaggcgctcggcggccaccagaacgcgcacaagctggagcgcaccctcgccaagcgcagccgcgacgtcccctccgaaattaccgtcgccaccacgactgcttcctcttccacggccgcccgctggctccacgccggcggcggggagctctggggttactctgcttcggcccctgctccggactccgcgaggatggcgccactgatgagcatgggcatgggctgggctggcactggaagcaccgcnnnggccggcggggaaggcggtgnnnnnaatngacctgtcgct

SEQ ID NO: 4671 - DNA, 1335 bp, Triticum aestivum
  Clone ID: PAT_TA_4671
tctcctctcctcgccggcgccaccgcccccatgctcctcccagtgcgcggcctcccggccgcccctccccgcccgctcgcccacccacacaccgcccccgcgccgccgccctccctcctcggtccccggcgccgccgtccgtcccggaggctctccaaggtcgtgtcctactacggcctcaccactccgccgtacaaaaccgacgccctggagccgtacatgagcaggcgggcggtggagctgcactggggcaagcaccagcaggactacgtggacgggctcaacaggcagctcgccatcagcccgctctacggccacaccctcgaggacctcatcaaggaggcctacaacaacggcaacccgctgcccgagtacaacgacgcggccgaggtctggaaccatcacttcttctgggaatcgatgcagccggaaggcggcggctcgcccgaggcaggtgtgctgcagcagatcgagaaggatttcggctccttttttaatttcagggaggagttcatgcgctcggcgttgtcgttgttggggtctggttgggtttggcttgtcttgaagagaagcgagaggaagcttgaggtggttcacacgcgaaacgctatcaacccacttgcttttggagatattccaatcatcagcctagacttgtgggagcatgcttactacttggattacaaggatgacaggcgaacatatgtgtcaaactttctggatcaccttgtctcttggcatactgtcactctacgcatgatgcgcgcggaggcttttgtgaaccttggtgaaccaactatcccagtggcatgagatgatatggacatgacctggagttgtctctaaatatgtcaatctcacgagggatgccaaggaaaatcctgaaccacatcctactggatgagacggagagtttgcggggggcagcctgatgtaaccacgtcatgcaatgcacggtgaacaagtaagctctgcctggagataagacagctgatgtttcgtcgttgtcctcattcgtcgctacagggaagtgacctcccatttcaagttattatgcggtaaaagcagaaatggacgcttcagagcacgggcacttgagtttagactttagagtacgcgcccgcgatctaacttgtgcttgaagccacagaactttatgtcttcagaacaatctccccatggtgctgttagagcagcccctagttttccaccgacttgtaggcacagcttttcatcattctgttgcaacagaattcagccattgtgggccgaggcagattcccccatgaatgtttgccttgctcaaacatactcttctttttcatcaatagttgc

SEQ ID NO: 4672 - DNA, 758 bp, Triticum aestivum
  Clone ID: PAT_TA_4672
ggcctgtttcgccaccgccgccgcctaggtcatgtcctaccgccgccggctaccatggactggatatcggcgctgcgggagtcggtgtcgttcgaggggttcctatccgagccagtccagtggtataccatggcacatgtctgctggcaccgacggctaccatggcgcatgtccaatagccgtacaggtcaatttttctgccggctgcagcaggatctgccacctccaactgcgatgttgcgtgcattagcagttctggaccaatctagagttgtacgccattcttgcccatggctcgttcgtcggaagtgcaacacatatgggaggagccgagctcatatggaatggaaagcttacattgtgctaacttgaactgaatcacctaaggtgtgcatttgcgctgaccaatgggagcgtacatgctgcaaactgcatggctcgcagctctcaagttcagttagttgttagtctgctgataagccacgaccaacttaatggttcgttctagtactgggcattgtcatggtcagctttggttctaattctgtaattgtgctcagagtgtagtgcatcttgtagtagctgaatctgtaactagccttggtggccatgtaattcagctggatctagtatgttctcgccctagtactcgtgctaactagtgtcaaaaaacatcttacattatgggacggagggagtaattatctatgaaagtttcagtttcttgccctaaaaaaaaaaaaaaaaaaaaaaaaaaa

SEQ ID NO: 4673 - DNA, 955 bp, Triticum aestivum
  Clone ID: PAT_TA_4673
gcgggatcatcagcgccatcggcatatcgatagtggtcggctggggatacatactcggcgtcaccttcgccgtgaaggacataccctccctgctgagccccgacaatgaagctggagggtacgccatcgcccaggtcttctaccaggccttcaaaagccgctacggcagcggcgtcggcgggatcgtctgcctggggatcgtcgccgtcgccatttacttctgcggcatgagctccgtcacaagtaactcgaggatggcgtatgctttctcgagagacggcgcgatgccgctgtcgtccgtgtggcacaaagtgaacgagcacgaggtgcccatcaacgccgtctggctctcggctttcgtctccctctgcatggcgttgccgtcgctgggtagcctggtggcgttccaggccatggtgtccatcgccacgatcgggctctacatcgcgtacgcgctgcccatcttcttccgggtgacgctggcgcggaagcacttcgtgccggggcccttcaacctcgggcgctacggcgtgctggtggggtgggtggccgtgctctgggtggtgaccatcaccgtgctcttctcgctgccggtgatgtacccggtgaccagggacacgctcaactacacgccggtcgccgtcggcgggctcttcatcctcgtcttgacgtcgtgggtcgtcagtgccaggcactggttcaagggacccgtcaccaatttgagcggctagtttcacggtgtgcggaattgttgtggcggtacgccatgtgtcgggcagctgtcgggggggtttagctgtccactgcagctactgtgggccggttgtgtccagattcttaatcaaatctcgtagactacaaaggccttccacgggggaggtggaccaaatacgaaaaagctctattccatgtcactgtcatgagacacaatttaattttagaaagaatagagcta

SEQ ID NO: 4674 - DNA, 732 bp, Triticum aestivum
  unsure (1)..(732): unsure at all n locations
  Clone ID: PAT_TA_4674
ttcttcctcgcgccgccgctccccgctcgcctccgatcacgaactcggccccgtcaatggtcgccggcggctggcgtaaacccccgacgcgcgccggagtcggcccccgcttcggcctggccatgggtccggcgcccggcgactcgaagcggttctccggcgtggtgccgccggcggcgctcgtcttcctcgcgctggtgttcgtcgccggcgccatcgtcacgctccatcacaaggagaacctgtccatactgcaggtgcagccacgagagctggccgctaacgaggactcgttcaggtccgtgcccccggccagcgatctgcgcgtcgccggggacgacgtgaccgagacgccgtcggcggaacaggcgacgccaccggtggaacaaacgacgacgctggtggagcaaacgacaccgccggtggaacaggcgacgacgcangtggagcaaacaaggccgtcggtggaacangcgacgacccggtggagcaaacgacccgccggtggaagaagcccctgacatctgcgaaaancaatgcaggctccgggcagcgangcgctgccgagggcatcntgcaagacagtcaacttcaattcaatcnctgggcggcaacccgggcggaaggggtcccgcgggcggccgcgaanactcctggcgattccctcngatcaacaaaaggcgtctcaaactntcncaanttccgggggnaattccgngatctgtcatacaa

SEQ ID NO: 4675 - DNA, 1218 bp, Triticum aestivum
  unsure (1)..(1218): unsure at all n locations
  Clone ID: PAT_TA_4675
gcacgagccaattcggcatcatcatcgccgccaccaccaccaccatcatcatctcttcttctccaaataacaaatcagcgcttcgccaaatcccacccaccacctgctcccctcgcccttctcctaaatcgcaagcacttcctccgccttccgcgttcttgatgcaacagacagtcctgcgatttcagtagccaggaaggagaaagggggcaggcgccgttttctgtcctgagaggagatcttgctggtctagtcttggttgttgaggcagggagattaagagccgagggagggggagggagatgtctcgtggcggcggctacggggagatggggcagaagatcgactacgtgttcaaggtggtgctcatcggcgactccgccgtcggcaagtcgcagctgctggcccggttcgcgcgcaacgagttcagcctcgactccaaggccaccatcggcgtcgagttccagaccaagaccctccagatcgacaaccgcaccgtcaaggcccagatctgggacaccgcgggacaagagaggtaccgagcggtaaccagtgcctactacagaggcgcagtaggagctatgctagtatatgacatgaccaagcgccagtccttcgaccatatggcgcgggtggctcgaggaattgcgaagccatgctgacaagaacatcgtcatcatgctcatcgggaacaaatcggacctgggcacgctccgggctgtcccaacagaggacgccaaagagttcgccgagcgtgagagccttttcttcatggagacgtccgctcttgaggcccaccaacgtggagaaggccttcatgacaggcctcgaggagatataccgcactgtcagcaagaaaaaccttgtcgccaacgacgaggctaactccggcggggaactcgagcttgctgaaaggaacgaaagttatcatccctggccaggagccggcccctccggccaaggcagcatgttgtatgtcctcctagataccatcttgttcctggcaagtaaagtttctaagttgatctcgcagtgtcgacacgctgaatgggtgggattcttgggaggagggatgtaattacatgaataggtgactcacataaattgtaatcttgttgatgattagattttgtatccgattatccgggggcacactgctagcaccttccctccggtgtgggttcccatctgcccggccgttggngtctccccntngcc

SEQ ID NO: 4676 - DNA, 636 bp, Triticum aestivum
  unsure (1)..(636): unsure at all n locations
  Clone ID: PAT_TA_4676
ntgattacgccaagctcgaaattaaccctcactaaagggaacaaaagctggagctccaccgcggtggcggccgctctagaactagtggatcccccgggctgcaggaattcggcacgagaccgccgccgtccccaacgccaaatccctcgcctcgccgccgccgccctcagcgccgcctcgccgccgaccacttcccagagccgcctcgccgcagatcactgccctgcgccgcctcgccgtcgaccactccctgcgcctgccgaaacccctcccccgtgcggccgttcccccaagccgcctctccctccgccctcccctgtcgccggctcgacgctcggccagcgacccctgctgctccacatcgtcaaagcgctagcccacaagatcgcaggaaccatgtcgttcgccggcgtatccgtcgtcgccggcggtggcggcaggctgccgcggccgtccgcggagtcggacacgatctactccggctccagcgcggccagcagaggcagctcctactatcacctgcttgtggtggaagggtactcccgcatcaaggacctgcccaatggaggcacaatcatgggccgcactttcaaagctggaggctatcgatgggttctgagggtccatcccaatggt

SEQ ID NO: 4677 - DNA, 523 bp, Triticum aestivum
  unsure (1)..(523): unsure at all n locations
  Clone ID: PAT_TA_4677
tttatgttggaattaccgtcagattccaaatgacgatatttttgcggctttctgaggcttaatacagcttagctcttctacttttttttgtatttttaactttcttaacaactcctcctccactgccaagtgtcctccttcggaacctttgtagtttggtctgggatggcatccccagtcgcacttgttttttttcaagctgtgtgagtgattttaaacaggtctctagggattctctattatgtttgtttgctctgattttttttttgcatatagtatctaaaatgtgccaagttgccgcatctcaatgcttgtgttttacgtggttataagagactacaattctgttactaaaatataagggccgtgcttcangaatttccantgatctaaggtttgacaaacaagtcctgagggtccaacttccaagtacaaagncgggggaatgaaccggttactgtcccaaagaaggntgcaaagaatancaatgccctcctttccctangtaacaaaangcttacgc

SEQ ID NO: 4678 - DNA, 733 bp, Triticum aestivum
  Clone ID: PAT_TA_4678
cccacgcgtccgacaagagttccttcgcactgttgcaaagtagcttggctgtaagaaatttgcatagcatctttacttcaatccctgtggagtacttcgatatccgctgtttgcctgtttgcgagcgaatattgccgctatattaacagctcatcactgagaagcagagagtagaatagaccgtgaatagaacgcactgtaacaaatacttcgacagtagcttcaagcagagagtatagccttaccatgctgtaactgtaataaatactccctctgtaccaaaatcgtcttatattttggtacagacgttccgcatattttctctccaaaaatggttgtttttcccgctaattctcactttatctagtcaaaatagataacttgtgctttaatcaggggcgttactggcatgtcaaaaacccacatctcctacagctgactaacaacagggtaaacaaacagcgagattctgattctcaggaatccagagccacatctgattctcaggaatccacagccacagtgattctcaggaatccgtagcacaaataaattcagttatctacattggttcagatgtggcaaccttctattctcctcctttgcttcattcttcaaggtgctgttgctgctgatagaagcgaagtttggggctacgttgaaattcgtcacaaggcgcacctattttggtggtattacaagagcccacatcgggcgtcttcgcccataaagg

SEQ ID NO: 4679 - DNA, 697 bp, Triticum aestivum
  Clone ID: PAT_TA_4679
ccgaatcgaacgctagggtttgttccttccaccatcccctgtttcctccccaccccacccccgcccccgcccccatggccgccgccgccgcctccgcgggggccgccgccatcacgcggcgcctggcctcctgcaacaccggcgcccgcgagcgcgccgtccgccacctcctcgccgacttcctccccgcctccgcgccgcacctctccgccaccgacctcctcaagctctggaagggcctcttcttctgcttctggcacgccgacaagccgctctaccaggccgacctcgcctcccgcctcgccgccgccgtctccgccgccgcgacgcccgccgtcgccgccgacttcctcgccgcctacctcgccaccatccgccgcgagtggtccgccatcgacgtccaccgcctcgacaagttctacctcctcaaccgccggttcctccaccacgccttcctcttcctcggcgcccgctccttcgcgcccgacgtcaccgcccagatcgtctccgtcatctcggagaaggccgtcctaccggaggccgacaacgccaccggtcgtggactcgggtaccatgtcgccgatgtgttcctcgacgagatcttgcccgtgctcccggttagcttgcagtcgatggagctgctgttggcccccttcttcactgtgctggagaagtcggccgacagggtgctggtgag

SEQ ID NO: 4680 - DNA, 904 bp, Triticum aestivum
  unsure (1)..(904): unsure at all n locations
  Clone ID: PAT_TA_4680
ggggaacccctcgcgttgcgatgtcgtcaacggagatgcagatgcgattctgccggggatcaggggaaacagtggattcgtttcacgcctcccgctaccccagcccttccacggaggatccggcttgcctgctccctcgccgtgctcccactccatcctacgcttccacggaggacctaggggatctccatgattcgctggaggaggtggatgtagtcgaactcgacccccatgaccagccggcgcgcatggtcgcagatcctggtcagattgcctggcatgccctggacctcaagttcccacgcgaggagagcgaatcagactggagcgactggagcgagggcgatggccgactgattgacggggaggagaaagattgcccagggaatgaagtagtcgatagcgatgatgatgatgatgacgacgacgacgacaactgcaatgttcaagtcgtttacgaggacaaaagcccaaacacgaagataatctgcccaggaaagctctatcctgagagcgaagcagaggaaattgagctggaatggattgagagctactgcaagcagatgggagaatactcggaactgtttgatgacattctggcccgggaggaccacgacgattttactactttgcctccttttcctatgaaactgctccctcccacaacatctctatgcttcatggatggcgggtactgctaccacagtctttacaagagccatgatacttctaccactgcatcaactctttggatatcgcacaccgcaacagatgctacattctttcatgcgttacaactctgggctctcctatccattagtgtgtatggatactgcgtcncgacactggacagnacgaatacccttacgtctaaaatacgcgtaaaatgtatcaggatcttgcn

SEQ ID NO: 4681 - DNA, 873 bp, Triticum aestivum
  Clone ID: PAT_TA_4681
ttccgctccgggtctgttcctcccccctttgtctcatcccagttcctccccccaccaagaacctagggttagggttagggaggcggcggctgctttattcccgatcccgcccgatcgccatggtcatcgcaggcgagccagagccggaggaggtggccgtcatgttctccgataggttgagggcggaggaggagaccgtcgtcttccccggttgggtgatgctggatcgcatcggccgcacccactgcgacggcgacctaggagctgctcgtgaggctgtcaacgggaacaagaccgccgttcaagtcgagatggacagcggccactccttctacgtgtccttcaccctcgcgcctcctccacaaggggcctcttaccttgatctccactggccgctggaaggctcagccaaatccgtgcccccctacaagcagcctgcctatcccttcgtccgggcaatcgacaaggacctcgtcctcttccacatctccatcccgagcctgcctcaccgcaacttcgtcccgccagatctgttcgtctacaatgccgctggtcaccccccctcggtgcagcagctccctctgtacaggagaaggtcattcctcagggttaacttcaccacaggcatcctgcggcgccaaaacggcagctacatcgtttccgacctcaatgtctacccaaaaaaggagggcactggtaataattccatgtgcgccgaactctgcgtcttcaacgcctctccacccccgtcgagcttcgcctgccacgttgctccgcagccccaggaccagagcaatggccagttccccaccctctggtcaaccgaccatgtgcttgcttttgacggccgtttcctgtgctgggttgactact

SEQ ID NO: 4682 - DNA, 483 bp, Triticum aestivum
  Clone ID: PAT_TA_4682
gcaggtaccgggccgcggttccggggttcgacgcgcatcggcagccagcccacgcgtccgcccacgcgtccgcaacaacattttggcggcggagatggtcgatggggagatggccccgcctctgatgcagctggagacgctgctagcactcaacatggaccagcgcatggcggagaaccaagctatagaggacggaggcttcttcttgtgtccgtgcgaaagtgaagctgtaccgattggcagtggaaggagcggggaacgggtacatgaagcttggatgtaatctgatttaaactatttttaagggaatgcattacatcacgcagcaagttcagaccaagaaaactggcattctgattctctcaaatctaatggcaaaagttcattgtttactgaagaggcagatgcgctaacggtgacgatcagtacaaaggacaactcagccgtgaacattaaaagagcaaacaagattctcgttttgga

SEQ ID NO: 4683 - DNA, 1532 bp, Triticum aestivum
  Clone ID: PAT_TA_4683
tcggcccccgccctctatcccatccgtcaccccaccgctcccctagcttctccctatccaccgtctcctacctaagctaaagctagctagcaccactagaaagtagaaactactagtatcgattgctatttcagctgggcgactctcccaatctcgatccattccttccgattcttgcccggtcgatcgatcgcgggaccggccattctgcgcgttgatgcgtgcaagcggtctggttgcggaagatgaagatgaagagcagcagtaatctcgaggccttcctccacgccgccacgcccctgctcccatggcgctccgccaccatggaacgcttccagggcgcgcccagcagcgtgtggcagcagccggacggcaagagcaaggacgcggtggagtacttcgcgctgtccgacctgtgggagcactacgccgagagcagcgcctacggcctcgccgtgcccgtccgggacgccggtgaccgcgccgtggtcaccacccagcacttcgtcccctacctctccgccgtccagctctacaccgccacacagcccaccactcacaccctcggcgccacctccaggagcacggggagcgagacagattcgtggagcgacgacagcgtgggcgacaggttcgccggctcagggtcctcctcctgggacgccgcgtcagacgaagacgattcttcctccacctacgacggcaacggctccaccggcgtctcagcgaagcagagcggctacctgaatttccagtacagggagtgggactcgccctatgagagggtgccgctggctcacaaggtggcggagctggctcaggattacccatgcctcttgtcgcttagcagcgcggagctctccccgtccagctggatgtccgtggcatggtacccaatctatcacatccctgctcatgtcaacctgaagggtacctctgcctgctttctcacctatcattccatctcatcagtcttccaagacaacatacatagcgggccggaacacggtgagggtgagatcgcggcgctctcgccgtttgggttggcaacctacaggatgcaaggggacctgtggaagagaccagggtcatcagactataggaggttgtctgagctccactgggcggcggcctcctggttgaagcaagttggtgctcaccaccccgacttcaccttcttcacatcttctcaccgtcgataacacggcacccggtcgattcctcatgtgtttcgatggcattgcatcgggcaatgtgaagatatgacaccaaaaacttcatgtagggtttgatagaacaacacgcattggatttttcttctttctgaacttgcaagaagattcagtaacttgttgcatcgaccttctggattggattaagtgtcagacaacatgctctgttttttcctcatcgacgggcatgttatagctgcaaaacaacattttcatataattgcagctcgtgaaatgtgacctcaatgcctatagtttaacaatccacctggttttaaaaaaaaaaaaaaaaaaaaaaaa

SEQ ID NO: 4684 - DNA, 430 bp, Triticum aestivum
  Clone ID: PAT_TA_4684
cccaatccctcacgcgcgtccgcctcgccgccggcccgccgggaagatggccgcgtcggggtccgggtccgggtccggccagatccagccgctcaagatcccggacgccgtcgtcgcgctcgcgcaggccgccgccaaggccaacaacagcagcaacaccggcgccggcgacgccaccgacaaatatctccccgggtggccgctcttctcgccgcccaagatgcagctgaccaagtgcgccaagtgcccccgggagttctgctcctccgtcgccctccgccgccacacccgcgtgcaccgtcgcgccctcaagatcgacaaggatttccccaagaacagagaccaccttgctgcattctgggacaagctcacggtggaccaggcccaagcgatactgtccttggagggcgtggctatagaggagaccagc

SEQ ID NO: 4685 - DNA, 955 bp, Triticum aestivum
  Clone ID: PAT_TA_4685
gggtgggctccggtgcgttctcgcgggtgggcggggtggaattcggagaggacgagctggggccgtgagagtcgggcgggccgcgggcgtgctcaccgtgagcgcttggagcccacccacccacagtcccatacgacgcacgggcgtcgcgttgtagcggcacgccgccgacgccatgatcgagcagttcgtcaatttcgtcatccggccgcctcggtcagagtataacccagatcagtacttatgggagagagagtttatgctcgcagggcgaaggtataaacgactagacttggagctcacaaatccaaggggccataccttgaaatgcagccactatcttcctgcttccgttccagaaaatattgccctcccgtgtgtgatctactgccatggaaatagcggatgcagagcagacgcaaatgaagccgctgtagtacttcttccttcaaacatcacagttttcacactagacttttccggttcaggtctatcggacggagatcatgtcagccttggttggcatgagaaagaggacctcaaatgtgcagtatcattcctgcgcaccaacaagcaagtttcccgtataggcctttgggggcgatcgatgggtgctgttacaagcctactatatggagcagaagatccctcaattgctggcatggtattggatagtgctttcaccaacttgtatggcttgatgttggaacttgtggatgtttacaaaattccagttcctaaattcacggataacatggctgtacagtacatgcgacgaaccattcagaaaagagcgaagtttgacataatggaccttaatgttgtaaagcttgctcccaagacatttattcctgcattatttggacatggtctgagtgacatgtttattcagcctcaccactgcgatcgtattcaacgaagcatatgggggggataaaagtatggtaaaatttga

SEQ ID NO: 4686 - DNA, 789 bp, Triticum aestivum
  Clone ID: PAT_TA_4686
gggagaacggccggctatggcggcggtcagatccacgctgggaacaggagactgatgccaacgccatggagctactctgctgttcgtcaagcctcccaaagcaactgaaggtcgcttgctcctcatcaacaacatacaaagcttgggctgacctaggactacggctacggccgcttctctgaccacacgaccgaggagggcggcgtgtgctccagcgaatccagcctgttccgaagggtgagggacatgttacacctctacggtaatggtgtcgaggacaaggtcacgtcgctgttcacccggaggggcagcgggcttgcccggggacagtccaaggagaaccttcgggtcaaggtgcgagccgcggccggggaaagctgacgtggtcaggatcaggtggactgcagctctcatcggtatcttgatgtgcagaaattccaggattttgggacaccgggggcgccccctttcgctcgaggcgggcaggtgcatggcttttgcgatccaattgctcactggcgctgtgccggtcagatgtcagagctcccaccggtggcggtcagccgggcgcttgatgcccatgaccttccttcgagcccaaccgttcaggcgcatggtgtcccgatgccccaccccgtgttctggtttttcgcccaggtaccctgcttcccccctaataagaaagatacgtgttgtaccgcaaagaccaaagcttcgcgcaacatcatcctttagaaatctctacatgcaagctggtcgcgaatatgtcaaacagatttctaaaattct

SEQ ID NO: 4687 - DNA, 566 bp, Triticum aestivum
  Clone ID: PAT_TA_4687
ccacgcgtccgagccactgcaagtgattcaactccacctccgtatccactattcccccctggcctcattccaggaatggtccggaagatgcagatcggtagtggagttccatactctcccttgagcccgcttgacattcccacaaccatcccaccatcgaccgttcccgagtccgagatcctcgagcgcgtaacgaggttcttcaaggagatcggggaggagaacccgtcagaaggtccgatgaagcagggcgagcccggtgactacgatgactacgagagggagctccctgcccgcaagggaggtgcgtgcatccctccccccgccagcctgcacgtgaaccctgagaccgggatgcgcgctgatggctcgttcgatagcaagccggggtctagcggacggttgggccttggagcctccgctgatccgagcgaggcgagccaccagtatggcgatgtgtattcgtcatatcgcaagcagaggagcagcaactaccattcttccatcagttcccgcgcagtagcgccaaggtgaaaacggcggacgagcgacgagctatcccgttc

SEQ ID NO: 4688 - DNA, 552 bp, Triticum aestivum
  unsure (1)..(552): unsure at all n locations
  Clone ID: PAT_TA_4688
cggcctggccccggcccacgtccgctgctcccccggcggcccccggcctcccccccccctgccccccgccccccccctcccgttccgcccgtccgcctggcggggcctcctcgggcgcctcctcccccctcctccgtggccccccccccgctcccccgagccgacccgcggtcgccccgcctcctcccccccgccgcctcgcctgcccacctcgcggcgtcgtggggaggtgggggttgcgctctgggccaggagaacttgcggcgccaacacaccaatatagatccatgatccaaagcactgtccaaggacaancgctggctgcgctgcttgtagatgaaattaaactgtcctccggacttgacctgggagcatgcaataaacatgttatgtcgcgaacaaatgttgtcaaccatgctcaacgaaaggactgatgaatnaacattgtgctccttaaacggtatgcaaccatttattatcatatgaaattgatgaacaagaacaatatcaatgggaacaaaggataatttccttcaagtgcatcaagataca

SEQ ID NO: 4689 - DNA, 843 bp, Triticum aestivum
  Clone ID: PAT_TA_4689
gtcggcttataataagcactctggatttcctgccaaagggtgtgttgtgcaccgacatctctgatgatgaattgttccgcatcaatgcagctgtggttcaagcgacagatagcatattgacacgcagaaaccccgcggcccacacgatccgccttctgtccacaaggttctacttgagagatgatgtccccatatccattgggcgtgctgttggtcatgccatggcggcacacttggttgacaatgccaaattcagtgttatgacagggaagtatgagatcagtgacatggctgaggatgatctgatcacctctgcgagaaatttcatgttgttctttgatgcctgtccaagtgcatttggtggtctcactacccttgacctagagaatttgagatttggcgaatcagacatatccaacgtcctcatcacttgcaagcgcttgaagcatctgcgtttgtacaattgtgactctggtgattgcagcacgctgcaagttgaacacgctcatctcagtgagcttagtatcgtccaatgtatgcttgaacgagttgagctgaagtggctccctcaactcacaacgatggtctttgaaggttggctacaattccaagatccactgttcattgggtcatgtcccattgctggaggttgtaagcctcacaaatcttgcccttagttaccacaagatggtgttgttaagtgagtttcttagcggtacctctatacgagatctgaagttggcatttaattctgaaaagttggggctccagcctgcgtcgccgtcgccacgtctctcctccgtggtccgccatcctcgcctccggaatctgcttcatcttcct

SEQ ID NO: 4690 - DNA, 2434 bp, Triticum aestivum
  Clone ID: PAT_TA_4690
cccgagacccgtctgtgcatccctctcctgacctgtgcatggcaccgcccaagccttgggaggcgcacccgctaaaaaacgtgaaattgacgacaactcaacgaagattggggcattatttgccaaactcaacactggagatatatctccaaatgtttcatcaaaactcattcagatgtgcagtgcacttgatagtagtgattttgccactgcaatgcaacttcagattcttctgacgaccagtgattgggatgagtgcaacttttggctctcatcattgaagcgtatgatcaagacaaggcagagcttcaggagtgtaaatctatgcgtggtgcctgttgccgcagctagttcgtgtatacacctttttctgattgtcaaaattgttagtgttagcaatttggagggttggcgtgcacagagatgttatcctgcttcgtctgtcaactctaccgggccttcatgttcctggaaggggtctctcactctgctgacattccgttgccacgacacatggatggtctgtgttccgtggcacgcgtgcgtctagacttcggagtgctggtgatatgctaactgcgaccctatgttacatttgtgctggaaatattgataaagctgttgaaatatggtctcgcaacctgaacatctgaagatggtggaaatgacttatgttgatcttctccaggatttgatggagaagaccattactctcgcccttgccacgggccaaaagaggtttagcgcatctctatctaagcttgttgagaactatgcagagctgttggccagtcaaggccttcttaaaactgcaatggagtacttgaagcttatgggagcagatgaaaattcagatgagctgactatactgagagatcgaattgcattttctacagaagagaatgatgctaccaggagttctgttccagagagtagtgccaacagctcctcctacctaccaaatcaacagagctacaccccagacccttcccagaatctttaccaggtgcctcaacaatataataatgtgcaaagctatccagaagtttacccgcaaccacctaatagtagagccaatgtgccaagcaatacatatccagaagtttacccgcaatcacacaatgcagcctactcgggatatgctggatatcaacctcaacatcaaacacaaatgttcgtccctcaaaacacaccagtggacacccagccaagcccggctccattaccggttccacatcaaacagtgaagacatttactcctgcaaacgtaccgagtctcaaaaacccagagcaatatcaccaagcaagtaccttgggttcccagctctacacgcctcctgcgaattcatcatacgctcctggaccacccgcccagttccaaagtggacctcccaccacgtttcatcagcctgcaccaccggctcaataccagactgttccacccatcccttcagttccaggaacaaaccctaaccagatgtttacccctgctgttccgactaattcagcctctaggtttataccgtcaaccaatcaaggttttgttcagcggccaggcttgagtcctgcacagccctcaagtccaacacaggcgcaaccaccagctcagcctacagttgctcctcctgcacctccccccactgtgcaaacagctgatacatcgaatgtgtctgctgagctgagacctgttattgcaacactgaccagactatttgatgagacttccaaagccttgggaggtgcaccagctaaaaaacgtgaaattgaagacaactcaaagaagattggggcattatttgccaaactcaacactggagatatatctccaaatgtttcatcaaaactcattcagatgtgcagtgcacttgatagtagtgattttgccactgcaatgcaacttcagattcttctgacgaccagtgattgggatgagtgcaacttttggctctcatcattgaagcgtatgatcaagacaaggcaaagcttcagagtgtaaatctgcgtggcctagtgccgcagctagttctgtatacacctttttctgattgtcaaaaatgttagtgttagcaattcggagggttgccgtgcacagagatgttatcctgcttcgtctgtcaactctgccgaagcttcttgttgctgaaagtggtctgtcattcgggtgacattacgttttgacgactcaatagtttttccatgttcctttacaagaggatgcgagtcctttgggggtgttgttggttttggaaattataagttgtaagaggttacttagtctgtcatactagctggtccattttccgtacccttgaattgatcagtctggacctttgaaataccctggatgattgatggtattacagtgtcttgtctgttgcattggtatcaatatagatattaataaacccaaaaaaaaattaaaaaaaggccccta

SEQ ID NO: 4691 - DNA, 734 bp, Triticum aestivum
  unsure (1)..(734): unsure at all n locations
  Clone ID: PAT_TA_4691
cttaccccgnaccacccaatccactcgtcctctcccccaaaatttccccaatcttcctcctcacccccaatgtttctccttccgggtccaatcccagttcgctgggagtcaatcctccaatccaagccagtctttgttcatcgggagagtaatggcggccagtccatataaattcccagtatggtgtgcacctcactggagccatggcgggcggaggagcgggcggaggagcggaagccgctgatggccagcgagtcgaggccgtcgtgacggccggcggcgcaacacaaggccgcggaggatctggttctggaggtcgtcaccatgctcgtgtagtcaagtttcgaccacgttcgccctcatacatccgtcggcggcggcaattcagttgcggcgccaagatccttgacttggacgaggacataggggctgatggtgaagcaggtgtaggccgtggaggcgctgtacctggcgctgcaccggggcatgcggctaaccaggtcggcacggcagcaggtgttgggcaggtcagcgcatccgtaggtgttgggcaagacggcacagcgacatcagtccgtcctacggttgaccatgacgtagcggccgcaggtgttcgggatgttgcagagaagatgcacaagaactactagctccgtaagttggctggatgcaatcttaaaattgtttggcttttagtttggctggatgtagtaagtaggccggatatttttatg

SEQ ID NO: 4692 - DNA, 508 bp, Triticum aestivum
  unsure (1)..(508): unsure at all n locations
  Clone ID: PAT_TA_4692
ctcgtgccgctcgtgccctcgtgccgaattcggcacgagcagtagccctaccactactacggcatgcacccgcggtttgctgaaagatctcggcgctgaactgcacgcatgcgcggcgcgcttgcgcaaccaactcttcttccccgcctccaccgcttcctcggtcttgctgcccgccctcgccttgcttgtctgcggcaccgctctctcgagggtcgtcgtcttcttcctgccgctggtggtctccaccaccatctgctgcgcggcgatgtacctgctcgtcgcctcggggtccgtcggaagggaggggcggcgaaagaggtcgtgctcctgtggggcgacagggtgggaggtcngggctcctggaggtgtacggcggcgccaacgggaagcgcgtacggcgacaggcgcgaacgtccangtgggntgttttctgcaccgcaagccccccaaccggnggtgggcggaagcggcgggtggaaagaaactccggcgtcaacnaaaaaag

SEQ ID NO: 4693 - DNA, 592 bp, Triticum aestivum
  unsure (1)..(592): unsure at all n locations
  Clone ID: PAT_TA_4693
ctgcagcagcagcagcaggagtttgcccaacaacagatgcagcagtacctgcaacagcaagcaaaccaacaagtgttcagcgatcagaatggcgagctaaatcaccaggatgcaaggaagaggcagctggagcatggtcaacaatctgaagcatcacagagtgatgtttccaaattgcggagtgatgagcaatctgagttgtcctacccatcgactccacagtcccaacgttctagtcattgaagtaatccatgtaggttccaagccaaggatctatgaaattccaagtgattgatctaaccattcgacacttcgatccatcaaagcattttggaaaagggacgtttcatctgttccatgccctaacagtatgccgtgtctgagtggtgatgctgagcttcccctttcccctggtgcagaagcttgaatgcgcgtgattgcggttgctcaatctaacacattgaatgttggtgtcatcctatagcattttgtgccttcttcgagagcaacggccaaaatatgaaaaactagcntctgctgaaatatgaantcacgaggaatgtcagctgtgactganagtccccctgggtca

SEQ ID NO: 4694 - DNA, 925 bp, Triticum aestivum
  Clone ID: PAT_TA_4694
gcgactcactgccctcgttcgcagccgccctccatcccttcgccgccgccaagaccccgctggatctcaccgccgccgatctcctcgagaagaccctgccggatctcaccgtcgccgatctcctagagaagaccctgccggatctcaccgccgtcgatctcctcgcgaagatcccgccggatctcgctgccgccgtaactccataaagccgccgccgccgatcccctccggaagaccccgccggatcttgcgtcggggccacggttctggatcgccgtcgcagggcggtttcaaccagagccggcggccttgaggagaggagctcgacgagcgggcagggtgaccccatgccttggagacggcgaccctcaaccccttgctgctgtggtgcactgggcacatatgtgacgaggaggaggcgacccccttgtcatcaccttcctcgtccctctcgtggccgggcgcttgcacgcccgccccccgagccgagctctgttcgtccggtggtcgagctgtggtttcccgaccgggcctgaggtcggggctcctgtgctaggccccttatcttgggcccctacaataagtaaactcaacatgcgtgattctgattagaggcaacccgatcgttattgaacatattgatgattcctgttgtgtattctcaaggaatggtcagggttagtactgtaactattttcttatcaaatatatttgggtggtgctcaaaatgcagagctgaaaagcaagaaacgtaaagccacctctgaagataagttcaccatgcctcccagagtgtcaccccgcttcgttgaacttaatggaataagatcagatcagaataacctttgtaaactaggcaactgaatcatttcattgttgcttgtccatgtaacgaagaactatcatttgggtaccaagttccact

SEQ ID NO: 4695 - DNA, 931 bp, Triticum aestivum
  Clone ID: PAT_TA_4695
ccacgcgtccgcccacgcgtccgcccacgcgggcggcctggtgctttttctcgggcaaatccccccatggcgtccacggctggactccaaatttcccacggccactggttcaacaccaccctcacatcctcccaatcccacccttgctcccgctcctccttcccgcgtcctccacccggggattttttggagcgctctcctcctcgttgccgccgacgatgctcgcatgcggtggcggcggcgatcgtggtggagaagctggggcagcgaaggtctgttggaccttctctgccggtgcctcgacgaagccgcgaccgcttcttggcgcggcgggggcgtcagcagcctgctgccgctccctccggcggccccgttttcccggcgcaggcggccgacgcagcaaccgatcgcttcgcgaagaccttgaccagcctccctaagcctggtggtggagagtatggcaagttctacagcattcctgcactgaatgatccaaagatagataagcttccctactgtatccgtattcttctagaatcagctgtccgcaactacgataacttccaagttacggagagtgatgtccagaatatcatcgactgggagaagacatccccaaagcttgccgagataccattcaagccagcacggcttgttcttatggacaacactggcggcccagctgttgtagatcttgcagccatacgagatgtgatagcggagctagagagtgatcccgggggagatcaatccactggttccggtggatgtcgtcattgaccacgcgagtgcgggtggatgtagccaagtgtgccgatgccttgaaacaaaacatggacctggagtttagccgcaacaaagaaagatttagtttcttcaaatgggcgtcatctgctttcaacaatatgctggttctgccccctggttctgg

SEQ ID NO: 4696 - DNA, 908 bp, Triticum aestivum
  unsure (1)..(908): unsure at all n locations
  Clone ID: PAT_TA_4696
ccacgcgtccgccttcgtctctctcccccacccgatcgccgatccccaacccctcgccggcgccggaatcctcatccgccgcccacccgcccgcccgcagttctccctctcacctccctcaccaccatccaccgcagccgatctaccgccgcgaagtggccggccggccggcggactgccgcttgctcgaggacgccggccgtcggcgaccggggagaagggccaaggctccgctgccgtggtagctttccgcggcgatcaggcctcggggcggaagcgggaggagggagccggccgtcaccgtggaccgcccgtccggtgatattgaagcgaagacctgtggcacctcctgtaccttttgtatggtattgacaagaagttcaactgcctgggtgattattttgggataatggaccgcagtaacctacctcctggaaacacgacgcaaggaactccttatgctagtttgaatctacatggtaactccttgcaaatgcatgctccaagctcaggaaaacatctattcaaccaatctcagatgccagggagtttcacaatgcctatcaaccgggctacagaacatgataaccccggatccggatttcagtttgtagaacatggaaaaaaggatcaccaccagcagcagcagcagcacaaccatctcataaagaactccatcagtgacgacgaggagcatgatatgactgaggatgctactgatgcccagagtggcaagggcaagaaaggctcagcatggcatcggatgaagtggactggttcgatggttaagcttttgattaccgcagcatcttacacgggggnnngatcctggggcggatttgggcggcgggaggaggaacattacagtaatgcagangnnnnncaagtggaaagcaatatcaannntc

SEQ ID NO: 4697 - DNA, 689 bp, Triticum aestivum
  Clone ID: PAT_TA_4697
agctcctgcggtccagcgtctcctggccctctccgtgggtgccaccgcgggcccgctccacggctgggacgatggtgatggtggtggagcagaagatcttgatgacgacgatgatgaggaagacaccgatgacgatgatgaggattcggaggatgatgatgtgcgagaagagacggaagaggaattccttgcaagatatgctgctgctgctggcgagtcaatcgaggttgttgaggaaggagacatagatgaagaaacccaagacattgaactgggttccctggacgaaatggacatacaacaagtggttctttcactgattcagaaacatactgctctcctccaagcgcaggttttgccagatgacctaattgagagaattgcagaaacatttcctgaatatgagcagctgttgcatgctcaccaacttaggtgttagacttgtgcagattttcttttccaaacatgttttcctatgctagctttgcggcttttattagctttattttgtttgtcgttctttttggatactctgcttgttctttgtgctcgtgtatgaaatgatggtctacaatgtgttactggggtttcacacttttggtggatgaaaaatatcatttgttttacagtgtgttactggggtttcccacttttggtatataaaaaaaaaaattcgtttaaaaaaaaaa

SEQ ID NO: 4698 - DNA, 1982 bp, Triticum aestivum
  unsure (1)..(1982): unsure at all n locations
  Clone ID: PAT_TA_4698
gggcacggggncggcggttaaagcaagcaagcaaaatagcaaaatactagctaggaaagcatcgatcatggagatggagctaagcctaggcgtagccacgtccctgtttttggtttctgtcatctcagtgctggccttaagcttgcttattagccgcaaaagactaggcagcagcaagcggcacgaagaagaagaagcagcttgggcggcctgctcctgggccatggcgtctacccttggtgggcaacctccaccagatcgtgacgtccaagtctgccggtggtcctccgggacctggcggagaagcacgggccggtgatgtgcctccggctcgggcaggtggacacgatcatcatctcgtccccgtcggcggcgcaggaggtgctccgggagaaggacctcaacttcgcgtcgcggccgagcctgctggtgtcggaggtgatgctgtacgggaacctcgacattgggttcgcgccgtccggcgcgtactggcggacngctgcgcaagctgtgcaggatggagctcctgagcgagcggaaggtgcggcatttcatgcccgtgagggagagcgagaccctggcgctggtgagggcggtgcacgaggcgggccagggcggcaagaggcccgtcaacctcgcgctgctgctcgtctcctgctccaacgcgatcaccgagcagacggccttcgggccggtcgccgtggcgcgagctccagcgagcagttgctggcggccattaacgttggcatgacgatcagcagcgggttcagcttcggggacctcttcccggggctggggttcatggacaccgtcactgggctcacacgccggctgtggcaggcgcgccgtcagatggacgccgtccttgacaagatcatcgctaaaagcgagcagaaaggtgatgaccttctgagcgtcatgcttaggatcagggacggtggagaccctgaattccccatcgaaacgacaaccattaaggcaatcatagtggatatgttctcgggagggactgacaccacagcgacggctgctgagtgggtcatgtcanagctcgtgaggaacccaccggcgatggccaaggtacaggcagaggtgcggcgaacattcgacggcaagaccccacaagagcacgaggggcacatacatgagctacactacatgaggatggtcatcaaggagagcatgaggctaaacccggtgctgccgctgctggtcccccgaatctgccgggagacctgccatgtcgggggttttgagatcgtcgagggttccaggctcatggtcaactcatgggctatcggtaggagcccagagagttgggacgatcctgatgagttcaggccagagaggttcgaggacagcatggctgatgacaaaggacccaggttcgactaccttccattcggaggtgggcggagaatgtgccccggaagtacctttgggttggccgtgctggagctaatcatggcacgccttctctactactttgattggagcctcccaaccggtgggactgagcttgacatggacatgaccgtgggcataacggcgaggagaaagaaccagttgcacgtagtggcattgccgtataaggaggttccactgcaaagctgattcatatctttgtggtggacaatttacccagttgtgctcatttgcgtcatgtgcatttcatgtttgtcccggggaaatggacaaataaataaattgggcaatcgcctaactactactagtactattttagcgcggggttactccagcagatttggacgttcgagtaaagggaatgtggtgttgcacaagtgtatcatgtaatgtctatgggccttgggtggtgggctctacatttattgtttaagagattaaattgtgggttaaattaagactttgtgcatcaattgatgcggaggcctgtgtctttctccttttaagaaaagtgtttccagtaaaaaaaaaaaaaaaaaaaaaaaaaaaaaaaaaaa

SEQ ID NO: 4699 - DNA, 701 bp, Triticum aestivum
  Clone ID: PAT_TA_4699
gccggcccgtcgtccgcctccacgcccccacccgcgggcctccgccgcgtccacatctggagctcctcgaccccatcccgtccgcggcggtgaccagctgcagcctctctctctctctctctgctcggctgggcggcagtgaagtgggcaggcgatccactcatcctgatttctcttctcggtgtttcatccatcggtaaggacaagacacacataaacatcctggtcattggccatgtcgaccaccactggccatctgatctacaagccatccgggaagtcgatggcggcggcgctggagttcctgggggcgcagcgctcgacacgcccggagctgccgaagtgccatgggcaagggacaagacttgcatcgacatcgtggtcattggcgatgtcgaccaccactggccatctgatctacaagcttggaggaacaacttaaggaaggagtacagggagaagcaccctgacgtcaggcatgtcttcgtggtaagcgccttggtcccgttccgccacctgtccgccccctcctcgtgtggttggtcccaatggtgatgccgcccggttcccttgcgagccccccggcctgggctgggttggcctcggcgcccctgcccaccgtggtgtcttcaaggctccaccactcgccggttctcctaggatggttggacctgtcagcacaccctccttgctttcactct

SEQ ID NO: 4700 - DNA, 789 bp, Triticum aestivum
  Clone ID: PAT_TA_4700
cccacgcgtccgaccaatgttgttaaagaattgctgttatgtggctacaagccggatgttgaaccatatctttctatgattctacaaacctttagagcatccaagttgctagaactgaaaacgaagtcaaggatattcatcccagaaggacgagcaatgatgggatgcttggatgaaacccgcacactgaagtacggagaggtattcattcaagcttctaatagtgcaaatgacagtgacaagttcgtcgtaactggaaaagttgtcgttgccaaaaacccttgcctccaccctggtgatatccgtattctcgaggctgtttatacccctgttctggaccatatggttaactgtgttgtctttccacagcaggggccaaggcctcatcctaacgagtgttcaggaagtgatcttgatggggacatatattttgtttcatgggacccagatctcattccaactcgtatggtggcacctaatggactatactccagcaccaacagaaacaattagatcatgatgttatgaatcgaggaagtacatgagtatttcgcaaattacatagttaatgagaggtctgggaatcaattgccaacgcacatgtggtctttgcggatagggaaagcttgaaggctgaaagtacacaatgcattaagctggcagagctcttctccattgctgttgattacccaaagacaggagtgccggctcaaattccgcctgaactacatgtgaaggagtacccagattttatggagaagctcgacaggggttacctatgtatctgag

SEQ ID NO: 4701 - DNA, 1068 bp, Triticum aestivum
  unsure (1)..(1068): unsure at all n locations
  Clone ID: PAT_TA_4701
gcgctggggtggttccttggggcctcaccattcagatacaattgagacctgccagagcctcgccaatgcatacaacacgatgggaagctatgccctggccatggagttccaaaagcgagtgattgattcatggcgaaaccatggtcccagtgctgcggacgagctcagggaagccattcgtctctacgagcagatcaagataaaggccctagcgttcatgtcacctggtgatcaagcaatcgcgttgcctgaacctcaggaacaggaagtcgattctgatccggccaaagtcgcacaacagtaatttggaacttcacgtcgtgtactcttttcattctattttgatgccactatgcagtagaagaaatcttgacggtgaccgtggccctcccggctgtcgtcggtgccgtcgagaggatgaaagaaagttttgggccgaagcattatggggtagggtatgtgtataacaacctgggggctgcgtacatggagatggaccgcccccagtctgctgcacagatgtttgcactgggcaaaggaagtcatggatgtttccttagggcctcaccattcagatacaattgagacctgccagagcctcgccaatgcatacaacacgatgggaagctatgccctggctatggagttccaaaagcgagtgattgattcatggcgaaaccatggtcccagtggtgcggacgagctcagggaagccattccgtctctacgagcagatcaagataaaggccctagcattccatgtcacctgggtgttgaagcaattgcgttgcctgaacctccaggaacaggaagccgatcctgatcccggcgaaaaccgcacaacagtaattaggaacttcgcgtcgtgtacccttttccttcctctattttggatgccagtttgctgttcctgcagttagaagaaattttggctggtaaatttagcgcaggaggtagcctcctgtaccacccagcagatccgacattctatctaaagtaatccagacttaattancatgatgaagaataggaacttggntgaacaantgggtgaggagtttcaagcta

SEQ ID NO: 4702 - DNA, 637 bp, Triticum aestivum
  Clone ID: PAT_TA_4702
gcggaactgccccaaccacgcctgggactggagactgcccgccctcgccgtcgacaggcgccgcccctactacgcctggtggcgaggacgccccgcccgcgccgtctagtgacacctccccgaccacccctggtggaggctactacccgccaactccgtcaagcggcactgcaccaaccacgcctgggactggagactccccgccagcgccgtccagtgacacctctccgactacccctgatggaggctactacccgcccactccgtccaccggcactgccccaaccacgcctgggactggagactgcccgccctcaccgtccgccggcacctctcctagcacccctggcggtggtgactacccgccctcgccagccagcggcactgcgcctaccacgcctggtggcgggaactgccctccctcgccgtccgccggcacctctccgaccgcacctggcggtggctactacccgccctcgccagccagcggcactgcgcctaccacgcctggtggaggaaattgcccaccatcgccgttcggcggcaccttttcaacctcacctggtggcagctactacccaccctcaccataaaccggcactgacccgaacacgcctggtggcggttgctacccacc

SEQ ID NO: 4703 - DNA, 746 bp, Triticum aestivum
  unsure (1)..(746): unsure at all n locations
  Clone ID: PAT_TA_4703
agctacagtaccgcgtttccttagacggcggcgctccacccactcctccgccgtaccaccacttggngaaatatctagccagcctcccatccccactcaataatgctggtgctccttcctggatctcacaacaagctagctcaacgagtcaactgctccggccggccggcgggcttcgtgtgtgcgcctgcatcaatccccgcccggctactctgctgccaacggcacacgtccggttgacatctaaacatgtccgatgtcatggatgaaggtttatggtgcgagcgggtgtttagagaccatcaactctctgtgatgcttcccgtgggtggaacaatggctgtttatttcttcaactccgacggattgatcccacgccgatacaatgcaagaataattcgtactgatgagggtcgggatcttgcttggctgcgggctcaagatgtctatgaaccagtgacttgtctgaggttcttcgacccaccatatgcttctgggtggaatgttgttgcgctggccttataccacaattggatgggtcttctgcctctcttcttccnaaaaccaagggaacgttattcctggtcaaaataaaccaaatgaaccaagattnaaattgtccccttaacctgcaatttgtacnatcctaanccaaaggngcnatcaanggtcaacctccttaattttgncaaccgggataaaaanggggtaaatttgggggtggcttgccggnaccttccanaang

SEQ ID NO: 4704 - DNA, 768 bp, Triticum aestivum
  unsure (1)..(768): unsure at all n locations
  Clone ID: PAT_TA_4704
ctcttggctgacatagggaggcagatcctgtttttgacctaagtctcatcgccaaagagcaagaaagaagcttgggggatttgaataatatcttcgtgagcttgtcacctgcatctatggcgatcgctcagcacctctttccctattgcttacgctcattaagcagattcgtttggcctatccagaggcangtgtgagtgcagagtttttggagtattatattgccctggaaaactataatcaaagatacaagagcgaatacttgattcgagagatgttccctgcagatggactattcttagtgtctaaagatcctattatattgtttcaagcagtcaagcagcacatactgtaagtggcctcatatgatcgcattgtggtcattgcacagttgttgactgcagtactgcgcaagccagaaatcaacgatgacctctacctttcctatctcgccaaggaaatataagtttatggcaacgacacttcctcctcggaagtataactcaaaatgcagagagaacgtatcgaaggaatgcttccacagatcactacctctaaactattactcgaacgtgctttgtccattttacgccctattgccacatcatttcgtgccaaggaagttgctgaaatgatccgtgaatctctgaggaaaaagaagaaggacttcctgatttgggactttgacaaaaacatagtttccctgaacctgtgatcctacacatatcatacctgcaaaaaaaaaaaaaaaaaaaaaaaaaaaaaaaa

SEQ ID NO: 4705 - DNA, 1525 bp, Triticum aestivum
  unsure (1)..(1525): unsure at all n locations
  Clone ID: PAT_TA_4705
nggacgaggcagatggtggggaagcctgcccggggagcaccaccctcaccagcaccagcacccgcatcagcatcagcaccagcaccagcacccgcaccagcatcaccctccgggccccatgctctacgccgcgccgccgccccacgctgtggcgccaccgccgggcagcaatgctgctcggcatgggcgaccttatgcgcaagaagcggggccgcccgcgcaagtacgcgcccgacgggagcatggccctcgcgctcgcgcccctctcctccgcctctggcggctgccgcgccgcccccgcctccagcgccagcagacggcttctccatcagcagccccccgtctgatcccaacgccaagcgccgcggcgcccccctggctcctggcaagaagaagcagttcgaagcactcgcggtcgtggggcatctccttcactccgcacatcctctccgtcaaggccggcgaggatgttgcttcaaaaataatgtccttctcacagcaaggacctcgcacagtttgcattctttcagcaaatggtgcaataagcaatgtaacacttcggcagccagctacatctggtggactggtgacttatgagggtcgatttgagatcatctccctatctggttcattcctacttgcagaagatggtgacacccgtagcaggactggtggattgagcgttgcacttgcaggatctgatggccgggttcttggtggatgtgtagctgggcagctaacggctgcgacacctgttcaggttgtcgtggctagtttcatagccgaaggtaaaaaatcaaagcccgctgagccacggaaggttgaaccgatgtccgcacctccacagatggccacctatgtgccaggctccagtggccagccctccctcagagggcacatccagcgcatcatccgatgactccggcagccccatcaaccacggcgggatgccctacaaccactctggtgggcagcagcaccagcagcagcacatgccccctgcctacgcatccggcggctggtcgctctcggcgcaccatcagaacaacaacaggcatgacgctgacatgaagatgatgtcgaactaacaccgcatgctcaagccttcgaagagagccccatttgttggctgggctggagaggagctggtactgctgtaacgtctgccgtcgaccagcaatggccgacctggtagctaggagatttaggttcttgctctctggcatgctgtttttccctaagtaagattaatttagccgccgtctgtaatgctgtagctctcgctgtcactaacgtgagttttaatcttcatggtcatgtacctgctgagatcttcaccttctaggctaggcgtttgatcgctctcttctgtggatcatgaattctagaatgctttcagtttcaattcaagaactctagcttgtttaaaaaaaaaagtgcactgctgcttgagtgtgttgccagtcttctactgagatgtctgattgtgttttcagacgcggtatgggaatgggatggatcagta

SEQ ID NO: 4706 - DNA, 729 bp, Triticum aestivum
  Clone ID: PAT_TA_4706
ccacgcgtccgatcccctagcttcacattggccggttctggatctggtgcatccaatggatgtagcggcccggcagtctcaccagattcgccgcggtttgcaaggcatcctggatccctgggtgcagttcgtgaggtcgccgaagatgatcccagcggctgattccttgaagctgttctgcgcccagacgtcagcgattcagaagagaataaggccagcagggcggagaatgtgtatgtagccctggatgacaaggttggatgggttagcaggaaacggcgggatgtcatgccagacgaaagaccaacaagtgcagacagggtcaccgcgctggaaaaagctctaactgggtttgcagatagggattcagattctgttgtgactccgtccgttgggctatcatttgactcgataaatgaggcctatgaattctacaacctgtattcttgggagagtggatttggtgttcgctatgcaaagagcaggacaaatgtaaaagggacaaatacatgtagtagttcgtcttctgctgctcgggcaaaccaaaagaagcaaattcgaagtctacacggtgtcaatgccaagccatgataaggcttctccaaacggacgacgaaggctggtacatcaacgaattcaggtccagccacagccaccccatgcgcaaccctggtgctgtatcctgaatccacgcatcgctggtgcaaatggcacgtgctgaagaaggcc

SEQ ID NO: 4707 - DNA, 1262 bp, Triticum aestivum
  Clone ID: PAT_TA_4707
ggacagacccttggcacaacagagaaatttcagctcaagtgtcctgatttattcaagcattgcactgtcaagtcgatatccatccttcatgctttgactgacggaaaatggatgcgacactttaagagcaacctttcccaagacgctattagccagtttacgtccatgtggaatgacctgcagctggtgcagctatccgaagtcaggaagacaccttaacttggcgttggactgcaaacggccaatggtcctcctgctcagcatacacggctactcttactgccaacatcaaacctctgtttgctaagttggcctggagctccgatgcgccccctaagtgccagtttttcgtttggttggctgctcaagagcgatgcctgacggcagacaacctagcaaaaaggggatggcctcacaaccccctatgctctctatgccttcaagagccggaatctgctacgcacttgcttaccacatgctcatttgctaaggaaatctggcacttgacctttgacatgcttcatatgcaccacagtttgatggccaacaatggggagtccctcaactagctggggggcaacgctccagtttcggcgaatgaccaaggacaaggcaaagacttggcggtccattattgctcttgtgtggtggaacatctggaaagaaagaaatgcgagggtattcactaattcatcctgcagtgcaagacccctgttcgagaagattcaagttgaagccaaggattggattgatgctggtcgtaggagagttctacaacttgtcgagggacccttagaacctgattgatgtaacttacccagctatacccctccctattcttttcttgtaatttgtacctttattccttctaagcgcaatgaaaagcagtgatcctgccttttcgtcaaaaaaagagacaatgagtcacctaactgcatcggccgacagagctatgtccttccttccgaaagggaattaagcaacattttggaatagtcttcgtaccctacaatctatgttgaaagagtaagatgggtatgttttgcgccttgctatccatatgcaaaggagagaagagatcaaagccgcggcataaggagaaagcatggcaaggcaggaagagtagttggagctcttgattactttattgaacgaacccgaggctagagaataatgaggagaaaagaggataccttttttgaggattaatgacactatattcggaatctcatccacactaccaccttattatccagctataa

SEQ ID NO: 4708 - DNA, 893 bp, Triticum aestivum
  Clone ID: PAT_TA_4708
ttgagaagaatttggagtttgatctcgtccgcatcgacacattcaagaggcagcacaagcttcctgagttcatcaggctgcgcgatccaagtggacaagtgacattcaagcatggtgacaagactcttgtcgacccaagggctatttgccggtacctctgtacccagttcccaaaccagggaaacaggaacctctatgggactggctctctggaacgggcatcaatagaacagtggctgcaagcagaggctcagagcttcaaccctcccagctcggccctcgtgtttcagctggcatttgctcctcttctggaaatccctcaggaccacatggtcattgcagagaatgagaggaagcttcagcaagtcctcaatgtttacgacgaaatactctcgaagaatgagtacctggctggcgacgagttcaccctggctgacctctctcatcttccggactcgcagtaccttgtgagctcggagagggggatgaagctcttcacctccaggaagaatgtggcgaggtggtttgaccaaatctcgagccgcaaggcgtgggagcaggttgtcaagatgcagatggagcatcctggtgcctttgagtaacgccttggtggtggcaagcaagtattttgagttcatcttgaagagctctctacgtttatcgatcttactttcatgtgttctttggtcatcattgctacttgtgctgtcgtcgtttaccgaatcctcatccacgttttcttgtgaaccagaataatatgagccgtgatgtgttatgtacattgcgctgtttaaaatgcttttgccctgaacattgcgccgtgatgtgttatgtacattgtgatgtgttatctactgaataaaattatctgtttgtttttcaaaaaaaaaaaa

SEQ ID NO: 4709 - DNA, 552 bp, Triticum aestivum
  Clone ID: PAT_TA_4709
cggacgcgtggggtagagagaaggattgcttgcctagagttggccagtggaatatgatgaacaagaaaatggtcaatggtgctagagtcaggagctggctgtgtgtcaacttcgctcgaaatgtgcaagagagtatggctactggattctgccgtgaaccggacgcgtggggccaagcctcaggaatggactttgctttggagcctgttcttccggttatatacgtgcgccctgatcaagtggagagaggtctgaaagctaggttccatgatgcgatgaccgcgcttggaccgcagcgcaaggagatcgagttgcttattggaattctccctgataacaatggctcactttatggtgacctgaagcgtgtctgcgagatcgaccttgggctgatttcccagtgctgtttgacaaagcaagtgttcaagatgaacaagcaaatcctggcaaacctttctctcaagataaatgtcaaggttgggggaaggaacactgtactggctgatgcgttgacaaggcgcattcctttggttacggacaagccgacgatca

SEQ ID NO: 4710 - DNA, 470 bp, Triticum aestivum
  Clone ID: PAT_TA_4710
ccatcctggtgaactccttcgacgccgtcgagccggacgccgccagggtgctctctcacccggagcccgggcgccctccggtgtacaacatcggtccgctcatactggccgacaccggcgaggagccgcgcgctgcgtgcctggactggctcgaccggcaaccgcccaagtccgtcatcttcgtctcctttggctccggaggctcgctgccgacggaggagatgcacgagctggcgctcgggctggagctgagcgggcagcgcttcctgtgggtagtgcagagcccgagcaactatgtactgctagtgccaatcacatttattatttctcgcatattgacagttgacagggataggacctcgcagcttgcactagtggcctttgctgctatttttgacggaaattagattttttcgacaaaaaagtaagaatccccccgttcctaaaaaaaaaaaaaaaaaaaaaaaaaa

SEQ ID NO: 4711 - DNA, 1235 bp, Triticum aestivum
  Clone ID: PAT_TA_4711
cgcgagatgcccccttccaccccgggcccctccgcccccccgccccctgccacgccgcctcatgtcctcctcctcctcctcctcctcctccgggtggcaccactcttcccgtctcccgccgccgcctcctccgccgcccccgtccttctccgacaaggatcagctgttccgggggctggaggcggcgctgggcaccacgtttagctccgaaccgctggcgccgccgccggagccgatgatcctcgtcatcagtggcccgagtggcgtcggcaaggatgcagtcatcaagaggctgcaagaggagagggaagagatccattttgttgttacggcgacgagcagagcaattcggccaggtgaagttgacgggaaggactatcactttgtcaccaaggaggcgttcctcaccatgattgaaagggaggagttgcttgagtacgcgcttgtttatggggaatacaaggggattcccaagcagcagatccgtgattacatggccaaaggacatgacattgtcttgagagtcgacattcaaggagcagcaactttgagagagatacttggcgaatctgcaattttcatctttctagttgcagagagcgaggaggcacttgtcaaaaggctcattcaacgtaaaactgaaactacagacatgcttcttgtcagaattgcaacagccagagaggaggtgaggcggatgaaatattttgactacgttgtagtcaatgctgaagggaagcttgaggatgctgttaaacaggttgagtctatcattgatgctgagaaggcaaaagtccaaaagcgtaatgtcaagatctagttaaggctcatatgtccataactgtcactttgatcagtacaagttcgatctagtgcgatgaaattaggattgacagatttgactgactttgcttgcaacagtagccagaaagttcagcacagtgccaagtcatgagggctttacatactgagatatcctggagagttaactttcgcacaatgctgaagggcaatgtactcgatctttgctgggatgtatattcaattaacattctcgttcaaacattcctggctaaaaatttgcctttcttaataattttcagtttgtacttttagaagaaccctgtaaaactcccccgaccatcttctccctccgtcccataatgtgagatcttattgcatccaatatactcgcttggatgccataagatcttatattagagacagagggagta

SEQ ID NO: 4712 - DNA, 1081 bp, Triticum aestivum
  Clone ID: PAT_TA_4712
gcacgagggtcgccgccgccggcttggggagaccgacgagggcggcggcttggagagcaagatcctggcgatcaaggatttcttggaggaccccgaccagtcggaggaggagctcgtgagcctgctcctgcaccgcgctcccggggacggcccccgcccggctcgccaggggccggccctcgcccccctcgggcgtcgcccgcccgtgcacccttcgggtgacgtccggcagttagtgaagctgctcgtcaggaaatggaaggagatagtggacggctgggtgcggctccacaactctggtggtgacggtggaaattcgatcctaactgatggtgactctcctgagaagactcaaggcaaaagctaccaaaatgcccgggtttcagacttcaagtatacgcccagcccaccacagaggcacagtggtttgagttcagagcggtctaggaataacaatgggttcgagtcgacactggagaggcatagagcaagcccagctcctacgtatcatacgaagcagaacaatggcaataactattcaactacttcgtcatctgctccagctagggcgatgagggagcagaaggataatcatttggacgagaagctcgattcagccagaaagaggcttcaagaaaattaccaggaagcacaaaatgcgaaaaaacagaggacaatgcaagtgctggatatccacgacatacccaagccgaaaaataaaaacaccttcatccgcaagcctggtggaggtggcctccctggccgacatcggtgacctggtgaacatgcaaattcttagccgcggcaaggttcaaaatgaaaaataaattgagcacgaaaggtttatgtttgttcttttgtttagttacactggttatctggtccgctgaaatattgtccagcacaaccaagtcaagatataatactagtactactgataaaaggaccaaggttatatatttgagaatttgtgctgtagcttgttttttttaagaggtctcttgaatgtacctggaagtatttaattgagaatttgcgttaaaagtgacgtttatccattttaccgttataacgccgtact

SEQ ID NO: 4713 - DNA, 2194 bp, Triticum aestivum
  Clone ID: PAT_TA_4713
ttttgtcttttcctttttttgagggacgtccaaaaacttccgggtccagggagtgaagaaatgtatgtacaacaaaggaagcaaaggccccaaatttactcataagcaagatacatataagttagtgaaggcaggggggggatgagcctcaaaacaacatgatgatgatccaaacacgaaatgataagcgcgtcgaaaattcaaaatgtgcaaggaaacaacactgggtcagtcatctattacacaacaacaaaggcagtgccaccggggtttctacctccacgcttcgatccgttcgaccttggagtttatccggctcacgatgctcgcgcccctcgatttttcagctggaggagcggcgggcgttccgcactgccgcttgccctttctagtcctcctgctattcaggcctcggctccctctgctcggaagtaagttggcagctgtagcacaggaagcatcagcaatggcagacgaagcgacaagagcaggctgcgagcaactagcggacccttccacgctcgaccggacatcacttgtatggacaacggaagctatggaatcgccttccacaggaggcttgtcttcagcactgtgtgtaggactgtacacaataggctcctcgctgacaaaagaggggcgcccagatgtttcttcaggttgaggattaacggggagactggggttctgatggccattttcatcagatgggtccttctgtggcaaagaggcatcttccagattggactcttctctatccttgagggtcttctgtattagcatcttgaggaaattcatcacttgcaccgcgtacatcagtgcagtcaaagggtctgccatctgggtcatatttggagcgaaaaccatagcaacattgcgatcgctcatcttgtttatctgttcttcttggacaacatcagccatcaaattaacagcccagtcaagtaaggctgcttcagttggtggaaggcatttggcaacccgagcacagtcctcttcagattggcattgcatcacctgttcaggtgggatagaatccagcaccccactcggcagttccctaaaccaggctttgattagacccgccaaacagtgaacatcaatgccatccggcacagttccactatttaagtgatctctcacaaactcttcctggctattctccgcatttatacgaaaaataccctctgcccgaagacctccttgttcatacagacgtctttgcatcatcaagagaatcgtcggaacactgtttcctctggaatcatatgaacactgcatcgattgtgttgaaacgccgaagacactagcactggcactgggagcgcggcggggcacctcgggctcgaactcgacggggagcccgaggaatccatggaaccggtcgaacgtgacgtgcgccacgtgctgcacatccgtgggcaaccctatctccatcccgccctggccttggccgccgtcctccgctctgcaccggagcagcgacttccgcagcagctcgagaagcagcgccaagaaggaccagcgctcctcctcctcctcttcctcctccgatcctccggcctgtcgctccgcggatcctgcagggctctgggcgctgccggtggtgcctctctggagcacgtcgctatcggctaaatagcgcagggaggtggaggaggaggaggaggaggaggagccgcggcttgcgggcgaagcgaggttggtcgggccccggaacagcgccacctccgtcattgcttccgccccttttccgcccgagctccccttcttcttctcggggaattattacggtgcagccagtaatctggcgcggcgtagggccgattcggcccggaggtttgggatttccttccttgttcctgggtggtggtggtggtggtggtggtggtggggtgggccaaatgcctgggatgattggatcctggtagtggagttcttggtggcgggacgctaatttaggattgatttctgctccggtggctctccattagagattgctgggacggggaggggacgggatttgggtgctgcatgcggccgcgtggtccaaatccacagcggggcggggcggaacggaacgggtattctaatctgggctgcgctggggacaaaaaaataagaaaaggaatccaagtggatctgtgattagggagggtttcttgctgtggtggtgcgttgggtgggtaatggt

SEQ ID NO: 4714 - DNA, 590 bp, Triticum aestivum
  Clone ID: PAT_TA_4714
tcgagacaccgcaaaccctagccgtccgccgccgccgccgccgtccccggccccgccccctccctctcggcgagccatggcgctgcgcacactcgccgcccggatgcgttcctccgccctacagcgtgcctccgccggctccccgcgacctgccggcgctggcggcccgcgttcgtccaagggtcttctgcagcacctccgcgcagggtggacagcagggcaaaagacttgatttgaacaaggcaagtcaagaggaggtcctgcgtgaggtcgagttgattggcaaacagatagatgaagcctgggagggagtgaggaaggagaaagagaaggtgcctggcctgatgaaggacatgtttgggacaataaagatgtgctttggcgctggcattctgcttgagattgtgtcgtattccatccccatgttgcgccctgcagctgaagctcaacctgagcagtgacttgcgcccatactgcttatggtgtagctggtagctgcatgtctctactctgctgccagcgctctgaagtagtatatatatataacttatgtaacagaactccggttacggacgtctctctactctcac

SEQ ID NO: 4715 - DNA, 753 bp, Triticum aestivum
  Clone ID: PAT_TA_4715
ccacgcgtccgctagggcatttgtcccttaccccgccgccgccgcatcctcatcgggatctatcccgagccaacccgcgcctccttcccctcctcgattttgccaccgaaccaaccagcctcctctccctcgattcatccattcccgcagttcctccacccaccaacaggagcccgagctttttctccacgaccccaagcactcgatccaccgagccaaccaccttctccccttgatccatggccacctcctactcgagcaaccagcgccccgctgctttctctcccctgtccgatccggaggagaggagctcctccaggccccacctagcgcgatggtcgccggccacccaagcatcagcagcagatgagcatcgcggccctcctcttcctcctgttttctccttctcctcgtcgatcctcctccatctctcaactcccctcctctgcttcctcccgcgccagccggtccccgcggtcggcccccaccctgccgccccctgcccccgccgccccgccccgtccccgcccgctggccccccgcccccccccgcccctccacccgcccgcctctgccgccgccctgcccgcgacctccccctgcacctcgcctccccgacatgaactgtcccgatccgaccatctccggtggcctcctcatcgtcgcggcctaggcaaactacagacccaccgaaccgaacaacaccgctgcctcccctgccgacttgaatccgccggatccggtgactcttgc

SEQ ID NO: 4716 - DNA, 1039 bp, Triticum aestivum
  Clone ID: PAT_TA_4716
gcccgcccccccgtttcctcagccgccacaactacccactcctgattccggcgattccgccagcgttcccccgcccgccgcacccccccgctcccggctcccgcggctccggccgcccccccccgcgcggtgccctcccccgccgccgccgctcgcccctcccccccccccccgcgcgggtttcgccctcccccgccgcctccgctcgccccgctcccccgcccgcccctggcggcccgcctccctcgtcgcctgcgcccccgccgccgcccccgccgcctctggcgcctcctcgcccccggcggcgccgcccccccccgccccctcgccccctggtggtcgccctcgcgccggcccccgcccgggagctccgcccgcacggccccctggcccggcgcgccctccggccccccgtccgccggggcggcgccccctgcgcccccgtcctgctcgagcgcgggcacggcggacgcccgccctgcccctcatcctcggccttggcgccggggcgccggtacagcagaagcacgcccttcccctgaacaatcttcatggcgtcaggtcgtcctcctcctccacgcggctgttcccaacgagctctctcctccgggggcggtgaagcagcttgtccagcacccccttggcctcctatcctgcaccacatgaacgagctcaccgacggttgcgttctgccctcctagcgtgatattggttatggcagcattttcaacaagaaagacatgcgttttgacaactttggcatggacgggtggatctgctgcttggaagacccctagttggtgtgtggccgcctgataagagtggccatcgcttggtgggcgtggtgctggttgtagagtaggatagtgttcttcgtgacatgcttgtaaaattaaggttttttgggtctttttttccgctcctgtacaagtgtatttttggattctgttgttgtaattttctttttctaatgacatgagcatatactttctgtcaaattcttattggccgtaaattttcccatgggaaaaaaaaaaaa

SEQ ID NO: 4717 - DNA, 3485 bp, Triticum aestivum
  Clone ID: PAT_TA_4717
ctcttctccgcgactccgctgctccccagtacaccgtccccaccaaaatcccgctcccgaattcgccgccgcccccgcggaatcccccgccgcaaccctcccggagcccgattcgcccccccgccccgccgcccgcgccgtcgattcgcccgccccgccgccccgctgatccgcggcgattcgcgcggtatgggcgggtgattcgcggcggctcgacctagtggtcccccgccgcgggcatgtgggtgtcgctggtctggatccgcggctgcgtgggcgtcacgttcgtcgactgcttgggcgggaggggcgccggctagatctctcggctccggcggtccccgcgcgctccggcggtttcagggggtttggttggttggtgagtgctttgctctagggtttcgtcgggatggacatggaggcggccagagtggggtcgctgagccgatccctgtacggcggagggctgggtggcatgattgagcagaacgtgcgcgagtagcgggtgttcggctcagaccttaacgattggagatcgggatgcgagcgctgcgtgtcctcgccgctgcccgcggctcaaagccatggcattgaggtcaacagttggcgcaatttgcaacatcaagcgttgtcagggtatgattaggcccaattccttaagcggggactttctgtacaggccagcaatgttcgctgtgctgggtgtcgccgtggtctgcgtttgcgtcggaatactcctccataccctccccaaggtttatgctgcaccgaatttcagatgggagctgttagagcgcggagccatgtgaggggtccgggccagaataaggttaggtgtgttactgttgagagttttaggctcgagcggtccgccatctcacgtggagggctgctgcgcggtcccgtgcgcggcaaaggatgcccatccgcggcacaaggtctgcgagatgcatgccaaggccatcaccgcggtggtcggaaataccgtccagcggttctgccagcaatgcagcagatttcaccttcttcaagaatttgatgaaggaaagcgcagctgtcgccggcgtttagcaggccataataaacgtaggaggaaaacccgccctgaaaatgctgttggtgggactcctattgaggaaaaagttagcagttatttattgttgagtcttcttggaatatgcgccaattttaactctgacaatgctgaacatttacaaggtcaggagttgctatccaatctttggagaaacttggggaacggacgcgtgggattggatccaaaagaactttgtaaactcctggaggcgtgtcagagcatgcaaaatcgatcaaatgctgggacctctgaagcagctaatgctttggtgaatacagctgcagcagaggctgcaggaccatctaactctaaggctccttttgcgaatggtggtgactgcgggcagacgtcatctgctgttctaccagtacaatcaaatgctaccatggtggcaactaccgagactccagcatgcaagtttaggaattttgatttgaatgacacttgcaatgatatggaaggctttgaggatggttcgaattgcccatcatggatacggcaagattctactcaaagcccaccacagactagtggtaattcggattcaacatcagctcagtcattgtcaagctcaaatggagatgctcagtgtcggactgataaaattgtattcaagctttttgagaaagttcctagtgaattacctccaattttgcgatcacagatccttggttggttgtccagtagccctactgatatagagagccatattagacctggctgtattatcctgacagtttatcttcggttagttgagtcttcatggagggagctctctgagaatatgagtgtatatctggataagctctcaagtagttccgctgataacttttggacatctggtttggtatttgtgatggtacggcgtcaaattgctttcatgcacaatggtcaagttatgttggacagaccactggcacctaattctcaccattactgcaaggtcttatgtgttagtccggttgctgctccttattcagcaacagttaatttcagggtagaaggcttcaacttattcagttcttcctcaaggctcatttgctcaattgaagggcgttgtatattcgaggaagacacagctattatggctgatgatgctgaggatgaagatattgaatatctcaacttttgttgttctctccctgatacaagaggaagaggattcatagaggttgaagatagtggatttagtaatggtttcttccccttcatagttgctgagcagtatgtatgctctgaggtttgtgagctggagagcacatttaagtcatccagtcttgagcagccagacaaggacaatgccatgaatcaagctctagagtttctacatgagctggggtggcttcttcatagagttaacataatttctaagcatgataaagtggagccgcctgtacctgcctttaacctgctgagattcaggaatcttggtatatttgcgatggagcgggagtggtgtgctgtgaccaaaatgctgttagatttgttatttgatggatttgttgatgctgggttgcagtctcccaaagaggtggtattgtcagaaaatttggtacactctgctgtgcgaggaaaatctgcccgaatggttagatttctgctgacatacaagccgaataaaaacctgaaggaaactgcagagacatacctattcagacctgatgctcggggcccttctgcatttacgcccctccatatagcagccgctactagtgatgcagaggatgtattggatgcattgactgatgaccctggactggtgggactcaatgcatggagaaatgcgcgagacgagataggctttacccctgaagactacgctcgccaaagaggcaacgatgcttacatcaatctggtccagaagaagattgacaggcatcttggcaaaggtcatgttgtccttggcgttcctagcagcatgtgccctggaataaccgatgggttgaaggcaggtgatatcagcctggagatctgcaaagccatgccaatgacaacaacatccgccgcaaggtgcaacatctgcagtcgtcaggctaagatgtaccccaattccttcgcgaggaccttcctgtacaggccagcaatgttcactgtgatgggcgtcgccgtgatctgcgtttgtgtcgggatactcctccataccctccccaaggtttatgctgcaccaaatttcagatgggagctgttagagcgcggagccatgtgaggggtccgggtcgaaataaggttaggtgtgttgctgctgttaagagttttagtgtggtggttagatcaaacaaacatgtaagtgtgtgaagaagttccgttgtatttaaaaattgcagaatctttgcgctgatataaatttcatataccgtcaataataaattgattgtacatgcggctgttt

SEQ ID NO: 4718 - DNA, 2115 bp, Triticum aestivum
  Clone ID: PAT_TA_4718
gcgcgcgcccccccccccgggtgctccgccggcggtcgcaccacaaccaggcgcggcaaatcctctcagagatgaagaggcgcccgcttgcgattgcggccgcgctgggctacattggcgcgaccttgttgtcgtgggcctcccccgccgcccccggcgtctctcgcgccccgtcccggtccccggaccttggtacgctccttgcgagccccgcgcgcaagatcctcgcggtcagggaggcgcgcgccagcgcggacggcggagagtaaaggtacgattacgaacaatataagattggctccaagctagaggtcctcccacggtgccggaatgaggttcgggtcgcagccgccgagactttcgggtgggagatcaatggcgacatcaactacaactggataaggtggctggacaacaagcaagagcggatcggcggtacgtcgtctgcggggaggctatttctttactacaactataagtctgtcttctgctgatcgcgccaactaggtgctgaatgcatggctgactttcggagaagaggctggtgcatcaaagttatagtctgcaccatgttgctggaaaaagtttcgggtgcaggacgccaagaatttcgggtgggagatcaatggcgacatcaactacaactggaaaaagttgctggaaaacaagctggagcggatcgtcggaatgtcgtctgtgcggaggctaatttcttccgacaaggatatgtttgtcttctgctcaccatgcgcatgagcgtgtgacggccttgccgactagtagaattttggaacatgagctgaaaatccgctgttgactagtctagctgaaagtgcgtgtacctgaagttgcggtagctgattattaccttgtagagggttaatgcttccaaattttttagcatcgatcttgagcatctcttggttctacggagcttagtcgttgtgccaaaagtcaccagtttggaattctgggaaaagattcaactgcctttttttagcatcgaccttgtcttattgattagatagatacagttggtgcagcagattgaaaaacctcgaaacgaaagctttctgatccctagggaagacggtcaaattggaagaaaatccacagactgacgaacccattgcctgcatcctgtagaagtataagataaccaaaagttcagcaaaataaagtctccacactcaccgccgtttcactctgttccttgcttcctaaacctgcacctgtagtagcttattgttatcctggttgttttgttgctatcaatattagtcccatgttttgtttccttgcatgcttactactacaatctatactactgctattgtcatatctactacttgtggttccctcaaattatgtatatctgctattgtcatatctctattcacatgtaatcaaacatctttgtactactgttgttgttgtatggcaaacaccagaggcaaatcatatttgtgatgcagtttctgtaacttggcgtttctacatggcttgtttatattggcaattatacactgatgatgatgtttacctgcattgcttaattttgtttatcttgatcttgacagaaaaacatcacatgtttcttttctgtctaagacataacaaacatgtctttttcattgttgagcttaattataggctcttgtgcagcagcaaccgttgatttcaatttcagctgatcaatcatctgtccttgtgcagcacaagggttccatggggatacaacagcagcaggacgaccatgactccatcaattgcaagctccagactcgaaggaggccctatgcaaggcaccaaggtgcatggtgctcgcaagcgacgaacggaggctattcgacatcggctacacaaaccaccattgagctccaggtctatgaaatttgaagttcgaagctcatagccctactcagcaaagagccgtgtagactgtaaatattgtaatattgtaatagtaggcatatttgggttgtaatacactatgtacagattgtggtagacttagttgtatttggtaaactatatttgtatacctacttgtatttgagaactatatcttgactgtttcgactgaaatattgactatgtatgtgattagaaaac

SEQ ID NO: 4719 - DNA, 979 bp, Triticum aestivum
  unsure (1)..(979): unsure at all n locations
  Clone ID: PAT_TA_4719
ccacgcgtccgcgctgtaatacctattcttggtgaggcctctagccgataccagataaacgaatcggatcttcggatagaacgcttccgttctggtggacctggcggccagcatgccaacaccacagaaagtgctgttagaattgtgcacatcccaactggtacaacggcaacttgtcaaaatgaaaggtcacaacatatgaatagggcatcagcaatggcggtgcttcaatctaggttggaccagcttgagattacccgtcaagcgcagatgaatgcagagcacacgcaatcactctctgaaataagctggggaaaccaaataagatcgtatgtgctacagccataccgtatggtcaaagatctccggacaaactatgaagtgtctgatcccgattcagtcctggaaggcgacctggatgatttcatactgagctttttgtcattatcattggataaagttgatgaaagtgtctgaacacaaaccatgtttatcatgtattgttagcaccagcagaccgtgacagtgcccaactgacagtaagaggggctattattttctttactacactgacaaatacaacggacatcttgagtggcgaaaggtgcggtataactgtcaagcgccaaaatcagtgctagtttcctactatgcatgtacgagtctatatactgtattttctggtagtgaacgtaggtgaagcagttgttccagtattcatcctgccactctgcttaccaaagtagtagctttttctttttttcttttttgcattgccgtctgaaataagctgcaagctttctgttgctctcgctggaggtgaagaatgaagcatgcgtacgagtgagcgcagcagcatccatttgaatgctactgacatgacttacatttcacaatggtggcggtggctacagctacatcttacattgtcttagacaaaatcttgtctgtaaagtnnnncgtgttgcatgttcannnn

SEQ ID NO: 4720 - DNA, 835 bp, Triticum aestivum
  Clone ID: PAT_TA_4720
gcgagtggacgtacaacatctgcgtccgtccgcggaccgcgcttcgccggcgccggccgccgcggcgccctcctcctcgcgctgctcctcgccgccgcggccgccttactcccagtagccgagccttcctgcccccgagacaattcagtcgtgaaagatataaacaaaatgcaccagagcaactatggaattggaggattctcgcatataaccgtcgctggcgcgctagctcacggcatgaaggaggtggaggtgtggctccaaacaattagtgcgggccagaggacaccgatccacagacactcgtgtgaggaggtctttgttgtcctcaaagggagaggcactctcttgctggggtcgacctcactgccgtacccgggaacgcctcaggagattcctgtctttcagaatagcacattcacagttcctgtaaatgatccacaccaggtttggaattctgatgaacatgaagatttacaggtgcttgtgatcatatcgcgcccacctgtgaagatatttctgtacgaagattggagtatgcctcacacggcagcgaagttgaagttccccttcgtctgggacgaggactgcttagacgcacctaaagatgaactgtaggttggaaagtgctcacatggcagcgcatcggcctcagtcagcgtactggtcaagtgcggtgtacagcttgcctgcctcctaaataatgcgcatgtctgtaacatcctttctcttggaacaacattttcgtcacggattatgtactacttgagtgcatgaagcagccttctgcagcaagaactatttccaaattttgaattaaaaaaaaaatcaaaaa

SEQ ID NO: 4721 - DNA, 841 bp, Triticum aestivum
  Clone ID: PAT_TA_4721
aatttccaaagaggctgatcctttgttgcgtggccgctttccaaagaggggtttgtaccaggccttggctattgcagcgatgtgtttgcaggagaagtcaaggaatcgccctctgattagggaagttgctgctgctctctcctatttgtcatcacaaacatacgatgggaatgacgctgctgttcgccgttaccttgatggcccttcagcatcaaaagtgtcagacgatcaggttaaccaagatgatgctttggctagtcaacatggagctcaaacgtcgatgcatgaccgtatgaatgacttcgtcccagaaggaaaagaacattgcaggagtggttccaaccgtggaggacggggcagggttgttccaaacggtgtcgacagagaccgcgcacttgcagatgcgaatgtctgggccgaggcttggagacgccatgagaaggcaagcaaagtgcgtgtaaccgatgaaatcctcggatagtgagctgagctctgcttgatgttttggcatgctggcgattttgaagagagcgttgttaggagaggaggaataatgcgcagcgaggtgtgtagtactgcaccaccagagtgagcgctcgcaaggtttcaccggtggagcctgtcactgtcaccgcctccatcgtttcgctgcatacattacacggtctgaatttcacatgtaggtattgtttcaggggctttgtaaataaatgtaataacccccttaattgatggatcagtgtgtacaacccttttctcagtacaccggccccgccggccgccgccagagttttgtgtccatgtagatgaaatggcaacgtctttcagcaaaaaaaaaaaa

SEQ ID NO: 4722 - DNA, 655 bp, Triticum aestivum
  unsure (1)..(655): unsure at all n locations
  Clone ID: PAT_TA_4722
gcacgagggcagccccccttcaggccttcacacagggacacacacgcttcctcctccccttcttcgccgccctgcctcctccgtctcttcacgctcgaggcctggcccctgcctccctccattcggaccattgatccatgccggagcgctccggccgctgacaccttgcctcggaacgacgccgcaaaggttcggtgcccactgattgtgcttgccggggaggaggaagatgaggatgaagacgctggcctgctgccggcggcggccgcannacttcagcgtcgacatggaccaagagccggaaaaggtgacgacatacaatggcctcgagagctgcattttcaacagttcctcatatgatgaggatagtggcgttagtgcaacaacaggggcggatggctgtgtcaccgctgattcccttgaagatgaagcttcaagttgctcctccagcagagatgttgatggctcttccttctcttcccaatgccttccactgagcgagcatgaggagcattcacggggtgagttcgatacactcgatgctattcatctactccctctcaaagggaagaatccaatcacatatacgttgagtgctgctgatattgagatcatgaaggagaagtttgcaaagccactgcttggtgatgacgtt

SEQ ID NO: 4723 - DNA, 839 bp, Triticum aestivum
  unsure (1)..(839): unsure at all n locations
  Clone ID: PAT_TA_4723
gctgtcggtgttgttgggggcgtcattgcattggggctgttggctttgcttctggtgtgttttgtcagatataaaagggaaaagaagatggaggtgatggaacgaaatgcagaggtcggggagactttgcgcatggcgcaggttgggcggtcgcaagcgcctgtagcgttgggaacgcgaacaaaacctgtgattgagagtgagtatgttgcatagttgatttttggtgttctgcagaattcaagcaacagcaacaatgctctatgatgatgccctgagatgtggaattgtccaccggtcagttgaggcagaaagcattcgatgtcagtgagggtgctgtgaattgctaggtttagggttcagctgctgctccttgcgggtagcaaattcttttggcggttcttattaggacttgaattgttctgcaatggttactgttgatgttcatagtcgccatgttccttgttgggttcatctgcaagcaagcaatggagaagagatatttgtcatgcctgatttggaatccttcgattattttttcattgttgtattcagaaggaaaatgggcctggcaataaggctgaggtaatattcattgcacatgccattgtgctgttcccgtgaaattcatataggttccaactcaattccattttgggtgccttttagcttctcctgtttgggacaaatgtttaaatacaatgtaaatgtttacccatttaatttgggttgggtaactaatctgcttattagattcaatggttgctggtttaacatgccggccgtaagcagtgagactccttttctcccaagaaagntacatccggntgtaaaaaaaa

SEQ ID NO: 4724 - DNA, 697 bp, Triticum aestivum
  unsure (1)..(697): unsure at all n locations
  Clone ID: PAT_TA_4724
tccttgaagcttctccggctgcgtaccgccgggcaatgccacttcctgccgccgctgctgctgctacatctcgtccccgccctcctgctcctgccgccctcacgcccggcgttggcggcggcggcgacggtggtcacccacctgccaggattcgatggccctctgcccttcaaccttgaaacaggatacgtgggcgtggaggaggaggccggggcggagctcttctactatttcntctantcggagaggagccccggcaccgaccctctgctcctatggctcaccggcggtccccgctgctcggtcatcatgggcctggcctttgaaatcggtcctctgaagtttgtgttggcaccgtatagtggcggtttgccggagttggtgtctaacccatattcatggacaaagatggcaaacatactcttattggattcaccggtcggttccggtttttcgttcgctcgtgatcccaaaggctactatgttggggactactcgtcatcttcgcaggtccaaacatttctaaataagtggttcacggatcatccgcagtacctttcaaatcctttctacattggtggagattcatatgctggaaaggtgattccacttattgcacaaggcattttcagaagaattgacatgaggcagcaacctgtcatcaatctcaagacatatggttactatctggcttact

SEQ ID NO: 4725 - DNA, 453 bp, Triticum aestivum
  Clone ID: PAT_TA_4725
gggggcgggggtccgatcccgggggccgtgggttgggtgcgcacagcggagcggagcaggtggaggacgggggtaggggaccccacggcgcaagggcggggtggctgggctgggctggcggaggaagcgatggcgagaggggaaggcgaaggggaatgattgggaaagagagcggacggacaaaggaaagtgaggagaccaccgggcggccgcagcggggcgtccgggcgagagcggaactgtcgccgcgcgcgtgcgttgcgtgtgttgcgttgcgttggccgccgggcgcgggctgccctgcctgggttggacccgttggtcgcctactccctcaaccgccctggtggtgtaccgtgcacgccgtggcacccgagagcgcagctgccgtgctctaactgtgttttctttcttttttttttaaattctcaattgtcttttttattgggtaat

SEQ ID NO: 4726 - DNA, 1506 bp, Triticum aestivum
  Clone ID: PAT_TA_4726
cagcaatccccatgtgctctctgccccgctccgcctgatcccactcccagcacctggacccctccccctgctcgtccgcgccccattcacccacatccgccaccgtcctccatcccctgccccccgctctgccgggcgtcccgactcctcgccttcccaccgcacccccctgctcgtgcgtaccccattcatccacatcccccaccgtgctccatgccctgcctccggtgaacctgacgacccgattcctcgccaacgaactcctcctcagccccccactttcccggatcctcgtcgccccggccgagcagaaaccggagccccgccgcagatccgcagggaggaggaggggggagaatggacgccccgtcggtggcgctctacaaccagctcaaggctgcgcaaccattcttcttgttagctgggcccaatgtgattgaatcagaggaacatgtcatgaagatggccaagcacatcaaagccatcacgaccaagcttggggtgcctcttgtgttcaaatcaagctttgataaagcaaaccgtacatcgtcgaaatccttccgcggtcctggtctggaacaaggcctaaagatccttgaaaaggtgaaggccgcatatgatcttccagtggtcaccgacgtgcatgaaagcaacaagtgtgaaactattggaagagttgctgatattatacagattccagctttcctctgtcgccagactgaccttctagtggctgcggctatggctgggaaaattagcaatatcaagaaaggaaaattctgtgtttcggctgtaaggaccaactctagagagaaagttagacttgctggaaatcaaaatgtgatggtctgtgagcgaggcaccatgtttggctacaatgatctaattgttgatccaaggaactttgagtggctgagggaagcaaattgcccagttgtagctgatgtaacacatgctctacaacaaccagctgggaaaaagcttgatggtggtggggttgcaagtgggggcttacgggaactcataccatgcatcgcaaggactgctgttgcagttggtgttgatggtattttcatggaggtacatgatgatcccctgaattcaccatgtgacgggccaactcaatggccattgtgcaatttggaggagctgttggaagaattgattgcgatcgctcggagtcaccaaagggaagaaaccgctcaagatcgacctaactccattcaaggaatgatttggcagtggatagcaataggaataaccatgtggctgccaattggtttcaccaatgtggtcgtgtccaggcgagttggctctttgtatgcggtactttcatttaccgttggattcaagctttgttcgattgcctgcatgtattagttcctttccaagcgtagcatatcagccacagattgctgttttgaatcaccctgtctcgagagtcaacccgaaagaagtcgacttttttctttccaagcgtagcatagcagccacagattgctgttt

SEQ ID NO: 4727 - DNA, 561 bp, Triticum aestivum
  unsure (1)..(561): unsure at all n locations
  Clone ID: PAT_TA_4727
ccacccacagatcccccgccgtgctcgagcgcgagcgcctcctcgctccctcatccaagaagcaggcacgagcaggcgcccctctcccgcagctcgaacctgagcgagtcgagcgagcgcctcctcgcaccctcgtccacgaaggaggcagctctcaagggccctttttccccgcagcgaacccagtgggtcgggccaaacctcccgccggcgatctgcagcagcaccccgctggatgcaccaactccagcacaacaatggcgccgcccatggatctcagaactgccgctgtcacgcccgcatcattcggaaccttcaccgacacccgccgtcgcgatcctgcatgtgcgtgtcagcaccacaacaatggcgccgcccagatctcagaactcccgtcggcatgcccgcgtcattcgtcggaatcttcaccgacgcccgccgtcgcgattctgcatgtgcgtgtcagcgaggagcatctccccccttggccctcaactggctcctcgtcgtctcccttctcctttttgagttcaacaanggcgggngggngaagctccgttg

SEQ ID NO: 4728 - DNA, 245 bp, Triticum aestivum
  Clone ID: PAT_TA_4728
agggtaattgtcgaaattttgtgtgaagctttttcatcacgatctgctcagtgctggatgctgagcagagtgttgtgtggtacgctacccaggcattgaagaaacagtttttgcgatataggggaaaggaatatacatgcgatgttgtattgtaggtgacaactgttggcatttttttttcttgtaccagtaatgtaaattttcatgtgatgagttgagcgggcgactgcgccagtggatttaac

SEQ ID NO: 4729 - DNA, 867 bp, Triticum aestivum
  Clone ID: PAT_TA_4729
ctagctccgactcccccacctcaccgatcatcaccctcccgctcctgcgcccctccggccgccctcagggcaagctccgcatccgcgtcgcccttcgcgagcgctcgccgcctccccctgagccgcagtatccgcctccttcctcctccccctactatttcccagcccccccgcctcccacctattcggcaccgccgcagtacggctcagaccagtactaccgtcctagcgggtactactcagcgccaccagcaccgcctccttctcagtacgagtacaccacagggccctctgcacctgtggagtacggcaggcaatatgagcaaagaggaaggactgagggtgtgactgggcagtatgatccgagaaggactgaaggtgtgactgggcagtatgatccgagaaggactgaaggtgttactgggcagtatgagccaaaaggaaggactgagggtgtgactgggcagtatgaacaaagaggaaggactgagggggggactcccagcgaaaggtatggattaggcactgggcttgctgtgggtgcagttgctgggggcgttggggcgcttgcaattgatgaaggtgtgaagtataaggaggaaaaggcggcagagagggtgggagagaaggtgactcctgccgcaagggatgattacagcgagtatcgtcgagaatattgatgggagttcacgtatgtgagttggttcttctcaattcctgttaatgtgggaataagttgcagtgtgatttcgtggtttgctctgtatatgtatatatttgcttgagagacatgaattactatggtgcttgtgcttatggcctgcgcattatgacatatttggtctgtaccatgaatgttttgtgatt

SEQ ID NO: 4730 - DNA, 1499 bp, Triticum aestivum
  Clone ID: PAT_TA_4730
ctcgcccccccgcccccacccccctcccctctccacccgcaccagctccagcagcacccgctccccccgcaccagcacccccacccgcagtaccaggccccgcccccttcgatgccccccccgccgggggcgccccccaacgccatggatctggaggtcaccgtcgtctcgggcaagcacctgaagaacgtcaactggcgccgcggcgatctccgcgcctacgccgtcgcctaccgcgatccctcccgccgcaccgccacccgccccgacggcaccggcggctgcaagcccgcgtggatcgaccgcatgaccctacagcgcccgcccctccttccgccgcacgacccctcgatcctccgatcgcctcgatgtcttccactccataccgtccaagtcgcccaagccccgcggctgctactcccgcgcgccgctccgccgcttgctcttccctgacggccttaagtataaggaaggaaaaggcggcacgagaggctgggcccgaacgtggctcctgccgcccaggaacgcctccgggcgaagtaccgtcccagatcgatttgatcgggagctcgaagtgtgtgcgggtgcgctgtgagtttgttcttccctaattcctgttcttgtggcaagaacttccgctgctgatttccgtggctttgccccggtacggctcatgtccgcttctaccgtcctggcgggctctactccgcgcccccgccgccgccgccttctcacttcgtggaccacgcaccgcacccctgcgcctgtggcgtttggaacggtactctgagcaaagaggaaggactgagggtgtgactgggcagtatgatcccgagaaggactgaaggtgtgactgggcagtatgagccaaaaggaaggactgagggtgtgactgggcagtatgagccaaaaggaaggactgagggtgtgactgggcagtatgagcaaagaggaaggactgaaggggggactccgagcgaaaggtatggattaggcgctgggcttgctgtgggtgcagttgctgggggcgttggggcacttgcgattgatgaaggtgtgaagtataaggaggaaaaggcggcagagagggtgggagagaaggtggctcctgccgcaagggacgattacagcgagtatcgtcgagagtattgatgggagttcatgtgggtgaggatgcgctgtgagtcggttcttctcaactcctgttaatgtgggaataagttgcagtgtgattttgtggtttgctctgtatatgtatatatttgcttgagagacatgaattactatggtgcttgtgcttatggcctgcgcatatttacatatttggtctgtaccataaacgttttgtgattacctttgaagctgtacccgcaacttgatgtctgcataatttgtctctgatctgagttgtgtcttaagtctgttccattagtatctgtatatctggtttggtgcttggcattgcagtgaaattcaattttatgcttctttcagtcaaa

SEQ ID NO: 4731 - DNA, 1066 bp, Triticum aestivum
  Clone ID: PAT_TA_4731
gtcctcctgcagcccgtccatgagcggttggagcaccaggttaagagcaaggcattcttcaagtaattcatctcatccagaaggttgatagttttttcggtaagtcatctcatccagtagcttggtgcattacttcgtaatgaaaataaatcacatcgcctttacccaatgatttttgtccagaacaaatcatattatttcttttctacgagtactatatatgttgattattcagaggtctcatcttcatgagacttgcaaggccgtcgtcagcatcacggcccgcgggtgacggaggagcaggtgcagcgcgacctcgccatgaacaagattgactcgaaccacccgcgtcacctgcagccggtgggcgagcccgtcgggcagcccgtcaccgtcacttcggacgcgtacgagcccgtccgcgatgcgcacgccgtctgcatcctgaccgagtgggaggagttcaggagcatcgactgcaggcgcatgtacaatgtgatgcagaagctggctttcgtcttcgccgtcgcaacatcgtcgacccgtagaagctccgagacatcggattcatcgtctatgcaattggcaagccgcttgaccagtgcccagtggctgaaggacatgccagccatcaccctaggcgatgcacactaatagcagagcgtcgacgagggttcttcttactaattaataacaacacgtggttaaattttaagagatttcttatgttataaaaaccgaaacagatataagaggacttgtctgtagaactttttcttttccccctcaagcagacaagacagaagcatccaaaggagtcggtacggagagggcctaagcaaaagcagagggcagatcaacgaggtagtacttgcactaatatgtttcatgcgagcttagtgcattcttattctattagttaaattttagatttgtacaactatgtttcacgagagaggacataattttacttcctattctctgttggattatttccaaattacaaggatacaagtgttcaaaagttacctaagtgaaacactgaacatgttagtttgatgacctc

SEQ ID NO: 4732 - DNA, 729 bp, Triticum aestivum
  unsure (1)..(729): unsure at all n locations
  Clone ID: PAT_TA_4732
tagcgtggtcgcggccgaggtacgagattgtccttactgannncttctgggatatggttcacaaggacgacgtggccctcaaggaggaggcccccccgagcaatcatgctgttgtgaaatgagatggatttgctaggcatagcttgctcgcaaacctgcaattctttcatgtctgggggaaatgtgaggtggcaggatggttacaagactcgaggggaataacaagcaaccaattaggatggggagatggggattaacaggttctggatttacttgggtttcaaccagccgcaagcggaggacctgcaatgtaaatcctctctccttgctcctgtcataccggttgtttaggtatctttctgttcttcgtaatttgcttcacccagtttagttagaacaaaagtgggggaacggaagccaagttctgaagaaggtatatttgttctggatgtgcaaatcttttgttcttgatgagtaccggatcagtggccaccaaaccttagtggtactaaatgatgaatatgtttccaatgatactggaggtctgagttttatcacctcctcgaaagaaaggggttatgcaattctctgaacttttagcatttgaaatgcaaacttgagtcagctctgtctgtggcactagttctatcatccaaaactgaattttacatctttgatcagagttaaatatgtacatgtacctgcaatgatgtcatttaccctatgctt

SEQ ID NO: 4733 - DNA, 724 bp, Triticum aestivum
  Clone ID: PAT_TA_4733
gccccctgttccggcggtcccgtcttcgtgtactaaagcgttctaggcagcagaaagcaacatcacgagagcaagcagccaaagatctgcaggagctggagaagtggagagaggaactcgaggcactgctaattgctgagaggtccgaattggtctgatgaatctgagcacgacgatttaacatttctcacgtggtgtagatagattgttgctcctgctaattgcatgccgctttttcatggtcatcgaattttcattgggagtgcccccttttcctgtgttccagttttcgtctagatttctgctgaatttggtttctggtgtgagcattttagtggatgcatggatcaagcgggattgtgttgtctcagttgtgttggatttatgtcaatgccgtaggcctcaaaatgtaccttgctgacgtggtctgtgtttgttgtctcagtagtctttgtctgaaccatggatgctaaataaatttctgtattttgtgtaatagaggtccatgcctgcttaacttctgagatttgaattcaagtaggtttgtctcaagcaatttagagttgggattcttgatctgataatgcgtatgtgccgttgcaaacttcataacaagtgttgagaaaaccagtcatacattctgcaaatatgtatatgaaaaatattactccctccatttctaaatataatctttttagagatttcaatacaatctacatataga

SEQ ID NO: 4734 - DNA, 813 bp, Triticum aestivum
  Clone ID: PAT_TA_4734
ggtggttaagcttgtgtttcatagccgggaccacgctactggcaatttggtttctcgagctctcccgtcgcaaccccaataagaagctgcctccagggccatggactctccccatcgtcggcagcctcctccacgtcgttggcgccttcccgcaccgcaccattgcagagctgtctcgccggcacgggccgctgatgcacctcaggctaggcgaagtcgccaccatggtggtctccagcgccgaggtggcggcgctggtcttgaagaccaacgaccttacgttcgcggaccggccgcgcaccgtgacgcaggacatcttcggcagcggcggcaaggacatcgccttcgccccctacggcgccgcgtggcgccagatgcgcaaggtgtgcgtcatggagatcctcggctccaagcaggcgaggcgcatggagcgcgtcaggaccgaggagatcggcaacctccttcgctccatcgtcagcgcctcggccggcggcggcgccggcgctacggttaacgtcagcgagaaggtggcgatgcttagcaacgatgtcgtttcgcgggcggttttcggcggcaaggtcgcgcagcgggacaagtacatccgcgagttgggcgaggccatggagctcgtcaccggcttctgcctcgtcgacatcttcccctcgtcgcggctggtgcggtggcttagcagcgtcgagaggcgaatgaggaggagctacggccgtatgcagagcatcatcgctgacatcctcgacgagcgcaaggccgcacgagctgccggcgatggctcctgcagcaccgacgatgaggacc

SEQ ID NO: 4735 - DNA, 1337 bp, Triticum aestivum
  unsure (1)..(1337): unsure at all n locations
  Clone ID: PAT_TA_4735
ggcagacccactccccccgccgcccccccggccgaccttccctccgcgtcgaccaccggatctacctgccgccttatcaacgccccgctccacctcggtcttcgcgcctcgacggcttccccgtgctgccgcttaacccacacgccgccctccccgtgctctgccccctcaccaggccgtccgctccacccaacggggcggccagcgactcctccattctcccgcctgtgcattgctcgtcgggcgcctgtacccccccgcgagcggccgggatgggtaatttgttttgatcttgacgcaccactcgcgatgggaggtgattctgccggctgcgattcttcacatcttccaatggcgcagcgagaggaggcccacgaaggcggggacagtggaggtatggggcccagcgctctccttccccgaggctctgcagctcaagttcatgtcccggatattgacaacaccgacagtcaccgagagagcccccatctgaatcgcaacacactccaactccgtggcctcaaagggtccgacttggcaagatacccgaccgccgcgcctcattatcgggaaggaaaagtgctttggagaaggccatgagaaattatacagatcgggtaaagcctacaatctctcgtgcggtgtctgtggacagtttttgttcataacccttggagtgtgtcccagatcggagatcgccagaggaggaagacggcggcgagtgtacctccacgttgcttcttcgtcctcaagccaagatggagagaaatctgctgctagcgacgcagaatctgaagttccgaaggccatgccagacttctgtccttccaactccgtggctgggaaggggtggcttgggttacaagatcatgccgcaactgaactgcatgaccaagatatgcctgtcataacaggagcaactattctatcaagctcaatgaatgtagtaccatgcaaaagtgatcgaagcaggccaatgaacgcaagagcaaagctaggttatgagaatgtcagcaagccaagatcaaagttttgttccttttgcagaggtaagggccacacagcatcctgatacccctcaaagcgaggtgtaccaaagacacaaaggaaagtcccaaagtgtactaagtccggccttgcaggccatgagagaattccgtcccataaaaatttcaatttgttcccaaaagatgaaattggggttaggaaaatttgtaggcttcctttgtgtgttgttcncanataaattggngtgtaggcttctttgttgtcggaattaggtcanttgtacaattatgaanatnaacncgaatcntaggtggtaaattacctggact

SEQ ID NO: 4736 - DNA, 664 bp, Triticum aestivum
  Clone ID: PAT_TA_4736
gctacctcaacagcatcatccagtactgtagctaatccatgttatgatcacaagcctgacattctaaacagtgatattgccagtcattggcagaatttacaatatggacgattctgccaagatgcacgccccatgggtcctgtattatacccttttgcagtgcctccagggtacatgcaagggcatgttccatgggatgggcctggaagaccaccttcaccgaatgtcaactggacacagatggtgggtgctggccaaagagcctttcctatgatgcctctacagcctgcttcagaaagagttactgctgttcctccgcactatggagagcatgcacccagataccgtggtggaacaggaacctacttgccaaatcctaaggttccattcagggaccgagagcgtccctcgagttcaagatacttcagaggaggttataatagtgacaagggtgacaatagtgataaagaaggaagttgggcaaactcaagacaacgaaatacaggccgcaactatggacgtagccagtcagagaggtatggcatgaggtctgataggcagacaacacatgaaggtcagtttgacaggcagcgcagatcctatagaaatgactcacacaggcatgaggcaggtgctcaataccttggacagggtcaatctcatg

SEQ ID NO: 4737 - DNA, 498 bp, Triticum aestivum
  Clone ID: PAT_TA_4737
gaattcgccccgacggccatccccactcgagcgccgccgcttcgcacgatggcgacggggcacgccttccggcgcctggcgcggcggatgctgagcaacgtgccggagtcgaccgtctatgggggcccgcggccgcaggaggcggcggcggcgcggcgcgtgacggtgacgaccctccgcgggaagcaccgccggggggagcccatcaccgtcgtcaccgcctacgactacccctccgctgtccacgtcgactccgcggggatcgacgtctgcctcgtcggcgactccgccgccatggtcgtccacggccacgataccaccctccccatctccctcgacgtcatgctcgagcactgccgcgccgtggcgcgaggcgcctcgcggccgctcctcgtcggcgacctctccttcggttgctacgagtcctcttccacgcaggctgttgactctgcggtgagggtgttaaaagaatgtggaatggcatgcaatcaaactgga

SEQ ID NO: 4738 - DNA, 682 bp, Triticum aestivum
  Clone ID: PAT_TA_4738
gcgagcccgatgacggcgagaagcccccgaagtccagccttcccctcacagtcaccatcaccaagagcgacggcccaagtctcgacttcacctgcaccgcctatcctgacgagatcctcatcgataccttgtccgtgaagcagccctctgagaacttgggagaggactacattgcatacgagggtcctgacttcaatgacctggacgagaacctgcagagggcattccacaagtacctggagctgcgcgggatcacgcccatgacgacaaacttcctgcacgagtacatgatcaacaaggacagccgggagtacctgttttggctcaacaagctcaaggatttcgtcaagcagtaatctagagattgcaagttatgatccctagcataaagacgagccaatgtgctttgcacatcctgttctgaggccttcgggcttcggaactccaaactgctccgtgtttagtacacgatgacgatgtgtatgcttagcatcgtgttttagattgcttttttcggcagtgtggaaatgaccgggtgatgttagagttgaaaacctgggcagggcttcagatagaacacttcgttaagtagcgtgcatttttttctgaccatataattatgctctgtgtgcgtgaaggtttacgcaccagtgtttaaaaaaaaaaaaaaaaaaaaaaaaaa

SEQ ID NO: 4739 - DNA, 432 bp, Triticum aestivum
  Clone ID: PAT_TA_4739
aagcaaaacaatctgaaggctatgtgaggccaaattttctgcctagaattacccttgcaaacatatgggagccagcaagcagagaagcttgtgacaacaatatttgggagataataaaagcttcttttggcattttatttgccaagtctactctccagcattcgaagaactgatcatactttattccgatgattctgctcaaagtaatgagaaggagagttctgagatgcagatgctgccgccgcagttgaaaatttacgagaaaatacccatcccagatctgccagtggttttccctcacaaaaagttgtcattccgcatccttgatacagtaaggcttgatatagccaccgttataggattgttggcatatgttgtcaactacaaatttgagagtttagcctcatctccggcagctttccttcttgatct

SEQ ID NO: 4740 - DNA, 665 bp, Triticum aestivum
  Clone ID: PAT_TA_4740
cgccgctgctccgtccccgggccgccgccgccatgccccatgccggagtcggccacatctgcctccactgtgcccacccgacaccggatccagcgggaatgccccgccagctcggcgtggtgagcgttcggggctacggcgtccactgccccgatgaccatgggatggcacgaggatgaagaagagaggccagggtcagtgccagagggggacgccggcaggaaggctgccacacggagtcgtcgttgtcggggggtgacaagggcgctgtgactgggcagccggggcggcaaccggagcagcagggccggccttgggaagaagagctcgggaggacgagggagacagcctggaaatgaagagtgcgggaggacgacggccggagcagcaggggcgagctgccgctcatcgacggtccggcagcggccgatgcagctcgacagcgtgcgcgtgcactcactctggtcgtcgtcgagatccagattgggctcgcccctgttgtcatcctccttctcccattgcctccttccaccggcgaggtccactgccgctccaatcctccatggcgccgcccaaaaccagtgaacatagcccctgggcgatgtgctgcatgtttgttcggagctaattgcgttttacattttttaaaaaaaaaaaaaaaaaaa

SEQ ID NO: 4741 - DNA, 1071 bp, Triticum aestivum
  Clone ID: PAT_TA_4741
cggacgcgtgggtagaaaaaccacagccacgaatcagaggaaatccggcagcgccgcgtgtgcgaagacgagtccaaacacggaacaaagccggcgattagcagcacgctgagccggcatctcgtgcttctccgtccatctgcatccacaccggagcggggaagaagaaggcgacgagtaggcgatggcgaccgagtcgccgttccgggcggacgtgctgaggggcaaggcggcgctggtcaccggcggcggctccggcatctgcttcgagatcgccgcccagctcgcccgccacggcgcccacgtcgccatcatgggccgccgccgcgaggtcctcgacaaggccgtagccgccctccgctccgagggcctacgggctgttggatttcagggagatgtacgtaaccaggaggatgcagctagggtacttgcgtcaactgtcgagcatttcggcaagcttgacattcttgtcaatggtgcagcgggcaacttccttgcatccccggaggatctgacacccaagggattccgaacagttcttgagattgacactgtgggtacatacacaatgtgctatgaagccctgaagtatctgaaaaaaggtgggccagggagaggtccctccactggtggcctcatcattaacataagcgcgacactgcattacactgcttcttggtaccaaattcatgtctccgccgctaaggcaggtgttgatagtatcacaagaacgctggctctggaatggggaacagattatgaaattagggtcaatggaattgcaccaggaccaatcggcggcactccaggactaaggaagcttgcacctgatgaaatgggcaaggggaaaagggaaatgatgcctttatttaagttgggggagacacgggatatagcaatggccgcgctctatcttgcttccgatgcaggcaaatatgtaaatgggactacaatggtggttgatggagggctttggttgagtcaccctcgccacatccccaaggaggaagtgaaggagctctcaaaggtgatcgagaagaagttagggcctctggtgtaggtgtaccgtcc

SEQ ID NO: 4742 - DNA, 1291 bp, Triticum aestivum
  Clone ID: PAT_TA_4742
catagaaaaaccacagccacgaatcaggggaaatccggcagcgccgcgtgtgcgaagacgagtccaaacacggaacaaagccggcgattagcggcacactgagctggcatcttgtgcttctccgtccgtccgcgtccacaccggagctaggaggagaggagggggaagaagaaggcgacgaggaggcgatggcgacggagtcgccgttccgggcggacgtgctgaggggcaaggcggcgctggtcaccggcggcggctccggcatctgcttcgagatcgccgcccagctcgcccgccacggcgcccacgtcgccatcatgggccgccgccgcgaggtcctcgacaaggccgtcgccgccctccgctccgagggccttcgggctgttggatttcagggagatgtacgtaaccaggaggatgcagcgagagtgcttgcgtcgaccgttgagcatttcggcaagcttgacattcttgtcaacggtgcagcgggcaacttccttgcatccccggaggatctgacacccaagggattccggacagttcttgagattgacactgtgggtacatacacaatgtgctacgaagccctgaagtatctgaaaaaaggtgggccagggaggggtccctccactggtggcctcatcattaacataagcgcgacactgcattacactgcttcttggtaccaaattcatgtctccgccgctaaggcaggtgttgatagtatcacaagaacgctggctctggaatggggaacagattatgaagttagggtcaatgggattgcacgaggacaaatgaggtgcacctcggacctaatcggcggcccgtccaggactaaagaagcttgcgcgtaatgggaaatgatgccttaattgaagttgggggcctttcagtaaattgcgggggccacgggatatcgcaatgcccgcgctctatcttgcttccgatgcaggcaaatatgtaaatgggactacaatggtggttgatggagggctttggttgagtcaccctcgccacatccccaaggaggaagtgaaggagctctcaaaggtgatcgagaaggaagggttacgggcctctaggtgtaggtgtaccgtccatgcaaggttgtgatgacatccttggatttatgtccactgtctcatgttgattccagagtaccacacttacagtttttgtagtcgagcaagcaggctcatgcaccgacttttttgtgtacagtgaatcttgtaacctgctgagcagaattggtttcaaatgaacaacttcaatatttacctctgttggt

SEQ ID NO: 4743 - DNA, 623 bp, Triticum aestivum
  Clone ID: PAT_TA_4743
ccgatcactgcgacgccggagccatcatggccgacgtcctctccagggccgcgaatcctgctacaaggcccgggacgccttctacgcgtgcgtggagaagcacgcggacaagaagcccaccgagatcgccaccatggggctcctcttccccgccgactgcaagaaatcccgcgcccagtacgtcagcagctgccgcccctcctgggtgaggcacttcgaccggcagcactgcgccaagaagcgggtgcagaggctgctcgacggcgacgacgacggccggggtcccatgtcgctgccccagccctacacgttcaagcaataagtggcgctgacgatgggcctgtcctttgtgcgaaccaaatctggccgagatggtattggtttattgttctctagtcagtactgtcgagatggatgcttatctgctgcctagtatgttgaagaaattgtgaatctgtgacttcgtagcgatcatgaccgttgttgtagtgctcctgttatcctttgatgagaattatgttgcagtactgtctgtagacattagatgacctcctgtttaatgctctgtttcgatggatgaaagttgagatgtggaataatattggggagggagggttattgcc

SEQ ID NO: 4744 - DNA, 638 bp, Triticum aestivum
  Clone ID: PAT_TA_4744
ggtcctccgcccccgccgccgatcaccgcggccccggaacctccatggccgacgtgctctccccgggccgccccccctcgtacgagccccgtgccgccgagaaggcctcggtcgagaagccccccgacaccgcccccatggagctccccctcctggcccgcctcttgaaggcccgctgcaagtacgcccgcgccccgcgcctcaccggcgtccgccccttccggctgccgcactgcgaccagcagctcgccgcccggtcgctggacgagaggctgctcgacggcgacgacgacggccggggtcccatgtcgctgccccagccctacacgttcaagcaataagtggcgctgacgatgggcctgtcctttgtacgaaccaaatccggccgagatggtattggtttattgttctctagtcagcactgtcgagatggatgcttatctgctgcctagtatgttgaggaaactgtgaatctgtgacttcgtagcgatcatgaccgttgttgtagtgctcctgttatcctaatgacctcggtactcatggccttccatgctttgtttcgatggatgaaagttgagatatggaataatattgcggagggagggttaacataaaaaaaaaaaaaaaaaaggccccta

SEQ ID NO: 4745 - DNA, 650 bp, Triticum aestivum
  Clone ID: PAT_TA_4745
catcgcatctgttcctttcccggatttatatataggatgcactttggttcttacaggaagggccttgtcgcatattcatcataaaatttaaattcaaatgcgctacatcaaggcaagagataataatcgacacacgagaattacatggaaaagaagaaggcaaaacacttagacgctgacaaaattgctcggtggccccgcataagtagaaaggaatattgcatcaggagtgattctggtcaattaattgtcttagcaacttaggcaccgcctgtccactgtttgccagaacatcagccaagggctttgcatgagcagcatcagtcttagagacgataacatgcacctcccctgcaaccgtgtgacggagctatcctggtgaggatctcaacataatcgtcaaatgaagcaggcaagtccgcgaccaacacaatctcaaattcctccacgcctgatgttgccaagctctcacagcctttcacaaggacattgataagccccatgctgctgcatacggtaaaggtgctgccttgcgagccatcattcactgtgagaatttccagtttaagggatgaagagagtttctgcgcttcattatcattcgcggccactagcaaaacctttgctgtcttactagcatggttttctaa

SEQ ID NO: 4746 - DNA, 649 bp, Triticum aestivum
  unsure (1)..(649): unsure at all n locations
  Clone ID: PAT_TA_4746
gcggccgccgccacccccgccccccctccccttggcgcagctcaacagcttcccccctccccgctcctgccttccctccctcgtgaggcgggccccgatacggcccggagcggccctgcgccctctcgttctccctcccccagcgcgcagatccacgcacaaccacctgaataatttacagatcccggagcggatttcgcacgggaacccgccgcagcccacccgccgcctcaccctcctcctcctcttcgtcgtcgtcctaggggccatggggaacagtatttacaagttcctgggcggggtgtgctcggacctgtccgacgccgcctgccagccgcatggcgcggcacgcctccgtcgccgggctcggccgcgacatcctcgagttcccagcgcaccaagcaggtccccgagggcctcggccgccacgtcgtctcctccgccgccgcgcacgccaactggtacaagaagctgcaagtgggcatggcaagaacggcgacgccggccccgaacgaagccggacgaatgccggccccctcgcggtgcttgacgctcaaagaaaccaccacggccggctcgttcgaacnggctcctcgccttcttacgggctccccgcaccccgaacgaagcgggatttggggccaccgcc

SEQ ID NO: 4747 - DNA, 683 bp, Triticum aestivum
  Clone ID: PAT_TA_4747
cggcacgagacctgccacaaaacatccttttattattgaactaccgctctttagcttcagacttccatcttaaaatcgcgcacccacaggccactaggaagtttttttgcatacatgcacctaaccggataatgtagctagctatctaggcgggccgcggagcacagtccggtccacctgatccgccgaatgcaacgctggcacccacgctgccattgctttggtcgaagaacttcacgtcgtagcagttgggcgcagtgtggacaatgacttccagagtggtcggggaaggggtgtccatcgaggtcaacagctacgtaacccttgacgatagcaggtttggagtccctgggtggccgtcgtccgttgcccacaacggggtcggtgtgcttgccgcccggccatgtgttgagcaccgtgccacccatcaggttggcaacagactcagggaacatccaccacgggaaaatggcccgagggtagtagccgaggtccgtgtcgttcaccagcacatgccaaggcccagcagcgctcttttctatactaactagtaagtatggtacgggatcatctacaccggatgcaccattgacgatgctagcgcccagggcgatggccctgcttgtttgaacgaaccctccgcagttcaagttgtagcacagagtcttaccgccatcggccgt

SEQ ID NO: 4748 - DNA, 762 bp, Triticum aestivum
  Clone ID: PAT_TA_4748
ggtaaggggacaacaatgacaaagaataattacaagaatttcacattacaaaaagttcacaagtctacaattacgaccccccccctgcgggctgacttttctgtcaagaaaatttcacagcaagtctacaattacgacaagttcacatcaagtccacaattacaacaagtttacaaatagaagctaactaaagtgacaacttcaatagttcacaagttcacaaatacattacttcttccccctcgcctgcctcacaaccttcttcgtccccggctccaccccgaccctcttcaacctcctcagaaccttcttcggtgccggctcctcctcgtcctcaaactcgttctcggactcaacaacggtcctcttttgtttcttgttccatgcctccggtgtataacggttgaaggtcttcctaggctttaagttgaagtggcgccgctcaataggctgactaggctgaggtgcatcatccataaaccccctcagggccatctcggcggccgcctcctcttcagaagaagtggacctcgactgggtgggcatgccggcctcgacggtacggcaaccaagaagatgagctatggaacgtagccgagtagcgctacgcttaatgttctccccaggggcgttcccggtttccctcccctctctgatgagcctgttgtactcaaggttggcagtcccttcaaaacctgtgggcgcctccaatatgccctcctcataagcaggtgggcataactccacacgggactcgctaag

SEQ ID NO: 4749 - DNA, 977 bp, Triticum aestivum
  Clone ID: PAT_TA_4749
gtccttcacaaaaacgctgcttccccccccaccctacatcaccgcacgtagccctgaaggacgatgcagacgcagtcccgtctaagccgccctcgcacatggagcccccagtggggatgccccctcacctcggtaccacccgctcacacgaggagcggctccccggcccactaaccccaggcccgccccccgcccggcctccaccagtatgccgccgggacccgccgcgcggggccctcgccggacccagcgcccccggccatggcgcgccgccccgcccgctgggtcccccaatgatcccaccccccccgacgtccgcctgttccccccgtcccccgctcccccaatctccccacatccctggtgtcgtctgaaaagaattccatctccacgtggtcgtgaagatcggttcaaacgaattagcgtcctcgtcggcgttgcagaagagggcctgagtggaggagccggcttccgtggatagcacacgctgagatggggagcggctacacgacaaaaaaaattcggaggccagcagcacattggaaatccatcaagagttggcctggatccgccgaccggagccaccgtcggaatccgcgccgtccttactctgccttctcttctccccatctcacctcctctctctcccacgtctcttcttcccacgagaccgaggcgccacggccatggagcgccggccgccgtgctggatcctgatctgatccgcctcgccgcgacgtccgccgcctccccgcctccccgtcgttccccactttccggagccctgccgccgtcgtcctacatgtcccgattggatcgggacttcgggagcgccgccgctcgatctaaagccaaacatgcacagagggttgacgaagaaaaataactgcgggttaaattagcgagaaccgtttattcgacagtgagagacggggcaaggccaactggatcgcggcccagttaagcgaccaagaacc

SEQ ID NO: 4750 - DNA, 1697 bp, Triticum aestivum
  Clone ID: PAT_TA_4750
cgggagactgtctcgtcgtttccttctgtcagatctacgctcttctttttgcttccccgtgcggttccctcccgggcccctcgcagtggctcggctcttcattctctcccgccctcccccccccttgtcggatgcgaaaagctgccaggctcacccgcattgatcccaaagtcgtaataaacgtaagattgactctcggctgtgctttggtttgtgcccaataatcattcaaacgatcctgggtgcgcgggggggtgtgcccacatccctcagacacttcttgttcatttcgttcgtttggccactctcctgcgacacctctctttctggtcttgcctgagccgcctctgttgctacagcgcctcttccggcgtgccgatgctcccgtgaagcctgcatgccgcctccctgcccgcggcgtccgactgccatcttcggcgccccagcgcctgcagcttcggcctcccaatattggtgctacggaaggttcctgttcatctcacaatgaagactgccgtcagctccgctctcctctttcataaacatcatgcaacttggtcaaaatctcggagaatttgtaggaatgcaaccagtagatattaaatatggcagcatggtgtgtcttccctacaagcaatgctggggtactccacattccaggttctagccgaggggttctttaaaaatctgagcatctttcccgcaaaaaaaaaaacaagtacatttgaacatgtttcccctaaacaggcagatacattcaagcttggagaacttgacaatgtatgatgtgggccttcaaattacgacctgcaattgctgaccacaagttcgccatcaaagacctgtgctggtggcccttccgggcaaaagtctcccacacacgggcactctccatctcaataacttttgttgggtcacagacatcaacaagggtcatgcccatgttattacggataacacagatctttccattcagtgagaccaaagccacggcttcaaaagctcgtgagctgcccagatggcgtctactgtccatgaatcttgtccacaatcctatgtccccatcataaactcttagcttgcaggcatcccgacaatccgctgaataaagacgaccattaaaggaaatggttggattccgcaagcctgcaaccagtgcgttaccagtggtcgaccacgtgttggatgttggcagatagacctcgctcacaacctggcggtgggaatcaagtcccttcaggaaccatttgccatcatatacaactccagtgaacggcaccattcctgtgttcatttcagtgatgcaagaccatctagtcctgttcggattgtaaacctcagcagacctcagagttctctgtgtcccttcacactccccaccggcaacatagagacagttgtttatgacacaagagccaaacaagtgccgcttccgtagcatatctggagcccggtgccacttgtttgtccgagtattgtaatacacgacatgcctcatagacccccgtactgggtttttgccaccaaataggtacaaatagcagccactgagaacagcgcaaccaaagcccacggcttccgaatactctggtggaactggaggaagtgacctccagagctggtgcactggatcaaaggcatgccaagatagtttctgatcacgatcccttttgaagacgtaaacccattcttcttcc

SEQ ID NO: 4751 - DNA, 685 bp, Triticum aestivum
  unsure (1)..(685): unsure at all n locations
  Clone ID: PAT_TA_4751
gggatcccactggttcgaagccccttccatatcccttagtctcctgtcaggctctccccatcccatttacgaagacacaagagatcttatttatacgaagatctggcgcttcagttttgatttcaaggaaactgaagcaggcagtcgtggaaccgcatgccctatcttccatggattggtgtcgattctcttcgctcgagtcgaggaatgtatcatgccccatcttctgctctggcttgagtggagtctcatctgaaatcccgcgtgtgtctaaaggcagtcatccctctcaacctccttcactggaggcatacatcatggtctttggatccagatcttcgccaagtaggtcttcgtcgttggttcatattccagagttatgccaccaaccgtacaagggacttatttctctcctacttatgatgctctgtgtgatcctcgtcatcgacgagctcgcgcccttccttgtccagaggctatcagatgaagttgtccttgtcctcttttcggtgggcggccatcatcttcatcaccggcgttcagctatgggccccgtatgattgcggcctctccctgcacggctgggtggcacaagttatctggtgcgttgttgtaatttgcccccttgtgtgtatgttatttacttcttgtaaataaataataannaaggtcttatttcaaaaaa

SEQ ID NO: 4752 - DNA, 640 bp, Triticum aestivum
  Clone ID: PAT_TA_4752
cggttgtttccttggtgtttgtatgaagctaaagcaaatttatttgattttcatcggatgctccgactgcaggttcatcaaaacatgcatcgacttcatgcaccagcgttgttgtgcacaagcacgagatctcttggcggcgacgccggcggcggcggcggctgattgtagtctcggcagcagcactccgttctgttgtgtcggcttgtggtcttgcgactgggtcaattaatgctcccactgcaggttcatcaaaaaatgcaacgacttcatgcaccagcattgttttgcacaagcacgagatctcttggcggcggcggctcatgattgtagtctcggcagcagcactctgttctgttgtgacggcatttggacatgatactgtaagcgtgacctacaccatgttttaaaactttgcaataagagaggcacccaggagcagtgcagtgcagtaattgacggcactcccaaccctcctcttcatcagttccatgacaagatggcaacgaagaggacatcatcatgacgaccaagagagcaaccgccatggtgtagacaatggtccttgtatcgctattgaggattgccataccacaacaagagagtacttctacttgccctccttcctggtgccgaattc

SEQ ID NO: 4753 - DNA, 524 bp, Triticum aestivum
  unsure (1)..(524): unsure at all n locations
  Clone ID: PAT_TA_4753
tcgccatgggacccacaggccggtctcgagccgtcttgcttctgctcctcgccgccgccgccgccgccgcgccggagcacgaatccttgctccgcctcccctcctcggcgcgttccctcgccccgaagaccccccgctccgccggcgccgacctcatccgcgccctcaacctccacccccgcgacgcctccccccgccgccccggcggcgtcggcgtcggcgtcggcggcagcgatgctctcccggccggaagcctcgtcgagaggccgatccgcctcgcgtctctggtggccggagacgacggcggcggcggcacgtcggtgaagcaacctcgggcaccacgccgggtactaccgcctccccaccactcacgacgccaaggctctttctacttcttcttcgaatcccaagcgggaacaaagaangagggaccccgttggtatctgggctgacgggagggccngggctgnaacaacgaagctagcctcctttacgaaaaatgggccccttaanataacgggcaa

SEQ ID NO: 4754 - DNA, 2356 bp, Triticum aestivum
  Clone ID: PAT_TA_4754
cactcacgcaaccctctctcaccgccgtctcatctcctccgcggctccgccgccttcgcctcccctcccctcccacctcagcgccgctgcctctgtctgctccgcctcgctctcctccgtcccttcacgcgccacgccgcctccacagggtccagcctccaccggagccgatctctccgctgagcacgccccgcgccgccgttgctgccaagggctcctcggggccgttgcagccggggaggcggcctgcaggagggccctaaatgcggccgacgactccatccccggtcgcatgtggcggcagccagcccagctccgcctcttccagcccatcttcttgggcatcattggtagtgaagaaggactcttgcagctgcgaaatattagaagaggaaaatcttatggtttgaagggttcagatccataatctgataatattaggacccttgatccttcaaccattatgagatttcaaggcagatagtgcaacttgtactgtttaccttgattaaatcaatgccttctgtagcttaaggtttaattagcagactactaatgctttgatattctcctttctgaattccatacttggtacaacaatgttcctcacccggtcaccccaaactggtggaatataagaacgatcggaactgggacacaatgtccggtgactatcttgttttccctggaggcgggactcaattcaaatatgatgttgcaagatacatacagtttgtagaacaggcacaaaaaatcctgtgctacaaaggctagcttcatagtgtccatggcatgttgatggctagctctactgcgtctacaccgtggagctcgaaggctgctgctattacttcttgcgccattatttggcaacctactgctgcagtctccagagatgacaccattagtatgggtcagttgcattggtgacgctgagcacaaagctatgaatccactcccttttgctctggactgtggtcaaaccagccgcccccctcttctccggccgcccgctccgatcgccgcctccctccatccacgcctcccgaggattctgcatctataggtttggtcatggcgtcagctgcctatcttgacaacattgatgctgaagttatcgaccctccaaagattgggatgttagatgtcacagaactcgtcggtgatcttatcgagcactcaccgaaaccaaatgtcatagtttctagcaatgtgcgtgagctattggaatgccctgtgtgtttggtcgccatgtatcctccaattcatcagtgctccaatggtcataccatttgttctggatgcaagccaagggttcataatcgctgtccaacttgcaggagtgaattgggtaacataagatgcctttgctctacgagaaggttgctgcctctctagaggttccatgcaagttccagaactttggatgcgtgggaatatatccttattattgcaagctgaaacatgaatcacagtgccaatacagaccctatacttgcccatatgcgggatctgagtgcactgtcaccggtgacattccgtatctagtaaatcacttgaaggatgatcataagggtgacatgcacagtgtgagcacgatatttcattgagatgtcaaatcaaatcctcatgaagttgagaacgccacatggatgcttacggttttcagctgctttgggcagtacttctgcctgcacttcgaggcgttccagctgggcatggcgccggtctacatcgccttcctgaggttcatgggagacgacgccgaggccaagaactacacctacagcctggaggtcggaggcatcaaccgtaagatgacctggcagggcatccctcggagcatcagggatagccacaggaaagtccgggacagctacgacgggctcatcatccagcgcaacatggccctgtgcttctccgggggcgacaggaaggagctcaagctgcgggtcaccgggcgaatttggaaggaacagtgagctgtagctgcatgcttagaaggttgtttccgagtgaaccgctgtgagggcttgattaggactaggtaatggtgtgtagaatgtctcttaggttctagtagttgtgagatgtttccatggatggttgtgatgagaaccgaggtggtactgatgtggtactggtagagctcaaggcaaatctcctgttttgctttgaacaagagctggctggctggccgctgcgctgccgtttggtgagatgttgctggtgcctcgtggactgtaaatgatgtagcccctctctagtatgagatgagactcgtatctatgtcagaccgcaaatgttctgaacttttgatgctgatatatgaatgagactcgtatctatctacgtc

SEQ ID NO: 4755 - DNA, 689 bp, Triticum aestivum
  Clone ID: PAT_TA_4755
atccgctacatccccaatcagctgaaaccctagccgcgagccgcatctaatttgagcccggttccaccagcgacgtctcgccggagacgccgctgacacctcgacggaaccgacgccttccaccgcctacgcggaccttaccgtcgcgcaatccagggttcgatggccgcgtcgtctccggcctccagcggcaaggcggcgagcgactcctccgctcctcctccggccccttcccccgtggtatccaatggcaatggaacgccgcagaagccgccccccgtcgccggattcgacatgcccaagcccaacctccgcggcctcaacaaacctaagtgcatccagtgcggcaacgtcgcccgctcccggtgcccgttccagtgttgcaagagctgctgctacaaagctcagaacccttgccacattcatgttctcaaacagaacaacacattgccagagaagacaccaccagctcctatccctttgtcagaccaaccatcaaccaattcacctttaaccggttcttcgtcgaggctgtcttccctacaaaagcttccccatcattttctgaattcaatccgaacagaaagtcccttgccaagaaggacattgcaagcattaccaagtggaggtttatgaagctaaagaacatatgccaggagatattggatattgaaatggagcatatgata

SEQ ID NO: 4756 - DNA, 1420 bp, Triticum aestivum
  Clone ID: PAT_TA_4756
gctgaaaccctagccgcgagccgcatctaatttgagcccggttccaccagcgacgtctcgccggagcacgccgctgaccccccgcccgccccgacgcccccctcccccctcgacggaaccgacgccttccaccgcctacgcggaccttaccgtcgcgcaatccagggttcgatggccgcgtcgtctccggcctccagcggcaaggcggcgagcgactcctccgctcctcctccggccccttcccccgtggtatccaatgggccggattcgacatgcccaagcccaacctcccccccctctccacgcccccgtgcctcccctccggcgccgtcgcccgctcccggggcccgtgcccgggttcctcgaccggccccggcgccgctccgagcccttgccacattcatgttctcaaacagaacaacacattgccagagaagacaccaccagctcctatccctttgtcagaccaaccatctaccaattcacctttaacaggttcttcgtcgaggctgtcttccctacaaaagcttccccttcattttctgaattcaatccgaacaagaaagtcccttgccaagaaggacattgcaagcataaacaagtggaggtttatgaagctaaaggaacatatgcaaggagatattgatattgaaaaggaagcatgtgagaggtacacacagaatataggattgctggaaggaaacattctatctcaaagaagattcttctggtgaacatgaaactgaagcaacttcctcagaagaaatgatggaaataatggtctctgaggcaaaggtgaggttaaaatctgatggcgcaaatgcagctggctttaaagagaggattgccactgtcttggaccagaagctgaagaaactgcaagagaggaacagtgcctacgaggatgacaactcctctgaccaaagtctagatgaccatacgaagccggtgaagttgaacataaaacagcaaacagtgagaaacgcgaaaacaaacgagctgcttggtaagttgacaaaagcacagagtgaggatgatttgaagccttgcctcaatatcatggcgcagctgtttggaaaggagatcgcttcctcctccatgggcacatcaaacaagtcaagcgaccaagaatcaacccctgcagttgcgccctcttattcatttccaaagctcacaactaggctggaggtagacgagaacatgatgtctaagatcagcgagctatcttctttgagtcaggttgttcagctataatctgggacctggagtggtcctatacctccaaaccccagaggcatgtcgtgaatacaaaatgtggactggtttcttgctgcctgaaaacgtcaaaacgtaaccagtactgtttatctagcgtttccgtaccgtcttggttaaaaaaaagcatttccgtactgtcttg

SEQ ID NO: 4757 - DNA, 1020 bp, Triticum aestivum
  Clone ID: PAT_TA_4757
ggcgcgtgggcattcttctgctttgggcagccgtgctctggcttccgtggcatctgccggatcggtgcccttggcgggcttcggccaggtgcctgtcacactcttggtattctttgcccactcttttgtttcttgcttgctgctgtcctgtctgctcgccgctggggctggcctctgatgcccctccagccggcgggttgcggtgctttgctcccctgctcctttttccgggttgttgccccggggacggccatcacttctgcgtggtgtccccctgccctggctccacggcttgcagtcggtccaggtcgcccccctcagcgtccagctcgcctcatatgacccttcttacagccgcgcctaagtggccctttcccttgctgcgtccctttgacacatgggtgttccaggttgtgccacctatgaggtaaagcggaccactttctgggctggcgtatttggctctggacattgctaccgacttaccattgcttggtttcagaggcagcagtgcttgtgtgcttctacggctttgtggagttatgctgcatatgcatgagcatgatgatgatcatgccataaatcatatcgctaattgagaggaggcacactggatacaagtagcagaagaaagattttggttactcggaaacaaaatggtgcagaaatggtgcataccggagctgtgcagaaattgtatatcatatattataaaaatattaagaatgttttgcggtcccattagaaatacagctgctgtgctttttacttggcagtgtgaagagctcaattttggtgcaacttgtgagcccccacatatattagcattacaaaatatatattacttgctgagaattaaaggaattagattggtggtatgtgttgtatacgattttacacctttttagctcattgagtacatgaggaagtgtaaatcttagacgccaagttagaagatttctctcacaaaattgagatcttgttcactcttaaatcgttcttatcgaccaaaaaaaaaaa

SEQ ID NO: 4758 - DNA, 1107 bp, Triticum aestivum
  Clone ID: PAT_TA_4758
gtcacctgctcctccaattggaactctcacatctgcccttgcaaatgctactccagagcaacaaagaacgatacttggcgaaagcctctatccacttgttgagaagcttgaacaccaacaagctgccaaggtgacgggcatgcttctggagatggaccagacggaggtgctgcatctgctcgagtctccagaggctctcaagtccaaggttgccgaggcgatggatgttctccgcaacgtggcccagcagcaaaacccgaatgcccctaccagccagctcgcgggtctaaccttgagcgacggcattatctcttagtttagagtcagtttgcggtctcatgatgctatagattggccaatccaaaggctttggatttgttcagtatgagaaagaagagtctgcacagtctgcaatgaaaagcctaaacggcatgcttatcaacgataagcctgtctatgttggaccttttctccgcaagcaagagagagataattcttttgacaaggcaaaatttaacaatgtctttgtgaagaatttatctgagtctactacaaaagatgatctagtcaaagtattcagtgagtatggaactattacgagtgctgttgtaatgattggcatggatggcaactagtgtactacccaacttctccgcaacagccaggacaattgcaacaaccagcacaagggcaacaagggtactacccaacttctccacaacagtcaggacaagggcaacaagggtactacccaacttctccgcaacagtcaggacaagggcaacaagggtactacccaacttctccgcaacagtcaggacaagggcagcagccaggacaaggacaacagccaagacaagggcaacaagggtactacccaatttctccgcagcagtcaggacaagggcaacaaccaggacaagggcaacaaggatactacccaacttctccgcagcagtcaggacaagggcaacaaccaggacatgagcaacagccaggacaatggctgcaaccaggacaaggcaacaagggtactatccaacttcttcacagcagtcaggacaagggcatcaatcaggacaagggcaacaagggtactacccaact

SEQ ID NO: 4759 - DNA, 2600 bp, Triticum aestivum
  Clone ID: PAT_TA_4759
gcgccgcgcgggcccccgcgtcttctccgcgcccgccccccccttactgccgtttcccgcatcgtatccctccaccaaaaactattcgcaaaaaaattcacatacccaaaaacatcgcccgaggtgcgccgccatctcctcccgctctcctcctagctataagccgatctgggactaggactgagcggggacagcaaactccccagcggaatgagtcaacagaaagggaggaggggtcgcgttggccgcgcccgtcgcgggcggcgtcccgcggcggcgctggcccaggcggctgccggcggtggcgggaggtccgggtgcgcgctcccacaggggccggagccctgtgccagcggctgctgtctcccctgctcctccactgggaaccctcacatctgcccctgcaactggtactcctaagacatctacagcccggtacgcgggcgcgtcgcctcctatccactcgttggcgaagcctgaccaccaacaagctgccaagggtgacgggacatgcttctcggagatggtgccagacggaggatgctagcaccggcccgagctctcctgaagagcctcccaatgtccgaaaggttgccgaagcgggtcgatattctccggcaacgtggcccagcagcaaaatctctgaatgcccctaccaagccaatcgcccacgtaaaatcttcatgacaccttctctgcatttggtgcaattctatcatgtaaggttgccatggatgatattggccaatccaaaggctttggatttgttcagtatgagaaagaagagtctgcacagtctgcaatgaaaagcctaaatggcatgcttatcaacgataagcctgtctatgttggaccttttctccgcaagcaagagagagataattcttttgacaaggcaaaatttaacaatgtctttgtgaagaatttatctgagtctactacaaaagatgatctagtcaaagtattcagtgagtatggaactattacaagtgctgttgtaatgattggcatggatggtaaatcaaggtgcttcggcttcgtcaattttgagagcccagatgatgctgctcgtgctgttgaggaacttaatggaaagaaaatcaatgacaaagagtggtatgttggtagagctcagaagaagtctgaaagggagatggacttgaagagaaggtttgagcaaagcatgaaagatgcagctgataaatatcaaggacagaacttgtacttgaagaatttggatgatggcattacagatgatcagctacgtgagctgttctctaactttggcaaaattacctcttgcaagataatgcgtgatcaaaatggtgttagcaagggctctggctttgtttcattttctacccgcgaggaagcatctcaggctctcactgaaatgaatggcaaaatgatatctggaaagccattatatgttgcatttgcacagcgtaaagaagatagaaaagcaatgttacaggctcaattctctcagatgcgccctgtaccaatgaccccttctatgactcctcgactcccaatgtaccctcctatgcctactcttgggcagcaactcttctatgggcaagctccacctgctatgataccccctcagcctgggtacggtttccagcaacagcttgttccaggaatgaggcctgggggtggtgcccatatgccaaattactttgtgccagttgtccaaccaggtcagcagggtctgcgcccaggtatcaggcgcaatggtcctgggtctgctcagggacagcaaactcctcagccatttcagcaacagatggttccaaggggacgtgtctaccggtacccacctggacctcgtcacatgcctgaggttcaacagatgcctggggttggtgttggaggtatggttcagccatatgatatgggaagcttccctgtgcgagatgctggcgtgtcacctgctcctccaattggaacactcacatctgcccttgcaaatgctactccagagcaacaaagaacgatacttggcgaaagcctctatccacttgttgagaagcttgaacaccaacaagctgccaaggtgaccggcatgcttctggagatggaccagacggaggtgctgcatctgctcgagtctccagaggctctcaagtccaaggttgctgaggcgatggatgttctccgcaacgtggcccagcagcagaaccccaacgcccctaccagccagctcgccggtctaaccttgagcgacggcattatctcttagattagagtcagtttgcaagcagtctcatgatgctatagattgttttgtcctccatggttgaactttggtgagttgcgtttttgcactggttgttaggctctatctgcctggtctctttgccaatgattggcaggcaccttttcccgtgtttggctactattgagggcttggttacatacctcttatgcggttatgacttgccgaaagttttgctattaatatgagtgaagagtgacattgctgtccgacattacaagaaacagttgaattgtatgggggggcccggtacatcattcgccggggtacggaccaatggatgaagtttttttcctcgttttacgcaccgttcttcaaa

SEQ ID NO: 4760 - DNA, 876 bp, Triticum aestivum
  Clone ID: PAT_TA_4760
cgcacgcgccgccgctcgccgcccctgcggtccccctccgcccgcgatcctctccggcccggtgcgtctgacttgcgcaggggctcttctctcccatcgatcggcgcctcgacttcgaacccctccgcccgcccctccactgcagcgtgccccctccggcgtccggtggggcccgcccctcccctcgcccagcgcctccgccccgactcctacagatcgcgccggccaacatcctctgtcgcctaatcttaaccacaccgtgttccttcggacatcgtcgtgaacctccaagcagataagccaaccttcatgtgtatctcccgttatatctcggctcgattcttctctgctctgtttttcaggtggaagctggcttgctggccgtctccggtttccagcttgcagctgggtatgccaacgggcaacggctgttccttctgttgaactatgcaatgcatcgcggctgaattccaggctgttcgagtaggggtcccctgacatccccaatccgagtgcataatatgctttagcagccggaaaaagagtcaagatgcagcgatgcagtgtcaagtgagcaatggcatggcatgagcaattgcggggccagatgcgagcgccagtgctgttcgacaatgaacaagttattctgctgtttatgatcaaggcattgtttgataaggaaacccatttgcttctgaactaatccacgtggcaatttccatggttcatctaatataattgtcacagcaatctgatacgacctcaagtgtgcgtttgcattcgtgtttttttgtgtgtgaatcgacttcaagtgtgtagctttggtaagataatcctttccatgcatgtccagcatacatatagccaattagtaaa

SEQ ID NO: 4761 - DNA, 806 bp, Triticum aestivum
  unsure (1)..(806): unsure at all n locations
  Clone ID: PAT_TA_4761
catcactgccaccggccgacccgacccagcgcaccaccgctccgcccaacccgacccagcacctcgggaggagccggacccccaccaccgcgccttcccctagtggcttttccccgaccaccactcccgccccttcttggatcatctcatcctcaaaattgtcgtctgtgacctccacctcaccggtgacttgtggctctcgcggcgtcgccaaaaaacgtgtgaagtgtcgcgatggtgcaatccggcggggtagtctgtgcagtgctcacatgccacagcagcgccacctccgacctcgcacagcagccgtgtgtcctgcaggtcgccccatcctcaatggccgtgaagacgaccatgcagttcagaaaaaagtttctttgttgctttttttataggttttcgatgtgcagatcacctcgtgagataacagtgcagtccgtccgcttctggcgcgctctactaatttttctgttctagcgacatggtggattgggtgctcaaccgatgcaattcagtttttctagtgtgtttagttttacagtgtggtgcagctcactctctttgttttgcagctcactctttttttgttttgcagctcactctttttctcttctggaaatcatttgcagtgcactcagtaagaaagagaagagaacatcgatgttcatttgaagtttgttttgttgtttatgggaaacgcaaagagaaaggggtagtaaaaatggatggtcattttgtataagcaagtctttgcctagtgcagttctgttgggtactgcatcgtnattctgatgtgtactaga

SEQ ID NO: 4762 - DNA, 862 bp, Triticum aestivum
  unsure (1)..(862): unsure at all n locations
  Clone ID: PAT_TA_4762
gaaaacaggaaagtaaagcttaagctacgcgtcgatgcgtctccatcatgctgggccggccggcagccgccgccgcagccgcacccgccgcagcacgccgcggcgcaccaggccaccggccacggcgacggcggcgggggcgacgacgtggtgcagccggtgagcatcgacatcgtggcgcccttcatggacgcctcatcgatgacttcgcgcgggggtggcggccggccggcggcgcgctgcccgccgttctcgacggcgggcatggactggaaggagacgcggacggcacacgtgtccagtggcggacgtgcccgggccggccgtgcgacgaggtggagggtgaggtggggatcagagcgcggatggtccgctatcgatcgggcagcgcgcgcgcgccccccaccacagggcaagggcgacgcgtggcacggcgcgggagccgagcgcctacaagtgcgccgcaccgctcgcctgccgccccaccgccgcggcggggggcgtcacccccccgcccgacaccgaacggctcaccatcatcacccccaaaggagacgccgaagataccaagacagccatacacctctccagccattgatcacatacgcatcacatcccccaagccaattccttcaaccacacggctctactacccgatcacactgctaatatactcattaaagagaccttagatccggagatatccggcgggtatttgtcccgatggaatctgaanattcgtaactatcatnaccagnaaccactctnatcacgatcaanacatgaccncattagattcncaatacangnttttcacacttaaaattntnaaaaaatttgtgtaaaaaaannnaaaccggcg

SEQ ID NO: 4763 - DNA, 654 bp, Triticum aestivum
  Clone ID: PAT_TA_4763
atgtcaaaggaacgcagtagcaccacaagcttctctctccctttcctgtaatgcagctacctgccactgattcagaataaattgagcgcttctgtgttccatcgagcaaacagatacagattaaatcgagcagtgtttctattcccaaaaaataaaacaaattgaaaatagcttcagaaagcatgaagctagtagctttgggattagttttattggggtgcctccaatctttggcagctcctgacttccaagtcatagcactgtatgaaatgaggatgatgctcactgacagccgcggtgtcttgaaagactggaacaataaccaagtgagcccctgctattttgataatgttagatgcgatcaagatggcaagcgttattggaatgtctgtgagcgcctccagctcaagtgcgtacttcatcaaccttcccttgctgccctatcaactttgcggcgtctgttcttcgatgcgtctcgtgcaacatctcggaggtgctccacgccgacttcgggttagatcactcaaaaacttctcataacagaacaatggttttacttcaacagcacattcttcatgggctactatctcctacttttactattataatacagttcactatagcatttacttgtgtccacgtgactatgtgcct

SEQ ID NO: 4764 - DNA, 536 bp, Triticum aestivum
  Clone ID: PAT_TA_4764
aggaattcggcacgaggctcgtccaccccatctcgccgctgccagacctaaccctcgcctccgccgccagacctaaccctcgccgccaccgctgccgccgcagcagcggtcgccgcctttgtcgtcccactccgctgctccaggccggcgcatccacccttgagactgcacatcccctcgtttcttgtaccttctctatcctctcgccggtcaagcgaaccacaccttgtcctcctcgcgcctacgcgcagcctcaccacgagcccgagcgcgccttcctcacatcgtcaccaccgtcgatcctccacaccaagaagccggcggctactttctgttgagagacgcatcctgaacaatgagagaccaggtgagtggtggctccatggacatggagtactatgcatcgggttgacgaactctccagggcgctcaccgatcttggctttttgttctgaccttgtgtacatgaaggcacatggatcacctaatttcaactctgacgcagagcaataaaatgatttaggaaagcattgagc

SEQ ID NO: 4765 - DNA, 1267 bp, Triticum aestivum
  Clone ID: PAT_TA_4765
ggtcgacttctgccacggccgcggcgtgtaccaccgcgacctcaagcccgagaacctgctcctcgacgaggccggcaacctcaaggtcgccgatttcgggctcagcgcgctcgctggccacgcacgccccgacgggctgctccacaccgcgtgcggcacgccggcgtacgtggcccccgaggtgctcggcgggaatggctacgacggcgccaaggccgacatctggtcctgcggtgtcatcctctacgtgctcctcgtcggcgccctgccgttccaggacgagaacctcatgtccatgtaccgcaagatgcagcgcggcggcttcctctgcccgtcgtgggtctccaaggacgcccggaagttgatcggcaggctgctcgaccccaacccgagcagccgcatcacgatcgccagcctcgtcgagtcgccgtggttcaagaagacgtcgcccattccgagccctctcttggagcccgtgccaccagcggccgcgcgcggcaacggcgaggacaaggacgagcctccggaggcgctgaacgccttccacctgatctccctctccgcgggcttcgacctgtcgccgctgttcgaccaggaaccgtcgacggggcgcggggcgaggggcggcgtcatgcggttcgcgacgcgggagccggcgagcggcgtgatcttcgcggctggagggcctggcgacccggcggggccatgcgcgtgaccaagagcggggcgcgcggggtgcggctggagggcgccgagcgcgggcgcaaggggcggctcggggtggccgcggagttcttcagcgtggcgccgtccgtgctggtggtcgacgtcaagaaggacggcggcgacacgatggagtaccggtcgttctgcagcgacgagctccggccggcgctcaaggacatcgtgtgggctgccgccgccgccgccgccgcgttcccccggtgacccccctgcccccacttgatgtcgctgtcgtccacgccaccattattgcccctgtctgtcactgttgctatccggccgtaattaggtgtgcattattgttcggtgccgaagttgatggctgctgctggtatggttgtgcttgtagttgttggctggtttttgcgcgcggcagcaggacagaatcggcgccaagtgatgtgatgtctgcgtctgccaatattgttttgaactttatttgaataaacagtatcatgttgtttcgtaaaaaaaaaaaaaaataacctggacaaataaaaaaaattataaaaatttttgtaaa

SEQ ID NO: 4766 - DNA, 593 bp, Triticum aestivum
  unsure (1)..(593): unsure at all n locations
  Clone ID: PAT_TA_4766
ccctactcatgccatggtagcatcagaaatagctgccgttttctttctgttcaatgccttgttgagaggttctttggtccatagccaagggctgcagagaggattctacgactccagctgccctgacgcagaggatatcgtgaggtctaccgtcgagaagtactacaacaacgacgccaccattgccccgggcttgctcaggctgcacttccatgactgctttgtccaagggtgcgatgcttctgttctgatttctggagcgtcatccgagaggagtgcgccgcagaacttcggcctcaggggattcgaggtgatagacgacgccaagtcccagctggaatcgacgtgcccctggnggcggtgtcctgcgccgacatactggccctcgccgcacgcgactccgtcgatctgaccggcgggccaagctggccagtgcctctgggacgaagagacgggaggatctcatcagccgcagacgccaaggccctgccgtctccggccgaccccgtgtccgtccagcggcaaaagttcgcagaccagggcctgtccgaccacgatctcgtcacactagtcggcgcgcacacgatcgggca

SEQ ID NO: 4767 - DNA, 1018 bp, Triticum aestivum
  Clone ID: PAT_TA_4767
ctcgctcgctcgcacgcgcacagacagacagaagcgtccggccggccgaccgacgcttgagggaggtggagggcggcggcatggtggtcaggcggtcgccggcgcggcggcggggcgtgcgggtcggcccgaccaagctcgagggcctgccggccgcgtggtcggcccccgccgtggccgccgtcaaggtcaagtggcccggcgccggcggggcgctctcgcagatgctcacgggccggcgcggcggccgcggggtcaccgccgtcgagcccgtcggcggcgacggcgccgtccgctgggacgccgccgccgacgccaaccgcgtccgcgtcgacgtcgagcccggcgccagcccgcgcggcggcgcgggcgcgggcggcgccggccggccggagcgcggcgtcttcttctccgtcctatacggattccaagaacaagggaggggcaaggacctggtgaggctggacgagatcgggacagccatgatcagcctggaggagtgctgctgggagatgcagctgcagcagcagcagaaagttggggctcctctgcagcagctggtggttgtccccatcagggtcaggaaggacgggtgggcaagtgatgccatgctctatgtgaacgtggagctggtggacctgagcacgccggcggggggggcgccctccgcctcgcccacggggtcgccgtcgccgaaccccacgccggtcccgacgatgagggagatccacaggggctccacctaccacgaggttcttgacctgaagcagctgctcgacctcgccgagaagcagggcagggtggcggtgtaccggaacaagcgcaactcggacaccagcagcgtcagcagtggtggcatgagcagcagcagcagcaccgtcagcctgagcagcgccagcaccagcaccagcggcggcgccagcccggagcccgggtccacgtccaagcgccggttcctgccgtggcggcggcggagccgggagtcgctctcccaggagatgcccgtcgccaaatgctg

SEQ ID NO: 4768 - DNA, 451 bp, Triticum aestivum
  Clone ID: PAT_TA_4768
cgcgggcctccgcggccgcccccggctcgccctgcgcctccggcatgcgccaggccctcttcatcttcaagccccaggccccctccccctcgccattgcccggctcccccgccgcccccgccgccgccccggcctccgcctgccccccctccccctccgcccccaggccccctcgccctcccccgcccgcgcccccgccagcgccgccctcgtgccctccgtcgtctgcctctgccgccacgcttcggagcgcgtgtgggtgcgctctgctccgcgtgctggccaggtgtcctctcccacgttccgtgactttctgccgccacgttgcggagtggatgtcggtcggacattcaccaggtttgtgagcaacatactactaccatgtaatgtaacgaatgtgcgagtgtaagagggagtgaatgctgtctgattgaggttgaggcatgccaaa

SEQ ID NO: 4769 - DNA, 701 bp, Triticum aestivum
  unsure (1)..(701): unsure at all n locations
  Clone ID: PAT_TA_4769
tttccacgcgtccgccgtccccttatcacaagacgagatatttagaagagggagggaaatcgatcgcgaccgatcaggtcaagcggcgacaatggcgcgcctagacccgccagtgccgtcatcgtcgagctgggctgggcggcgcagtccggtagagtaggaatgagggggcggtgggacgcctcccctgctcgagctgctccaagcgagcgaccacagcgccggatccacctccacaaccacccaccggcggccacggaaggtcagggaccttcgtccggtccgtgtgcttcttctccatgcgtgcttcttccgctctccgctgcttccatggaagtgccgacgccatggacctcgtcaatcgtggtttgctgctgccgccgaccgtttccctgacaagttgacaccaaagccaccattgtcaaagtcgccgttggccggcgttgccactggtcgctgctccacgcatcttgtcggtgctgcgaggcgatgccatctacatatgttgctgcagcctgggaggtggcagggtctccaggtgatgccctctttgctgcccaatcgttgaagatgccataggacgagatcctctgctgctgctgtgtctggtggttgaagaaagggtgtgcttgggaaaangangcaattgtttganaagtgctccatntgggaacaaggacganctttgggctgcaatcngg

SEQ ID NO: 4770 - DNA, 861 bp, Triticum aestivum
  Clone ID: PAT_TA_4770
tactatttccctttttctttttttcttttcagtgagaacgaacacatgcacatatgatttagtgagtggcgttcatttacttgcttgatccataggaactggagttcaagaagcaacactactgatcttgatttctgctgtaaccattgcaacgagccgtgatggtgggccgtcccaagaaaacatttatggatgaatggatgattgctttcatacttcacaactgttgaattcttctcttctttgggtttacccaaaagggttactcggttagtttatacgagtcatcctcattaaagctctactttactcactgggaagtggtgaatcgccgttccttgacattgtggcatatgctgggatgggtttgccggtacctcacttgcgatgcttgtcctcatcttctggagctactcatactattttgtgctgccgtggttctgtatcttctacagggtgcatcgaggacttatgagagacatcctagtaggaaccactactttcttctattcctcgcggctgcgcaattccccatgcttttctggctaggcaacatcaagggctgatgtttcagtcttatctcagaacagggacacctttttccttctcttgccttcaaggcgcagagctaaaactcgatcagaataaagtttgaggttttgtcttaccgttgaactttggtagtagccttgtctatagttcaggctcttgttggagtggtaaatttcttgatagagggcctcaaaaatatgcagtcgaggttatctttttggcctgcaaaggatgttacttaaccatgatttatgactagctgaagacaaatgcatacatggattttgaatattggatagtaacttataa

SEQ ID NO: 4771 - DNA, 744 bp, Triticum aestivum
  Clone ID: PAT_TA_4771
gagaaacactcagccccaggagcacgcctcgcaatgctcatggcttcggccgccctctcttccaccgccacccccccccccccctcccccgccgacgccaccctgccccccccatccccgttcttcgcccccccgtacggtcccctcccctctcacccccccgcctgcacctcaacctgcgcggcctccgcgacggcgtcgcagctggggcacgcgatggggggcgcgaccctggaggaggccctggaggaggtgcacggcctgcaggaccgcctgggcgtgcccccggccgcgtcggcgccgccccgtccgcgccgccgcgccgccgcgggcgcgcccccggaccggaccgggcgcgccgtggccgtcggggacctgccgggccgagcccgcagcgccaccgtgaaggtggtgcgcccgttgacgaagctgggccctcaacgacgccaaggacctcggcgggcgcctccccaagcggggcacgcacgccgtcggcaaggacgagcgcggggaccccaaggaccagcacggggccgtcggcgccaaggtccccgtcgcctgagcctgaccttgacgacgttgctgctgcccaccttgctactaggaattccataattttaccaaaattttccttgtcgaaaagacattttctcttgtgtaattgtaaaattgtatccggcccgttgcaagatcttgcgtcctttatatactctgtttcttgctctgttttttaaaaaaaaaaaa

SEQ ID NO: 4772 - DNA, 1201 bp, Triticum aestivum
  unsure (1)..(1201): unsure at all n locations
  Clone ID: PAT_TA_4772
gcacggccaggctgattcggaagccccctgcgccggtggtcgatgcagtggtgccgctgccagaggaagtggccgcaaccgccgctagcgttgtcgatgtggagagggcggttgctgcccctgtgaatcgcaggcgtgctccaaatggcgtcgcagagcaagaaccaaggagtggtggcatcaggggtgaggtgaagccaaggatcatagatgtgccgaatggagtggtgggggagcatgtggcggctggctggccgaggtggcttacggaggtggcaacagaggcggtccgtgggtggcagcctcgcaaggcagagtcctgcgagaagttggacaagatagggcaaggtacctacatcagcgtttacaaagcacgcgatcttgagaatggaaaaattgtggcacttaagaaagttcgatttgccaacatggatcctgagagtgttcgatttatggcgagggaaattcacatcttaagaagacttgataatccaaatgttattaagctcgaaggtttggtgacatcacgcatgtctagtagcttgtatctcgtgttcgaatacatggagcatgatcttgcgggacttgctgctacacctggcataaaattcacagaggctcaggtcaagtgttacatgcaccagctactgtctggacttggtcactgtcatagtcgtggtgttttgcatcgggatataaagggtgctaatcttctgcttgacaataatggtgccctcaaaatagcagattttggtctagctacattctttaatccgaaccaaaagcagaatttgacaagtcgtgttgtaactttatggtaccgccccccggaacttttgctgggtgctactaactatggtgccactgttgatctctgggagtgctggttgcatcctttgcggaattcttgtcagggaagcctatcatgccaggacgaactgaggtggaacagttgcacaaatttctacttgtggtcacaacaaaggattctggggcnatttgaantacactgcacatcttcaaccacaaanctttcgccttggttaatgagtnataaggttcnccttnacttgcattcnggcgttactgcgtaaactaaaagggacgcggtcnccctgaataataatcgtcgcctaatatgtcataaagcgcgtattccgtanaaaaancangcagtngttaaagtantaaggcttgnttt

SEQ ID NO: 4773 - DNA, 760 bp, Triticum aestivum
  Clone ID: PAT_TA_4773
ccctcgcccgctggatccccgggtggggtctcgacgcggccacgctgccgctcgccgtcgacctggtaagcccgtccgtcctccccggtaaatcgcaagcttggctttttttattatcgcagcttggcttcttccttgttttccttgtgggcataggttgagtacccctgctgctgccgcagaacatggcaacggacagcgagacgaaggcggcgcggacgctgacgagggacgaggggttcaacttccgcgcggcgcactggggcgagctgcaccggcggcttcacgaggctccgccggccgcggtgaccgtgcactggggccaccagttcctttcgttcgaggtttcggacacggacggcgatggtggcaaacgcggcggggtagtcgcgacggctcgcgtgctcagaaccggtgaaacggtggaggtcgctggggatttgctggtcgcagcggatggctgcacttcgtcgatccgccggcgcttcctccctgacctcaagctcaggtactccgggtactgcgcatggcgtggcgtgttcgatttcaccgggaaggaaagctccgacatcatcaccggcatacgaagagcgtacccagagctcggcagctgcctgtacttcgatctggccgaaaagactcacgccgtgctctacgagttgcccgggaacagactgaactggctctggtacatcaacggcccagagccagagctcacggggagctcggtgacgatgaaggtgagcgacgccacgctggc

SEQ ID NO: 4774 - DNA, 1667 bp, Triticum aestivum
  Clone ID: PAT_TA_4774
gcccgacacctcgctcctccgcaaggggccctgtgccgcgcaccgcgcattcctctccaccctccaagccgtgctcttcggcagcaagctcgtcgttctcttccccgccggccttctcgccgtcgtcgacagatacatgcgcttcggccaggtgcggctcctccggcttagccgcctcgggcgcaggcctcttgcggggcgactcagtttccgggcggcacagctcgctctctaccctgctcctactgccggtggactgccgactcctcgatcggccgccggctccccggctccccgcgccctagccgcccctacgcaaggcaggagatccgttgcgacaccctccctgctgtcctccatcccgccgacctccccgccggcgtccccgacctcatgcgtttcggctgggcgtgcccaccccggcgtcgcgcaaccgggcgacatcctcctggcgggcgtctcagcttcgcgtcggaacctatggctttcaacacaggccccactgctggtggtcagttgtgtgcgacgttcggcaacgtcaccgcggttatcatcgcgctattcgccctgagggaaggcaagataacggtggtgaaatgctccctgctcggctccatcttgtccaacctgctgcttgtcctcggcacctccctcttttttggtgggctggccaacctcggtgtcgagcagccatacgacagaaagcaagcagatgtcagcacagggcttctgattcttggtgtgctatgccaatcgatgccgctgatgctgaggtatgcagtaagcgccggtgagcatgcagtaaactctgacgattcaggattggtgctatcccgggcatgcagcgttctcatgatcctggcctatggagcctacctttacttccagctgaagacgcatcgccagctctttgaaccacaggaggttgaagatgatggtgatgatttggtctctgaagatgaggcggtactggggtttacaagtgcgatggtttggctagcagtcatgactgtgataaccgccttactgtcggagtatgtcgtgagcacaattgaggcggcctcagaatcctgggaactatcagtgagcttcattagcatcatcttgattccgattgtcgggaatgcagcagagcatgctggagcaatcatatttgcttttaagaacaagctggacatcacccttggagtatctttggggtcagctacgcagatttccatgtttgtggtgccgctgagtgtccttgtggcttgggtcatgggggttccaatggatcttgatttcaacctgctagagactggttccttgttcctcgcaatattggtcacaagcttcaccctccaggacgggtcgtcgcattatctgaagggactgcttctcctcctttgctacgccgtgatcggcgtgtgcttttttgtcctgagacgacgttcagctgatggaagcaactaatcgggttcagcctagcagatcggcttagttcagggttcccccaaaacggacggtgatcaagtcgaagatcgtgaagagaaggtagtagactatgtttcgcagccaggccaagcagtagggcctgcctgcctgtaagattgtagatcgagactaaatcaggtgtgtttatggccatcacaggcctgtaaattaatcgagcttaatgtatccgttag

SEQ ID NO: 4775 - DNA, 2348 bp, Triticum aestivum
  unsure (1)..(2348): unsure at all n locations
  Clone ID: PAT_TA_4775
ggaaggccgggactcctcctggaccctggcgtgtcgtcggctagcgcccgcccgagctacctatttcacccctcctccgcgcgcggctcctagccccttctgtggcgagcgtttctccccgggtatgcgagcatcggggcagaggcctccggctggggtggcggctccttcagaggagagtgcgcttgcggcggcttgcgccgtactgtgcaggtgagcggggacgaggaatgagcaaactcttctgcggaatagcttggggctttttttccggcttgaagctggggtttgcacgagtgaccgggggcactagctgtggggtcgacggataagcccacaagctgttcttctcagtctggaccagcgctaccgcaccttaacgggtggagcggcagttcgctagcggaaacgctgtgcgatgctccggccgtcgctaatggctgatgccagcctcgtcttcatcggtggagtactacaactgccgagattgacgaacaagaacgtgataactatgagtgaacaaaccgtgggtcgtgcaaacatgttattagaatatcaccaagatagagactttggtgatgaggaaggagaatccagtggatcttcctaaaattgggaatgtaatagcgttttgagagtcaagtctgtatatgtcagctctgcgattcttgctacaaaaagtcccttcttttacaagcttttctcaaatggcatgaaagaattcgtcttgacgcatgcaactctaaggacaacagcgtaagaggaaagtgcccttatggagcttttaagatttatttacagtggaaagttgacgaccaatcagccaacccttctgcttgatatcttgatgatgtctgacaaatttgaagttgtttcttgcatgagacactgcagtcaactactaaggagcttacctatgaccacagaatctgcacttctctatctagatctgccttccagcatttcaatggctgcagcagttcagccactgactgatgctgccaaggaattcctcgccaacaaatacaaggatttgactaagtttcaggatgaagtgatgaacattccccttgctgggattgaagctatcttatgtagtaatgaccttcaggtggcatcagaggatgcagtctatgactttgtgatcaagtgggctcgtgctcaatactcaagaacggaagaaagacgtgaaatcttggggactcgcttgctgccacttgttaggttttctcatatgacctgcaggaagttgcggaaggtccttgcatgcagtgatctggataatgagcaagcaactaaaagtgtcactgatgcactcctgtacaaagctgatgcaccacatcgacagcgcgcccttgctacagatgtgttgacctctaggaaatatactgaacgagcttacaaatatcgtccacttaaggtggtggaatttgaccgaccgtatcctcagtgcatagcatacttggatctgaagcgtgaggagtgtggccgactattcccatctgggcggatttactcgcaagcattccatcttgccggacagggattcttcttctcagcacattgcaacatggatcagcaaagaggcacattgcaacatggtctcatgcaaagtgctttccactgctttggtctcttcttagggatgcaagagaacggctcatcgagtgttaccgtggactatgactttggtgcaaggcaaaaagtacaagggctgctacaccttcactggtggaaaggcgtttggctaccgcaatctcatagcaatttcctggcccgcgtttatgttcggcgattccctggccgtcgtttatggcggattacaggcctcattcttcattccatggaagtaccacatctgagagcggagctgactataaaccaatcatagatagtggaaaatcttgtgtggttcaaacatgttttccccaagcgccaaaatagacgctttagtaccgagtattaaaactttgggccaaaatagacacttctgaaacgagaagccaaatcctttgttttacataaaaaagaggactgtcatgtcatgcattagttttgaactttggaagctgaagctttgacagagaatcaaagttacattcgtaacatgttcagatgagttgaatttgcagtctgttagatttcctacacgcgctggtaggnttgtttagacagtactcccttcgtccgaaaatacttgtcattaaaatggacaaaaaaaagatgtaacaaagaccatgtgctaaattgctgctggtggggaggcttggctccggctagtagatgtgctagggttttagtgatcctttttaatttcattgtgacagattttacgaaaaaaaaaaang

SEQ ID NO: 4776 - DNA, 790 bp, Triticum aestivum
  Clone ID: PAT_TA_4776
aatacggagaccacgatgacatggtaactgtaattgatccaaaaagatcttacagtgtgaaggcacccactagacatcccatatatgaaaacttcagagttgagaccttcaaggcattattaacagcagctaacacagatgagcaattgtcagcccttggagaacttatgtaccagtgccactacagctacaatgcatgcgggcttggttccgacggcacagataggctggttaatctagtgcaagaaatgcagcacagaaagacgccggaaaatggaggtcctaatctgtacggtgcgaagattacgggcggagggtctggtggctccgtttgtgttatcgggaagaactgcctccaaagcgctgaagagatcgccgagattcagcaaaggtacaaggcggccacgggataccaaccgatcgtctttgacgggtcgtctccaggcgctggcaagtttggttacttgaagatccgacggcggttgataatcaccaaatgaagtggccggctttccaatccattgtgcccagtgaactcaggtttgttgagaggtcaggctgctgaattgattgaacacaggacatgggaagcagcaattcattgtgtatgtcggactgcagcatgaataataagctctttttggagcacgttttctgtagcacagttcgtttcgttgccatgacatttgtgcttcgaccgggaatgccaggaatacatatatagcacagataagaatcaaacagtttttaaagatgaaagccaacttggttttaaaaaaaaaaaaaaaaa

SEQ ID NO: 4777 - DNA, 1436 bp, Triticum aestivum
  Clone ID: PAT_TA_4777
cccgccacgacgccccccccgccccgtcgccgttcctcccgacatggccgcccgcccgcaccccgaggccccaccccccgctcccgacgcccgggcgcctcctccccgccgtccctcgcggcctccccgtcgccccccgccccgacccccgaccccccccccccgcccggcgcgccccccccccccgcccggaagcctggcgcccctgccctcgcccccctgcaagtttggcggcagccaccgccgctcagtcaccacaccagcctccggaattgaagaccgccctggctgcccctctgctgccgggctcacggagaagggcgccaccccgccatgattgccgcatcggcgcggcggggtcgctgccgccgccgcttcgtcttccccgtccggccgtgtctcccagctggcctcgacgctgaatcaccagggatggattcacgaccggaacaagaaggcaatggagttggtggccaagggttggagcgccctacaggaggtcgatcgcgtcatcgacttcgccgaccgcaacgacaagcgactaatcccacttctcaggggcgcaaaggagaactttgagctggctctagagatcgacaatatgaatactcatgcgagatgttggctggccaagatgcatttcaagtaccatgttcccggggcgtgcaaggcaattggtgctgctttgcttgttgaagctgcgaacatgggtgatccagaggcacagtatgaacttggatgtcggctaagagttgagaatgatcatgttcagtctgatcaacaggccttccattatatagagaaagctgttgaccagttgcatcctggtgctttgtatcttcttggtgctgtatatataactggggattgcgtcaagagggacatagcttcagctatgtggtgtttccatagagcttcagaaaagggacatgctggagctgcaattgcatatggttcccttcttctgaaaggtgctgaagtgcctgaagtcattaccaggttcaactcaggcaagagtccgtcaactgggaaggtgcgaaaaaggacaatacagcaggacccagtaaagctggcaaaggagcagttccagatagcagctgagtctggatctgacctcggtttacggtggttgaagaggcttggagattacgaaaaacagcccgaagagctaaagcaaatccagcaatgacctccagcgaaagaataccactgcattcggcaattagtggatgttgcaatgctcttgctgcacattagtagagagcttcatgtttcatctgccttcagaatgtagagataacctatctgcacattaaaaatcgctatttctgtaagcttttcttgctcctaggtgatcttttgaaaaattcgtactccagctattcctagcaaacaaccctagtatttttgacaggcatagtaaacagcccctagta

SEQ ID NO: 4778 - DNA, 1443 bp, Triticum aestivum
  Clone ID: PAT_TA_4778
gtcgtacggacccgacgtccccctccccaaatcgcgccccacacgccccccccttccctaaatctcgcctccaacgtccgccttcggccccctcacgcgccgccgccggcgaacctcggcgcggtgtccccctcccccggcagctcgccgcagccgtgcgcccgcccgccggctgcatgggccggccaaggtgaagcgttccagtaccaggcttgcgtcatgtcgagcgcggcgctgcgcgggctgcccgcccccggcggcggtttgcgcgccaggagcatggcgtcccccctcctgtccggcaccacccggcagcacacagagcgatttgccacacagcctgcggacggcgcccgtggctcagacgcggcgcacctcttgcggaggcgccagctggccggcaggggcggctgggggcgtcatcgcccagcgcaccccatcccccccctagaccctgaactcccggccggggacacagtggccaccgaagcagacgtatcccggtcgcggtggctccgacgctcccaccctcctccagatactccagctagtccaaacggatggctgggggggtgttgtacagcggcctcaaaccctcacttattggcaccatgttcttcctgcgattccattacgggttcttgtcacacgtatgcagacacatacacaggcaggaaaggaaggtgatagagtccaagagggagcttttgcttaaggaaatatccagggccaatccaatggatgctcatattcttaaggatagattagctaagcttgattctgaaaaacctcgcccatatggcacacttcaagcgatccgggaggtctatcgtgaatcaggcataagtggattctggaaaggacttgttccgacactaattatggtatgtaatccatcaattcagtttatgatatatgaaacactgtcaaagcgtctcaagtcaaagcggtctggaaagcgattccccaagaagaatatcactgctatggaggtattcttaataggtgcaatggcaaagctgggagctactcttgtgacctacccgttgttagtggtcaagtctaggttgcaggcaaaacaagaaattggcaggaacgcggcgtccagatatacaggtacattagatgcaatattgaagatgattcgctacgagggattgcacggattttacaaaggaatgggtacaaagattgtacagagtgttcttgccgcctcggtcctttttatggtgaaggaggagctggttaagtttgtagttcttttagttgccaggagtaggactctgcttcttactagatctaacaaacgatagatcttgttttctgatcagattattgtattgtctccacatgtagtattccttttgaaaatgcactttcagttctttattagtcagaaaatctcaagtatctctaaaaaaaacctcggccgcgaccacgcta

SEQ ID NO: 4779 - DNA, 915 bp, Triticum aestivum
  Clone ID: PAT_TA_4779
gaattcggcacgaggtttcctccacccctcgaggctgcaagtggattgcccgccaaacctcatccatttcatctcacgctgatcggccgaagcttcccgtggatgctctatacgcaattttctagcccgtgcatcacacaccaccacctccgtcggtccaccccctccgtccacaccccagcaccgccggatcacctccagatcccagattgcagctccacccccggtctccttgcaagctctgaggtgcttcgaattttcttactcctggtggatccagtctctcgtgagctggagatccttctacagcggccagctgaccatattgccactgaccacgggttgtggttgaaaacaactagcttataaaattcaatagtcgaagccataaccgcgagccatccagtaaaatctacaagatggaaggacgatttccttccagagatattacaaatgttcatcctacgacttcaccaaaagggaaccagttagctgtcattggagagcagagtggtcctttagctgaaaccaaaagtgttatgcaaatgaattctacccagcgtaagcgttaccgcgaccgggatagatatctgcaaatgactccatattagagggaagcctatttgcgaaggaatcgtgagtataagagaatgaggcgtgtgtgcagtgcaagctgtaccaatacagaaccagcatcagaacagagaatttcagtagctaataagaacacatgcatgacaggaaaggaagtcggggccagttcaatctatgagaagcatgattcagtatttagtcaagtagggtcttcgaaaggcaaaacaaggttgtgatacataattaattaacagatatctactatcaaaataagtgagcacatatcaattttttaaaaaaaaaaaaaaaaaaaaaaaaaaa

SEQ ID NO: 4780 - DNA, 369 bp, Triticum aestivum
  Clone ID: PAT_TA_4780
ttttttttttttttttttttttttacctcatgaatgtagcagtaacgtgtcccttctccagtcttggattccgcctacaaaattgtttacaaggagttatattaaatggtattcactgatcggatgcatctgaatcaatatgcacaacaagaccactactccttggtgtcttctgtgtatacatcaatacatatactatttatccacacaccatggatcatcgcatatatattcatgtggtctaatagacgtttattcaatagctacaggctgatggtgatgagctgctccctgctgttagacaagccgggcgctgttggccagacccaaattacaccggctacaaggacccaacaggctttgctggag

SEQ ID NO: 4781 - DNA, 777 bp, Triticum aestivum
  unsure (1)..(777): unsure at all n locations
  Clone ID: PAT_TA_4781
gcccataatgcaataaatattgatataaaagaatgatgcaaaatggacgtatcaactcccccaacggctcttaagtgacccgcactctagctaggcgagcatgcccaaacgccggcccgaactaggtatccacacatcactcccttgtgcactgttccaacgatgtttggatatcctttcactgctctcttagcttacacgcctatgcaactctgactttaactcttatttcttctggagatatcatctgaaacaagcaaatccatttttttagcgaagcatgacggcgctacgggatctggtacacatcatgcacacccgtataaccttgtaagtatctgtcctccggtacaacatcaaggtcgattcctcttatttgatcaaccattcgccgtgtcaaaaatgcagagggggatgcaaggagcacaaggcctgcacatccaagcaagtggtaacatggacttgtacatggaacatcccaagcgcaatcagagctgcagtgagcctgtacaacgagctagcgtaagtccctgcatttcatttaattcgtactggcattcgtgtatgatttgtgtgcagtggctgatccacgaatttaagttaccaggggcgaacatttaacttaaaaaatacgaaggcacttgcactctggaaatcaacataacttgagaaatgtgaagctacatgcactttgaaaactagctaatgatccaaagtagttcagattataaacactaaatgatgcaagcaccanaaaacacaaaatgcaacatggtg

SEQ ID NO: 4782 - DNA, 907 bp, Triticum aestivum
  Clone ID: PAT_TA_4782
cagtcgcggtctctgtccgcaagctccaactccctcccccctccaaagccctccggctgcaagataagtacaagatctgaatcaagaaaaccgccggcgatgggctgcgtgggccggtgctgggacaaatgcaagtggccactagcgtgcttccccgccctcgccgccgtcatcatcatcgtcgtcatggtcgcccgcctacagcttcgccatccagccatccatcaccgtcgaggacgcctcgctggccaggttcgcgctggcgaccaccccgacgacgtcgctcgggtacaacctctctgctgcggctcgtcgtccgcaaccgcaactgggcgacgaccatgaagaacacggagccgcttggaggcggcgtaacaatttcgacggccagcagttcgaccgcgtgcaggtcgccgacaagggcgacaagcacggccccaggaagacccgggtgtaccccctcgtcacgggccaagagagcggctacggggcgctgggccaccccggcgtcgccgcgtacaaggagcagaacaagaccggggagttcgagctggaggtggcggtcaccggcgaagtgcggtacacgctgcaactgaagaagaacaagctgtcggggacctgcaagctcaagctgaagatcgactcgccggcgacggccgccgtggtgttcgagaaggtgaaatgcaagctcgagaaggagaagaaggaccaagggtagttaatttgctagctactgtgcactgtatggttttcatccaaagttccaagcaatctatggcggccgggtggccacttgccatatcgagttggtgtagttcctctcatttttttttcccccccttttcctttatgtaaaatgtttttcgatggtgaatcttgggaggtgtttgtttcagcaaaaaaaaaa

SEQ ID NO: 4783 - DNA, 570 bp, Triticum aestivum
  Clone ID: PAT_TA_4783
cccacgcgtccctctgcggccccccccgggcgggccccggcgcaagcacaaactggccacgaccaacacccacagcccggatccagatcttctttcttcttcgtcggctcaccagggaaggacccggcataccgtcggtcgagccgattcttgtgagcgggtcgttcatcggtcatcacgcgatggctcgcgcggcgaacgtcgacgtgcccgctgccggcgcggcgcagggcggggcgaggaaggcggaggggttggcggccgtggccggcgacggcaggagggtcgaccaggccgtggcgtacctgctcatggccgccgcgcttgccgtcacctacctcgtgcactgatcgaccggtcggtcgacggacggcggataggagagttcatgttcgtgtcgcttcatctttgtataaatctttagcgaggaaaagaaaagagattctattacttctgtatctctgtataatcagttaaattcgtaggtgaatcgcctgttcgtgtcgttaaaaaaaaaaaaaaaaaacaaaaaaaaaaaaaaaagaaaaaaaaaaaaaaaaaaggccccta

SEQ ID NO: 4784 - DNA, 837 bp, Triticum aestivum
  unsure (1)..(837): unsure at all n locations
  Clone ID: PAT_TA_4784
cccacgcgtgcgcccacgcgtccaatcacgcgtacgggcacggcagtgataactggccacgaccaacacccacagcccggatccagatcttctttctaattggccacgaccaacacccacagcccggatccagatcttgttctagtagcaaccttcttctgcgtcggccgctcacagggaagggaaggactccaccgtcgagccgattttcggagcggatcgttcgtcggtcatcaggcgatggctcgcgcggcgaacgttgacgcgcccgctgccggcgcggcgcagggcggggcgaggaaggcggaggggttggcggccgtggccggcgacggcaggagggtcgaccaggccgtggcgtacctgctcatggccgccgcgctcgccgtcacctacctcgtgcactgatcggtcgatcggtcgacggacgacagtcggcagctaggagaattcatgttcgtgtggcctcatctttgtgtagatctttagcgaggaaaagaaaagggattctattacttttgtatctctgtagctagttggaatcagttagattcgtaggtgaatcgcctgttcgtgtcgtttcatccatgttcgttctgaaggtctcttgacatgttcgtggtcaggcccagttaattgaagaactaggttgacgtctcccaaaaaaaaaaaaaaaaattagccctaagcgccactgcccacgtgtcgctctcataggcggctcggacggccgcctcatcctccaccaccagcgcctctcctcccctctccatggcgattgcacttgggagcagcggtttttacattttagtanaccgcacgcatcattaatcaatg

SEQ ID NO: 4785 - DNA, 1028 bp, Triticum aestivum
  Clone ID: PAT_TA_4785
tggaaagcatgagcacggaaccgcaaatcacacggccaagcaaaacacacgaggatggctagctgctacaagccacgggatgagagcaatgggtttgagagatgcagcatactcaaggccgacaagggattttcacgaaaggcgaggacgaactaattaagcaaggaattgcattggtaatgtttccccctaccccaaacttgattacttcagcaacagttctttttgtttacttgatatatatggtgcaatttccaaaaggttttttaacccgcaattattttcatttatagatgatgatttcttttgaagggttcctaactgaatgttgtaccctcaaccgtggcaagcaaaattttcatgcaatcagcatcacaaacattcagtggtagttaatagtctatatccttggtcactctccaaactttactatttctctcaagattaaacctaatatgaccatagctaacaaagaagctctaagtagcgagaatccgagttttaatatagctgctgctaatatatgagaagaatgtgagtacagaagatcataaactgatccagtaaagtaatactattagttttaggatatatatatatatcttctcacgttcttcaagtagtcagttgttgactacatttgtaatatagtaagatttgtttcattgcatcggaagtcatgccataaaatatattcaaacttctctactgattcaagtcgctgccatgctgttatatatttcttttcttcattatgattatttgtatatggctttcttagcattgataaattcactgatgtaacacttctattttgattcagcaaaatctggtattgattattgtggtggcttttagtaagtaactcttcacaatttcaatccttcttatcattggttgagtgcaggctaatgcaaacccattagctacaactcttagtaatgccaacacctacgcggcatcacacatgcatgcaccatgtatcgtgataataatgtcttctttctaactaaaaaaaaaaaaaaaaa

SEQ ID NO: 4786 - DNA, 651 bp, Triticum aestivum
  Clone ID: PAT_TA_4786
tcgacccacgcgtccgctgcagccttatccggtcgcctcctatgcgccgccgcatcaaccggctccagttgcctcttatgcacagcatcagcagccggctcaacaggttgcctcttacgcgccgccactgcagcctcaggttgcctcctcttatgcgccgccgccgccgcagcctcaagttgcttcttatgcgccgccgcagcagctgcctcaggttactgcttatagtacttcgcaaatgccacaatcatacatagagcctcaacaaatccattacgtcaatgcacagcaatttggtctgcatggtgtatctcagtccgctaatctgatgcctgcgcacatgagccagtatgtgcccagtactctgggaacaaactccatggcgaccacgggtgcccaaattggtgctttgaggcctgtttctgcaggtacagaacgtgttctggagaatctgcatttctcacggccaatgcaaactccagttgatccgaattgcagggtgctgcagccactttcagagcttcctcctctgcctcatacgactttgcaggcaagtgatgctcagaggtatggcgtccagacggtactcacaagcacagcaagctcaccggtgatgacgagctcgagggcattcccagtggtggtaagctc

SEQ ID NO: 4787 - DNA, 936 bp, Triticum aestivum
  Clone ID: PAT_TA_4787
gccccccgcgcgccgccgccgggctcgaccgctgctctcgtggggcagacctccggcacagggagtatccttgtgaatagtttggactgggcaaggcttagaccaaatctgccgtggcttgtagatgctggaggatgtgtttcgcttgattctttcattattcttcagttcctttattttcaataccggaagcaaagtgggcgtgatgaacttgacaatttggataaagcctaatgcatagtgaaaaagtatttcatttctcttcttcaatggaaaagacatggaggtaccacctgcgtggggattgtgcatttttcctggaaagctgcgcaatagcactccccccgcgggactgctgaggcctgggccacacggcgtcctttgcggccgtggcgcggcggtgccgcagggcgcggggtgcttgtctctttcgggattcttccgctccgtctgctgcgttaccggaagcaaagtgggcgtgatgaacttgacaatttggataaagcctaatgcacagcaaacaaagtatttcatttcttttcttcaatggaaaagacatggagctaccacctgcgtggggattgtgcatttttcctggaaagctgcgcaatagccactccccgtgcagaactgcagagacaaggttcacacgcttaatttgcggtgaatgagctgcggctccgcatggttaagggatgaaatctgttaagggatagatgcagcagtctgctgtgttagaatacaaaaaatgtgtcatgtactcggggtcatgctatatctgtacatcgtatggtgatgtgcagttcttcatgctatctctatttttgtagcggtgccgtcttgtgtatgatctggccattgttgccggatgctcagattcaaatacgcgttgaggccccatctttgatctaaagcattaccaaagttttaaaaaaa

SEQ ID NO: 4788 - DNA, 1608 bp, Triticum aestivum
  unsure (1)..(1608): unsure at all n locations
  Clone ID: PAT_TA_4788
gacccacgcgtccgggggtgcaaatctggaaggcgccaccccctttggggccgggacggggcggcggggtgcgtatctgggtggggcctccgccttttttctcgtgccgggcccgctgcctctgctcgggggtctgacggccgcttttagccacgttccgcgccccagccctcttctccgggaacagatggcggaggttggcgaccgcccccgtcccggcctttctcaacgtgatggagtcacgatggttgttgatccgacccatcacgccgtccaccagagacatggagacacaatggttattgatctgaccgataaacaaggtgatgaaggaaatttaagcaatgcatttgctgctgaaatgcagaactttcctgatatcaggtatgtgcactttgatttccatcatatttgtcgcggagggaactttgataacttgcaagttctctatgatgaaattgaggaagctattcagaaacaaggatatttccttatgaactctaaaggagagatattattggaccaaagtggcgtcgttaggtccaactgcatagattgcctggaccgcacaaatgtgacacagagtttccttgcaagaaaatctttggactcacagctgcaacgaatgggggcattatcatcagctgaaagtatctctcaatctgatagcattaacgataaatttaaaaaatgtaagtgtgggttgagcatggtgatgagctaagccttgaatatgctggttcttatgccttaaagggagaccttgtaaggtatggaaggcagacattgcctggattgattaaagatggcatgagcgctctttcccggtattatttgaacaattttcatgatggagtgcgacaagatgctctagatcttatcagtggttactacacggtcagcaaaagcagttcttctccttttcaaatcattggatttgaatctgcaccatatcttcctgtggcgtcggcaatcatagttggtgggatcactgtcacaactttcactcttagtcaagttggacggagcgcacaacacctcatctcatccatcatcttcgctggcttgacagccggagtggtagccttggtgaaagcgaatgggaagcagctctgctctagaccccgattatgcggtctgatctagttggcggccccttttctcttgtccggttctcagagctttgttgttggaatctgaatggatatgaagtgttgacagcaagctacctgtccactgtcagcgtagatagattaaccaagggagaggtcagcttgctggtccggtaaatctgaagtaaattttgtaaacacctggttagattgtctggtttcctggtaaatatagtggattgtgcagtcggagacacaccgtcttgtagtacttactgtaaactaaggttaaactgtaacactggattctaccgcacagtttctgtatcttaaacttgtgaaattgcttgcaaaaaaggagaaccttcgggtcgaggtgcgagccgcggccggggaaagctgacgtggtcaggatcaggtggactgcagctctcatcggtntcttgatgtgcagaaattccaggattttgggacaccgagtgctcccccaattgca

SEQ ID NO: 4789 - DNA, 793 bp, Triticum aestivum
  Clone ID: PAT_TA_4789
agcactgaagcagtcaagtgtccccgttaaagctgtctgggttaaacccatcatcggatcatataaactgaatacagacgcatcgttgttcgaaaagaagcagttgcaggtgtggctaaaccgtttgattttgctgccagccctccgtcagcagaagctctggctgcccttcgtgggctccaaacaaaattcgaagaactcttaacaaaagtaaccaacacttccaacaatgttaaatcaaggagttgaggtgttggaaatcagcttgtcctcactatatgattcttttttcctcttatcctcatccatctccattgaggagtaactaacacttccaacagcttcaatgttaaatcagcaacttgtgtcaaaccgtgagcactccgggtacagaatctttgcttgatgatcttcccttaccatcttgttggagtgaattatggcaaaggactcaatccccacagttattctcttcttcaatgaaatcctctgccttttagtccaggggaacctgacctgcttttcgtctttgcagttagcacacaacaacctactatacaggaacacatcctctagattcacggccgctgccataacacgtctgacataattcacaaagtaatcttcagattcaaagccacagatgacaagtgtaaccaaactgcggtgttggaaatcagctgtggccgagtcccactctacacccttgtcctcactatataattcttttttcctcttctcctcatccatctccattgaacacgcatgatcccatactgtgatgtatagatcc

SEQ ID NO: 4790 - DNA, 1581 bp, Triticum aestivum
  unsure (1)..(1581): unsure at all n locations
  Clone ID: PAT_TA_4790
ctttgtgcccgtgctggcgagtctgtgctccggacccgctgggggcactcctccgagggttgtcgaagcctcggccgagcctgcactgcccttccccgtgccactcatgtgtttgtcaagaagcagacagagatccatctgttcagtgcaagattcaaggagcttaatggcgatactgatggagcacgtgcagagtatcaacatctccactcagtgttataccctggcctcctcgaagccattgtgaagcatgctaatatggagcaccggctgggagataaggaatctgcttgtttagtctatgagaaagccattgctgctgaaaaggagaaggagcagagccagcttttaccaatgctactgatccagtactcacgtttcttatatatggtcggtgacttggaaaaggcaagggagatctcaggtggactgcacgggctagctaaccttactaaaccagttcttgaggctgtcatctttcttgagtcgatctttcagtctgagaagcgtattgatttgttagaatcactggtggagaagtttcttacagctgaacagactcaaggggagctggcaagcttaagtgacaaagaagaattatcttccatatatttagagtttttggatacgtttggggatgtacagtcaatcaagaaggctacaactcgacatactattctcttttcacgtaaaaggagcattctgccatcaaagaaacgaagagcagatgatgctgtcatgtccggtagagataaaatggccaaaactggagatggcacccaaccaggcatgggaactgatccaaatgctcataatcctgcagtttggcctgcgacttctgaagcatcagcgcagcaatggggggctgcttacgcacagcaggctgcttatcctgcatatggagcttacgactacagccaacaaatgccccaatctgctcctcaagcagccgcttatggtgcctatcctcccacataccctgcccaggcctacccgcagcagagctacgcacaacctgcagcgatgcccgtggcagcagcagtgcccaccccagcacaggcaccagcacctgcagcagcctaccctcagcaacctgccgtggctgccgccccccaagcttactacggcggcgccgccacgtactactgatttctagattggtgcgcacactaaggggcgggtgttctcaacgcatgggcatgtgtacctacgtagctgccttacatagctgtgacccccctcggtatcgtgtatgcattggcaggaagttttttggcagcagcaggccaaagaagaagaaaggcaagaccctttttgtttgtcgaggtgtaactagttattcagtcagatgctttttgcagcagcagcagcagcacttgtaatgcgtccagatcttagatctgtataggatctttctttgtccagtgctagcacccatgcatgcatgtttctaggaattatctttcgtttttnctgtgttatcactttgttgagatgacttgtgagttgcaatagtatggctgtagcgggtatctcagcaagtggaatctgccctccaaaaaaaaaaaaaaaaaaaaaaaa

SEQ ID NO: 4791 - DNA, 568 bp, Triticum aestivum
  unsure (1)..(568): unsure at all n locations
  Clone ID: PAT_TA_4791
atcacattcaacgacgcaattgtgcagtacgtagtagaaggtcttccgttcggtggcatcgggcaaagcgggttcggacagtaccagggcaaatacagcttcgagcttttcagcaacaaaaaggcagtgttcaagagaagcttcctaatcgagttcatgttcagatacccgccatgggacgacagtaaaatcgggatgttgagacatgttttcaacacgaactacattcttctactccttggactgctcggcctgaggagatgatggaaagaaacaactcggagaaagagaccacgaagcaaatagccgagagaagctgcgccagatgaacaaaagcatatggactgcaaaccacataaatgctacgtaccctatatacttgtgttcgattgcaaaattggattgtgttagtgtgttacccgttttcccgttgagtgttgtgattcccccaaagaatttgacaatttaatactaacnaattcaaggagaacaaccttaaggtgtttggcctagaaaaaacaaagaaaaccttttgaaaactaaaactaagaaacttccttactaaaaa

SEQ ID NO: 4792 - DNA, 703 bp, Triticum aestivum
  unsure (1)..(703): unsure at all n locations
  Clone ID: PAT_TA_4792
gggtaaccgtggagtggatctcgcagggggggctccgccgaccgccggcccccggcggccccagggcccagggttcgttcatcctgccggccaccggcgacctgctcgccggtgagtatgtacagcggcctgaagaagcgcctgcaggggaaggcgtcngatcttgcagggcagatgagagaaccacttgcatggcactgagtgagagtggtttatacaaaggcaagacttgaagattattcatccaaaagagcatgtcggatatgaccaccatcagaagcagcaatgccacaagtgaggtatcttacaataaatctatatgtgctattgctgatagtgctgcttatgtcgagtacctgtgttggatttagaatactgtgttgtatgtttcttgtcaatggaggctcctgaaacttggagaacactgcatttgtcttggtgttttgatttgtctttcttctgcaagaacatgaagctctccttgtgattgcatcctcctatgcctgaatttttttttatcgactcaagaaccgtcaagtttcagcgccgcctcctgtgtttagcttcttatgaacttatttttccatttctttgtgttgtaaggaagtgtgtaattatgatgtactgctggctggttaatttgccttggcgttttgatctttttcgacatgaagctctcattgtgattgttcccaaaaaaaaa

SEQ ID NO: 4793 - DNA, 2056 bp, Triticum aestivum
  unsure (1)..(2056): unsure at all n locations
  Clone ID: PAT_TA_4793
gtagccgcctcctcctttcagccgccgtttctcccccccgtccccgcccccgtccacgtgctccggcggcggccatctttcgccagataatccacgccgccgcccccgtccatcccgtctcgccgcccccagctcgacctcgccgctgtccagctcgccgccaactagctccctaagctcagaacaaggccttgggcgggcgccctttttgctctatctcagggccggccccgatggcttgtgcggcttacagcatcagggggcatctcaagcttgccacggggcctggcctggatagtaatcatctgtgcggcggctggaagcctttcggtgtcttaggcccgtttctcgggcactggagttaagcaatgtcctccaataatgcagtgcaacacgtcgcctggcattctcatctgtcggtccggaactcgagagcgtcggcgctcaaccccgacgccgtcgctggagggcggatccctggtcgcggcagggggggtggcggaacgcgacatgcgcggtggtgggcgggggcccgctctccgtcttgcttcgccccgttcgccgccccgcgggacgctggtatgcccccctggcaatgctgggattgcttagtccaggtatgcgtttctagtagtgatgctgttatatcgttctgccgcaagaggggagtgggaatggtggtagtgggtcctgaaggtcctctcgttgcgggtcttgcgaatgaccttgtcaaagctgggatacctacctttggtccgtcgtccgaggctgcagcattagaaggatcaaaggactttatgaagaggttgtgtgataagtataatatccccactgctcagtaccgcacattcacggatcctgcaaaagctaaagagtacatcaaggatcaaggggcccctattggtggccaagctgatggattggcagctggaaagggcgtcgttgttgctatgactttggatgaggccttcgaagcaattagactctatgatggttgacgagtcatttggttctgcttggttcccgggtcgtcantttgaggagtatcntggangggcgaaggagcctctttctttgcattagtagatggagaaaatgctttgccacttgaatcagcacaggatcacaaaagagttggagatggtgatactggtccaaacacgggtggtatgggtgcatactcccctgcgccaatagtgaccgaagagcttaagagcgtgatcatggaaactataattactccaactgttaaaggtatggctgctgaaggatgcaagtttgttggtgtattatatgccgggcttatgattgagaagaaatctggtctgcctaaacttattgaatataatgtgcgatttggggatcctgaatgccaggttctgatgatgagattggagtctgatcttgcacaggtcctgctatctgcatgcagaggagaactgggtaaggtttcgctaacctggtcacctgaaatcgcgatggtggttgtgatggcgagcgaaggataccctagctcttataagaagggcaccgtaataaaaaacatcgacaaggccgagcaggtttctcctgctgtcaagatattccatgctgggacagctttggctggagacggcaaccttgtagctgtcggaggccgggttcttggcgtcactgcgaagggcaaggacatcgaggaagcgaggtcgagagcgtacgatgcggtagatgtcgtcgactggccggaaggattcttcaggcgagatatcggctggagggcactgaagcaggagcagacggctaactactgattagttgggttttcctaaatctggggtgagcttccagcgtccaagtgaaatgaagacagtagagccaccattgttgtggttgcggaattgacaggagcatagcttctcccgtcgaacatgagcatcttttggccatggtttggctccgaaccatttgtagcagtcatgtattttccacaagtcaggcaatgtgtcaattgctcttgaggtgcaataataataccaccaaccaactattttcaagtgaacataaccatgtgatctct

SEQ ID NO: 4794 - DNA, 1298 bp, Triticum aestivum
  unsure (1)..(1298): unsure at all n locations
  Clone ID: PAT_TA_4794
gcttcgttgaatttttaagtatcgaagtggtggctcattatttctctatgcaaatgcggatgattcaacacttccccaggacatatatcgcctgttgagtcgaccctatgcatttggttgtgttctcaggctgagaacatcacctgattttgagcctggccactcttatggccatttcttccctgatcctcaatatgaaaatgtgcaacatattatctgctgtgattcttttgctacatatgcctatgactttgactttacccatgctgatggcttctccaggcacacagaacctgctgttgtacagatcgcttttcagtacagtgtcattgagcctgtggaggtggcatcagggaatggcccacaatcatatccaaggttttgtctcaagagacggttgagaataaggacattgcagtatcggccggctaataatatcaatgaaatatatgacagtgtcgatcaagaggctgtcctacatatccttgttcataaggttattctagtttcactggaaaatggggttagagaaggcaagaaattcggtgcatgattggctggctatccttataactcggtataatgatagcgttgagatctgatccacgaacaccagaatcgcacattgatatagacttctcacaatgcccccatctgcaaatgataccccagtttgtgtttggaatgttgaggagccctcttcttcgcttgcatgaagaaggcatccacccagattacaggatatatcttcaatgccttttcaggtatgtaattttttcgttttgtacggttcacaaagtctggtgcctgtatgtctcggagaatgtccaaaaacttgtttctgctgctgtaactgatatggcaacaaaattttatactttgttgctgctggagtgatatctcatgcatttttgtgaatcaatgcgaattaattttctcacttgcaagtttgtaagtcccctctgaactattcttgcagctcactggagccatcttctctagccaaagctatatatccacttttaatttcgtactcctcacctaataagcaagcattcccacggcacactctgagccgtgctgctctgacgatgagtgagagcccgatatttcttctggatgcgtttaccaaccttgttngttntactattcatcgactgctgatccttcgcttccttttcctccaccccatgactgtcttttgagaacaacgattaatgcgttgaagccggacanggtgtatcacagccttaagcttgccanttgttccgntggggggacacggacganttcactcg

SEQ ID NO: 4795 - DNA, 895 bp, Triticum aestivum
  Clone ID: PAT_TA_4795
ctgaattcggcacgagctgaggatccggctgttgccgggcttctcccgtcggatccaatcgctgtcagccagatccgctgcagcgtgctagctggccgccttccgcagcctcaccgcatcctgcatcgaccggagaaaccccttcgtgatcccatcttcctccccctacaccagcgttggtgttttggcgcctcccccgtgaagcttcgttgttgccacaatgaagttcagctggctcactgctgcagcacgtcgccggcggtgcacactctgcacgcatgttgtccacttggcgattgtgcgttttggtgtttacatgcaggtcatcggtttggtgcggcgagctcttacagttcagggcggcactggccgatggagcgccaccacacctgcgccaccccttcaacctcctccagggccgccgtgccctgatccacctagttgcctctgtcccacctcaatctagatcaggatctagttcctcgttagctgtcggccgagcttcttcctcgctggtgagctccttctccctctcccatcagattggggagtcgctggtcaacacacctcctggtggtgtcctatggcaagcgtgcttgcagtgcagtctggcagcgagcacacttgcagtgtagtccggcaaaaatttatgtggttcgctccgtaaaaatgaatgtgtatgaagaaacacttatgcagtcctttctcgcgagtggggaagccgatgccgtgaccatgcagttccaacgcgatgtgtgatgtgtagcgtgcaaacaaaaaatgtagtccgatcgcctcatccctgcagtgcatatttcatttttaaaaatgcagtgcactacgaggaaaattaaaactctgtagagaaaaagaaaaagaaaaatgcaggcactcc

SEQ ID NO: 4796 - DNA, 1904 bp, Triticum aestivum
  unsure (1)..(1904): unsure at all n locations
  Clone ID: PAT_TA_4796
gnnnnnnnnnnttctgattacgcnagctcgaaattaaccctcactaaagggaacaaaagctggagctccaccgcggtggcggccgctctagaactagtggatcccccgggctgcccgctgtccgccccccgccggccatttcccactccggcgagatgctgacctgcggccgatacctatcctccgccgctgccacaacgccatcctttcccccgctccggacactaaccttctctctcctccgctatcatcctatccgcttcctctcgttctcctccgccgccgccaccaccgcagtcgaacctgagaccataagcggcggcggcggcgcgggtggtggtgccacgaggccgcagtggaaggcggcgatagacttcaagtggatccgggacaacagggatgtcgtcgccaccaacatccggaatcggaactccgccgccaacctcgacgtcgtcctccagctctacgatcagtacctcgcgctgcagaaggaggtcgaacggctccgagctgaaagaaatgcagttgctaacaaaatgaaagagaaactagacccgtctttgcgacaagcccttgttgacgaaggcaaaaacctgaaagaaagccttattgcactagaagaggatcttgttcagctaacttataagcttcagttagaagcacaaagcattcctaatactacacatccagatgtgcctgtaggggatgaggaaagctctgtcaccagaaaggaggtaggcagtcagagaagcttcagtttccccattaaagaccaccttcagcttgggaaggaccttgatttattcgactttgatgcagcttctgaggttagtggttcaaagttctactacctgaagaatgaagctgttttgttggagatggcccttgtaaattggggtattgctgaggtctcaaagaagggtttcacaccactcataactccagagattgttagatcatctgttgttgagagatgcggcttccagccaagggcccaaaatactcaggtctattcaatagataacagtgatcagtgcctcatagggactgcagaaattcccgttggaggcatccatatgaactctatccttgtcgactctgatttacctctaaaatatgtggcatattcacactgttttcgcacagaagcaggtgccgcaggtgctgccactaccggcctttaccgagtacatcaatttagcaaggttgagatgttcatattctgtcggccagaggaaagtgacaagtaccatgaagaacttataaccatcgaagagaatctttatgcatcacttggacttcatttcaaaactttggatatggcaacaggagatttgggcgctccagcctacagaaagtatgacattgaggcatggatgccaggcctggatcggtacggtgagatctcaagtgcatcaaactgcacggactaccagagcaggcggctgggtatccggttccgtccagcacccttggagcctccaccgtcgacgaacagcaagaaagggaaagggggtagttcaggtccgacgcagtttgtccacacgctcaacgccccggctgtcgctgttcctcgcctgatcatatccattttggagaattttcagcaagaggatggtatggtggtgattcctgagccgctgaggcccttcatgggtgggcttggcgtcctcaccccaaaaaccaagtgatagtggcaattaaacttctttttttgcgggaggcatttaaactatttaggaggagtttctttttatatggaagtggcaagtgcctcgaagaacctgttagtacctgcccgggcggccgctggtactccctctgtaacttaaaagaagtcattttctgacactgattttgacacaatcatagtgtaaaaaaaaagtcttatattaagttacaga

SEQ ID NO: 4797 - DNA, 746 bp, Triticum aestivum
  Clone ID: PAT_TA_4797
ttcgtgcttcactggactgggcaagaaggttagaattactacgcgcgatcgcgcatggtgttgcatacctccatgcaggatcaggcgagagtgtgatccatcgtgaccttaaacccgggaacattcttctcgatgatgagtggaagccaaaaatcgctgactttggcaccgccaaactgtttgtcgataatcggactgggcccgatcaaacaattgtcatttcgccgggatacgcagctccggagtatgtgcggggaggggagatgacgctgaaatgcgacgtttatagctttggagttattcttctagagactcttagcgggcaaaggaatggtagcttgcaaaggttctttcccaagcctgggaactgtgggagcagaataggatcattgaacttctcgacatgacaattgtgccgctccccaagtccgagcctgagatacttcctgagctaaaacgttgtatcccaaatcgggctcctctgcgtcccaggagatgccagatgataggccagccatgcctgaagttgtggccatgtttacaagcacaacatcaccaaattgattggcccagaagatcggtactagatagcagaatagtcatgcctttgaatctgtcccttgaacttgacactgatcacttgaaccccactgcaattgaggtgagatcgccatcgagtcgatccagctattgttgtctagctagcaacctcgctaattaagttcgtacaaaaaaaaaaaaaaaaa

SEQ ID NO: 4798 - DNA, 1222 bp, Triticum aestivum
  unsure (1)..(1222): unsure at all n locations
  Clone ID: PAT_TA_4798
actagtctcggttttttttttttttttttgaatgataacataatcatcgttgcatgcttcgcatccatttcatccaaaacacattatgagttatggcataacatacaacgcacaattagtctcgtacatcaaccctttaacgactctgatggccttgataaatggcatcatcatgcaaatgtacgctccttccacttcgccaccatctcgttaagcgtcttgtgcgacatgccacctgccgccagtccactccttgtcgccttctggagctctgtcacctttgtacgcattgcatccccctcttcactattcatcgtatcattcacaaccttcgtgatgtcttcaccaagaatcatcccatccgctcctcgaacctttggtcttagcgccaccttgatttcttcatgtaacatcactgcattctgcctctgctcggcgtatagaggccacgcgatcatcggcacaccatgcatcacgctctctagcaccgagttccatccacaatgcgtcaacatggctcccgtggcccggtggccgaggaccctgacttgtggggcccaggatgggaccaccaggcccacctccttggtcctctccaggaacccagatggcaggaacttgggtggatagtccttgctcttcgacccgtcgtagtagttggcaccggggtcggccccactgtcggtgggactcctcacgacccacagaaaccgttgtccggagagctccagcccgcgcgccagctcgtccttctgcgccgcgggcagcgcgcccccgctgccgaacgagacgaacaacacggacttgtcgggctgtgtgtcgagccacctgatacagccggtggnatcgtcgtcgccgtcgtcaggctgccgtatcaccggcccgacggggtacaccggcgggcgtcccggctcgggctgccggaggattgccgccgcgttgggctcgatggcgtcgaacgtgttcacaagtatgccgtccgcgtcgcggtacctctcaccgtggtgcaccatccagcggtaggcgtcgctggtcctgtcctggagcggctgcaggatgtcggcgccgggcacggccacgcagccgggcagcctgatgggctccggctggtcgcggaactcgccctgcagttccccgtcgaggcgcgggaggtggagcatgagggagagcatcagcaggttggaggggaagaagagtacgccgacgccggcgtcgcgcgccg

SEQ ID NO: 4799 - DNA, 531 bp, Triticum aestivum
  Clone ID: PAT_TA_4799
gtggagccatcaggctgcacgaggaggcatcaggctgcccgttgttgcgtctagaggagcagaggcactccgcggttgccgcacgaggagcgtccgcggtggccgagcatggaggagcatcggtgcgtcaacatcgtcttcgccgtttcctgctccgtcgccgcgcatggaagagcacgcgtcatcagtccttcgtcggccgtcagtgcttctcctccctctcagtacagatcattttttagcgtttgtttgctgctgctatgcttatgcattttgctgctctagaatgctcagtttactagatcgagcttaccactatattcagcgtgtctccttcagatgtactaatttgcacacttgtgccaagttgccatgtttattcagtgatttaatttgacatatcacctaaattgtttgccttgtcaacttcttcttttttgccatggttaatttagtgatgctgctgctactgtaatcaaacaatcgattggtcaacaaatcatttttctaaaaaaaaaaaaaaaaaaaaaa

SEQ ID NO: 4800 - DNA, 636 bp, Triticum aestivum
  Clone ID: PAT_TA_4800
aaataaataccaaagggtttttttcagtatcacaacagtttttttggttgctcccaaaaaacactgtaagaaaaacaaaccaaaaaatacatttcaatcaactaaatgaaatcggatcagaggaacttcaatagaaattactataaaattacatatagacattcttgaatgcaaggaatagccgtgggacagagcacatagttaagtgagaagtgatagagcattgagacctaagcgcgcaaataggtttccaccagagacactggaggatagtgcagaacctaagttgctcagcaccatatcattggcagactttcataaaataaccaccaacatacagtacttgaagatgatttttaagaaaaatagcagatttgccttttaataggaataagtaaaagaactaaatttaaataacaaattacagtatcagataaatgtttctttaagaaaagctgcagctttgcctcatgattcatacgaaagaatcatgaatcatctaatgattttttctttgcaggtgaattatctcgccttagaaaggttgtgccagatcatggcacaggcgagttgtgattttagttgcacatgagcagatctcggacgcgtgggtcgacccggaaattccggaccggt

SEQ ID NO: 4801 - DNA, 733 bp, Triticum aestivum
  unsure (1)..(733): unsure at all n locations
  Clone ID: PAT_TA_4801
gtattaagttcgtcaattcgatgccgaaaccgctcgcaatctacgctttcacaaaaaacgagaagttgaagcatcagattatagatgaaacgtcctctgggagcgtcacgttcaatgacgcaattgtgcagtacgcggtggaaggcctcccatttggtggcgtcggggaaagcggattcggacagtaccatggcaagtacacctttgagcttttcagccacaaaaaggcggtgttcaagagaagcttcctgatcgagttcatgttcagatacccgccgtgggatgacactaagactgagatgttgaggcgtgtctataatacgaactacatacttctactcctcggcctgctcggcctgaggagatgactgaagaaacaatctggacaaaaagaccggggacgagagagagagagaagctacaccgtatgcaccaaagcatatgcattacatattgcttccattccaaaatatgctgcgtccgcgctttccgaggtccaactttgaccataaatttaaccaacgagaccgactacaagcgggagaaaaaaatattgaaaaattcttttgaatacgaattcactgggtataacttttgctgccgccacagtcgtcacgttgggtgaatttgtggttaaagttgaagcatgggaatagaggaagcactatattttagaatggaggganacaacataattccanatacnatttaattggattgcaaaaaaaaaaaa

SEQ ID NO: 4802 - DNA, 1188 bp, Triticum aestivum
  unsure (1)..(1188): unsure at all n locations
  Clone ID: PAT_TA_4802
tttgggagatctccccccgtcgccgcttggctggcttccctgtcacccctggccctcgtcttctattcggcccctgctccccccgttctccccgattccctcgggtcccgcgtggtgccctggcgtgtgatcctcgtctgaagatattaaggatcggtcttgtaaagctctgagaggtcatcaggcagatctcttgatgttccccctgacgctgtctggctcccttccttgctgatttctctgcagccatgaactttaaactgaatggcatcaatatgttcaaaggcttcaaaggctttcgcttgctggacaaacaggaactggcttcgggagaatttatgtgatgctgtaagaattctgcaaatgaatgcagactatgagaaccaagggattctcccacggacatgtacctgtgacagcattaaggtgcgagggaaggggaagaggtcatatgcattctcagaagattttgaagataaatcagtttagaagacattgacctcatcgtgcgaagacattcactcatagatagggtgttggttccagatttgtacgaatccaaagattagcacaagtaaggaatctaactgcctaaacaagcttaagagaatatactgggcagcccaagacccgcagtccaaggggtccccgccttttgggaacacaaacggttcaaggtcgcctccgcacccccgagggggccgaagaagccgccaaccagaagccctgggggccacaccttgaccagacacccgtacccccaggggcggccgggcggttcatttgctccaanctttctacccatgcatggtcccgaaggaccacaacctggctggaacacatccgtccncactacccgggtgtccctgacgacaatcctgttcaagcgcacttccaatttgccccagantccagcgancaaaacaagaagaanttggggttaacttaacctggccctccggaacaaaggcaaatggacacgcgagcaaaaccaatacacngccgtattcnactggctgctcataaccgcncttatcaaaggatgcgtnatacctcaactgcccgatcgtgaactctgcgtncgaancaacatcaagancaaaacttaagtggccntccaaatccaggngagcattgaatgcccncnagantcatctaaattcccggtcagccaagcannctacaacc

SEQ ID NO: 4803 - DNA, 1332 bp, Triticum aestivum
  unsure (1)..(1332): unsure at all n locations
  Clone ID: PAT_TA_4803
cagttatccggagccaaactcacacctctttaccgtgtggatcaaagttcaggttggcgccaacatgtcgtcgaagaagatagagctggaccacaaggacatggttcatgattctgccattgactactatgggaagcgccttgccacagcctcctctgactccactgtgaagatcaccaacattgggggtgcatctgccccgtcccagctcgttgcgaccctcactggccactatggtcctgtgtggcgtgtcggatgggcccatcccaagtatggttccattctcgcatcctgcggctatgatggccgtgtgatagtctggaaggaggctgccactgggcaatggtctcagctccatgtgtttgacaaccacaaggcctcagttaactccattgcctgggctccatatgaacttggcctttgccttgcctgtgggtcttctgacggcaccatctctgtcatctccatgcggcttgatacaggaggatgtgacgctgcaaccattgagcgggcacaccctgttggcgtgacagcagtctcctgggctccagcagcagcacttgggtccatggttggctcagatcagctcgtccacaagatcgtgtctggtggctttgactgtgtcgtcaaggtgtgggagtttgtcaatggtggctggaagctggagagcgctttggtctccgacatgcacaaagagtgcgtgagagatgtctcatgggcaccggtcctgggcctggcaaagtcaaccatcgccagcgcttcccaagacggcaaggttgtcatctggaccagtggcaaaggaggaggcaagtgggaaggaaagctcatgcgcgacttcgaggctccggtgtggagggtgtcctggtccctgacgggaaacatactgtctgtggctgccggcgagggcgacataactctgtggaaggaatcgtcggacgggcagtgggagtcactgtggaccaaggcctcagaggagccgccacaggaggagcaggcgatcgaggaggccatgcagtaggggagtcgacgccacatctcctgtgtcgatttcggaccatgattcgtgtttctagcgccaacgccatgacttgctttcacctgctgccctgatactcttagagatactcgttgccatctttttccccgtttgtttctatatggacaatgtctgattgcactgttaagttttatactgttcgtgaatgtctgattgcactgttaagttttatactgttcatgtactcttgtgcacaccgtcagaatgtatcgcctgtttgacctgtttatatcntgcantagntgntatnagtgttacccccccctcgtgtgtgg

SEQ ID NO: 4804 - DNA, 1493 bp, Triticum aestivum
  Clone ID: PAT_TA_4804
cgccccgcgcgtcctggccttcgcttccacgttctccgaccgcggcggatctaccttcaactgccgctgtgccgccttagcgtcaccgccggcgcgtcgatccggccccctcctgccgccactcggggacgcgcttctccgccgccaccgccgttccccttcttcctcgcccccgggagatcctggccatcggggtctcctcccttcctccgcaggtatcaaaagttcacaggttggcgccgaacatgtccgtccgaaggaaagatagagctagaccacaatgacatggttcatgattctgccattgactactatgggaagcgccttgccacagcctcctctgactccactgtgaagatcaccagcattggaggtgcatctgccccgtcccagcttgttgcgaccctcactggccactatggtcctgtgtggcgtgtcggatgggcccatcccaagtatggttccattctcgcatcctgcggctatgatggccgtgtgatagtctggaaggaggctgccactgggcaatggtctcagctccatgtgtttgacaaccacaaggcctcagttaactccattgcttgggctccatatgaacttggcctttgccttgcctgtgggttcttctgacggcaccatctctgtcatctccatgcggcctgatacaggaggatgtgacgctgcaaccattgagcgggcgcaccctgttggcgtgacagcagtctcctgggccccaggagccacacgcggctctagggttcgctgatatcagcgcgcacacaatcccgtgtctggtggcttgtgactgtgtcgtcgtggtgtgggtgtgtgactttgtcgatgggagctggaagatggatagggtctcggacatgcacaaagagtgcgtgagagaggtctcatgggcatcggcaccgggcctgggccaggctaagacaaccaccgccgccccagacggaaaggtaatggttgtcatctggaccaaagggcaagggaggtgggaaggggaaagcaagcgtcacttcgaacttccggcgtcgggggtgtcggggtccctgacccgaaacagccagacattgtctgtgggcgagggcgagagagctatatggctgtggtcgtcagaccggcagtgggagtgggtgtggccctgggcctcagaggcacagccgcagcaggagcgggggataggggaggccaggcggccatacagtagggtggtccacacctcccctcccgatttcggttcgtgactctgattcctggtgccaacgccaagacctgcttttaccttatactcttagagatactcgtttccatctttttcgtcgtttgttttttcatggacattgtctgattgcactattaagttttatcccggttcatgttctctttgtgcacaccgtcaggaatgtatcgcctgtatgtattgtctgtttcaactacttatatccagcaatagctaatatcggtgttaaaaaaaaaaaaaaaaaaaa

SEQ ID NO: 4805 - DNA, 687 bp, Triticum aestivum
  Clone ID: PAT_TA_4805
attcggcacgagccgggcagggtagccaacagtcccagcgaccatttcttcttgccaagttcaaaggaccatcatgattctagggaaccagattctctgattgaggagcagaaacggtcactaccctatccagccaggatggagcctcaaggagtccttggccaaattatgtttgatgtctgtgttccgaaaaatgttgaaggatgggacatcaagccaacagcgtctccgaatggacgaccaacgttggcttctgcacggcaactgggtccgttcaatcccatcaagtacctccgccgttcaaggctatagtttgtgtttgctgcaaagaagagttttgtgtatataatggaggcaatatgttaaataccgattatgagcaagctttgcagctatgtaagttccctcaatatttgacttattagctgtttctttttatgccttttggcgagaggatgtacatatcctatgtatattttactggtgtatgttagaaagggggttggcataggttctagcaaagcttgttaaggtgtgctaacaatataggcaagggactgcattattattgccttgtaagtttatttatgtacctaatatgacctaagctaactatcgggggaaccatttttttcccttttgaacctttgctgctgcttagcgtttcactggtattatcactcttcc

SEQ ID NO: 4806 - DNA, 1866 bp, Triticum aestivum
  unsure (1)..(1866): unsure at all n locations
  Clone ID: PAT_TA_4806
gcgacctgaggcacgcgcttaaggtgttcgattgattgccgaccggagcacacacctttcaggcctttttggttctctggattgggttgcaaggcagagatcagagatggttgggagcgtgcacgtcaacgggtcggtgaacggcgccaacggcaccgaggagcggctggacgagctgcgccggctgctcggcaagtccgaccggcgacctgctcaagatcgtcaagcatcggcgcccggcgcctgggggcagcgtccttcgccgccctccctgcanggacgccctcgcccgcctccggcagagggtgcagggtccggtgtgccgccggccgggccgcccggccggccgggccaccgccgagcacctgttcgacgtgatcaactcacgggaggacgtgctgagggcgcctcacccgccgctgcgcctacctcaagtacgtcgaggcgcggctgggtgaccggaccctgtacgccgacgagattttgagggatgggttctgcttgaacatggtcgacacgcccctctgcccgttgaaggtggtcaccaacctccaggaagctgtctgggatgctgacattgtggtcaatggcctgccgtccactgaaacgagggaggtgttcgaggagctcagcaagtattggaaggagcggatcagcgttccggtcatcatttcccttgcaaaggggatagaagcctccttggacccaattcctcgtatcatcacgcctacacagatgatcagttccgcagctggcgttccaaccgagaatatactctatcttggaggcccaaacattgcctcggaaatttataacaaagaatatgcaaatgctcgaatctgcggatccaccaagtggaggaaacctctcgctaagtttttgaggcaaccgcatttcattgtttgggataacagtgaccttgtcactcatgaggttatgggcggactgaagaacgtatatgctattggtgctggaatggtggcagctttaacaaacgagagtgcaacaagcaaatcagtgtattttgctcactgcacgtcagagatgatattcattacccatctactgacagaacagccagagaaacttgctggccctctgctggctgatacttacgtaactctcctgaaaggtcgcaatgcatggtacgggcaaatgctagcgaagggagaactcaggctcgatatgggtgacagtatcaagggaaaggggatgattcagggtatttctgctgttggtgcattttttgagctgctcagtcaacccagcttaagtgtgctacacccagaggaaaacaagcaagttgctcctgctgaactgtgcccgattctgaagaggctttatagaattctgataaaaagggagctcccagtgggagacatcctccaagccctgagggacgaaaccatgaacgacccccgtgagaggatcgagatggcgcagagccacacattctaccgcccgtctctccttgggaagccgtgacctcggtagccccgtgtacatgattagaatgtaaacaaaaggcttggattagctccaaccctgtcatgcttcacatcattatcggttgagcaaaggcgtctccgggtttctgctggcttgtgtgtttggatcccagaggccccagcggccatagtttgtgggggtcgttggactgtcatgttgtacaagagagtattgatcgagtgaataatatgttgctacttggacaataaacatgaggcgtaaacgagacgccggttatgtgtgggtgttttaaccatagttttaaatagccggctatagctccgctttcagcagggtgccgctaaatggttgctatcacaaatagcccgctatagctgatttggagacccgccgcta

SEQ ID NO: 4807 - DNA, 380 bp, Triticum aestivum
  Clone ID: PAT_TA_4807
cccacgcgtccgcggacgcgtggggaggagctgatttctccgagcgggcagtggcaaactgaatggcgtgctacgccgctctcctgcaccagccgcccgcctcgccgtccccgtgcacctcaggccgcgtcggctcctgccgtgtccgtccgcccccactcctccagcgccgagcccctcccctgtctgtgcgcgctcggatctccccccgctgctcctacgccgcagccggagaaagcgccggagcgggcgccggggaacagcccgcggcggcgctccggagagtgctggggacgccgggcgcccaccaggcgcccgcttgctacgactcgctcagtggccggctcgtctagcgcgcccggttcaaggcctgcttaacg

SEQ ID NO: 4808 - DNA, 893 bp, Triticum aestivum
  unsure (1)..(893): unsure at all n locations
  Clone ID: PAT_TA_4808
tccttcagggcatttgagnancgtggcntttgtttacccgtggaagggtttnttcagggatagttgnacccnggttcccgtcagactttaangacgccntggcngntancgaccatntggcgattggnccggcccccctggattttntttntttgttggactgcngggttttcccagntttacttcagtttcaccacccaggaaactacagaacggcagtttttttttttatgccctttatgttatagttgtacctatgactttcaactcttcatatttctatccagccatgtaattaatctccaaatataccgatgtcgttggttttctcacgcagatgaagcctatggaaaaagacttattttttgattcaagctcaatgatagtaacatcagctttggcacacaaaattagttaatagaacatttgttcttgatgattggctcgagaaactctgcttgaatgataaagatgacggctggacatgcaactcaactccagacgaagacacaccatcaatgtacaacttgacgtccaatgcagtcttgccgaccaacttctcacagtggtagaagtccggctgcaataacgattacaaaggcctgtatcctactccgcctgagagaaccactgcgccgagcagtccgtgcagcaactccaatccgcctcgatccagaccacagtggctagggtttgaagccttgaccagaggatgcataatcagatgaactaaaaccaagaagaggagcggaggttcatcgtggatccattctgtggtcgccagcgacgagattgaacttcgccggcgaggagaccagtcaacatcccatttcggggaagtctatgagccgagagaagagagacagaaaggctcgtgccgaattcggcacgag

SEQ ID NO: 4809 - DNA, 1174 bp, Triticum aestivum
  unsure (1)..(1174): unsure at all n locations
  Clone ID: PAT_TA_4809
cccccacctccgcgggctgcgcctcgagggcctcggcccccgcgcccccgatcggtggcgcctcccctccctcctcccccgcgcaacgcgcccacccccttctctccccgatctgcccctccccgagaagcccctccagctccccgtgtgcggcgagctgcatcggtggcgcctcccctccctcctccggcgcgttctactctaccccagaggggcccccagcgtgtgctgcgccgtgtgccacgccgtcaccagcgcgccgcctccaggaatggagatggctcagcttatatgcgtcggctgtcgaactttattgatgtatactcgcaatgcaactactgtcagatgctcatgttgtgatacagtcaaccttgccagaccagcaccgccagtgaatagtatagctcatgtgaactgtggccagtgccagacggtgttaatgtatccatacggagcatcttctgtcaaatgtgctatctgcaattttattacgaacatcggaatgaacaccgtgagacctttgccacctacaatgcatgcaccaaacggaatttcatatagtgtcccatcgacttctgcgccatccgctcaatcgcagaatgtaacggtggtcggtcgaaaacccaatgacagtagatgacaagggaaaattggtgagcaacgtcgtagtcggggttacgtccggcgggaaaaagtagcaaaacatgccagcgcttgtaccaagtgatgccctgttctatgtcttataatctggagttgggaacactttgtattatactcagtgtctggtgatcgaccgatcggtcgcatagaagaaaaccccgaagcgcgtaaacggactgcgccaacaaaaaaagagagtgcgggtgtggataatactgaaaaaaactgtattttgcttaccccataaattcttttttgtataaaatcctggagaccgtcagtcgtcagtgcttgaaaaaataatctcaaaacctgtgcctgtgtggatattctggaggggccctgcattctggatgaataccagcatctatctttggataagtgtgggcacagctatcaatgattgggtgttaaaatcctctttgtcctgtcatgaataatactttgaagggggcattttattttgataataacagcaaatagcttngcatagacaggccccacctgtcga

SEQ ID NO: 4810 - DNA, 575 bp, Triticum aestivum
  unsure (1)..(575): unsure at all n locations
  Clone ID: PAT_TA_4810
cagctatagaaaatatctccagtctatcaccgccgtgaggctgctgagggccaccgccgacgcctcagacctgcaacccctctttccctgcccgcccccaaccccgccacctctcgcgccccccgtgatgtcccggtgggcgccggagatcaaggtctatagccgcaggaacccccgcaaaaaccctaaacgccctcctgaagaccctacccccgaccccaatccccctccagaacctagccccgaccccaatccccatccagaaccttgccccattcctaattccgacccccttgagcaaaccctagcctcgttccgtcgctcgattcgtcgcccggaggctgaggatgcggtgccgccgctctccgatccggccgcaccgacttaccctnctcctntttctcccacatcgtcgccgcacggggcaccggntgncgcctccggcgatttctcctccggccttgcccgggatggcgccgccgntccaaacggtcatgccgacatcgacatccgggcggacgcggatgacaaggctcggaagcgcagggtccggagcgagctgcgtcggcagcttg

SEQ ID NO: 4811 - DNA, 476 bp, Triticum aestivum
  unsure (1)..(476): unsure at all n locations
  Clone ID: PAT_TA_4811
tgggtaggaatacgatctgccgcggacgtcgcctcctcgcaccattgccgccttgcaccgactcccaggtcgtcggcggctcgcactggcgctcagatcgcgccggctcgcaccgacgcccaggtcgtgccggttcctccccacctgcctcgatcccactgtcctgacctaaaggacaagcggcgcctgtgttggagacgggggccctgatgacagtgaggagcacggcgcacctccacgacgacacctcgctgccgccgctcggcgtagaagggcgcacatccccctcctaaagattggaggaataaaggttgttctcactcccttttggtctgtgctggcgtggatggagggtgaccggtgagcctcttggtctgtgcaggtnttatacgatcgacccaactgttagctttaggatgctttttggagtcgactcatgaagatgatcgctagtctgcacgaacatttgtagcttc

SEQ ID NO: 4812 - DNA, 617 bp, Triticum aestivum
  unsure (1)..(617): unsure at all n locations
  Clone ID: PAT_TA_4812
gaacagttgcaaataaatttcgacttgcgtaaatcatcaacacccaagttaacactaaaaggggtttatttgtcacttctttggagccatacatgtaggtcgtaagttactgcatcttgttgttggacaagcacagatgttatgattcgcttagtggatggatgtctcaagtctgtggtcaccaacagccatatcaagtctgtgatcggaatgagtactttgcaagagaaggaggcagaggcggaacatgcaagtggcgccgtggagctaggaactattagttgatgggcctcataatgccattacatgtctaattagcacaataaccatcccttatccagctgaaggtgtggtctgaataagagcgtggttggttggttcctatgggccgatctcaacgcgtcatcatcaacctgtggccttgatctgccttggctccttgtgaactctcctggggcttgaaatcattttgttcctagagcatcatcatttgggatcctttccaaagcttctcccaaaagccctcctgctgtgttctcctcaacaactttagaagcacctnactacttacgtcctccaagcgtgttgtttaagcagccttccgatatggtttaacc

SEQ ID NO: 4813 - DNA, 734 bp, Triticum aestivum
  unsure (1)..(734): unsure at all n locations
  Clone ID: PAT_TA_4813
taagccttcccagaacgccgtggtgtcgctcaccgtgttctcgctcgtcggcgggccgcccgggcaggaccaccccaaggcgcatcgcctcgctgatgaagctcgacgtgccgtacatcgtcgcgctgccgctcgtgttccagaccacggaggagtggctcaacagcaccttgggccttcaccccatccaggtggcgctgcaggtcgcgctcccggagctcgacggcggcatggagcccatcgtgttcgccggccgggacccaagatcagggaagtcgcatgcattgcacaagagggtggagcagctctgcaccagagcaatcagatgggcagaactcaagaggaaaactaagatggacaagaagctagccatcaccgtgttcagcttcccaccacacaagggcaatgtgggaactgcagcatacctgaatgtcttcagttccatctattctgtcctcaaggatctcaagaaggatggctacaatgtcgagggtcttccagagacacctgaagaactcattgaggaggttattcatgataaggaggcccagttcaacagccccaacctcaatgttgtttaccgcatgaatgtgcgggagtaccaagcactcaccccctacgctaacatgctggaggagaactggggcaagccacctgngcatctcaactctgatggtgagaacctccttgtctatgggaagcagtatggcaacatcttcatcggagtgcagccc

SEQ ID NO: 4814 - DNA, 603 bp, Triticum aestivum
  Clone ID: PAT_TA_4814
ccccctccgcctccgccgccggccccgccccgggcccccgcgccgtgccggagggcggcctgccgctgccgcgtcacgcgggcgcccgcccctctccccgtggccgcgcggcggtccccggccccgccgctccggcccgcgtcgccccgccccgcccccccgccgtctcctccctgtcctgcccctgcgtcccccccgcgcccccaagcccctggcgcggcgcggtgccgccacgcgggcggcgggtgccaccactccggagggcgcgtccggcagccggccgcctcccgctccgcgatgcaccccgagagggccggggtccccccgcccccggcggcctgcagccgctctcacgacgcgtgcggcaggtggccgggcgctggcgggcaacgcgcgcccagagggcggcggtcctgccgcccccgccggcctcggctggacaccaggagcctgccccctttcgccaggtcgctggcaccgtaccggtggccgaggttcgtcggtgttgtcgcgcgctcccattccggtggaccacggggcgctggctcctttccgtgaggaggcgcaaatagttattcacgcaaaaaaaaaaaaaaaaaaaaa

SEQ ID NO: 4815 - DNA, 1972 bp, Triticum aestivum
  Clone ID: PAT_TA_4815
gccgggccgggcgagcaataattcgcaccggcacacaggagcggcagtaatggccgcgtggtgccggtgccagtgccagtagcacgcaggcaggcaggggagcagcgccactgcactgggcactggtgacgcttcgagcccactcgcctcacccttccctccctccctcgctcccttcgcctcctccagccgggctcccaatctcgcggagcggcggccctcattggccggcggcggtgcgcggccccggtcgtttcctccggcgtcaggtgcccgtgatctggttgttgcagaggcggcgaggtgaggtgacgcggcggcgcgatgaggtggctcaagtcgttggttgggctgaggaaggtggagaggcagcagcatcagcagcgccgcaaggaggatggcgacgccggccgaacaaaaagggatgccgtcgatcagttccacttccaggatcagcactcccaggatcacgctagccttgtcggaccagaagagttccctgatggaaatggtccgtcagaagacgagtgcgacacaccttcatgctcaggacctggtttcagtatgcttagcgtgccactgcctcaaacagaagaggagctcaaagagatctgggctgccacaattattcagactgcatatagagccctactggctaggagagcccgccgagctttaaaaggactggttaggcttcaagcccttgtaaggggtcatatagtgagaaagcaagctgctataacacttcggtgtatgcaagctttggtcagggtacaagcccgtgttagagcaaggcgggttcgtgtggccttggaaaatcagatggatgagcaacaaaataatgtagaagagcaaacggacgaggcacatgttcgagaagttgaggatgggtggtgcgatagtatagggtctgtggaagacatccaagcaaaattgttgaagaggcaggaagcagcagccaagcgtgagagagccatggcctatgccctttctcaccagtggcaagcaggttcaaggcaacaggcagccattacagcttctgaactagacaggaacagctggagctggaattggctggagagatggatggccgtccgcccgtgggagagtcggttccttggcatgtacgcagcagatggaattgccattgataccggagcgcacaatgctgagggaaatgcaaccaaggctccatacaggaaacctgtgaaaaagcaggtttcagctcttcattcaagtgtgttgatccagaaggcccgcccctcgaactcagagggtggtggctccttgtcgaacccgtctgccggttcggcgtcagctaaaccgaaacggaagctgccaccgaaggaaggttctgatgaagtctcgtctcgtctttcgggacttggtgcccggagcagtagtaatcctaaggagaggcctgggcagttacaacctcgggccaacaagaggttctccttgcctggcactggcacagaaactggcaaacggcaagtgaataaacctgcggtgagccgatcccccaaggctaccgaagactccccagcgctggaagggaagcatcgccgtgccggttccgttgatctgttgttcaagagagttgagctgcaggcttgacaagccatctgaagccctatctaccgtcgtcaaggtttgaagcatgcgacgacggccttagattctggaaggtccattggagcaatttgcatttatttcttagccatataggtatgcagtcaaatgctcatctcatgagatgagatctagctagtgcttggatatgtatgtgctggtcagctggtgcctctagtcctggaggttaccatagcttgtactgttgtatttgtagctaagagcaagtatggactcacattttctgggactattttttgtacaataaaaatcctgaatggtactttctccgggtaacaaggggaaccccgtgcttttcaaaaaaaaaaaaaaaactcga

SEQ ID NO: 4816 - DNA, 836 bp, Triticum aestivum
  Clone ID: PAT_TA_4816
gacaacaaaggtgggtgattcatttttcaccaatcttataaaaaagagcttcaaaatgaacaatggaacacgcaatggaagagcaagggtttttgtaaatggtttccctatcccagaccgtgcagtcaggaaggctgagaagttagctggaccaatatatcctggtgattactggtatgactaccgtgctgggttctggggtgttgtcggtcagccctgccttggcatgatacctccttatattccagagtttaattaccctatgcccaagaattgtggtggtggaaacactggcatttatatcaacggaagagaactccaccagaaggatttggatttacttgtatctcgaggactctctgattcccctgaaagatcttatatagttgaaaattctgggaaagttacagatgaagcatctggcgaagagctatatggccttggcaagcttgcaccaaccgtcgagaaattgaggcgcggatttggtatgcgagtccccaaagttatcgtgacaggccagcacgctacgatcatcacccacggataagatcggggataaaccagtggcgtagctgcatccgagaacatggagatttgaagatcaatggcggtcgttctgatttccagaaattgttttcagctccatcctatgtggcctcctggctagttcttgtgcttgttggattgtttatccgaggcctcctatagaggcgtgcttgtaagtttcttcctagctagacgttttgagtgaaaagttggtcgattatgtttgtctgtttggttgttacgttttcttgatcttgatacaccaaccaacctacctcaaaaaaaaaaaa

SEQ ID NO: 4817 - DNA, 567 bp, Triticum aestivum
  Clone ID: PAT_TA_4817
tcccaaatgttcaagatgtgctgtagcggtagaataacatgctaatgtttctgcttacattggtatgtattcagttattcaagacttctaccagttatgcctgatttgcaaatacacatgcaatgtcaactcggccacaaatattattcacagttagctttggaacttatttaagtattgcactcgttcggctttttgtgattgttgagagacttgatacatcaggaagctcatgtacatgatataatgttcttcacaattattcctgcattcatcatgttttgctgatgcagaattaactattctccgttgctgatgcagaattaactattcgccgatcttccatgttggcgtggatagagaattctagattttctacatcatgacattgtttaaaatgatccactagcatgaaaatttacctctcatattttgtgagtattcactaaaatctgtatcgtcaatcgtcctttgaagtcttagccaccaaaattgccaaatgatgccatctctgttcgagcggttttaattctgaatgctggactctgtttgcacaatttgtacaaa

SEQ ID NO: 4818 - DNA, 878 bp, Triticum aestivum
  Clone ID: PAT_TA_4818
ttttttttttttttttttttttttaccaaaaataataccaacagaaattgataattacaacagacagtatctacgtttaagcaaaacattaactctcatgatctaatcttcactacttactgtgaccgtataagcaccacgggggcacgacacaaccgcactctgatataccaaccaacactttgaagtcttgtgcttctgtcgtcttggtctaagcagtcgaacataaaagtagcagaaatgagagcgtataccggacaatcatttaatctgaaaccggcacatctgcaagctgaagttccacagcttcttggccaattctgcatctacagcttgcgagcttgggttggcaatattacaattgccgaagtatttaccagttatcccctggacttgagggtgcatcgccacataacatgtcgttgcagcaccctgttcaacgcttctacttatgattctcccaactgtgttcatgagagcgctcacaatggtcctgttcctgaaaaggcttgtcacgatgacgcccggatggaccgtgttagctgaaatgttgaccccttcatcctgctcacaaaattatttttgaactgttcttcatccattcattcaggcggcaaagaatcgacgtaccttgagaatccgggacagctcattcatgtggagaatgtttgcaagcttggactggccataagcaatgaggctgttgaaccctgaaggatcatgtactttgtcgaagcatatcccttgggggtaggtcatgatatgccccgaagatgacacgttaacgatccttccttggacgccgctgtcccggcacgcgctcttcatgttctccagcagcaggtttgtcagaaggaaatgccctgccatcctcgtgc

SEQ ID NO: 4819 - DNA, 756 bp, Triticum aestivum
  Clone ID: PAT_TA_4819
cggcacgagccgatcccaatccccgtgtccaaactattccgccgccgtcgtcgatggacggaatagaagctagcgctggcgctggcctgccacgaccgccccagttcgactgcctgttcacggacgaggggtgggccttgctgtccgaggaaacacgccgttcaattataggagttctggatcatgacagagaagagaagatcagcctcctacagcgccgtcaggcccgaaaggaccgccgcaaggccctgccggatcatcggccggatatacgacctagcgagtccctcgattctatcttgtccagggatgttcgtgattcagatcaacttttgtggatccgacaacatcgcatgctcaacctttcagaatctctactgccgccgatgcgctacacctcctgcgaactcctcgggaacggatgctctcattatcctcatcctatgctacagttcttcggtatttttgtccagttttacaggaacgccttgaatatcatgcgagacaatacaaggtcctcacatattgatgtatatggcttgcttgctgtaagggataccttggattattcccggaactatatttttcagcgatctagagagaaccctcaacctatagacgtggatggtggttatctaagtctgagctaccctgcacgaggcatatctgcaatgggctgcttgattgaaattgatataaagatcaagggcaaggaggttgacaaagatctgtcaattattgatggatctgtgaaag

SEQ ID NO: 4820 - DNA, 556 bp, Triticum aestivum
  Clone ID: PAT_TA_4820
tgttgctcgatgtccgccgcataagagaacttgaagatttgcacaactccgtgctagaaatttcagcggcgggtgcgctgcagatgtttcatgagagtattcatcaggataatgacccatcagaggaaaacagcctccaaactattccaatcgaccttctcctgttgttgcaagaatgtccagatgttcaggtccctgaagagccggcacaagttccttgagcaaaggtcgtaatggaattgtttttttttagaaaaggagggtcacccccggcctctgcatcagaatgatgcatgcaacccctttattaagcaaagtaaatgaaaggtccgcggtcgtaatggaatggtagatctgctgatactgattttgaagtctggtagaagtcacttattagactgattctttctgaaggatgtaactgtaaatctgttgatactaagattttctttatcatgtcaccccttcctttgtatgaaactcctgtaatttcgcagtttgaatggaaataataaatattttcttcccggggggggctgaccaaaaagaaaaaaaa

SEQ ID NO: 4821 - DNA, 634 bp, Triticum aestivum
  Clone ID: PAT_TA_4821
cgtccgcccacgcgtccgcccacgcgtccgacagcttggtcaacaagctgctggccaggagcggaccgaagcgggcactactccaggcaatgttaacctcaacagcttgatgagcatgttcagtgggcttggtgctggcggtggcctgggtggtgtcccaaatgtcccaactgtgccaccggaagagcgctacgcgacgcagctagctcagctccaagaaatgggtttctttgacccacaggagaacatccgggcgctgctggctaccaatgggaatgtccatgccgcggtggagcggcttcttgggaactttgggcaatagtagactatatatgcagggccagacacctgtagtatgtggcattgtgaggtttgattggttgtataccctacccggtcccggtgagattgaaaggcagcgtctctagattctatgtgttttaagatggatgaataaaccagtctatctgctggctaccctttgcatgtatacatgagtcccgtgtcgtgtcgtgtcgtgtcgtggtggttaaactgtggtatattgctgttggtagtagtaccttgggtcgtcggtgtacatacatattgaattgtggtggtcttaaaaaaaaaacccccccccccccccccc

SEQ ID NO: 4822 - DNA, 2021 bp, Triticum aestivum
  Clone ID: PAT_TA_4822
cggcacaggacacaagccacaaacccctccccccctctctcccactccacaggccggatcggggcggaggccggccggatcgaccctcgggccagcggcatgggcggcggcgagggcggggccggcggcgagcccgcggcgggagcggccccggccgcggccgcgcaggcgacgctgcacatccgcggcaccagcgggaacaagttcgcggtgcgggccgacctgggcgccaccgtcggggagttcaaggcggtcgtcgccgagagccgccacgtgcccgcgccgcagcgccggctgatctacaagagccggatctgcaaggacgatgagaccgttgcccaccttcggctgggtggtggcccacatcttccatctggtccgccgggcgagccctccgccaccctgggcgctccccgccgcagactggcttgcttcgtcccacaggagaccagcgggtcgctcctgggtacctatgggaatgtccttgccggggttgggcggcttagtggctgctggcggtggagcttttggtttatctcgctccgagccttctggaattatgagcatgatgcaacaggagttgatgtataccctacccggtcccggtgagattgaaaggcagcgtctcctagattactatgtgttttgagcatggcttgtaagcaacctagttttgaacattcctcaaatgtgtgagctgctcggacgtattccggatctggccgatgtcctgaatgatccaagaattctcctccactcttgtgaggcagcttggaatcctgaacttatgcgagagatgatgcggaacacagacagagccatgagcaacattgaatcttctccagaagggtttaatatgctgcgccgcatgtatgaaactgttcaagagccatttatgaatgcaacaacaatggctggggagggctacacaaatccaaacccatttgcagctcttctaggagaccaggggtctaaccaagccagagatccaactggagatgcaccaactactgctcctgctccaaataccagctcaggccgcacaaggtggggcgcaaatgcttggtgctgcacaaggagcaacaagccgttctgctgctggcaaggagtgccacaagcggggacctatgctgggtgggttctgcaatgtttgctaattgagctaggttttacaaaaccctgccatgatgcaaatgatgcaaaacattatgtctaatcctcaggccatgaatccgttgctcaacatgtacccgtatgtacgtaacatgatggaatcaaatacccaaatgagagaaatgtttcagaatccagaatttcttcgccagttgacatctcctgaaacattgcagcaattagcttcattccagcaggcattgacgtcacagcttggtcaacaagctgctggccaggagcggacccaagcgggcactactccaggcaacgttaacctcaacagcttgatgagcatgttcagtgggcttggagctggcggtggcctgggtggtgtcccaaatatcccgactgtgccaccggaagagcgctacgcgacacagctagctcaactccaagaaatgggtttcttcgacccacaggagaacatccgggcgctgttggctaccaatgggaatgtccatgcggcggtggagcgccttcttgggaactttgggcaatagtagtagttggcattgtgaggtttgattggttgtataccctagccggtctcggtgagattgaaaggcagcatctctagattctatgtggttttaagatggatgaataaaccagtgtatctactggctaccctttgcatgcatgcatgcatacatgagtcctgtgtcgtgtcgtggtggttaaactgtggtatatttgctgtttggtagtagtaccttgggtcgtcggtgtacatacatattgtgtcggtagtagtaccttgggtcgtcggtgtacatacatattgaattgtggtggtcttaaaagtacatcatgtgtccgcggtcaaaaaaaacggacgcggggtcgac

SEQ ID NO: 4823 - DNA, 1094 bp, Triticum aestivum
  Clone ID: PAT_TA_4823
caacatcattacagaagctccatcaacaagaactgcttcacgttctttatttgagacgtgtgcaggaaatggtttcagagaataccacccaaaagccacatgcccgcctcagaacgacagatttggattcagtgtactccccttccagaatcagtcatcgcatcagcagaacatgcatgcaccacctgcatattcaccgaccacaattgggccacacagtcactcgtgtgctgctccaacaaatggatacttccagtatggtcagccaaccaatttcttctctggtccagtcggattccgagtacctgggaacggacctgctgatttctcggtgcagtacaacaatgtccatcgctacccagctcctgcttttagttgtattcacccagagcaaattctcaagacaccggccagcttcagagtcatgcctccgcctcccctccccccttaccgacatggaacagcgccaactggtggtcatccttaatggaggcttgaatccagacaggcttaattccatgttgaagccgatgggcccgaaggatgctccagatggtaacaaattgcctgacaagagtgcatccttctcgttgttccaattcaacctgccgatagctccgcaaggcccaccgtcacgcagagatggtaagcgcggagagtcggcagcaaggatgccgccatttgctccggttcaagtgcagccatgctctagagagcagacagatgtgaaggagtataatctgttttccaccgatcaaagcggctatttccctttatcccgttaaaagcaacacacatgggggacgtgctcttctcatttttactgtctacaactgtatacggtgagtgattgtatcaaccgaacgaaataaaggatgttttgagtggtttttctgtatgcttacgtgccttcagttttggactatagggccgggaactatatctttatacatttttttcttatattttccctttgtgtgtatgagaagatagtgtatcatgtagcctttttgatttataaacgaggtaaatttccaattctcagtagttcctttttcagaatgctgatgctgccaaaaaaaaaaaaaaaaaaa

SEQ ID NO: 4824 - DNA, 1489 bp, Triticum aestivum
  Clone ID: PAT_TA_4824
cccgccacgcgccgccgcagccggctgccccgtcggcacagccgcccccccgcgggacgtcggcccacacggcggcaagcggcggcgcagcttgtttcaaggtcggcacatcctgtaggccaattgaagggacgtgactaacagattcctagtttttgctctcccagtcggcctaccacccctggaccagcccaaagccgagtcacggccgcaccgcaactcgccagcttccgcgcaacagctgcgccgccctcgccaggcagcgtgatctcctatatctcctgctggcgggtcagtggttccagcggacaacgtgctggccgtctccaccggccagcttttggtcatcctcggggcctgctccgtgatgatgaagcccagtgacatgatcaagatggcaagggtggcagggaggatgaccgggagagcggtcggtcgcctcatgctctaccgccggcagatggacgacatcttcgagcagactgcagcgaagaagattaatacggagcttcaagatgccatgtcaaagttacaatcaattggttatgaagttcagaacttatctagaataactcctggccagtttatcaaaaggcagcacaacacagagggcatgactgaagcaggaacatctgatggttctgcaactcagtccggagaatttcgtgatgatattcgcagtataattcgtgatgaaattgagagcttttgtagaaaaaatcctgatcaatttaccaggaggttaaataatcctgacggaattcagaactctgaacaaacagctgaagctacacaattcgatgtaactagtaaatttgcaatgacatctaaggacatggaatcagcgaatacaagctctacaaatctgcacagccaagcaatgatgtatgccaagctaagtgtatccccaggaattaagatgagttcttccatgagtgtgagtaatggagaacaattcaaagagagcaatggactgctaaatgtacctccaagatcggctgcaactactggattgcctccgacacccacgggcgtgccttcagcgtctgctagccccccggagcctgtgcttgaagcagaggttgcagagaacgctaaatttttcgtctcacagcctcatgatcagttgcccaaggagtaacagcatcttttcatctttcaatagcagttgatacatcgcttgcacatttaactttcttggtagctctgaagacagctttgatggctgatgatggcatgttctgatcttcacctcagcggcacaatcttacgttctgacgtttttttaaaggcgttacattctgacttcatgtcgatctaaatggagatggaaccgacagaatgttgagttgactgttagggtgtaaatgttttgtcaaataaattaggacgtaatgctaggcagtagtagccttcttgtttgtttaaaaaaaatatcttttttgctctaataggtattattggtatgttgatgcgccgtgtttcactg

SEQ ID NO: 4825 - DNA, 1376 bp, Triticum aestivum
  Clone ID: PAT_TA_4825
tttgctgaatgcttttcttctcgtaaatctagttccaacccaaaaggcttggtaccgaccgcattactgcccacaccagtggctcattccagctcctgcagggcaacgaaatacgcgtccctcgcctcctgacgccgcatcccaccgcaagccagctcatgacagtgggccgccaccacacatcccgcatcccacatccccgcccgcccgctcggtatacggctggaccaccaccaccagtttcctcgccgcgcccttggcgtcaacgcttgatctcggtgtttccatcacctgttgggcgcgggcggcaccaggcatcaacaacctggggcatttatttgtctgccaccccccgaactactttcctcaggcacggcatctactggttgatgtgagttctcagcagccttgcttattgcttgccatcgctcgcctcgttttggctcagctgcaatgcatcgttccagaacatccctttgtgtgtccgcatttccgtgcgggcggtcgcatttgtagttcaatgcccaaaaatccccaatgtcaggagcaagagtaacagctctgttcaaccaactccttgctttatcaaccttcctgtcatgccagaaaagtttggcgacagctgcaatgacatgtggatcatgactcacatcgctttatagcatctggagctctttgcatttgcgttggggacgtggcaccatctcaatagctgcccccccacagaagtgccacttgttgggcactcttgtaaatgcctttggctagtagagaatcagcttcctttttgttcccgtgcctcaattcagctcgaattgctgcaagccatagttcaggtgtagctggattctttttccttgccatggtgaggaaagcgcgcgacttactcaagccatttatcctctcctctagactagctagcgagagccaaagagggatgcaaccggggcagtgtttgagtccattctcgtaaacctcctttgccttccctacatggccaatccggtcttccatctgtccaagcattaaccacaatttgaaaaacgcggggaataacttcagaccttcctccaacagcctcctttcctcattcacatttcctaattccctctcaacaattgctgatttcatccaaaccctctcggtgcctcctctttccctggccttggtcaaaagcattcttgctctctccggttcattgttctcgaactctaacttgaatgcagctaaccagatctcctctgaaatagggatagcagcataagcttcctgaaggatggcccgagctgcaggggcatcaccagccagccatttctcctttgcgcccataagccataacacttcagcttttggattgtacctgcccgggcggccgc

SEQ ID NO: 4826 - DNA, 1001 bp, Triticum aestivum
  Clone ID: PAT_TA_4826
atcacaacttcacacgccagcgatggaaggcgacggcggcacggcggcggcctggatggcgacgcaccgcgggatgtacgagcgggccacgcggcaccccttcaccgtctcgatccgcgacggttccgtcgacctggccgccttcaaacgctggctcggtcaggactacatgttcgtgcgggaatttgttgcatttctagctagtgtattgctcaagtgttgcaaagagtcagacagctcggacatggaaacaatcctaggtggcttggcttctcttagtgatgagctctcttggttcaagaaggaagctgctaagtggagtgttgatctggccggtatttctcccctcagttctaatatggagtactgcaggtttctccaaagccttgatgatccagagatcagctacactgtagccataactacgttttggataattgaaaccgtgtaccaggatagttttgctttctgcatagaagaaggtaacaagaccccggcggagctcctggggacgtgtcagagatggggcagccctgagttcaagcagtactgccagtctctgcagcggatcgctgatcgctgcttggcaaatgcgccacctgatgttgtcaagagtgctgaagaggcttttcttcgggtgcttaagctggaaattggattctgggacatgagttcttctctgtcctaagcggcgactacatcgtgccaacaccctgcattacttggacggaatagacgccgcagtgggttcagcattttactgtcatttcccttgtatcttggtttctctggtgaacaccgtgcaataacctggatgaaataaatgttgtgttggttcagaccgaaacctcgattgcactttattttttcacgtatctaggtttctttggtcagcacggtggaattacttggacggtatagatgtttttgtcggtttagtgttcagtctttcaggctgaaaacctcggctgcaccgtcggtataaaaaaaaaaaaaaaaaa

SEQ ID NO: 4827 - DNA, 955 bp, Triticum aestivum
  unsure (1)..(955): unsure at all n locations
  Clone ID: PAT_TA_4827
tgaaccgcgacgggttagcggacggcgccgccggtcagatctccctccagcgacctcctccgcctcttcctctctcggatccggaatccccatcgcgccttctctgtctgccctccgcctgccggcatcccctgccgccgctccccggccggtcggtcatgttctccagcgatgccctcttgctcagcatccgccggcggcggcggccacggcgcttcgcccgcagcctaatgattgtattcgtccatgcacttctttgattgtttgaagcattgtggagggggatgtctggccacagacccactttactgtgatcatcattgtctaatgattgtgttggtgcattggtttctctgatgcttggaaacattgaggaggggatgtctgtccagaataggtggtttccatgatggatgcatcttcttgtgatgatacgtcaacagtttgcctccgtcttctcgagaattctttgttacgatggtaccagtgttcatagacatgttgaatgatgtcgtatattgaaacagatntaaaaattacctgatgtaaagctgacttgccaaacaacttaattgagctgaaggcagtttgcacaaggcgacaaggcgacgtgtgaaactgactggttgactgcgccaaatacttggggtttgtgtaagataaaatcacttggagatagtatttgtagcaccaacggtgcctgcctcagagtaggttttggcctcctgtacgagtaggttttggactgctgtaccaatctaaataggatattcactctccaagtctcatgtatacggatacggacacgtcttgtgagaagtcagcgggtgtatgctgcgcgtttttttttctttttgagaaacccgtgtgtgctgtcctacgcaatcagccagcccggcttattagcagtgtttgcatgcgtaaaaaagaaaaaaaaaaaaaataaaaaaaaaaa

SEQ ID NO: 4828 - DNA, 549 bp, Triticum aestivum
  Clone ID: PAT_TA_4828
gctgcgtctgggctcttggcgcactacgccttcgtcgccccccggctccccgtccccccatcccccagccgtctccccatcccccagcccccgttgcgtcctgtccggagaaagcgccggcagtgccaacttatcgccatcgcccgtgtggaagttgggagatccccgatctgaagttgggaaaccagattaaaagattttgttgtcttcgtgggttcaagtttagcagtggttcccaagaggaaaccccccgccgccggcggcggcgacgacgacgagacattggaggaagctgtccacacacgagttgctctacaaggcgaggccagtggaggataggcagcggcacacgatcattgcgtacgtgcaaggggttttcttgactaccctggactcgagctgccgctgccaccgtcaagtctaggttatgactcctgaacatgatctaattattgatttttggaaaagaatggtgttctccagtactgttcatcctcttttggtgttccaatatgtttgcagcaatttgactgattcgagtggcgtcca

SEQ ID NO: 4829 - DNA, 1935 bp, Triticum aestivum
  unsure (1)..(1935): unsure at all n locations
  Clone ID: PAT_TA_4829
tcctcacacagcactttcccccccgccccactgcgtcggccccctcagcgccgcggccgccgccgctgtcccccccgggagccgctgcctccccaccggggggccggcggcgccctggtcggtggcctcgtgcccgcacctctgccgggcggcgccttcgctgcaccgccgcatcaccctcgccgtccttggccccgccgcggcatctccgagctgacaggcgccggcgccgcccgctccctggcgtccacctcccctggacttccccctgcttcctcctccctcctccccccccgctttcctccggtccgctcctgcgtctcctatgcaaccaccgctgggccctccgtcgttgtcgcctccctcgccctgcccgccgtcgcccgccgctccccctccctccgtcgcgcctgggccttctgctcctgcgacgccggcgccccccccgccgaggtgaccggcgcgctcggctccgcctggtgcgccaacgagaaggcccccgcgagcacaactgagcctaggaagacctggtccttccgtccagtcgcgcagccaggggtcagctaaccgccgcactgaccataaccttacaacgggtgaactccactcataccatatgtatccctgagagcccatgcgggcggctcgtctcccccagctctgctgctggcggcgcccatgcctccccattccttcaccctgtagtggcaagttaaaggttagatatagtggtaagtaattcagtgtccagctaatcatcattcatagatggaacccaaaggtggtgatgcagatcctggaaccctccctccatgtgtggtggatgtcgttgtgatggtcgtcgtcgttcaaaaccaccccgcgtggacttctctgcacgactccaaaacaatgatcatgctatggatcaccgggtctcattcgagctgacagtagaggatgtcgcccgctgcctggagaagaagaccgccatttctggagaatctgctgcatcatctttccaccttccatccagcaacaccggcgaccactccagagaatccaacgagacaagggcagggctgtacgttgatgaaacataccatgacctgcccgagaaagcacggcgctccctgtccctccgtctggccaaagagttcaagttcagcaacgtcgacgccccgcacgtggaggagacgggcgcgctcgggtccgactggtgggcgaacgagaaggtggccgcaatcacaacggagccgaggaagggctggtccttccgtccagtggcgcagccaggggtcagctaaccgttgcactgaccataaccttacaacaggaagatacatgtttctttttgcttcttttgctcctgcaatgcaaacaggaagacaccatcatctcatctgcaggaggcgccaaaacctatgcaaacattcaggttgtagtggcaagttaaagttagattatagtggtaagtaattcagtgtccagctgatcatcattcatataaagagaccaaaggtggtgatgcatgcagatcctggaaccctccctccatgtgttgttgatgttgttgttattgtcgtcgtcgttataaaaccaaaccgcaaatactttccgcctcaataaaaccattgtcccaagcccacaactagaaagagatgagtcttgtagtagcttggccatcgatgacctggacaagctttgtgggaaatgcattgtgaacccatggcctaaggtttagttgtgcgccgaatgtgccatcagtgggtctccttctagtggagacttctaggatcatgatcccaccactaaacacatcactcttccttgatgcttttccaagtgacccgtactctggtgccatgtacccaactgttccaggcatgcttgcatttatgatggagttgtcctctagaagcaatcttgcaatcccaaagncccccacatgcgctg

SEQ ID NO: 4830 - DNA, 1549 bp, Triticum aestivum
  Clone ID: PAT_TA_4830
gcgctccttgggtggtttcgacactgcgcacgcggccgcaagggcctacgatcgcgcggcgatcaagttccgggggctggaggccgacatcaacttcaatctgagcgactacgaggaggatttgaagcagatgaggaactggaccaaggaggagttcgtgcacatcctccgccgccagagcacggggttcgccagggggagctccaagtaccgcggcgtcacgctccacaagtgcggccgctgggaggcaaggatgggccagctgctcggcaagaagtacatatatctgggcctctttgacagcgaagttgaagctgcaagggcgtacgacagggcggcgattcgcttcaatgggagggaagctgtgactaactttgagagcagctcctacaatggggatgctccacccgacgccgaaaatgaggcaattgttgatgctgatgctcttgacttggatctgcggatgtcgcaacctaccgcgcacgatcccaagcgggacaacatcatcgccggccttcagttaacttttgattcccctgaatcgtcaaccacaatgatctcttctcagccaatgagctcatcttcttcccagtggcctgtgcatcaacatggcacggcagtagcacctcagcagcaccagcgtttgtacccatctgcttgtcatggcttctacccgaacgtacaggtgcaggtgcaggagaggcccatggaggcaaggccccctgagcagccgtcgtccttccccggctgggggtggcaagcgcaagccatgccgccgggctcctcccactcgccgttgctttacgctgcagcatcatcaggattttctaccgccgccgccggcgcgaacctcgccccgccgccgccgtacccggaccaccaccggttctacttcccccgcccgccggacaactgaagctggccgttgtgaccagacggcggtgggtgcgcgcggtcgaggtgttcgctcctcgtcgtcggttacccctgttctgaaactatagtcggtgagagatgacattgccaggccatgtgtggtgacactactggctggtctctcgccgcctcgccatgatcgggatcacgcggatcatggctgttcattagattctcatgtatccaatgttcaagtttccccaaacggttttaaaaaactttcaaattgggcgtgcctcgccccgccgccgccgtacccggaccaccaccggttctacttcccccgcccgccggacaactgaagctggccgttggtgaccacgacggcggtgggtcgcgcgcggtccaggtgttccctcctcctccgtcggtaacgcttgttcgtgaaactataatccggagagagatgacatttgccaggccatgtgttggtgacactactggctggtctctcgccgcctcgccatgatcgggttcacgcggttcatggctgttcattagatccccatgtatccaatgttcaagtttcccaaacggttgaaaaaactttgaattttgtgatggcaaattcatgcatgggccgcacggtgcgcccttgcacaagaaaaaaaaa

SEQ ID NO: 4831 - DNA, 565 bp, Triticum aestivum
  Clone ID: PAT_TA_4831
tccgacattgtggcgtcgtgcgccccccccgccccccccgcccccccccccccccccgccccccccctccccccgcgtccccgacctgcacgtccccccccccccccccgcgccgccgcccccgccgccggccccccccgccgccggccaccgcgacgtcggcgccgcctgcgtcacccgcctccgcttcgtcctccgcgaccagcgctgctgcctctgcatgacccactgccccgccgtcttcgccaccaaggaaatgggggaccgcaccaaggcgatcggcgatctctcggcgctgccggccgcggccggcgagggcaagaccggggagtactggtaccacgaggccacgcaggtgtggttcgacgacgctgaccattacaggatggtaagggcgatgtgccggatctcctgcaccgtctgcgaaagcagcggcaacaaggggaagaagggcagtaagtcgtccaaggcgaaacacaagatcaagttcgacagcattgagcagctcaaagcccatctgtccaacaagcattgcttgtacatgtgcgacctctgcttggatggg

SEQ ID NO: 4832 - DNA, 857 bp, Triticum aestivum
  Clone ID: PAT_TA_4832
gcggcgtccatggtcagcccttccgtctccgcggtggccgccgccgtgcccgccgcctcccgcgaaaacaaaacccgggaccctagctacagcaccacctctcacggccactagaaggcacctcctcctggcctccgccgcatccgcactccccacggccgccgcctccgccgcgagcctctcgattcaccgagatccctagctccggcggcgtgaaggccctagagctccgggagggttccggcgaggtcccggtcgacggagaccaggttgcaattcactactatgggaggctggctgcgaagcaaggatggcgcttcgactcaacctatgatcacaaggacgcgaccggtgatccggtaccttttgtctttaccatcgggtccggaaagggtatacctggtatttgaagcagcagtgaagtccatgagagtcggtggtcttcgccgtgtggtcattccgccaacacagggataccaaaacacatcacaggaaccaattcctcctaatttctttgatcggcagagattatttactactatattcaacccgacacgccttgcaaatggcgagggttccactcttggtactgtcatcttcgacatcgagctgatcagcataaggcagcatacatgactgttatgctttgccaaggctgaaagtccgatcaggcgatcaccgccctgattaaaatcctttagcattgcacacttctgtctcaaagaaactctgaactagtgatcatgcttctgtccaatccctctgtaaatgcaatatatgaaagttgtatagtgattttctgcagttattgagcaacctcagtcacacagatacagactgtacggtatatacagaaa

SEQ ID NO: 4833 - DNA, 980 bp, Triticum aestivum
  Clone ID: PAT_TA_4833
ttcgagcggccgcccgggcaggttgaaggataagtttgagaagtattggaaagatatccatggtcttatgtctgttgcaacagttcttgatccaaggtataaacttcatatcctcaatgctctttatggtcccctctatggaagagagcatgcagccacaggaaggtgaagaagttattgattcaattggtgaagtaatataaagatgaagttgaaggcgaggatgcatgggatgcttctgttgccgatccacttggagaagaagaggaagccatgaaactctatgacctgtatttgtctagtcgccccacggtcccttcttcttcaatccatacagaattggacttgtatttggaagaagcttgtttctacctagaacacaagaattggatatcatcaattggtggaaggttagcggctcgaggtttcctcccttgcaaaaacttgctcgtgatatattgcctattcccataacatcagtggcttccgaatgtgcgttcagcactagtggcagagtgctcagtgcacatcgcagtagacttactcctaatgtggctgaagctctcatgtgcatgcaagcttggtctcgtgcagatatgttaggtggttggaactctacactcttttctacattccagagtgttctcgaggatgaggaagaagagatggatgagtctacttcaatcatcacccaagagtgaagatatggctgctgtttgtgctgggttggaagctgatggttgctatgtgtgctggctaggtgtgctagattttggctgctagctgacgtagttgctatttgtgctagctgatgggtgctccatatgtttcttatgtttcttatttattacttatcagttgttattttctgaagtgtgccctggatcctgtgaacatatgttttgttctcattatttttccattttccatgtaacacgtttgcactcattaacttatacgtacctcggccgcgaccacgc

SEQ ID NO: 4834 - DNA, 1082 bp, Triticum aestivum
  unsure (1)..(1082): unsure at all n locations
  Clone ID: PAT_TA_4834
tatcttgggngcggggcngggcattttngaaatccaaaggccccattaaaacantatatcccnccgtaagaaatttagnggtttgatccctaaaggagtgatcttatatttctttacaggggggtaccattcatgtgnttcccacacagcccagagatngcagcaagagacgtatatattgaaantgacaacacatgtaaaagggcattcattcccttgttttgcttgtttttgtccaccggaggctttggttgcttgatcatagcccaaggaggtgacacacaaaccaaggaattgcggaggaattaaagtgcaatgggcctagattccttacaaaggcactaatccagcatactaatttcagcctaggttcctcaatcatttaagaacatatctgaagtacaaaaagagggtagttttgttactaattgtacagcgctgacacagataaagacagactggtctatttttcaaattgaaggggaaaatagtaagatactgttctgttcctattatacagttgctaatttcctccagatccaccaattcaagatccacaccctaaaaagcaacaacattcggatgatgcaactttgaaagcattcgtgccgccctccaaaaccagctgaccccacagtcaatacggcgcagtagcagtacatgtacatccctgttccttcaggcatccaatgtgacattcccctcccaaattggtcagaatagaaagcagcacacttgggtcactaaatttatttttcccaaaattacggagcctgcaaaagccaagaagaaaaggaaattatctttctggtaggaaatagcaaattgatggcggaaattaaaagtgttcagtatgaggatgaaatgatcagattcaaacatttctccgcacacttcttctctatgagatcgacaatcacggcaggaacaggttctgctccacgaccgactaggcctttcagttcagtgcctcgcaaatcttaacacattcagtggaacaatgccgctccttggggtaatgccgtaaaatcagccatgtcctgttcttccccccgcccccgctccgcctcctggcctcgtgc

SEQ ID NO: 4835 - DNA, 1094 bp, Triticum aestivum
  Clone ID: PAT_TA_4835
cccccacccacccacacaccccgtttgatgggcactcgctcaatctgcggacgcaagcggccacctagcgcaggatggagatgacgagttctttaggagccgacgagaggcgggggccaggatcggtggaggtgcaggtggctgcggcggcgcttcagcggtcggaggtgttccacgtcgtgaaggaactgctcggcttcgttctctacatgcaccaccagatcccctcggtattgcagagtcttgaaactgaatttgcaggtttaaaggaggaaatgtcagaaatgacagcaccattggcagaactgaaaccttctgatcagagaaagtacaacacacgaaaaagggaggttagatgcagaatcaagaagcaggaaaagttaatgaaaggcatctctaccgtactttctgcttttcagcaagcacttgataaagtttctaccattgaaggagttgccctgatcctgggagggagtcttgtacgacctttgtttgtctatgacattacagttactcatggccgtccgggctcttatatcatgtggtgcagggagtttatcttacacaggccctaccaagctgtttctgctggttagatgtccctgtacattgaacttacccctggatttcgcgccaaaacgggaattccgttacagtaagaaggttgtaccccagcaaatgtctataaaatgcaatacagcatactaccaaaaggctcgtgggcatgttgcatcaatcgtggatccgtcatgttgtacttcagaatcttctccgtcagatgttatctggttccagtgcaagcacacgataagagggttaccatgcaaggcgtcattagaaggatgatgatcagctcattttcattatcctacaatcatgtatgttacaactggaaaatgctgtagtgaggtgaacaccgaccctgacctcagcaatcttcaatcctaaattggtcttccccccttttctgtaagtgttcaccaaggatcagcattcttcaatcttatatcccgcccccctccccccttatgttcgtttgcactggaatggtttggtgctcaacgaaaatattttgtttcccgtgtgggctatct

SEQ ID NO: 4836 - DNA, 1643 bp, Triticum aestivum
  Clone ID: PAT_TA_4836
cgccacggtgcgaatattcgttctctggtgatggttggaggggggtcggagaaggttaccactggcagaccgcacgagtgggggacggcagcggttagagtggtcgcgggctaggtacagcagaggttgaatccgcccttgtttcacatccaaaatgtgcggaggccgctgttgtcggaattgaccatgaggttaaaggtcagggaatctacgcatgtttaacttcggtggatggtgttccttacagtgatgatctacgaaaaagcctcattatggcggtccgcagccagattggtgcgtttgcagcacctgacaagatccactgggcaccagggctcccgaagacacggagcggcaagatcatgcgaagaatattgcggaaaattgcctccaggcagctggatgagcttggtgacacgagcacgcttgctgatcctggtgtggtcggccagctgatatcgcttagcgacagttagcgtgtgaggatggagatggcacgttgtcacctatacttgtagcacgtctcattttctttcttgcctcgggtgctaaatagtacgtgagccagtttttcctactccacggaggggcttctatattgttgtcgttaattagagatgccgcatatcagacacttggtcgcagactgaaactggtggttatatgattacacctttacctggcgctaggcctcaaaaaccaggatctgctacatttcctttctttggtgtacagccagtgattgttgacgaaaaaggacgggaaatgactggagaatgcagtggatacctttgcataaagaagtcatggcctggagctttccgcactctgtatggagataaggacagatatgagacaacatacttcaaaccattctctggctattatttctctggtgatggttgtaggagggacaaagatggttaccattggctgacaggaagagtggatgatgttatcaatgtcagtgggcatcggattggtacagcagaggttgaatctgctcttgtttcacatccaaaatgtgccgaggccgctgttgtcggaattgaccatgaggttaaaggtcagggaatctacgcatttgtaactttggtggatggtgttccttacagtgatgatctacgaaaaagcctcattatggcggtccgcagccagattggcgcgtttgcagcacctgacaagatccactgggcaccggggctcccgaagacacggagcggcaagatcatgcgaagaatattgcggaaaattgcctccaggcagctggatgagcttggtgacacgagcacgcttgctgatcctggtgtggtcgaccagctgatatcgcttagcgatagttagcgtgtgaggatggagatggcacgttgtcacctatacttgtagcacgtctcattttctttcttacctcgggtgctaaatacagagaatccgtttatatgtgccacgcatggcctcatgattcccctgatttattcagtaccttgaggttcgggagttgcatcttgcaagtcaagtgagatgtaaatgtaaattgttggatcacatcacagaaaaatactcctacgtagtatataaatataaatgtatgcaagtatgtattagctgcattaatgtagacgaacacttgaaggtgacttgag

SEQ ID NO: 4837 - DNA, 543 bp, Triticum aestivum
  Clone ID: PAT_TA_4837
catgctttttaaagccgacatgggaactgggcacgcgcgtttttccgttctttcggctttccatccgcccgatcatcggaacttcctcccaatcccgcgccttgggttcgcccctccgctgatcagctcggcggcgcgcccgccctccccgccccctgggcacctacgaactgggggccgagagcggaacgccaccgggctccggatcacagggtgggggcgatctagcagaggcggctcaccacgctgacgacgagacgcgcgatgcagtcctcggcgccgccgtcgtccctgacgagccgccgcagcgcccggttcctcgggagcacgccggcgcggtgcagcaccgtggccgccgcctccgccggccggcccgccaggaacggccccaggaaccgcgccgccggcctcaggaacagcggcagcagagacatcgggctatcgggacggcgcggcgcctggccggctttggttgctcgatgcgacggccgccggcgtcaagtcaactggcagcagcaatcggcaatggggatgaccggcgcg

SEQ ID NO: 4838 - DNA, 581 bp, Triticum aestivum
  Clone ID: PAT_TA_4838
atttttgatggtcattacgatgcgcggctgtcctccatctgttttttgatcacaacattgttctttatttcaaaattgcccatcagctggcgcattagcatgatcacttggaacaccataaaattgattaggatgtatgggatggcaaaggaggatgggccgacgtcgctgatgcgccggaagaagaatatgtatttttgcaccaatccatgcattggtccattgaaacatagcagaggttgtttgttaaacaacactcacaacgagatgcacctgcgcagtctataccactcttatgcacgcacaatccatgtggtaaattaatcttcttgttgactttgccatccatgattcggcaatgtacatggataggaaagcacaccagaagcagcaacgagaacagtgttggtgcatgggcaaggccggtgcgcttggccatcaagaccacgatgcaattgaaattgcaaatacttccttcgggagtgagtatgtgcgaggccggtgtgcttgtccatcaagatgatgcaattgaaattgcaaattcttccttggggatgtgtatgtatgttttctgatcgaag

SEQ ID NO: 4839 - DNA, 798 bp, Triticum aestivum
  Clone ID: PAT_TA_4839
ccccgattcccctcatctctcccagatcgccgccacctctccctcttccgatccacctcaccgccggccattcccttcccctcatcccaccgcgcagctccggcggctgctggatccatcgcatcccccacccacccatccctctcgggtcccatctctacctctcttcatacgcctcctcgccatctgcgacggctaattcaggcggcgcccggcgaatcccaccatcacgaagcacagcccgaggtccccatcgaaacgcggcgccgtcccatgcgactagatccggtgctcacggccacctccgccctggcaagggtttcggccgtcggctccggcaccggtggccaggtcatcctcctctggtactcctctcttccgacgtgcaaggaggaacaggctgcgtatgaactcaatcgtgacgctactgacggtgatgtcaatggacgagatgtgcctcggcgtcgaccagcatccactgaggcgggaagtggaaaaggactacatcgccaagcgaactcattggtacatctgtgtgagcctgcgacgggcttgtcatcgccctgtatgccgacttgcacgagggcaggtaggtcaccatcactgcgccgtcgaactagccgcggcggtaccggctgtgcctcctgctggtgtgttgcgcaacctctactggtacacaagtttactattgtgccaatgtgtcatcatgtgtttccatgatttttgcaaacctttaatatatccccgggttccttttcttctatgctagaattggttggaaaaactgtatgcaactag

SEQ ID NO: 4840 - DNA, 774 bp, Triticum aestivum
  Clone ID: PAT_TA_4840
tcggcacgaggtacggggcaggggtagagggcgacccacgcgtcgcagaggaggagagagagagggtagcagcagaggaggagagaggagggctgagtccacgtgagcccagcggaggaggcggaggaggagcgagagatccccctctccctccctctctccggccatggatcctccctacgcaggagctattattgaacctgctaaatgccgattgatgagtgtggatgaaaagaaggatcttgttcgtgaattatcgaagaggccacaaactgctcctgacaaactacagtcatggagtcggcgtgatattgtggagattctctgtgctgatctcggaagggaaaggaaatatactggattatctaagcagagaatgctggattatctcttcagggtggtgactggcaaatcatctggccctgtggtgcatgtgcaagaaaaggagccaactctcgatcccaacgcaagcaaccatcagtacccagcaaagcgtcaaaggaagagtgacaatccatcacgactgccaattgctgtcaacaatccgcaaaccgcagttgtacccgtgcagattaataatgtgcggtcctgccgaaatatagcatgcagagcgattcttagcatggaagataaattttgcagacgctgttcatgctgcatatgcttcaagtatgatgacaacaaggaccctaccatatggttgtcctgtagttcagatcatcccatgcaaaagggttcttgcgggttatcatgccatcttgagtgtgctctcaa

SEQ ID NO: 4841 - DNA, 537 bp, Triticum aestivum
  unsure (1)..(537): unsure at all n locations
  Clone ID: PAT_TA_4841
caggctttttgtttggtgtttttcccccagcggggctttccccctcaccagggcgttggtaatagcaagctttctttagtcctagattaaacatgacaacccaaaagttccatctcgggagttgagtggtgtttagtcgatagggcaacagcaataatcaacatctttgcagtggcctccagggtttatgcaatacttgtagcgggccttttcggcgcccctaggagtctcctctcgatggcatcgtgcgggtgctcgttccgcagcgccacgtctctcatcgttcgcctggcgcgggggccccctgggtgcctgcaccacgtgtgccgccccttgctagggcccttgggtcacctcgttggttgccatcttgcggggcgtgctagtgcttccgcttgtctctcattgttcgcatggcatggggacacaatagtagccagtaccatgagagccaccaaaaagaagggaccaagattcatcttgaaggttgccatttggtgaggccaacaagtgacttctatgctcaantgttgtgct

SEQ ID NO: 4842 - DNA, 755 bp, Triticum aestivum
  Clone ID: PAT_TA_4842
ggttaagtgagcacattctcgttgaggttagtatattagccttctgggtaacttttaaggagaagaaaaaggaacattggcactcataccataccaagtagaatgcctttgggtttttctcaagggagggggatgaacacatgaatttctccgacctgaccagacaggcagacagcctacaaggagctagctaacaagtatacccaacatgaaaacctgaaaccttccttggacatgagagcacagagatactcaattacacacagtgatcatttttggagggcaggagacatcgtttgcttgaggagttatttctgcatccatgtctggaacatccttcatattatcgtcaccttccttgagaaaaccgagcgccgccaggcctgcgccatgcctggtgctgcagtcgtcgatgtcgggacatccttcgaacaggtacccgatgttgctctcgaaggtggcatcgtttacgttgaagtactcgctcagattcatcgagttgctgttgtcgcgcccaaagatgggctccaattcataatccatgcaagggctccacaggttctcctcgacgccgctgtcaaacacaaggggggcacccatgtctccggcgctgtctgtgtcatccactgcaatcggctcgttgacgctacccggcttctgcgcttcacctgagttgagctcttggactgcgttgtcactttgttgatcatgttgaagctcctcttgcaatgctggcaccacctgtggcccctgct

SEQ ID NO: 4843 - DNA, 679 bp, Triticum aestivum
  unsure (1)..(679): unsure at all n locations
  Clone ID: PAT_TA_4843
gccttgtcagggagaggccatacttgcttgatgaggatcttggagatggctctgaagataagcaggggctgtacacgtggcaagacctatgtgtgcttgttcagtccagcgacagcgagctgctggaggggctgaattccctctcggctgtcgagattgatgggttctggaggaccgtggatgtcggttctgtgaacacggttctggacatgattctgcacaactctgtgttgcatgattggctgctaaatgctttgccagaaaatgctgtgctatctgtcatggaagctgacggttttacgcataagattgtagctcattgcctcagcagattcggcacgaaggttgagcaggaagcagggagttgttggaagcttgatgagagactggtctgcttgcagtttgcccgaagagcactcgccgcaggaaagatgaagctcaacaactttatggataaatgggaacgaagcatcccttcaggaatgcgtgcggatcttcagatgcttgaaggggaagttgctgtttgaaaggcttggggctgagacctgggtgcatgcccttcagatgtcgccgatctgcccgtggaccccagctnaagagggtttgcancactattcccggaanccgccaaagtngggaatngaaaaacctncanccccttcntccaagggaacattgc

SEQ ID NO: 4844 - DNA, 692 bp, Triticum aestivum
  Clone ID: PAT_TA_4844
ccgatctgaacaggaaactttgctcaactttgaatgagcccgcaatcaggttgaagcagggacggatggttgttgccatggacgaattccaccggatgacacatattcgactaccactttaaacagtttcctttagttgcctgatgattcatggttgttgtattcatgctgactctggttttaatctgccttactttaactgaatattctattatctggaaaaagatagtgaaaatctagatctaattaaccctgccttgtttttgcagttctgagatgcatgcatgtttctaaggaccaagatctggaaattgctaaggaatgagtaatctaactgttttcatgcgattcaagacctcgctggtgtttgtttaagttatacagtttcctacatatattggttgtcttccaggttcagtttgctgtggcgaattctgcttgaatttgttgcagcaaacttgtggtcatgtatattttctttagttttgtattcatgcctagaagggtagaaagcttgttcaccccttggtctggtggtcgtcttgattgcgcgcctcacaattattgagggccagatctacaaatattgtttctaaatacaaacgcccactctgtttctcctgggtattaatctatgcacaacaagctcttctgtgcttgatgacaaataaaggttgcatcttggatgtttg

SEQ ID NO: 4845 - DNA, 1205 bp, Triticum aestivum
  Clone ID: PAT_TA_4845
agactcaatgtaaccgacccatcagagaattgccattcttttagcacaagactgacagttaactcgcctgtgatatcctcctcaaatggaaccaccattccaacttctttcccacaatgctcagcatgccttgcaaccacaccatcattatgtcctatagcccagaatattgtcgaaccatctaaaacatacttgacctttatctcgcagcttgtcaggtaattatacttgacaccatcggaatccagttcatacagaagaaacttgacaacacctgtctctccatgcagtaccatgttaaatgtgctattccatgtaggatttggaccctcacaagtagttgtttttctcgtcaaagtgccgacttctacctccaataaatgtatgtgccctcctgttaagaggaatcccaggtgtagtgtttccacttgagctttggttgttccctaactcattagttctgctctttctgccaagattactagctgaaacaacagtaacagaaagaacaccaccaactgcttgtttcttcagatctactggtggcaaagaaaagcagagacggcgaggctcaaccattgtcttggctattgtttcagtcaaaagctttaccagccatgttgagacacccggtaactccataccaggaactgtttggcttccaccacttccaaatgctacacctatcctgacttctggagtagattcaaaagaatagaggacagcttcgccatcaagaatgggactcagtagaagatctcccttgatgtggatgctgtttataactcggcccgcagcgcccatcagaggttttgctaatttcgccataaacatcacactcatctctttgctgtgccaatcaaaacccaaggacatgacttgctgttcacctgaagtcatccagcgcataccctgctctcccaaggtaggtgggcaagaaccgagtgagaattcctgtaattctattttatcaatcagttttggttttcgattctttaagcgtctctcgacggtagattgaaacttctttgatagtttcggttccatgtagtttggccaaacttcaatcaaaagtttgttcaaccactcgcaaggctctatcggtgtggtaggtgttgtgttcagtataaggtgcttccatcttttgttcaaatcttctacagccatctttcgtttaaacctcccatactgaatggtcgcccaga

SEQ ID NO: 4846 - DNA, 912 bp, Triticum aestivum
  unsure (1)..(912): unsure at all n locations
  Clone ID: PAT_TA_4846
cccgcccctcgcaccgccttgcccggctccctcaggggcgcccgtgacgcccccgacctcggccccccccccaccacgccaggaaacacggcggcaccatcattgatgtcgggacaccgcagaccaggatgatccgtgcggcgtacgacatcctggaggccgcggtcgtctcggatctacaacatcgcctcggggtgcgccggccccgccaccgtcgaccgcgctccccccgaggcctcgtcgtgccgtgccgcgggcgacacccggggcgccccggccgcccccgccccccggccgcgcccccccggccgccgtgccggtggccgagtcccgggctcccacctctgctccgtcgtgcccagcccgccggcctccccgtcgctcccgaccagcacgcgccgcctggccgcgcccccccaccggtcgacccgcgcggctccactgtcgccgaccagaggccaccacgctgccctccgcgcctgcgcccgcacctctccggccgggtcgatgtcccttcctggcgccgcccctccgggccccccgcgcggctcctgcgaggtcggcctgcggcggctctactttgctccggagaattgcgggaacgacagtagctagatcaatacgcctttctttcttatgcactagatgccgctggtgcaagaactgtatgcatgggcacaaataaataaaccagcacgcctgcttccgctccgttccggacgagaagatgacggttcttggcgccgcgcaacaggtggacacgcgcttcaccattgatgtcgaccataggctactctactttgctccggagaattgcgggaacgacagtagctagatcaattatttatttatttatttatttgtgcccatgcatacagttcttgcaccaagcggcatctagtgcataaanaa

SEQ ID NO: 4847 - DNA, 551 bp, Triticum aestivum
  Clone ID: PAT_TA_4847
gcaagcgcctcctcccccctctcccgcgccgcgccgtcgcccgccatgcgcacgcccccgcggcgccggcccccgcccccgcccgcctcccccacgccgggcgcccgccccgcggccgccgcctcccccgccccctcccccggccccggggaccggcccctcgacccccgcccccgcgccctcgcctgggggcccctctggtcgtcgcggcggggccgggccgcgcgccgtcgcctgccgcccccaccggccgggccgcgcggcgcgggcggcgcgccttcgccgtcccccgcctccgccccgaccccgccgcgggtgggggcctcgtgcgtcgtgccgcggcccctccccgtcccatccgggaaagtgggcgtcgggctttctggatgtgccccccgccttggggctgcgggggtgatggccgccctttgcggggacggatgtctagtgccgcttcagaggctcgctcgtgataaatatttctccaagccagcttttgagtctgttatgactgaaaatgaaagttgtgagattacttccatacagtcctt

SEQ ID NO: 4848 - DNA, 781 bp, Triticum aestivum
  Clone ID: PAT_TA_4848
ttcttcttccttgcttcttaccgtgcagcaaacggttaagcaagtacacatacatagtagcatcggcactagcctagttggggaggatttgcaggaggcaagctggcgagatggaacttcttgaacacaaccaccagaggctcacgcccatctttctctacggtcagccacctgtgtccattgtagtcgaacaacaccagatcgcggcacggcgcatggaagcacgacatcagcttgtacccggtgccgtgcttctcgacgcgaaacatgaaactcttcttgcatgtgcctgcccccgcctccccccccgcccgcccgtcgggcccgtccgccggctcaggcgtcccgccgggggcccccccctggccgcgccactggcgccggttgatgctcccgccaaactcgatcacgacgtcgggtggagaggcggggtgacgcctccttgccggagccggagctcgcctccgccagcttgatcgaaacatacccgtctggattcccgcgaaactgcttgcacggtgtcagaatcgcacgcatacgacatctggggtcccgtaatgagctaacatagatgcattggtcgctcaaattacggtccaccggcatgatgttgtacatgttgtggcctgttagctcatggccatctgtgtcgtagatcggctgcggctgcgcttgcgcagcgttgcacgggctggtcagctgcaaggccatggccaagccagagagtgagaggatgaccaggaaacagaagtgttccatcgctcgcgtggtagtaactcgt

SEQ ID NO: 4849 - DNA, 832 bp, Triticum aestivum
  Clone ID: PAT_TA_4849
tccccatcgcgcccccccccgcagccgccaccgccatcgccgggaggggccgccgctcgcgtcgctttccgcagccgccacagccccctccccttccaaacccaccgagatgacggcgtcggcactggcgctcgcggtggtcgggtggcttgctcgcgctcgcgaaggccgaggtggtcgcactgctctggggcgtgcgccgcctccatcgccggcaggagggggccgcagaggccgccgcgcagcccagcgaccaggagctccccgccgcgctcccctcccgcgtccccctcggccgcgcccgcggtcccgtccccacgccgccccccccctccgccacggcagcgccttcgtccccgacgacacccagcagcagctcactcccggcccaaaacgaggtagcgttcccaaatgtgaagcgacaacccgcagaaagatgagcaggagcagaccagggatgaagccaagatctacgatggtgattcttccaataaaatgatgcaggtggccaacagcttgatggtgccgtcgatattgtctcctccagcgtcaaggaaccagccaaaaacgtcatcgtcaagcaagcgacgctgagcaaatgtcaggtgccatcacgcaccagtggtgtggcgatcagattggcaacgtgttcgatgcagcttacaatgccaatgatcagttcatttttgtggattgttgtggggggattgaggctttaaagcacatgaattgcagcaggaattgttcaggatactactgttgttgctacttggtgcgttaccatcaccgggaggagcgacggccatccacatcgccattgccatcgtccttc

SEQ ID NO: 4850 - DNA, 605 bp, Triticum aestivum
  Clone ID: PAT_TA_4850
gtgcggcgctcgaggcggcggtaagttaacggacaactcaacccccaggaaaacccctctctcctctccgcttctccctggctgccgaaaccctaacctagccgcgcgtcgccgccgccgccggcgcaccagtcgccatgtcgaaccccaaggggtcgaagatgctccagttcgtcaactaccggatgcgcgtgacgatccaggacggccgccaactcgtggggaagttcatagccttcgatcgccacatgaacctcgtcctcggcgactgcgaggagttccgcaagcttccgccctcaaaatcttccaagacaacaggcgagcgcgaggagcggaggacgctcggcctgctccttcttcgtggcgaggaggtcgtctccatgaccgttgagggcccgccaccgcccgacgagtcccgggccaaggcctccggtggcggtggcgcgctttccggcactggcgtcggtcgcgctgccggacgtggggtggccaccggcccgctgctccaggcgcagcccggcctctccggccctgttcggggcgtgggcggtccggcccccggcatgatgcagccccagatctcgcgtcccccaatgccgaacctc

SEQ ID NO: 4851 - DNA, 1816 bp, Triticum aestivum
  Clone ID: PAT_TA_4851
cttcgccgaaaccctagccctcccggcgaagtcgccaggtcacgcccggaagaaccccagttgctccaccgcgtctccctccctccccgagcgccgacccaggacggccccgcgctcgcggccaggaccccgacaaaccaaagccccccccaaaaccaccatctcccctccgcgcctctccggccgccgaagccctaacctacccgcgggtcgccgccgccaccggtggctcgggagccccgaaaaccacctgggggtcgtggtcgggcaggaacgaaggatgcaaaaagcacctggagttaaagcaagccagttaacggcgatggatcctcaaggccgggccagtgggctcctgctggcggcgccacggctggtactgcaggatctgcaggcggaggaggatcatggggaaagcgcaatgaagatagctggaattcttcaagaggaactggaggctcagaaggtggtttgaagaaggaaggatcctgggacaaggctgaagggagcgggagccaaggcggaggtggcggcagttcttgggacaaggtggccagtggcggatgggacagcaacaagggcggggatgccggcaatggtggtggcagtgggtggtaggcttgttccaaaatcagctgtgcctgattttggcgtgtacataagggttagcgctatgcaggtctcagcgctctagcactttgtgctggttggttccattggccgtgcgacctgaacctttagaagaacatggcctagctgggcaaaacgtcccctcatgcgagcggtaatattcttgtaatgcaagcggaacctcagcgggtggctcacagtaaggaagatcttgagacaaggggaacgggagggattccgaaggtggcagcggcaggggttgaggccgctatggccccggtggccgctaccaaggcaacaacgttgggtaagccgacgatggtggtggcagttggggctctggcaggggaaacagcggccgtggtggaggttacagaaacaatggaaatgacaacaatgagggaagggcctccagtcaagaccgcggttgtgtggtgtcatactcttctgcttggaatgctgataaaaagggaagcgctgaagaggatcaatctttctcaaagggcaagtccagttgggggagtggcaacaacgatagctggggagctccaaaaccatctggtggagatgatcaggcaggaaagaaggatggaaacaacacctggagtcaaaacaagccattttctggcgatgggtcctctatcctgggccagtgggctcctgctggcggcaccaccgctggtactggaggatccgcaggcggaggaggatcatggggaaagagcaatgaagatagctggaattcttcaaaaggaactggaggctcagaaggtggttcgaagaaggaaggatcctgggacaaggccgaagggggcgggagccaaggcggcggtggcggcagttcctgggacaaggcggccagtggcggatgggacagcaacaagggcggggatgccggcaatggtggtggcagtgggtggtaagcttgttccagaatcagctgtgcctgattttggtgtgtacataagggttagcgctatgcacgtctcagcgctctagcaccctgtgctggttggttccattggccatgctaactgaacctttagaagaacatggcctagctgggcaaaacgtcccctcatgctggcagtaatatactagtagtgccagcagaacgtttcgtggtacctgcagtaacttataagtaccttattatcccatcgtgtctgagatttccatgtggtcaaaa

SEQ ID NO: 4852 - DNA, 451 bp, Triticum aestivum
  Clone ID: PAT_TA_4852
gcacgagggtcaagctcgcaaaggatgcgtacacacctgatttaatggcagcatctgactgcatgcttgggaaaattggatatggtaccgtgagtgaggctttggcgtacaagctgccatttgtatttgttcgtagagattatttcaatgaagagccttttctgcggaatatgcttgagcattatcaatgtggcggggagatgatacggagggatttacttactggacattggaaacctgatctgctacgggctttaacacttaaaccctgctatgatcgtccaataaatggtggcgaggtggctgcacatatcctccaggatactgctgtcgggaagaagtatatttccggcaagttgagcggggcaagacgattacgtgatgccatagtgctaggataccaactacagagggctccggggagagatgtaggaattcctgaatggtattc

SEQ ID NO: 4853 - DNA, 1662 bp, Triticum aestivum
  unsure (1)..(1662): unsure at all n locations
  Clone ID: PAT_TA_4853
gcacgaggctttcgtctcccgctcccccggtctcgcgctgtacggcgcgccatggccatgccctccacttcttacttctcgcggccgcctatcgtgcaccccacctccaaaactccgaaccctccccgactgctgccgctcgtctccggggctgctgcccctcgcccgctgctgccctccttcgctccgcccgcgcccggtcgcgggctccggaccgccgccgcccaacaacccgcctacgaaaatggagaggaggaagaagatggggaggaggatgaggagtattacagcgaggaggaggatgaagaggaattggacgtggaggcgatggaggaagaggcgcgccgcgccgccgcccgccccgccgcgcgcctcgaccgcgacctccgccccgatcccagacagtaagcttccaaaggtggctgttattggtagacctaatgtgggtaaatctgcactattcaatcggcttgtcgggggcaacagggctatcgttgttgatgaacctggtgtaacaagggatcgtttgtatggacgatcttattggggtgatcaagagtttatggttattgatactgggggtgtgattgctctatcgaagtctcaagncaggtgtaatggaagaacttgccatcacaactactgttggtatggatgggattccaatggcctctcgagaagctgctattgctaggatgccatctatgattgagaagcaagctgttgctgccgttgaagaagcagctgtccttcttttccttgtggatggtcaggctggtcttgtggcagctgatatagaaattgctgattggttacgtcgcaacttctcacacaagtgcatcatactggctgtaaacaagtgtgaatcgccacggaaagggcaaatgcaagcattagaattttggtcattagggtttacaccttggccggggtctgctatcaccggcactggaactggagagctcctggatgtgggcgggtcggaactgaaaaagttcgagggactagaaggattggatgatgttgaagaagacgaaaaccgcgttcctgctatttctattgttggaagaccaaatgttgggaaaagtagcattctaaatgctttggttggagaagatagaactattgtgagcccagttagtggtaccacccgtgatgccattgatactgagttaaccataaaggatgggcagaaatacaaactcatcgatacggctggcatccgacggagagcagcagttgcttctgctggcagcacaactgaaacacttccagtaaaacgtgcatttaagtgcaattcgtccattctgatgttgttgcccctggtaattgaagcgatggcctgtgtccccggaccaggattataaaattccagaaaggattgagaaaagagggaaaggcatgtgtcatggttgtgaacaagtgggatacaatcccaaacaagacctgtgagactacctgcccggccggccgctcgaaaactcctgtactnacnggcacnatgttacgtctgccaaaatggacacnttanaaatatccgcgctcttggtnaaaagaagcaaaactggacccatctacatgtaaaacgtcataagccnccacaangngaaaagcttntanaaaagnngtcccaaatgtccnagacaanttcnctcggaagaa

SEQ ID NO: 4854 - DNA, 781 bp, Triticum aestivum
  Clone ID: PAT_TA_4854
cccccgccccgcgccccccccgccgcccccccccccaccccccccccccccccccccgccgcccccccccccaccccccccgccctcgaggctgccgtcgccgccccccacgatcacgtcgcccaggcccccgccaccagccccccccggccccccgcccccgaccccgcccaggccaagccgaagccccagtcgtcctccaagaagacgaagaccaaggccccggcccccgctcccgtcgccgccgaggcccccaccaagtccaagaaggctaaggcccccgcggcctccgacgactccgaagcccccggccccgcactcgatgctgccgccgacgacaccgcgggcgcgatccaagaccatggcagcgggcagcctgtcggcgtgcccgacaccgcggggcctcctcgccctcctcgcctagcacgaggcaagccggtgaacgcgggaggccagccggccccatcgagacacgccacgagatcatgcaatcattcatgcggtctctgtaacgggcctggccggggcggtgtctctttccgtgtttgtccaccccaccacatttcgtgctgtatctccgtgcctatttgttccattcctctggacgagccaggagatccgatttctcttttctttgtaatcccactcatgcaagtatgcctccatattttttttatctgtgtaccaaattgatcagaattgatttatatttttattacccctcattgtattattccatcattgtttaatcatagatctgtctctttcgtcaaaaaaaaaa

SEQ ID NO: 4855 - DNA, 787 bp, Triticum aestivum
  Clone ID: PAT_TA_4855
tgatcaacgagccttgcaagttaaacgtacatacgtcctctgatgcgggaaagtatcgggtgctgccagccctgaggtatacagagccaattctcaatagaatatgccactgacaccaatctaggcatttcaggtaacagagcaaacacaaaatacttccacactatgctaggctttgcatcgcagtcctgacctaggcctttattatacttcctcatggacaagtagttcttatgcttcctttccctctccatcttcagagaaagctggtggtgatgcgcacgggtctcgccgggagttgagacggaggatgggtggttcgcggttgctgtacgcctcccgcagcgccgcccttttcttcctcaccgcctccgcgagaaaaggctggatcttggaggggacaccgttggtgaccttggcgccggggagagattgttccttcagcttcgccttcatctccttaaactgcgccctaagttccgccgacttgaccgggtctggtggtgatgcgcacgggtcttgccgggagttgagacggaggatgagtggttcgcggttgctgtacgcctcccgcagcgccgccctttgcttcttcgccacctccgcgagaaaagcgcggatgtcggaggggacaccattggtgaccctggcgccggggagagatttttccttcatctccgcctggagctcctcaagccgcgccctaagttccgcccgcttgaccgggtccatggcgacggtagcggttgcagcgtcaggggcaaagcggaggcggcggcggcggcgc

SEQ ID NO: 4856 - DNA, 575 bp, Triticum aestivum
  unsure (1)..(575): unsure at all n locations
  Clone ID: PAT_TA_4856
gttgtatttaccaaggggacatgtggcccctgctgattcaacgcagcaagcggcagcaagttaagattgtggaaagtggaattgaggaaaagtataaggcatttaagcagtttgatactgttggtgaccacagtgatcacttttatttgaagtttcggaccgtgaagaagccatcaaaggactgggtgaagagaattcagcatgaatggaaagttctagggaaagatttaccaagatacaatatttgtgagagcggatgaggacagaatgggacctgcttagagctgtcatagttggggccggcaggcactccttaccatgacgggttgttcttttttgatgtctatttcccttcccaatatccaatgttaacctccctcaaagtgaattaccgctctggagtctggcggcttaanccaanctcctatcctgtgggaaaatccgccttaaccccttaaacacatggactggtatgggtgttaaatgttggaacccaccactncaactaagttgcangccctgggcnccaatcaaaccctnggggctgaatgccaaaacttatttcantgaacctg

SEQ ID NO: 4857 - DNA, 1065 bp, Triticum aestivum
  unsure (1)..(1065): unsure at all n locations
  Clone ID: PAT_TA_4857
taccactgagcatgcaaaaagcccttctcgacctgtccatagtccaaaaaatgctttcactgagcttccaggtgttctaatggctcctccaagccccctggggggtaatcaaatgaaagttggcaattcacaggcggaatgtgctccacccagagatgtagcaaccaaagaagttagcagtgcttgctccagttccatgatgggggatgctgacagcaccaagcagtctgaaccatctgaacctgatgcgacgtagacccacttggattcatcttgcaaatgctcaaccctggacactgccatacaaaagcatgatcaaactgatatgccaagctcagagctcaacaccaccaatttgcagaagagtatgcctagtaatgatgatagtagtgtaagctcagccttggaacccatctgttgatacaaatgtgcaagaatttatttgcaaggatgatattccctgcagtaagacggtgcagagcactcccactatcactgtacagagtgaggaggataagttcacagtacaagaactgctctcatcagtaccatatattgctcctgatgattcagcaacaaaaaccattgcactagacaaaggatccaattctatccatcagtcatcagagaaatcaccaggtcctcattcgggccctccagttgaggacattatacatgtcataaggcccagcagtttcagcgtcagcgatgagcaggcagtaacacggaatgctgaaatggaagcccagagcacagatgttggcgaacttggcgatgttataaaagaagaagtggatgtgagaagcatcacaccaagtcttataccttccggacttgttggttctgccactgtgaagcccaacatttcagaagataataccatcggtccgaagccgccaattcagatgtgctaaaattgcccgctgtnccagaaccaatccctcctcggccgcagcccgggggtggggtcgggcccgcggagaccccggcactgcgaaggccggctgattaatcntagcacatcaggtctgaggcctgagcttcgcgtcgctggaanaaagtgtg

SEQ ID NO: 4858 - DNA, 509 bp, Triticum aestivum
  unsure (1)..(509): unsure at all n locations
  Clone ID: PAT_TA_4858
acccaccaggccaccaccgtcgaggcgcacgcagccgaccgagctccaagaatggcagccacgccggcgtcgccgcaggtgcacatcgagtccgcgcagacgggcttgccgactcgcgtcgtcgagcccgacaggacgcgcgtcatagccgtggccgcgccgccgctcccggcgaccgcgctgcagcggcgcctccgcgcggtcttctactaccgcggcgacgacgcgccggtggaggaaggtatattggtaaaggagtccctgggcgaggtgctgtgcttcttcccggagatggcgggcaggctccggcggcacgccgacgggtcgtgggaggtgaagctgaacgacgccggagtgaggttccancaggcgacggtggaggtgaccatggaggacttcctggcggacaaggagcgcgcgcgtaaggaggccgcgctggcgccgtgggtcgacgtgagcgcggaggatcctgacatgtgctcgctcctcttcatgcagctgaaccggtt

SEQ ID NO: 4859 - DNA, 977 bp, Triticum aestivum
  Clone ID: PAT_TA_4859
attcggcacctcgggctgagttagcggcgcgcccaaggaagaaacggagaaccaaaacaatggccgctctccgccacctcgccggcgccacccacaaccaccgcatcgcggccaactcctcctccctcttcgacctccagcggccgccttcctgcctcgccgcggcgcgacccctcagcctcgcgcccctccgctcccgcttcacccggctttacgcgctgtccagcaacgacatcaaggtggggttcaacctggaggtggacggcgcgccgtggaagattcttgagtttctccatgtcaaacctggaaaaggtgccgcttttgtgaggacaaaaatgcgcaattatatcactggcaacacagttgagaaaacctttcgagctggaagtacgatccaggaagcttctatttcaaaggaaaccaaacaattcacctacaaggatggctcccagtttgtgttcatggatttgacatcctttgaagaaagccgtttaaacgagtcagatgttggcgacaggcagaagtggttgaaagaaggaatggactgcactttgttatactggaatggacggatcattgattttgatctccccatcactgttaggctgaccgtaaccgaggctgatccagggcaaggtgacagtgcacaaggaggaacaaagcctgcaactctggaaacaggagctgttgtcaatgtgccgtctttcgttgatgtaggcgatgatgtcctaattgactcgagaaccgggcagtatatgagccgggcatagagtggaagtggataccagatgagatgccaacagtgaagagctagttttcttgtcccccaatttttggtttaattatccgttcaaaagttcacaacattgtctctttttttcgcatttatcatactgggaccatctacaccgggcatgaaattctatggaaaatttctgaactgggcccctttctccttcaaaaaaaaaaaaaaaaaa

SEQ ID NO: 4860 - DNA, 441 bp, Triticum aestivum
  Clone ID: PAT_TA_4860
cggacgcgtgggcggacgcgtggggcgaagattggaatctccgtggcaaaggccatccacgccggggccctcaagctcacactagggggtgtggtgcttggggatagctggatctcaccagatgattttgcgctgtcatatgcgcaactgttgcatgatgtatcgaggctgagcgacgaagctgttgcccctctcaacagaatggcggcaattgtaaaagagcagatagcagccggacaattcaccacggcgaagatgacgtggacgaatcttgttgatttgattgaccagcagagtgatggcgtggatatgctaaatttcttgcttgacaaaggcgaaggctcatcgacgagccaggtgtttccgtcgacccccaacaccattgacggtctcatgaatggggtcattaaagaaatagtgaaggttattcctaagaacata

SEQ ID NO: 4861 - DNA, 766 bp, Triticum aestivum
  Clone ID: PAT_TA_4861
ttcggcacgagtgatgtacgaggagctgcacgtgatgtcgccggtcgtcccgacgcgcgagttttgcttcctccgctactgccggcagatcgagcagggcctgtgggcgatcgccgacgtctccgtggacttgcagcgggacgcacgctacggcgcaccgccggcccgctcgcgccggctcccatcgggctgcctcatcgccgatatgtccaatggctactccaaggtgacctgggtcgaacacatggagacggaggacaagacccccatcaaccagctctaccgcgacctcgtcctgatcggggcggcgtttggggcgcaccggtggctggcagcgctgcagagggcgtgcgaacggcacgcgtgcctcgtgacgccgccgcacagggacatcgccggggtgacgttagagggcaagaggagcatgatgaggctgtcgcagcggatggtgggcagcttctgcgccagcctgagcgcgtcgcagcagcaccggtggacgacgctgtcggggccgggcgcgggcgtggacgatgcggccggcgtgcgcgtcatggtgcaccgcagcacggaccccaggcagcccagcggcgtggtgctcagcgccgccacctccatcgggctccccgtgtcatgcgaccgggtgttcgccttcgtgcgcgacgagaacacgcgctcccagtgggacgtgctctcgcacggcaacccggtgcaggaggtgtcccgcatccccaacggctcgcacccggggaactccatctccttgctc

SEQ ID NO: 4862 - DNA, 829 bp, Triticum aestivum
  Clone ID: PAT_TA_4862
gatcaacccgctgagcatcccggcaagtcatgcttcggaaacctcttcgccccatcaccccccggatcccgagttgactcacggtccgcaatctcacttatcttcactgcatcctcgcatcaactgctggttctggagaaacaagttacgtagaccatattgtgaacttgaacccagattcaggaacaagcgtgtggtatcgtctgctttgtctcttgttcctacgaagatgggagttaaataacgacacgagatttcacaaatttctgcggcatcctctcaataatatctagtcagctggaatggccccgtgcacccttgtcgaacggtatctaatccgggaagaaactagctgtaacattgttcttaaaagatgttgcaaggcagccaattcttatcttgaatttaaagacatttaattcagtagcaaatggcctcaatggaatctggtgctgaatctcttaaaatggctggttgctaaatagccaattatcagccaattgtaataatgggacaaacatttcactcgagctatcaccatttggaatatatttacaaggcatagttctattcttttttgatctgccaatgttgtgtttgaatgtttcagtaataagcaagaattttcccgcaagatgtgcaatcaaggagcactgttcaccttcacctggaactacgaggctctgcattataacaaaatatgtctaggtacagctggtgctatgactggcattttcgctctaattgggccaagactgttgatttcctttcttaatcttatgtagcaaacagccccaattaagtgttttggtatctgcaacacatttga

SEQ ID NO: 4863 - DNA, 593 bp, Triticum aestivum
  unsure (1)..(593): unsure at all n locations
  Clone ID: PAT_TA_4863
cctcaatgttgatctcttggacgtgcatgctgataagagtacatttcaccgttttgacaagttcaatctgaaatataatccatgtggccagtctcgcctcagggagatctttcttaagcaggacaaccttattcaaggtcgcttcctcgctgaattaactaaagaagtgtttgctgaccttgaagcaagcaaatatcagatggccgagtatcgaatatctatttatgggagaaagaaaagtgagtgggatcagatggcaagttggatagtgaataatgaattgtacagcgagaatgttgtttgggttaatccagattcctcggatttacaatgtatacagggagatgggcacgattaattcattccagaacctccttggacaacatatttcttccactttttgaaagtaactgttgatccttcttcacatcctcagctgcacgttttcctgggggaggggggggggggtgatttgggggggggtggatgaaaacaaacccaanaaaggngccccaaacaaaaacanatgnccgaccccccggaacaatgggccnaatggttttcaaatccanccctangcaanattatgtttg

SEQ ID NO: 4864 - DNA, 786 bp, Triticum aestivum
  unsure (1)..(786): unsure at all n locations
  Clone ID: PAT_TA_4864
catcatcggctacggcgcttcaagtaccgtgtataaatgtgtgctcaagagtggcaaggccattgctgtgaagcggctctacagccaatacaaccatggcgcccgtgagtttgagacagagctggagacagtcggtagcatccggcacaggaatcttgtcagccttcatggcttctcactctctcccaatggaaacctgctcttctacgattacatgngaaaacggttccttgtgggatcttctccacggtccatcaaagaaggtgaaacttgactgggacacccgactgagaatcgccgtcggtgcggcacaagggctggcatatcttcaccatgactgcaaccctcggatagtccacagggacgtcaagtcctccaacatcctgctcgacgagcactttgaagcgcatctctcggacttcggcatcgccaaatgcgtcccagctgccaagacccacgcgtccacctatgtgctaggaaccatcggctacatcgatccagagtacgcccggacgtccaggctgaacgagaaatctgatgtgtacagcttcggtatccgtcctcctgggagtttgctcaccggaatgaanggtgtcgacaacgattccaacctgcaacagtttataatgtccaagaagcttgacgacaacaacggtgaatgggaggngggtgggctcccggagggngtccggtnacgttcaacggacaatggggggctggtggcnggaaaggggtttcaaacttggcccttgcttgtggcaacaaaagcgggaaccccaatccaac

SEQ ID NO: 4865 - DNA, 1066 bp, Triticum aestivum
  unsure (1)..(1066): unsure at all n locations
  Clone ID: PAT_TA_4865
ggttccctccgtctccttccgattccgccccctcccccgccgctacgcttcccgactccggactccccttcgcaccccgccgccgcgcttcccgactccggctccccttcgcacctcgccgccgctctgggccaccggcttcgcactcctccccgacacccctccgctccctcccacaccccagtcacctgcccatcggcaaggtcaccgtcgccctcctgcctccccccctcccgcccgccgtcccacaggggcaccgtcttcctgctgcgcgcggcggcgcccgccgcccgcgagggccctgcggcggtgtcgacttgcctggccgtgaggtccgtgagtataccaatctcagcgatcctaaagatctccggcgggcggaggggcgggccttggccgccgttgagcacgccgcggtcctggctgattctgcacctcctattcctgcggctcttcgccgcgtgcctccacccgatgctggttgttggcggcgtgagcgctggctgccgtctggggcgagcagccctgggcgggcatgagtcgcctgccctcgacgagcagcagagggcgatagaccttgccgggcgcatgctgcgccggtcagggaagcggccacgcccggcggtgaagatggcccccaccctagctgattctgcacctgctctacctgccgctctttgtgtcgacgccaggccaaaaagcgacataaggcaacgggatcttttgaagaacattgttgggatcaaaccgaagcgacccaaggtttgcagccctcgccaagcggcagagaacgacgggcctaagcggaaccaggaagtttctgtcagcaaaatgtcttcatgtcagaatgaaccaaagccagctgaagcaacggagtctaggccacagaacgtgactggaatgcttgcttggtttggcgtacgaagagttcggatgaagaatgaccagtggtggtanggaagtcacagtanggctgtaggctgcgtgttagttcatcctgcaacgttgctagattgtgtttctgcgccgggggttcaagataattcaaagaactctttctgctngg

SEQ ID NO: 4866 - DNA, 1019 bp, Triticum aestivum
  Clone ID: PAT_TA_4866
ggggcgaaggcagagcgaggggcaccagcgcgcccccccctgagaagcggcggcctccctctggctgctccaggtccctcctcttcctctccccagcatcgcccccctcccgaccggcccctccccctagacgaagtgcgcgccagcgtcgcctctgcggaacagcacgcccgccccggacagagggcgacccccccctgcctcccgttcccccctctgcacatcgccctctgcttcccgagttacgactcaccatcccgctctcctcgtagcgccgccggggccgccctcctccaccccagctccgccgcgggccgggcccgacgaaacctttcccccagctcacccgggagctcagcgtcccctccttcccctgttgtgaccaaagttcaacggggagcagcggctgctgggcggccgaccccccctccccttgttcgggtggtggccgatcaaggcttaacggccgtgccctgcctccggcgcctccgggggccggtaccggcgctacggcaagagcatggacgacgtcatagccggcaaggggcggaaagtcgcctccgacaagaagaaaagtgacaaatgatccacctcaaggaactggagtgcaccgcatgtgctggagaaggatgtccattgttcaaccttcctagattttgtttcaggctcgacgttgtctagctaggtcagattgttcgagcagcgctgtaattcatccagcctgcagaatcaattcccatatcgaagttttgtacgtagccctggatcaacggactgcagtgcagctgcccatcttgtgtagctcaagagcttatctcctatcatctcacatagccatgtgctggagaaggacgtccaaacctctttgattttgtttcagtcttgacgttgtctagctaggtcagattattcgagcagcgttgcctgctgaatcaattccaatatggaagttttgtacgtagcgaagccgcggcggcggacttccccgtctgcgtcccggcccgggcggccgcatcttg

SEQ ID NO: 4867 - DNA, 2423 bp, Triticum aestivum
  Clone ID: PAT_TA_4867
tcgaccccgcgtccgaaattgcatatcgctatttttatgagcttgtcaacaagggaatgatccaacctgagcaaattaaccacaatgatgaggtgttatcctgtacattgcaccacactgtacgtgatcttattatgtacaagtccaaagaagagaattttatcacttccatagattactcaaaagccatcacaggaaattctaatatggttcgtcgactttctctccactttagcagtgccaaatatgcgaccaaaccatcaggtgtaatactgtcgcaatcgcgatcacttttcttttttggacttctcagatgtttgccttctgatgtggaatttaagttgctgcgagtattaatccttgacttttggggcaaccaatatgggcttacgagtctcaacctcacaagaattcgcagtttggttcacctcagatatttgaagatttcatgcgatatcattgtagaactgccagcccagatgcgaggactacgatacatggaaacactggaaataaatgcaagatcatctgctgttccattggatatcattcatctcccgggcttattgcatctctctcttcgagatgagacaaatctacctgatgggattggccgcatcaggtctctgcgtacactacagtattttgaccttggcaataaccctgcgggcagggtactgagcctttgtggcttgatgaacctgcaatatcttcatctcacctattccacagtgcagtctgatgagcatctgaagagaaacatggtagctttggcctcttctgttatcaagcttgttaacctcaaatctgtcattccgactcctggagctttaagcacagccatttaccatgatgtcttgagcagcgtttcctctcctcccgtctttcttcagggtcttcagagacttgtcgtgttgcccccaatttgcatgttttccagggttcccaaggatattggagcagttcgcaaactttgctatttgagtcttgtggtccgtgaactacgaaggaatgatattgacagcatcacaggattgcctgccctcactgttctttcattgtatgtccggcaaccccctgcagaaagcatcatcttcaacaatggggtgttccctgctctcaagtatttcaaatacatgtgcggtgtactgtgcctggccttccaggaaggagcattgcccaatgttcataggctcaagctaggtttcaatgcccgcaaaggacagcagtatgatgttttgcttgccggcattcagcacttggtaaacctgaagaagattgatggaataattggggcagccgagggtgctgaggaacccgacagaggtgctgcagagtctgcgttcaaggacaccattcacaagcattcaaggtttcctagttacgtcaacgtaaaaagggtagattgggttgaggaagagaacgagccaaggaccgaagttaacagctcatcaagtaaatgtcatgaaattctacaagaacagcgtggggtaaatgagaccgaggaagatacaaagcagtttgctgatagcggggtgacaaatcagatcatgcaggtgtctcctcagcatatggatttatgcgcagccgatacaaagctgactatgcctagtaataacagaatgtcatttcctgaaaagttacatgatagtattgcagctgaagcagtgagcttttcatgtactacatcatctggttcgagtccaaaatcgtcgtcagctccatcatctcatcactctttacctgaaacatatacatgggatccggggggatctccttggtcaagggcattgagcagtccttctcttacgccaaggaataccagtgcccctcaatcagctatgcatccgatgttatccccagaagaccatatttcacgcgctgaaggcacctggagtactgcctattttcaccccttaccacttcctcccagtgctataagccaagtgaaagcaactctcagcaaccaacccgctccaaaagttgaaatgtccttagtagctggtcaatgggaaaagagaaaacttataggcagtggtacatttggtgatgtatatgaagctaccaacaggcatactggagctctttgtgcagtgaaagcgatcagtattcctaatgattctaaatctgctgagtccttgaagcaattagatcaggaaataaagcttctaagccaatttaagcatgagaacatagttcagtattatggtagcgaaactatagaaggccacctctacatttacatggagtatgttcatcctggttcaattaataagtatatccaacaacattgtggagcaataacagaatcgattgtctgcaacttcactcaccatattcttaggggtttagcatttttgcatggccaaaatattatgcatagggatatcaaaggagcaaatgtgctaattgatggtaacggt

SEQ ID NO: 4868 - DNA, 1499 bp, Triticum aestivum
  unsure (1)..(1499): unsure at all n locations
  Clone ID: PAT_TA_4868
cccacgcgtccgccgattctccgactacaacgcaggatacgcgattcctgcggtggcagtcgggttcatgatctatgtgcttctgttgctgctgatcacctcggctcaggatcctggtatcgtgccccgtgcatcgcatccaccagaggaagattttgcgtatggcaatccgttagctggggaaacaccgggcaggctgcagtttccccgtataaaggaagtgatggttaatgggatgcttgtgaagataaagtattgcgacacctgcatgatttaccggcctcctcggtgctcgcactgttcgatatgcaacaactgtgtggagcgattcgatcatcattgcccctgggttggacaatgcattggtcagcgcaattaccgatactttttcctatttgtttcttcctcgactcttctttgcatttatgtctttgccatgtcggctctacacatcaagtttctcatggacggagactatcctacagtatggaaggctttcaaacactctccagcttgcttggtgcttatgatatattggttcattgctctctggtttgttggcgggctcactggatttcattcgtatctcattagcactaaccagacgacatacgagaattttcggtacagagcagacagcaggcccaacgtctatgaccgaggatgtctgaataacttcctagaagtcctgtgcagcaaggggaagccttctaagcacaggttccgagcctatgttcaagaggaggtacgcgctccagtagttaacttcggtaggcagatggaggaggaaccggctggcggccctcgcgcaaaggtagaagacgatcttgagattggcagcgatctcctgaagatctctcggcggcgcaactacgaggacgttgacgtcgaaatggggaaccaggacgacggtgagacggaaggcacgggcgacgccaaactggcggcgggttcgggatcgcagatccctgcggtcgggagcgaggtgcgggtgcggcactcgagctgggaccggaggagtgggaactgggacatgtcgtcggacgtgatcggaaggagcgcatcggatgtgcttggaagaagcgcttccctcaccgaggctgcgccgcggtctcaaagagaaactcactagtagccaatatgtgtgaattcttctgaactttgtgttggcgggctgggttctgtgattgtttactgatggtgacacaccgggagaagagggaagaacgatgaccgtgacccattttgacttttgactgtcatgttttggtatcttggatcgtgttttatgtatggacagttgttgtggtcaaagggtttagtggtaatgggggtcacatatcggtcttttttgcgccggtgttgtcatctgacagtgttcgatgccattctttgtgtaaattactgatgcgggatactcatccacctgtaattcctcaccggctcttccttggaaatgtccactagtttaatttgcaacccaaanggncacagnaacc

SEQ ID NO: 4869 - DNA, 1118 bp, Triticum aestivum
  Clone ID: PAT_TA_4869
tcggcacgagggcggggggagaggacgctggtgatgagatgcccagggaactgcccgaggagctcgccagaggggtggtgtgcctcgagtgccagacttcggccgaggccgtggcggccggggaaggcgagacctgccgcgtctacgtcgtcggcactgcccatgtctcgcaggaatcttgcgtgctcgccgccgccgtcatcaacttcctgaaacctcaggctgttttcttggaactgtgttccagcagggtttctattctgacaccacaaaaccttcaggttcctactatgaacgaaatgattgacatgtggaagaagaaaaagatgaacacctttgggattctctatagctggtttcttgcaaaggttgccagccagcttgatgtgttacctggagctgaatttcgagtggcatttgaggaagcaatgacttatggtggcaaagttatccttggagatcgccctgtccagatcactctaaggagaacttgggggaaaatgtcattgtggcacagggctaaatttctgtactacattgttttccagtccttatttttaccgagccctgaagatcttaataaaatgttaaaggacatggatgatgtcgacatgctaacacttgtcattcaagagatgagtaaggcatttcctagtctgatggagacacttctccatgaacgtgatatgtatatgtcttccaaattattgaaggtagcaagggaacattcttcagtggtggcagttgtgggaaaagggcatgtttctgggataaagaaaaattggcaacaacctattgaggtacaaagtttgatggaattacctgtgcctaggaaaggtgtttcgaagttgaaaattttggcgtccattggagcagtaagcgcagtagtagcatctggaatctatatatggggtaaaaaataacagtgtatccaccaatgtgtcaaagtgttctttgttcttgtcatgtgtagtctctaaaaagcaaagagtgttcagttctcacttacagtttttcattatacaataggtgtaatttctggaatcgaagttgaacaaatgaaagaacaattccactgcaatgtacactggatgtgtctaaaaaaaaaaaaaaaaaaa

SEQ ID NO: 4870 - DNA, 790 bp, Triticum aestivum
  unsure (1)..(790): unsure at all n locations
  Clone ID: PAT_TA_4870
tagctagggttctagccggctcccctgccttccttccgactgcccgtcaggctggcctccccggtggtgcgccgccaccccacggaccacaacagagaagggcacgagctagggttctagccggctccctcgcctccttgcagcttcccgttaggctggcctcctaggcagtgcaccactcccctacgaccatacaatttctctaccgcctcctccccaaatctgagcgccgccactcatcgtctcctcccgccggccaccgctggccagagaaccacatcagttagctgccctctcccccattatcccttcattagcacttttcccagttcattttcaaaatccgaatccagcacttccgaatcatgcttggtgtttgctagcggcgggcgaggaacgtggtgattttttttctccgaatgaaggggaagcagaggcgacaacaggcaactgttctctttacatctgtcatggtccagaggctacggagcaggagattttgcactcgtatttggtaggatggagatgaattcgggagagatgttgttgggagttgtatcgatcatttttctatcctccctatgttatccctttgcacggatgtgtaattttttntgagtgggggatagtgtagcgaacatgaacaggaaaattggtagaaggtgaggagaacaatctgagtgaataacattagttgagtattaagatgtagcttttcttgtgcctttaggtatttcagacaagcatcatactctgtccgcaccatgtaaggaaaccaaaaaggaataaa

SEQ ID NO: 4871 - DNA, 2376 bp, Triticum aestivum
  Clone ID: PAT_TA_4871
gaactcgctccgcgccccctacgcccccccgcctctgggtcgccccctccctcccccccctcccccccggctcccgccctcctccacccccccatcctacttctcgccagacagacaccgctcttgtcctttctatctttcctgggctcctcgggactcagacaccgctgctgccatgggcgtcttcggctcctcggccaaggtgtaccggccggcgccggaggtcgacctcggccccggcagcggcgagctctacatcagccccaatgtcaaagctcctcgggtcgccggccttctggtcgaagatcttcgtgtgggtcctggagatgccggtggtgggctgggtcctgcctctacatcctcaaggtagggacaatctcatccaacaagcttgtctccgaagccgagatccctgagccgccactgttcacctcgacccaccgctgggaagacaccccggagcaggacacttccctgccctgccccggcctgacggccacggggagccgaacgtcagcctgaccacccccggcctgtcgcccgcggagcgcgtccgggaggccgtcgactgcctccccacgcgcctcgagtcgacgctcgccgccgacgcgccgacgtcaggcaagcctgaaacgctggacgatcatggacttctcaagggcctacagctcgggagagaccactcctgtccaggtggcctagaggttcctggccgcagtgaaggagtgctcaggccctaccatgaacatggccttcttcatcagctgcaaccctgaggacgtcttgaagcaggccgaggagtccaccctcagataccagacagggacaccgctgtcagtgatggacggcgtgctggtggcggtgaaagacgagatcgactgcttgccctaccccaccacaggcgggacgcggtggctggggaaggcgcggccgtgcgaggcggacgcggcgtgcgtggcgcagctgcgcgcgtgcggcgccgtcctcgccggcaagaccaacatgcacgagctcggcgccggcaccagcggcatcaacccacaccacggatcggcgaggaacccgtacaacgtcggcaaggtggctgggggctcctccagcggctcggccgccgtggtctgtgctggcctctgccccgtcgcgctcggcgtcgacggaggaggctctgtccggatgccggcagcactgtgtggcgtggtcggcttcaagcccaccgccggacgcctctccaacgccggagttcttccactgaggtcgccggccgggctggcgcggcccttggcgggcactcccgaccacgccgtcgtagcttactcggccattgttgatcagtcccaaccatcttacttgaggcctgagctgaatctgcctatgctgacgtcgacaccctcgattagcaacgtcaggctagcaaaatatggaaagtggtttaacgacagttccgaggacatcagaacctgctgtgacaaagctcttcagacactgcgcgcacaatacggctgggagactctggatgtgacggtcccggagatcgaggaaatgcggctcgcacactacgtgacgatcggatcagaatgcactgcttcacttgcaaagtatctcgacaaactgaagaggtctgagatcgggtgggacgtgagagtcgcgctgggtgtctacgggtcattcagcagcagagcttacctgaactcacaacgactccggaatcgtcagatgttctttcacaaagagatcttcaagacagcagatgtcatcgtctcaccgatgaccggtgtgactgcctacacactacaagatgacgcgctaagcagtggtgaactcgactacataaacggagccgcgttgattcggtactcgatagcagggaacttccttggtttgccggcgataacagtcatggttgggcaagataagggcgggctgcccataggtcttcagttcatcggcaggccgtggtccgaggcgactctactaaacatttgatttgcaatgcaggactccaggaaaaactgagagattgaacatgacagaaacgcagatgaaaccgaaaacaactcagcgtttcagatcaaagtctcaaaagcattgattgcccattgaatcatgtattgattgattcattgctccaattcaaggcatatattttcgtggttaggaaatgtgttgatgcactatgtggttattactgctttccaagtttgctgataagcgtatcttttttcaaacatgggaatagagtttataggtgtaatcaatctcttgtcatgccatcttgtgaagtgatcagtaaaagtgtagcccatctctacatcagttgtccagtactcacagttgtatctttgatacatcttggagagcattctcgtttggaaattt

SEQ ID NO: 4872 - DNA, 817 bp, Triticum aestivum
  Clone ID: PAT_TA_4872
ccacgcgtccgcgctctaaccctagcgccgcctttaccggcaccggcactcgggccgcctgtcaatgaaatagacaactagagaactccccgtcgcatccttgccccctccgcccgtgcttgatctatcggggtgaatcccgacctcgtcggcgactatgtggcgatggtggttagcgatggtctcgactctgtggagttggtggtcaggggtggtcgcccccctggggcaacgccgccgtctccggcggcgacgcgctgctgcgacgggtaccaactctgctgctcgtaccggcatgctgttcaacgtagaaatacaacctggctacgctgatcctgagtctctgcgacatgtttggaatagaagtgcttcccctatgaaaggccggaagaggaaattcggtgttgatgcaaccaaaggtgaatcaccaggtattaatgcaagtaacaccggggagcacctgcgttcctgcagaaaaggcaagggtccagggaaacgtgccaggttggtagacaaagaaggtgctactgggttggggaagagttcaaacaccaaccggcttatacgaagatgaatgtgctttctgccaatcatttagaaccagtgagccggtgcatggtccgctggtactgtatcacaatggaaggattgtgtccagtgacgaggccgacgctactaacgccatatatgtccacttcaaatgcatggtttgggccccaaaagtgaaatccaacgacgacggtacttttgagaacgtcgagagtgaaatcgagcgtggttcaagatgggattgcagcagatgcaatctccggggagc

SEQ ID NO: 4873 - DNA, 986 bp, Triticum aestivum
  unsure (1)..(986): unsure at all n locations
  Clone ID: PAT_TA_4873
ccaccccgacgcaaaaacctcgccacttcctcacccctcccctcccctcccccattctccgagcccccaaagaaggcggcagcagcacgagctagccagctgccagtgcagtgaccggccggcggtttgggaagctcccgcgcgtgtacgtgggcatgaagtatgtgctggtgaccggcggcgtggtgagcggcctgggcaagggcgtgacggccagcagcatcggcgtgctcctcaaggcctgcggcctccgcgtcacctccatcaagatcgatccctacctcaacaccgatgccggaaccatgtcccccttcgagcacggcgaggtcttcgtcctcgacgacggcggcgaggtggacttggatcttggaaattacgagcggttcctggacatcaagctgactcgcgacaacaacataaccactggaaagatctaccaggctgttattaacaaagaacgaaaaggagactacctgggaaaaactgttcaggttgttccgcacattaccgatgaaatacaagactggattgaacgtgtggcgatgaatccagttgatggcacggataagccagctgatgtttgtgtcatagaacttggtggcactataggggacatcgaatcaatgccttttatcgaagcattgggtcattgggcgtaccgccgtgccgcgggggacctgggcccggttcccgggggcctggtaccctggtcccacccctgtcggtggtcggggaaccaaagcctacccaagcataagtgtccgtggactaagaggacttggtttggatgcctgatatcttggcatgccgcaagtactcaaccactgggaaagaaaatggtgaaactgaaactcccncaattttgccaaagntccggnttcaaatatcggtaatccccaatgatgttacaaacatctggnaaaaccctttgntgctcaaggatnaaagagcccaatgnagctnttttgaanggtctggggccttgg

SEQ ID NO: 4874 - DNA, 1679 bp, Triticum aestivum
  unsure (1)..(1679): unsure at all n locations
  Clone ID: PAT_TA_4874
agaatctctgcggcatttgcctgtttcagcccaaccacaaccacaaccaacggctttctctaatcaagacctctttgacatgtcaacattgccgcaacccgttgtttgtgcaccaccaatagatttgtttgccggctttaatcaacagactgcatcagttcctaatggtcattctgatgttgttaaagaagctgtgcataatgctgtgggtcaagaaggttgtcacggcttcacgcgtctgtatcaagcaggaagcagtccccacatctcatcctgtgcaccaagatctcttcagtctgtcaatagcgcaggactcagcaacttcttcttcccctccgtcagtggatctgtttgctggctttgaccaacagctgccacctacgtctagtgttcatcatattacaccagcagctccattgcctgctaatgaagggtgggcattcttcgacacacctcaatatggttcgtcaacttctgtttcaaatgtgcaatctcaggtgcctgctgcattgccaagtgttgttgccaaagcaattgatcaatcaacattgccaaattcaccaccaagtgccatcatgtcacaaacatctccgcctactatggaccagtggagtataaatgctgaagaggtgaagatccctgtctcgaaggaaaactcccaggactggaatgcctttggtgaatccactgggaacatgcctaataatgtgtttgcattcaatgatatgcctcaagtagcacctcatcaatttgccatacccagtgttccatacatggaatccagaacttcgcaggacttggttaggggtgagcctgaaaggtcaactcctggggatatattccctggcttcaatgtctctcctggtgtcctggctgagccatcatttcctgcaccacttcaaccccaactgggcatggtgtctcatgctggaaaatcaacaaatccgtttgacatggcatttgagtctgatgttgaagccatcgacatgtttatggatttgacctcactacaagcaacattgccggatactcatcttcccgcagaatactccatcaacttagcagagccatggatgtctcagaattctaccgtgccatatattccttctgcatctcagggagggttgtcatacatcccggggcaagtacaagactcccatatgctgaactcagcacagcaaggacagtttccaccaagaaatccatttgatgaatgagagttgctggtgaagaacggcgctgatgatgaacagatgaggagagccgatttgcaccgctcggaacccaaaaggaccatcgggtgtactatatgcttgaaaccagaaacagcacagtagatatctttcgatttcactgtctcactctcagctttcctgtatattgctagaaaggaatgtgcagaattctatatggccggtgcgctggagtcttttcacctgaagcaaagctgctgtgtccttcagctctgttgtatattgctgtgtggtggttttgtgaaaaccatgagtctgcttttattttccaccaatctgtcatttgcctgtggtttgggtctgtgttctatttgaatcaaaataggatattattgactcaaagcaagaagaacgagaccagccgcggtcctcgcttacaaagtaggtgnctacgacgaatttgaaagtactaatggcactgcttac

SEQ ID NO: 4875 - DNA, 581 bp, Triticum aestivum
  Clone ID: PAT_TA_4875
cgaggcgccgtcagccagtgcaccgcgctgccgcaggcccgcggcgccgactcgtacgtgagcggcaggagcggcggctacttccgctacggccgctactactactaggagccgagcaaaacgacacgactcccggcgctatgagccgctgtaaaacgacctgctcagcccgctcttcgcttagaagggcgagtgcgctgagctgagacgacacactcgcggcatgaacgaacactgaggcgtgctagtgagagccgacgaccgcgctgggggacgaagcagtccgtccccaggccaatgcggaactttaaaaaaaaactgtttcctaatttatttttcagtttcccctcccgacgttttcttcagaatttaactgctccaaattttctcacgtttctctgactgcactgtaacatattaatgaccattctctccagtcgagacagaagtgccatgttaccctaaagtcatcgtcaacaacagaatgaaattctattttgtaccgaccgatttttttaagtgacttgcgatgcactattggcactcaataaaatgttgtgttataaaaaaaaaaaaaaaaa

SEQ ID NO: 4876 - DNA, 1015 bp, Triticum aestivum
  Clone ID: PAT_TA_4876
cccacgcgtccgcgtctccccgtagctcaccggcctctccctcttccaccgccacttctccaccaccccgcctccactcacaccccggaggtaaacaaattccaatcttttgcgccggcgacgagcttctactccacggaggcgtggatgtgcatgtgctagcgctggatctgggcgacagaggcatggatgtggagcggcacccgagcggcggatctggagccgtgccggagcggcggagcggcggatctggagcgacgtcgtcgtcgtcgtggagtagctgcttcctcccgcgtgaaactggagaacgagagggaggggcagatgatggccgccatcatggatttgaatcttctgttcttacattgctgtagtactggctgcagtcttgctgtacaatcacttgaggaattcaaggcctgatgcgtccttctgggagccatggctacttcttcctgtgccctgcgtcaggagaaggagcacgcccaggagaagaaggatcgggagaaggccctgaggacctgggatcgctgctgctagatctggatctgggacctgggactgctgctgccgcgtgctccttctgggagacgaggaccctccttggcgcccctggatcgctgctgctggacgcccctggatcgctgctgctggacgcccctggatcgctgctgctggagacaaggacctgggcctgggagcgctgaggagaagtaggggacctgggcctgggagcgcctgggacctgggcgcgtggaggagaagcaggggcgggcgggcggacgatggcctggcggagaatttcaaatcctcggatggaggaagaagacgatggggataccgattcatactaggggcagcgatgtaaattccaccgttttcacctggtcggaaccaatcctccagcgacctatatttcggaacgaagggagtacatcttaagacagacggttaatgtcaaaaatgttttgcattttgtgacagaggaagtatttatttattagccaaccagagg

SEQ ID NO: 4877 - DNA, 1281 bp, Triticum aestivum
  Clone ID: PAT_TA_4877
caccgcttctcggactctacttcttccttggtcaccatggaaggtggagtgttgttgaggtctgggagaaccatcttctacaggcgagacgacgaggccgttgtcagtggtgagctggtactacaggagaaggaacatgcccaaggcccgctctcctccccccctacccgcccgccctcgccgctcttcccccgtcgtcgtccgcctgcctcccccccccccgaccaccgtgctctcttccctcgcgccgcccactttctccgcccccgccgcgcacaccgcacggaagatgaatcctttgcttgtgcacgccgcgtcgacgggcgactgcgtggggtcggagggcccggcgtgcaactaggtgcgggcggcgcgtcgccacgccggcgcagcagcgccatccccccgtgcccccgcggcccctgcgcgggagggcggaagcagaggcctgcgagccccggccaccttggagccacggccgaggactcgaatgcgttgccagcggcggcacgcaagctatggacacgtaggcgtcggcatgcagggagtagccatgcctacggcctcctataacctccgcatgtcagagtccgcttcgtgctatctaacgatgaatgattcctgaccatggctagacggagccgatcaatgccctgatgaccctggatggctgcttgttgacctggtcgggtagtactatccacctatgggggacctaccagtgctatttgtttccgagagtacactaaacctaggattgctgctgtgggacggaacaaaattgatgatactgaaactgggaactgggatcgctgctactgtgtgcctccttggcacccctggatctaggatcgccgctggagacaaggacctgggatcgctgttggaggccaggacctgggagcgcatgggacctgggcgcatggaggagaagcaggggcaggcggaggagaagcaggggcgggcgggcggacgatgtcctggtgaacaggcgggctatggcctggcggatggaggaagaagacgatggggataccgattcaaactaggggcaacgatgtaaattccaccgttttcacttggtcggaacgaatcctccagcgacttacatttcggaacggagggagtaattcatactggagcagagcagcaaaagtgaggaacacagatagtgtctaaaattatacaaggacaattgtatgtttacaacattcatacaaaagaaacctgacacagtaaccagttgtactttgatcaattggaagaattggggatttaacc

SEQ ID NO: 4878 - DNA, 1040 bp, Triticum aestivum
  unsure (1)..(1040): unsure at all n locations
  Clone ID: PAT_TA_4878
tgagttattgagccacacattgtggattcaacggatgtggacccgcaaatnttgcagaaccccnttgaaggtatgntaatgtagtatttcttgcgataagttggacgcttgttcaccaaagatgttgcaaggcacaggttggaaatggaaacccagttcattttgtttgcctcccaaggagcccagtggtcccaaggccacgtgcgctggaaaacccccttgaacagccatctagtgttgttacctcaacattggacaagagcatttgtagttcagaaaagggtccttaaaagctcagttttacaccctgaagtatctgctgactcggtcaaagcagtggtggcttcagccaaggacttgaagcatcatcttgaagaaggaaagtttaaggaaatgcttgctgaatcagcatcttctgagcttcggtcgtctgcttgggcggatgatgtatgtaattttatgcgttctgcaaagaggcggtgtatacagaacacaggcacgtctcaagatagtgaggcaatcaggaagcagctaataagtgattctggaagagtatttaggtccaaaattccagagttactgcgggaagatctgattcaatccctgagatcatactttgaggataaattttgactagatgcttaagcttgtgtgggccttgtttaaaaggtgccagtggtctactaggagctccatgcacggctggcttatttttgaggcgtttttgttccctgagatgagatgaggttgagaagtagagcgacgtgtaaagcttgcctcctttttgctgttgtcccccatgctatactgtaggcttgaaaccccacaatcaggcacccctttcttctgtttctagcatctagcagcagactgtttcttgtttccccccctttgtacaattataagtggtagacccccttgtacaattataactggtagattagctcatgaatttcttgggtcttgacctgatctcaaaataaacctgttgatggttttaattatatatgatcggttactttcaaaaaaaaaaaaaaaaa

SEQ ID NO: 4879 - DNA, 692 bp, Triticum aestivum
  Clone ID: PAT_TA_4879
ttttcctgatgatatcctggtcgatgggcagttggagcggtcaaatcctagcatcggacaccagcgagcgcaaaagttgcgttggacgcttccttccttttcccctcgcatgcgccgcatagttagtttaattagcgtacaattagcgtccatggttagcatctagcgttggaaggtcaggctcttagatttttctaattaaatactattaatttgtttccttcgtaagcgccaggtcaggcacctggcattgtagatgtcgtaagatagcgtatgcctcagctttgcctcacatgaagtccatcacaaccgaacacggttctgcttgtttctagaacttacaactactaaaacttatcatatccgctccattatttggcaacctaggccgagaaagccatgatgtttcctttgtgtattctaaatgggctgctgtgttggatggaataacacaacctccttttatttgcatgcaaaagaaacagagagcttgttaagactttacgatttgtatttaacccaggacacactatgagcatatgaccattttaacaataagtagtttctgttaaatatactcctttatgaaatgctgttatgacgttgggggtaaattcttatgatgtaactgtacattgttagaacacatgtatatcttgtgccgattgtgattaaaaaaaaaaaaaaaaaaa

SEQ ID NO: 4880 - DNA, 718 bp, Triticum aestivum
  Clone ID: PAT_TA_4880
cggacgcgtgggtgcggggaaatgagctcgcactctgctaaggcgctcaaggagctatcaacagccattcggacaatgatcgtaccatctccagccaacatcaccatgtccgcagccatcaaagctgcaaaagacctcagaaatgaattatcagaggaagcagctctgttgcaagtgatgcatgtggctgttactgcgacacttctctcagacttggttacgacaatagtgaaaattgcagaaaccgctgataatctagcacggcttggccacttcaagaaccctgaaaaaactcagaaagatgtcgctatcaacattccgagcagataaagacgcaaatttccttccaaagaaaaaaaaagaggcaaacttctgtcctcaggtgtggttattctaaaaaaaataacgtgaaagtttccctcccttatacgttgttagatagaaatgaggcaccaaacggagactgctgctcgaacgcgggtgggcgagctcatcggcatgtgctcgaaccaaccagacactactcggttctcatgtggttgttctatccagagaataatccacgggagcatcaatgctaagcggaatctaccgtgtacagtactatattgtgtatacagcaagtgactaatttcttcagtattatagaagtaattatgatgctgaattatgataataaagcattgcagtctttccaaaaaaaaaaaaaaaaaaaaaa

SEQ ID NO: 4881 - DNA, 707 bp, Triticum aestivum
  Clone ID: PAT_TA_4881
ccagaagcacacacattgacattgactagagagtctagagcagcaatcaagcaagcaagcgagcgagcgagactacctggcttgacctgcagccgattcccgccgcgctgagcagccagttagctagcgcccgcccatgccggcgaagcggccgctggagggcggcggcggaggggactccccgtcgccggcgcgttcgccagcgctgaagaagaggtgtcgctccttcgacctagagatcaggggatgcaggcatctggaggagatggtcaccaactgcgtgcagagggtggaggctgcggttgagtccgtgattgagtctgccatcagccggataccagaagcggtgactaaagcgattacaggctacttaagccgtgctcctagtttgtgcagaacggtggttgaccaaaaccagcctccaagatacaagcttaggttcctgaatggcttgagtaatgaaattttcacaaagaagggaatccgcgcagcaaatggcgatcctctcaagatatgtctggaggacaacaaccaacaagagaacaattctcatcgccttctttctgccaagatcaaaattgttgttctcgatggcgacttcaacatagataatgaagattgctggacattagagaatttcagcagacatatcgtacgtccaacgggacaaaaattggggcagtgctgacgggagagctcgagcttag

SEQ ID NO: 4882 - DNA, 1384 bp, Triticum aestivum
  Clone ID: PAT_TA_4882
cttggcctgttcctctctcatcgcatcagcaaagagatagagagagatgtcgatgagcttcctgagcatggtggagacggagctgccgccggggttccggttccacccgagagacgacgagctcatctgcgactacctcgcgcccaaggtcaccggcaaggtcggcttctccggccgccgcccgcccatggtcgacgtcgacctcaacaaggtcgagccatgggacctccccgtgactgcatcggtgggcggcaaggaatggtatttctatagcctaaaggatcggaaatatgcgacggggcagcgcacgaaccgagctactgtgtcgggatactggaaggcgaccgggaaggatagggtggttggcacgacgtggcgccctagtggggatgagggaagacattggtgttctaccaagggagggcccctaaggggaggaagacggagtgggtgatgcacgaatacaggttggagggtgcacatgagcaagcttccaagcaggaggactgggtcctgtgcagagtcatctgcaagaagaaatcaggagtgggtgccacccccaggccaaggaacctcaccaacattgtccatggcacacccaccgaccgtccctctcctccaccgccacctctcaggaacatcaccctcgctgacctccgcgcctccatggacacctcctcagccgccgccgccgccgcagcacttgagcaagtgccctgcttctccagcttcagtaataacagtgccagcaacagcagctacctccccatggtgacaggcaacagtaatggcatgagctacctggaccatggcctgcctgactttgggagctacctagaccccgccatgaactgtgacaagaaggtccttaaggcagtgctgagccagctgagctccatgggtggtgaggtggtgccgagcatgtctcctcagatggctgctgcagtgagctctacttggaaccacttctaggcgaatttgcttatttatccagaaaacataagcagacaactggctagctagtagttaatctgcagtgtgtgtgtgtgtgtgtgatgatttcatatcataatgtatgatttcatatcaaaatgtataattatgtctgtttggtgcaatgtttcttgagtgtgagtatttagtagaggacgcggtgattttctttttctccagtcgattttggaggactaaaaccctggaatgtttttatttttggagaactctctaatgattgctgaactatgtacattcagaagtacagggttgcagtgatttggcggttccgatcatttatgtccccctgacggtccttttttgtgtttggaattctgaatgttcttccctcaatgaacatcatggttgattgaaaaaaaaaaaaaaaaaa

SEQ ID NO: 4883 - DNA, 1073 bp, Triticum aestivum
  unsure (1)..(1073): unsure at all n locations
  Clone ID: PAT_TA_4883
cagacttgtcgacttctctctctgctgatcgctccctgcttattacttgtcgtgccactccagtgaacccccgccccagtccgcttccgttccgtcccgttccgcctcgctccccaccctttcatggccggcgcgaccctcgccgccgcgagattccccgcggccgttgcgctcctccgcactcgccgctcccccgtggtcgccgtgccgctcgccccgtccggtctccgccaccaccgccgcagcgtcgccatggccgccggcgccgcgccctcacccattcccgcctccgatccgcttcccaagggttctgatctatttttccggtcagttctctcaaacatgcaaaaagtttatttgagcaggaatccaactgccgaaaagattctggaccttgtccattcttacgatggggaccacatttgttttgatcactttgctttcagaacatttggggttgatggttatggtataaactcacttgctgaattttttactgattttggttacgagtctcgtgaagaactacggttcccagcgaaaaaactaagagcactatggttctcccctcccaacaatgatggatacgccagagctggtatatatggtcctttgccatggatattcatttctgaacttcttgtagatgagctgagtgctcccgagccaggaaattatacggaaatacatcaaaacatcagctaatggaaataaatatgctgttcttgcaagtacatttggggagctgacatgggagaagcccacttattctgatttccaggttttatctagggaaagtgaatatgctggatggactcttgttaatggctatgcactgaaccatgccacagtctccactcatcgcttagatcccatatcagaagtattagtaaattcacacattgtggaggacacggttcaatttaatcagaaggaggatttgaaagtgatcctgacgtctctcancaaactcacgtaccgatcatcatattacttcgcggtcgccacgctcccgcccttccaaatgantgcnaaggtgcactcanatcanaattcagtaaangcaggaacan

SEQ ID NO: 4884 - DNA, 1108 bp, Triticum aestivum
  Clone ID: PAT_TA_4884
ctgtagccatttttctagtgaagggctccgactgattgggaagcgattttgccatttggaagagttggacatcaccgacagtgatttggacgatgaaggtttgaaagctctgtctggatgcagaaaactatcaagcttaaaaattggaatatgcatgaggataagtgatgaagcgcttatccacattgggaagtcttgtccagaactccgagatattgatttgtataggtctgggggtattagtgatgagggggttactcaaattgctcaaggttgtccaatgctagagtctatcaacctgtcctactgtacagaaataacagatgtttcgttggtgtcgctctcaaaatgtgcaaagctgaacacactggagatccgtggttgccccagtgtttcatctgctgggctctcagaaatagcaatcggatgcaggctacttgccaagcttgatgtcaagaaatgctttgcgatcaatgatgtggggatgctttttctttcccagttctctcatagcctccgtcagataaacttgtcatactgttcggtcaccgacattggacttctgtccctctctagcatatgtgggcttcagaacatgacgattgtacacttggcgggtattacacctaatggcttgatggctgctcttatggtctctggtggtttgacaagggtgaagcttcacgcagcgttcagatctatgatgcctccgcatatgctcaaagtcgtcgaggctcgcggctgtgctttccagtggattgataaaccattcaaggtcgagcaagagcgatgcgacatatggcaacaacagtctcgagatgtgcttgtacgatgagattatgagaaatgcttgttatcgtcgtcttgactgtcagccttacatgaacatgatggtgtagaacgaggctttgcaccaaggtggagcggagttgtgtacagaacagacgtcatcggaacaatgttgtatatgtatgtttcgttcagtggactgggaggttcttttgttgtgccgtatcctgtatatagagaagcaggagatagatgaaatcatagagaaattagtcaaattactggaggtcgacctgtactttactgatcaacatggagt

SEQ ID NO: 4885 - DNA, 849 bp, Triticum aestivum
  Clone ID: PAT_TA_4885
tgtggtgatttcgtgaatgtatttgtgggaatatgtgtcgatgacatctcaaacaaaattttgcatgcaatgtgtgttaaatagaggcatatccatatcatatagagagggccagagggggcggtccactagaagagaggacgggtcatagatatcgatagagtggaagagaggatcaagtgggtgggtgcgagatggatgaagagagccatcgaaattgtgtgtgtgcaagtcaaagatatagggtgactgacctaccagaacgtcagagggcacagggcaagtttgtgtgtggtagggagacatgactagagcgctcgatgtattggtgtgtgtgggggggtgggggaggcagaggcctaactaaagaggtagaacgacacgtatatgtgttgagaaggagagacccagctatgtcctgagggagatgggtcgacatccatacataactgaaggacgggaaataggatgggacagagagagagagaggagagagagggggagggagaggggtagagtgctggatgggtgatggagttgcttctcgaagatggtgggagaggcctactagacaaactgagggtggaactgcaatattatcaataagagtggggatgtgtttctgtgtgtgcctgtgcgtgatagatctgtcgggacacatccatggatgatgaaggggaaccatgtgtttggtaagcaaacctaactagatcggtagatcaattgttgtttgtcggaggaagggagagacataactaatgaggtagatcgatcgacgcgtggggaaaaacgagttataaggacctagctagctatatgtatagcgggagatctgtcggtgtacatcca

SEQ ID NO: 4886 - DNA, 247 bp, Triticum aestivum
  Clone ID: PAT_TA_4886
tttttcaagtgcagcaaaataaatgaaatatctgtaggacacatggccttactatgatgcaccattttgaaccacaaacagctacaatatttttctgtcgctgactggactaaacgaagaattcacgcggaactttcagcgacctccaatttcccctcaacaagatcctcgaggaaaccgctcaaagaacgatgggacgagccgccttcgatgaccgcgccacgggaagcctcgcgcagctgcgcag

SEQ ID NO: 4887 - DNA, 1624 bp, Triticum aestivum
  Clone ID: PAT_TA_4887
atagttgggtcacgagaagtgccgaaccacaaacagcgatttttctatcactgactggagtaaacgaaggaaatcacgcagaactttcagggacgtccagttttcccttgccgagatcctcgaggaaaccggtcaaagatcgccgggccgtgccgcccccgttggccccaccaccggctgccgcgctgctgcccggccctggtcctcacctcgtggccgcccccaccgtccagcgccctccgcttcccccccgccgcggtccccccggccccccctcagagaacgatgggacgagccgccttcgatgaccgcaccacgggaagcctcgcgcagctggcgcagcccttgtcctcatctcttggccggcaccactgtccaaatccatcagcttcctcgcggcaccagagagcgcggccctgctcacgatcccatcctcccccctctgctccctcaggttgatgccggtcttccattcgtcggcgaccatccgggcattcaccagctgatcccacgcgacggggaagccaatcaccggcactccggcgcacacggcctcgagcaccgagttccacccgcagtggctgaggaagccgccgacggacgggtggcgcagcacctcctgctggtcgcaccacggcaccgccaaccccctgtcgccgcacatctcccgcaggccggcggtggccctgtcccgggccacccagaagaacctgaccgcgctgtcgcgcagccccacggcgatctcctcgaactgcttgggcggcatggcgacgaagctgcccgaacgagacgtacagcaccgagttctgcggctgcgcgtccagccagcgccggtgctcctcgtcacgggcgctctccccgttgtccggcgcacgcaggattgcagggccgattggatagatggggcagggaagtgactctgctattttgctcatggaactgggctcgagctcgtggaaggaggtgaagaggacgcactgcgctttgcgtacgttgacgaacacctccgctgctattttgattggccccttccaggcgaggaagatcttgacatcagacaacctcactgatgagaggcccgggacatattgctccaacgacttgcggcttagttcttcgtcgctgacaccttcaaccgctggtcgccacaggtccaaatggcagagcgccaacaagaacgtggccggctgggtccaaagcgagcacaccggcacgccgcgccgcgcgccggccgccaccgcccactgcaggtacgtgtcggccacgatagcatctggcctccgccccagctccagcgccagccggtcgagcagccgctcgacgggctcccccatcttgcagtttacggcctcgatgaagccgccgtggtcggccccgcggccgtgctcggaggggatgacgttggggatggtggcgaggcggacgcggtccggcagcgtgggggtcaccccggcggaggccagcagcccgtgccactcctccgtgacgacgacggtgacggtgagggcgccgtccgcggcgacgagcaggcggcacacggcgagcatggggttgatgtggccgcggcccgggtacggcaaagcgaccatgtgccgagccgccgttgcggacgcggacgcgtggg

SEQ ID NO: 4888 - DNA, 1210 bp, Triticum aestivum
  unsure (1)..(1210): unsure at all n locations
  Clone ID: PAT_TA_4888
ctggcagtggcagcctctcgacacagtctggtttgggccgtgctgcaaggaagcagttagcagcacatcttgacgagttctgggggcatctttttgattatcatggtaagcttacacaagaggctaatngaaaaaaggtataactttttgcttggactggacttgagagcagctaattctgctgtgagggctgataaccaaaccattgaagcttcaaagagccccttgatgagagatgcgctgcgagcatcagctacctcactgaactcgtgggacccgatgtcccgtgataaggatatccgtagtctagactggagttctgggcatcagatgggtccaatgggttcatccaactggtctcagagcatgaattcaccatatacagacattttgagttcaagcagcagcttacttgagcaaaatccaaaatactattcaaatttcaatatgccatcttactctgataatcagttctatcagcctgctactattcatggatatcagctggcatatttgagagggatgaatgcaagtagaaatcagcactctaacatccccctggatccaagacgggttcctaggttatctgaacattcttttcctaactatgctgatcctgttatgcatgcccgcaaccaaaatttacccgggccgctgggagctaactctccacaaagcccagcaatgaatcgcttcaatgcaacggtcgagagaccttattatgattctacctctgttgatgaaagtgaaagtgttggctcacctggatactcaaagaagtatcacagttcacctgacatatctgcagtaattgctgcaaccagaaaggctgcgttgaacgaagcaaattttggtggtgctgccggaaatcaatcatacctaagtaagctggcatctgagagattacaatatgtcgagtcggcagccaggtccaaagcccaaattgcatttaatgagcgctcacaacataatctccaaagagatgtcctttctatgcagttgcgtatgaaccccaacaatacatccctttgggcccaacaaccgtttgaacagctgtttggtatgtcaagtgcagaattgaataagagcgaggtgaacactggccagagatcaagtggcatgaccaaggatgattcctcatacacagagtgtgaggcagagcttcttcaatctcttaggctctgcatcatgaatatcttgaaactggaag

SEQ ID NO: 4889 - DNA, 545 bp, Triticum aestivum
  Clone ID: PAT_TA_4889
tgcctcacacatcccactcaagccgccgcttttttctgtccatggcgagattccctaccactccacccctccacgctctccaccaggtctgtgttctcctcagcctagtgtatggagctcacgccgacgccggcggcggtgctcaccttgacggaatcggcggctgaagatttccttccttcctccatcgtcctaggctcctagctagcagcagcaccccagcagcgtcctccaccattggctgctatgcttcatcgaatggcgttctacagtctacatggcctatcacatacttctactggttgtccaagcctctgaatgattttctcagtgcacgtgtgtgtgcttgtgtgatattttcttaaagttgttcgtgtgtccatgagcatgatctgtgaggtattcttgtgtgtggctagttagatccgtgaatctgcaaggatctgtacttctatagtgttcatgcatcacgtaagttatcgtgtgcgtcgacgctggcactgtctccgtttgtgaaagcatattcattgcaaaaagatatctta

SEQ ID NO: 4890 - DNA, 1005 bp, Triticum aestivum
  Clone ID: PAT_TA_4890
ccccgcgcccgggcgctccccccctcccccgccctcgccaaaaaaggggaaccgcgggatttcgccggagatgtcgtcggcggccacgaagctcgccaccgcggccgacgctacctcgacggaggcccaaaccctcgtcttggacatgcgcaaggcgctcagctccatgaagtccctcgccgtggagtacgagagggccggcaagcccgacaaggtgaagcagctggaggacgcggtgcaggagctggtggcctcgtacgaggactgcgcgtacctcgccgaggcggtgaagaaggtgcccggggcgtaccagccgtccgaccaggcgactgatttcagaaagctgatcgatgcggaggttgagagagtcaaggggacctcgcgatcgtcgggacacaaggaccagctcatacggcagttcaaagaggctgtttgggatgttcaccatgcaggtcaaccgatgcctggtgatgaacaagaggaacttgttatgactagcacccagaacaacatcctaaatacagtatgccctttgactggcgagcctatactcgacttggaaaatcctgttcgctgcatcgattgcaggcacatctatgacaaggatccaatcctgaggtacgtccgggcggacatcgcgccccattgccccggtccaggctgcccggcggtccgacgaacgacgaggacgggtgatgacgcgtttcgagacatgaaccttgttggattctcggtattgtgtagggatgatggtaggtcttggtactttgttcaggtctcgcccgtgagcgcacgcgtgccacatttccagggcgtcgggtgcgttgtctggggatcgcgggattgatgtgtgcgttcgctcgtctgattgttgttttggattgattggcgaaggtactcgtactccgtctccaggccccactcgtatgtcgtcgtgtgtggaatcgggggatgtggctccccggcaattagcttaaccaacgtaacaagctagctatgaggata

SEQ ID NO: 4891 - DNA, 637 bp, Triticum aestivum
  Clone ID: PAT_TA_4891
gagatatagatcgacgaattaaccttaagagactagctagccatgtcctccgcaaagagatgcattgctactatcatgatcatggtgctagtgttttcccttcaagccgcagttgacggcggccgcctcctctccaactccagggtcaggatttttccttcttgtccagtcggccaattgatgaaatgtcggacgacttttccgccaactggttgtcggtgtgtgccggtgagtaatcttcgacctatggacactcacatcctaccccaacacaccgttgtcaacggcatcatctggctcccgagctacgtcgaagatgatcaagtgatagcaggcgtgagtcaggaggacaacaagctgaactaccggtgtgagcaagactgtccaccagagagaattcagtgcagcgaggttgaatgttgttgcatgtgatgagtagctagctcgtgcgtgtactagcatatatagcaataaagggccatgcaacatacgacctccataaacaggaaagtgtgcgcctgatcttagttcgcgtgcgtatcatgcctgttgttcgagtccaactgggtaatgatgctacagtagaaatgaataagggcatctccaacgcgaaaaaaaaaaaaaaaaaaaaaaaaaa

SEQ ID NO: 4892 - DNA, 571 bp, Triticum aestivum
  Clone ID: PAT_TA_4892
ggatttttcctcacgtacgtgcgtcctctgttgttcttctttcaggtttctccgggtgcacgttcgcttccagtgctagtgccgccagcaccaccacgggaattgcagtcgcaaccagatggcacgccaccaccgcgagccactcgtcggcgaccaccagcccatgtgcgcacacggggtctcatgcgcggcgccgctgatggggattgggcgtgacctgcacctggaggaggcctcgacctgtagctagaagaggcctcgacctgcagctggccgcgcgccgccacactagtctacaacctacagctggcgccgcacgcccaggccgttcaactttggcacaccaggtcgttcaactccgcccgtgctcctcttagattaccttcagtcaagattgaacacaaaatatcaatccattcggtacagtgcggttgtcttgattagtctttcttgcaaacaaaaaagaaatgcccgtaccttttgcaggtatgaaatggggagaaaatgtgaactacccctgtggaacttcatatacacaccgttgcctctaaaaaaaaaaaaaattgctgtg

SEQ ID NO: 4893 - DNA, 1084 bp, Triticum aestivum
  Clone ID: PAT_TA_4893
cccgcgagctccgacgagaatgctctctacaatgttgacctggtgtcctcgatactggaggagttcatggtgcagcgcaacggcgatgatgaagcattggaggacggtgagagctacccggcctctttggtctctggcggcgactcggagctcgcgttggtgaggggggtcgacgggtatctagccgacatcgccaaagaccccattcggcgcggggaaaagttcatcgccatcgcggaaatggcgcccctcgcggctcggccgacccacgatgggctctaccgcgccattgacatgtatctcaaggagcatccgagcctgtccaagagcgagaagaagaggctgtgcgggctcatggactgcaagaagctgaccgccgaggcgagctcgcacgccgtgcagaacgagcgcctccctctgcgcttggtcgtgcaggtcctcttcttcgagcagctccgagcatccgcctctgccgacgcggcggcagcgtctgatcaccacccgtcctccgccctgcgctcgctcctccccagagagaacggtaactcgtacggcagctccaggtcggctgccacgacggccacgaccgaggacgaccagtggggcggcggcggggtgccagcgtccggcgacaccagctccttccggtccatgagcggcctgggcaacaacaagagcggagggaacggcggcaaggcgacagccaaggggccgctgcagatgccgaggaagatgctgagcaagctgtggtccggcaaggcgagcagcggggagaacagcggtggctccgacacgtcggagagccccggctccgtcaacctcgaggctgaaaccaagtccacgcattcgcggaacaccaggcattccgtctcgtaggccgctgccttggcattcttcgctttttccctttgctccggggcgcgccgggcctgcccggggtcggcccgcgccgctattgcgtgcgggtccaccggctccgcctgcctcgcccgctcagctccccccaaagttagtgtattgtttggttgatttttggtgtctaaacagaaataaaatctggttttgggttgctaaaaaaaaaaaa

SEQ ID NO: 4894 - DNA, 547 bp, Triticum aestivum
  Clone ID: PAT_TA_4894
ccacgcgtccgcccacgcgtccccccgcggccgatccaccgaaatggcaagcggggctctcgttctcacggtttgcttcttgggcttttacgtgcccgccccttccctggcgtcgtcctcccacaaccacaacgacttcctccggtgcctctcgacgagcctccccagccagctcgtgctgacgccgagctcgccgtccttcacgccgctcctggtgtcgtccatcaggaacgccaggttggtggcgccggcgacggcgaatcctccgctgtgcatcgtgacgcccacaaacgcatcgcacgtccaggccgccgtgcgctgcgggcgccgccacagcgtgcgcgtccgcgtgcgcagcggcgggcacgactgcgagggcctctcgtaccggtcgggcacccccggcagcgaggcgttcgccgtgatcgacctcgccaagctccacgccgtccgcgtcaacccgcacgaggccaccgcgtgggtcgagaccggggcgaccaccggaaagctctactaccgcatcgccacgggcgcgccagggctgggc

SEQ ID NO: 4895 - DNA, 1795 bp, Triticum aestivum
  Clone ID: PAT_TA_4895
attcccgttacgacccgcgcgtacgtcactctgcactctgcatctaaggtttgacgaacggagaaaaccaagaactctggcgcgatggcgaggacggggcggtccgtgctgctcctcctcctgatcccgacggcgctctccctgctaatgctctccgagcgccgcctctccgtcgcgcttaaccccatccaaaggaaggatttgcctgccgagattgcgagtcagggccatagcatcaaggatagcaagctaaatgcgcttcctctggaaactctgagttctctgaaggaacctgtcggtgccgtgttagcggaggaaccactccatttggccaacgattcgattgaatccccggaccaagaattgctaccggggaagaaggccaacagggtgctttctgaaatcacttctggtgatgttgctgcattgaatcgaggcgacgtgctcgacgaactgggagcgtggagcggacatgcagtaggatgggaacctgattcgatggcttgagatgggaaggccacagttccggagcttctgttctcgggttctggaggacgatcagacgctactgcgcgaatgcaacatcaatccttcagccaagaccagaacctctcaagcaattatgacatttccagactagttaattcatggattgaattatttttcggtatccaacgttggggataggctgcaaaggaggttctagctgttgacgatacctcccggctagaggaaagctcgagccggtggccaaatccactttggtctcccacccgtttcgttcatttcttaaggccacaacgagcagtgccacctgcttatctgagcttcagacatcctacgtatctttctctgctggatcgtcgccggcaccactggcctgcccaatatgcaacgcgcgcagctctggtttctcttgtgtacgtcggcgtagtaagaaaggacataactggcctctggtcaatcgatatgaaggggaaggttaatggtgctgtagatacttgtggagagagcttccatagcttcgatcgttacttgaatttctcaagtcctgttgttgcaaagaattttgatcccaatgcatgtgtctgggcttttggaatgaatatgtttgatctggctgaatggaggcggcagaacataactgaaatctaccacttttggcagaagcttaatgaagatggattgctatggaaacttggcactctccctctaggtctggttacattctggaacaagacattccccctcgatcgatcatggcatgttctcggtctaggttacaacccacatgtaagcagtggtgacctggagcgtgccgcggtcatacattacaatggcaacatgaagccctggcttgagattggcctgcccaagttccgaagctactggtctgaatatcttgactacgatcagccttttctgcgggaatgcaacatcaatccgtgaagcaagaccagtgcctcccaagccattctgacatctctagcctagttagttctgtgtttgatctatttgtcggcatcccatgttgggtatggtttgtggagaaggttgtagcggttgagattacatgccagtaggggaaaataagttctgctgtgcaaatgctttttggcatgccatcgttgtgtacgaaatgttagattgctgccgtcgagtaactgtaacggggaagttagaaatacacgagaaaagacccaaagaccctgggtcttactactagtcagacagggttcaagcctcacttctacagtatctattaaaattgatgcctagttgaaaaaaaaaaaaa

SEQ ID NO: 4896 - DNA, 1188 bp, Triticum aestivum
  Clone ID: PAT_TA_4896
gcacgagggaaagaaaagagaaattcccaccaccgaccgcgtcacgcgcgcgcacgcgcacccgcgctgaaaacggccgaccgaccgcgccccgcggccagccgacgcgtcctcgcgcgcatgccgccgcccagcctgaccgccgcgaacgaccgggtcgccgccgcctccgccgcgaacggccacgcggggccggacgcgcgccgccgcgcgggcaagggcaagaaggtccacccgctgccggccgacggggccgcgatgggggacggcgccagcggcggcgagaggctggcgggcgggaggaggccgatggactggctgtcgccggccggggtcgccggcatcctgcggcggcacccgctgccggcgctgttcgcgtgcgggctgctgctcttcatgggcgtggagtacaccatccccatggtccccgccgccgcgccgccgctcgacctcggcttccacgccaccgccgccatgcacgccgggatcgccgcccgcccctggctcaactcgctcctcgccgcgctcaacacggtgttcgtcgcgatgcaggccgcatacatcctgtgggccgtcctcgccgagcagcggccccgcgccgccatcgccacgctcatgatgttcacctgccgtggcctgctcgggtgctccacgcagctgcccctgccggcggagttcctgggctccgggatggacttccccgtggggaacgtgtcctttttcctcttctattctgggcacgtcgccggagcggtgatcgcgtccatcgacatgcgccgcgtgggacggcgcaggctggcggtgctctacgacacgctcaacctgctgcagttcgtcaggctgcttgcgtgcagagggcattacaccattgacctggccgtcggcgtcggcgccggtctcctcttcgacatgctcgccggctggtacctggacagcaagaacatcgacagcggcgacaaccgttgctgcagcagctgccagaaggctctcgtctcacagaagcttacatcataggcctatcaatggccgtggaattgcagtggactggacatgatccaagtcattttctagattgctacttactgatatgtaattgtgtaactgtgtttgtcctatgtaagttgcaacatcttctgaaatgcaagtatcagaattcagaaaaaaaaaaaaaaaaaaactcgagactag

SEQ ID NO: 4897 - DNA, 868 bp, Triticum aestivum
  Clone ID: PAT_TA_4897
gtacactgtgcgcgcatccgctgcccatttcccccctggtctcggcaaggcgagagcgaagactgacgccgcagctgccggcgaggcgaagaccatggagcggcagcatccggcggtgcccttgctccccatcctcctcctcctcgcgctgctctcgccggccgcccgtggctcggagtcgccgcagtacgcgacggtgcatgcggagtcggacttcgaggtgcggcgctaccgcgacaccgtctggatgtccgccccctccgacgacatctctttccacgtcgccaccaagctcggcttccacaggttgttccaatacctgatgggcgcaaacctgaactcctccaggatcagtatgacgacccctatcctaacgagcatcgtcccaggcgcggggcctctccactcttcggcctactttgtccggctctacttacccttagagttccaagcttcccctcctgtccctctcccagaactgaacctacatccagataggtggccaggccactgcgtcgctgtcaggagcttctctggctacgcacgcgaccacaatgtggtcgaggaagctgagaaactcgcagtgagcttgagccggacaccgtgggtgaactccacagatcaccctagcaagaacgcctactccattgcacagtacaacagccccttccgcatcatcggccgtgtcaacgaggtgtggttcgacgtcgactgcagatctgctggtgtggaggcttattaaaaatgctctctgcagtatgccatcaccataaaaccaagcgaaatgcggcaccgtgtaagctgtgtagctttgtatatatgtgacctttggttatctgtatgcctgtgatgaagaagtgacacaatg

SEQ ID NO: 4898 - DNA, 2253 bp, Triticum aestivum
  unsure (1)..(2253): unsure at all n locations
  Clone ID: PAT_TA_4898
tcttgtccgcttcgaagttctgagtatgttgcatttaatctagttccaaacgatgtctcgagttttcagacacttctgatatgcacttccaatgaaaaagacaacagataaccactaaccacctataacagacaaatgtacagcacaaatctcaaacagcagaaaatccctatggtggcaacagactggcagagaaaatattctgtctccgaccgaaaaaccccgcaaaacaaatcaacaaaccgctcgcaaatcacacccgttgtgccagccatttcgggctactgagcgctgggaagtttcatgatccagcaccccctaagccccgggtgccggggccagctccgagcctgctgctctttgttgtagcagaggagagagcgccttgacgtcgatgctcatgttgggcctgaactctgcttcatactgcacgcacagagctgccaccgcacccagcttagcaactccctttggaggatattctcccttcaaccgaggatctacgcattgcttcaccttatcttcactcaatcttcggagtagcccaagtgactaaactttgctgcccccgaggcattgtgtgatcgaccggtttccttccagtcagaagttcaagaagaaccacgccaaagctgtagacgtcactcttctgtgtcagctggccagtcatagcatattctggcgcatgatatccaaatgtccctaatacacgagtcgaatggagacgtgctgccatatcaggagcttgatttaagaggttgaagtctgcaattttcgccttgaagtcctcaaacagaagcacattgcttgatctgatgtcccgatggatgattgtagcctgaacattcgcccgcccttcaaaagaatctaagaatggtttgcacaaccgtccatgggcacagcttgaagtacatttctacctaatctttgatggcacatacacctggtctgagtatgtgctaagtcctaactagcattcaaatccacatctaaatccacagggatacaattgttattcagtttgcatccataatgcagagtgaaccaaataatgtttaaacacacaagtacatgaacgaatcatgtaggtactctataccttttgccgcctcgatagcaattttgactctctgcatccagtcaagcacaggaccaggctgcgcaccttgaactccttttcttccatgcagaacatcatgaagagaacccattgttgcaaattcatatgccagtatacgatagttgccctccacatagtagcccagcatctccacaagattttcatgttttagccttgatacaagtgagacctgtttcaagaattcatcgttaggctcattttcagatgcatcaaatttcttaatagccgcttgcctgccatcatccatggtagcatgatatactcgtccgtatgaaccttcaccaatcagagaactcgatccaaaattgtcagtcttttctttcaagtcctcaaatgacagttctgggacatcaattgtaggaggggaaatatctggctcaggttgatcagcaggtttcgaagatttttgcttgccgtctatcttattcccctgagctttggaatgttccacctcatgtctgtcgtcgtcgtcaccgctccggccattgcaacaaagccaatgcctcatactgtctcctggccactgcgcgccggccgcggcgaccagcagcagcagccgcggcgcgcaccaccaccgcccccgcgccgccttcccccgcccgccccgcctcgctcccgccggctcgccggggagcgggtcgggcggagcgggcggggcgggcggtgggcaggcgagagcagccccgcccgcctcaatgcatgtaccaaatgcacaaaacaaaagagttagcctatataaaaagtttggggcacaagccatttcattacacacacaaaaaattacatttctaacgaagcatccaatgcgtacaaaatctagagttcagttattgccgaaaacacctactactactgatgaatgcacaataccaatgacacacatttaaaatccagcagcttaaacacgcagtagtactactagaactgatttaaggaacaaccagccagcacgtacaaaatatagagttcaattatgttctgtgcanaaaaaacaacaaaaagtgggtatactcaggcgcttncagttccaggcttggtctangaacccaatctacaatccctcacatcccccattccttcaaattcaatttccacatgcacccattcgatgc

SEQ ID NO: 4899 - DNA, 798 bp, Triticum aestivum
  Clone ID: PAT_TA_4899
ggggattcttcctggagcacattgtccacaatttgcaattgcagcgagggtctgggtgatgcattgttagggaacatcatatttacggccatgttactcctgggagtacgatatatcctcaaattttcttttgacattacaaggtatcgagagattctgttagccatcatcatttcaagctatttcaagttatttcttctgacaatgatggtttgggagtttccatcatctgctatattcattgtcgaaacatttgttctctcatcaaatgttgtagccctgagagtggtgacgcgcttcccaaaagcccactgcgttggtgtctgcttcatggcgcacgcggcaaagcacttgacggaacggtggctcatgtggacaccatgaacatgaattcatcacgacttgccgccgtcttactccaagagtcgagcggggagctgtcctgctggcctctgtaccgaggtgctgcgggttgagcgatcgtctccggcgagcgtatgcctgagagtgaagaggcaggcggtctggggagatgggctgtccctttcgcctatttatggcccaagtaggagtaggtactttgccctgttcgttcacgcccggaagtgcgtcagctgacagggcctctctaccttgtgaccacacgtgcaaaacgcacactccggtgcctgtatgtttgtatgtctccgttctttttcagtctggttttatttacaaccgttgtagaaaagagaaaaagagcttcccgggtcgacgcgacgcacttccgtagagttcctgagccttttccagcaacaa

SEQ ID NO: 4900 - DNA, 809 bp, Triticum aestivum
  unsure (1)..(809): unsure at all n locations
  Clone ID: PAT_TA_4900
gcacgaggccgacggcccccctgcgatgaccccgcgcgtgccgccgtaccgccaccaaccggcgcacctcgttctcaccgacgctgttgctgcctggcaccccttccacaagaagccctgcctctccgaccgctccactgcccccccatctgctcaccatgctgacgcagccgccgccggcgcggaaaccacgacccctcctccttccgcagttggcagcggaggatccttccggttgctcgggctccgcaagcgccggcgccgtggaggaatctcgcggtcggtctcaggtcgcagcagcgaccgccgggagatccggcacgtgctccgacttccatgtaacgtgcggtccaggtggtggcggcgcaacggactccagtggcgagatgtgggcatcggatgttggggagttgcgggcgagggacgttcctatggcgccggagtttgcatcggcaccaattggtctggctggatcgggggcaggtgggacggccgccggggttgagctggcatcggctgagtccggctatggcagcgagcctggctaccgtggagatgttgagcttggttacgggatgagatanacgaagaggangaggacgggaggcagcaggtgttcttctggggcggtgagatcggagattgcatcgcagatatggataagatggtcattgttggtgatagtagttttggggagcagaagagtcatcaccgatgcaggcgcaanaagcatgatgtgaggatgttggatgctttganaatgaaaatgttaatgagaccggtaaaaatctgtacatcattactgtctt

SEQ ID NO: 4901 - DNA, 488 bp, Triticum aestivum
  Clone ID: PAT_TA_4901
tttttttttttttgtttttttagagtgcaatatactgtctgtctcgatccactgtgttgaaacacaacacatatgagaagttttgttcttgctaacaaagggacactatctgtccactgtctgaaacacaacacagatgaggaatgttgttctccctaacaaagggacactatctgtacagcttagcaagatcgtcctgataacccttcttgatgacctccctcttgagcttgagggcagcggtgacgagacccgactcgggggtccatggctccggtatcagcttgatcctggcagggatctcaaacttctccagccgcgattgcttaccagcctttgccaacgactgtagaacttctttgacagtctcttgcttctggcacagatcggggaaatcagaatatgcaatcccttgttttgaggcccatgttctctagctcaccgtgcgcagctacaacgagtgcaacacagtagttttgggagggatc

SEQ ID NO: 4902 - DNA, 980 bp, Triticum aestivum
  Clone ID: PAT_TA_4902
gtagctcgagccccttcagaaggaagcacgccaagctagcaagctaggaagaacctccctcccgtgcatctgaccagcgagtgacggcgcttggatctccatggacggcaaggcgcctcatctgctgcctctgagtctgagcgaggccaaaaagaagatccgggatgacgtcccactggtctgcggatgggcgctcctcaacgccttcgccacggtctgcggcgtagcaagcggctacatagccgagtacatccatgtctcgtgcagccagtcctccttcattctgccgtgcatcgagctgacggacgcggaggccgccagggtaatcgccctctgcatcgggatgatgtgctgcgccccatcccaggcagccgcggcggcgctggcgctgctgctcccatgccgccgtcgccgggcccgccgtgccctcgcctacctcgcccttgcggtcaccgtcctcttccattgcatgtacgccagcgccgtctggatcttcctcgccgccgacccaggatacatcttcggcaggatctacttcaccgcgggcttctgcttcatcgtggtgggcgacctcctcagcttccgggccctcctgggaggtgatgggtggggcatgaagtacgtagcctatttcttctgatcatgttcgtggatcagctcatgaggtactgctgatgagagcgtagttcaagggggtatcctagagtatgcattgattatgctgtgacgactgatatggagtagtgccatatttgcgaatctagtaactggtgtagtgttaattagtatccagatcgactctagtagtagttactccatttgggcaatgctttgctggctagtatataattagactggatggattggtagattgcggttatctttgctgtattattcaaccctctatgtatggtgctgatcgtcagacatcatgcacatcttatataggtccagcttaaaaataatttgatgtttctgca

SEQ ID NO: 4903 - DNA, 715 bp, Triticum aestivum
  unsure (1)..(715): unsure at all n locations
  Clone ID: PAT_TA_4903
cccggacacacattggctatgtttgcagaaccatcctcttgctaaactcggccggggggtcctgacccgctcacgatccccgaccccgcgtctaggcttctacgagcaacagcctctcgccaccctggttcagcccgctggagggacttctccgcccgccgaactgttagttcacccctcgccgccgcagttctcctcacgaaagggctcacccgattcaaccctgccgtaggcccgtctggtgctcgctctcgcccagcacgaacccgtccacctgttcgtaccaatctaagggccgcgctggccggcgctccccagccattccttggcacgacgccggccgcacaccccaaatcccgccgcacatctccacgcgctcttcacacccagcctcagcgggctctgaatgagccaggggccaatggcatgcccccacctacgccgccgacacgctccaaactccacaagccaggctcacagcaccatcccacacacatctgggggcagtttgctcaaccaggctgcacgacaactattctgccgtggcctgccccgccctcggtgctgtctatgcggccttcacagccctataaaatagcacatcgttgatcggtctgctcatgtaatttcgattacttataagcagaacaaacttgtagactaattttccccagtactacgacgatcaccgagnatcctatctaatgcatgcaaa

SEQ ID NO: 4904 - DNA, 585 bp, Triticum aestivum
  unsure (1)..(585): unsure at all n locations
  Clone ID: PAT_TA_4904
attcgcacgagaaggtagaggtgattttatatcggagcactcagctgctgtatttctacagggttcgcttgtatatggtgagcatgccaacttatttatagagcaaacttgcatgtgtatatatgcaaggaggcatgtttgtactccttgaagcatagaattcctcttgntgcatactgcgaggaacaatgtttgaccttgtttgaacatccatcgtcgacttgttgcacactgtgcaccatgagaccaaggtaaaagtgatgccttcagttgaggacctcttggaatattcatcgattcagaagttgcttttccttggcaacacggatgaagatttttctgtcctcacacggcattggtcggaactaacagaagggaaagcatgtgttatcaaagagcagccaaatgcaattgagattgttccccttaatgcttcaaaaggtggtggtataagggctctacttgatcatctcggattaactgaagattctgatcttgaggcggtcggagactataccagatggctaagcaacaagtgatccaactgacatgacgaagcattctttagcaagagagtgctgattg

SEQ ID NO: 4905 - DNA, 1776 bp, Triticum aestivum
  Clone ID: PAT_TA_4905
agaatatgcagaagttacatgaatcggcacaaagccaattgtttgagctgggtactcaatcagaggaggaccggacagcaaaggaagctgaagtgagccttctgatggatgaagttgaacgcgctcaatcacgattagttagccttgagagagaaaagggggatttacggtctcagttgcagacaacaaatgaagacacaagtaataatagtgattacatggacccaagtgatatacttgagagttctttgaatgccaaggagaagatcatatcagagttgaatgcagaactgcgtaacattgaaagtactttatcaagtgagaaagaaatgcatgtgaatgaagtaaagaagttgactgctttactcagtgagaaggaaactgcgataacggagttgaagaaagaacttcaagaaagacctacgactagactagttgatgatctcaagaaaaaggttcagattttgcaggctgttgggtacaactcaattgaagctgaagactgggagctagcaactaatggtgaagaaatgagcaaactggaagctttgcttcttgataagaaccgcaaaatggagcatgaacttacacagttgaaggttaaaatatcagagaagtcaagtcttcttgaggaagctgagaaaaagatcgctgaactaacttcaaaggttgaagagcagcaaaaattgattctgaaactcgaggatgacatattaaagggctgcagttcaactgataggaggagttctcttttgaatgattgggatcttcaagaaataggctcaaatgaagtatcggagggtactgatccaaggaattcatcaccagaccaagatcaaagttccatgctcaaggtcatctgcaatcagagggaccgtttccgtacacgactacgtgaaaccgaagaggaactgaggagattaaaagagaagtatgaaatgctagctgtagaattggaaaaaacaaaagctgataatgttcaattgtacggaaagattcgatacgtccaggactacagtcatgagaagattgtttctagaggaccaaagaagtacgcagaagatattgaaagtggttcttcagacgttgaaacaaagtacaagaaaatgtacgaggatgacataaatccttttgcagctttctcgaggaaggaaaaggatcaaagatacaaggaacttggtataagagataagatcactctcagtagtggccgttttctcctcggtaacaaatttgcccggacatttatattcttctacactattggattgcatctccttgtgttcacactgctgtacagaatgtcagctttgagctatctgagcataacacctgcacatgatgagatcatcctcgacgctggcaatcagacactatcgcatatgccctgagccaagtttgatgtaacagtattatcacttgatcagtacggaaagggaagcgttcctgggttttggtctcgagaatctctgcataggatcatgactgaagtttttagtttactatgccctttaggtgccttgatatgttctcttctgtagataaatttccagtaaagcgggtaaggaccaagggacgaggtggcggatgaggtgtggtgctagagtcattctgtaaactgttgtattaccaaattgcccttttgatgacaaatgaaagcacatatgtacaaacccaagcccccccaaagtatgtttcagaatatatggtcgggagtttgtggcgaggacagttgtacagaattctagaaataaaaagccctgagggagcaatatt

SEQ ID NO: 4906 - DNA, 759 bp, Triticum aestivum
  Clone ID: PAT_TA_4906
gcgtccggtgattgacagctttactaagcatgggaatttgcacatggttgaatgcctatttagagaaatggtcactttgggggtccacgcggatgcatatgtttactctatcttaattgatacatatgctgaagctggaaatgtccagcaagctgcagcatattttggtttagtgacaaaggctggtttatgtgagagtgcttcgatctataattctttgatcaaactctacacgaaagcagggtatctggcagaggcccaaaagacatacaagcttctgaaatctttagatactgacaccaacctttatgcatccaactgcatgattggcctctacagtgaccattgtatggtgaacgaagcacgtgagctttttgagaatttgaagattacgggaagcgcaaatgaattttcatatgcgatgatggtgtgcttgtacaagaaagttgctcgctatgatgaagctcacaggatctccaaggaaatgcaagctttagggcttctaactcaagcattaagttataattctgtgattcagatgtatgtatctggtgggaaaatggaggaggctgtgaaaatatttcagaagatgttggcatcgagcacaccgccaaacgatgtaactttcaaggcactaaagccaatactagtgaaagaaggagtttcaaatattgagattgcaaaattagagtctctcagaaggtgtaacactcaagattgcttgaatcagtggtacagggcactagctctggttgtcag

SEQ ID NO: 4907 - DNA, 1114 bp, Triticum aestivum
  unsure (1)..(1114): unsure at all n locations
  Clone ID: PAT_TA_4907
aaaccccgccgngncgagcattacgccgncgccgccatgctccgcctccaaaagcggttcctctctctcctccgtgacggcggcgcctnccctctccccaccttccccctcacctccctccaccgccacctctgcgccaccgccaccgccaccgcgaccacctccaccgagtcccctttctccgtccaggactacctcgtcaacacctgcggcctcacccgggcgcaatccctcaaggcgtccaggtccatctcccatctcaggtccccctccaaccccgacgccgtccgcgccttcctctcgggcctcggcctctccagctccgacatcgccgccgtcgtcgccgccgacccgaagttcctctgctccagggtggacgggaccctcgccccccgcgtcgccaagctccgcgatctcgggctatccccttccaagatcgcgcgcctcgtcttgatcggcgcccccgcgttgcgctcctgcgacgtcgccagcaggcttcagttctggatcccattgttcggctccttcgacgagttggtcaatgccgtgtcgaggggagctctgggaggtggtgccctcctaaggcgtgacattgacacagtggtcaagcccaacgtcgagctacttctgcgctgcggcttaaaaatcccccatctcgccaagactggcctcaagtgggacgtgggtgctcgtctgcagcccnagaaaactccaagtactgggtcgcacgcgcaagatgagctccgggtaccaccggctcaagccaatcatgtatgcgctcaacaacgtctcctgctngacccaagagaacttgctgcaagaatggattnactggaagaagacctccggtgctccggatgaatgctgaaatnccgtcntcaagcacccaanctcctaantnatcnaaggacaactncncaacacgtaaattccgattaanaggttgncttaaccaaaataatctgccaagccgcncgatacttnaaccngaaaacaggattccccggaaatgtntnaaaangcaggcaaggatcgattcgacaatgccatatctncaaccaaggatcatcaggtnacanctaangaantccnactcaatttngccggctangaa

SEQ ID NO: 4908 - DNA, 534 bp, Triticum aestivum
  Clone ID: PAT_TA_4908
gcacgcggcctcaaccacacgctacgctacccaagcctcacgcacttctcattttccagcgatcttttttgccggcgacgtacgcgaggcgagttcgcacgtccgtccatggagatcatcgacgcggagctgcgtctcggcccgccgggcagcggcggcgacgcggcgttcggctcgcagaagaagcggtcgtcgtcgacagtggcggcggcggccacgagcgaggcctccgggaccgacgaccacgacgccgcaccggcttccaaggttccgccggccgcctcgccccgggcgggggcgtaccgcgagtgctcgctcccggcggcgccggcggcggcggcggcggggtgtgtgcgcgccggggtcgccgggctgggtggccgccgctgcgggcgggccggcagggcccgttcccctcgccggcgccgtcggcgccggcggacggtcggggcgcccgagaggccgcgcagagagggggcctctacgtgaaggtgagcatggacggggcaccgtacctgcgcaaggtggacctgc

SEQ ID NO: 4909 - DNA, 1420 bp, Triticum aestivum
  Clone ID: PAT_TA_4909
cccgggtcgccccgcgtccgctgacacccatccctccgccaccgcagtcgccggtgaccaggacgcgcgtccgagttcgccggcggcgaggagaagggcgccgagtatggggtgctccctctcggggctcaacgccctctacgacgcagcgactggcggtggcgacgtgtggatcaacgagcgccgcttccgcgtcctccgccagatcggcgagggcggctttgccttcgtctacctcgtcaaggagcacgacgcctcctccgacgccgcgcgcgacaggcacccctcccacgtctcagacgacgggacatatgctatgaagaaggtgctgatacagagcagggagcaactggatctggtgaaggaggagatccgcgtttcgtccttgttcaaccaccccaatctgctaccgcttcttgaccatgccataatagcagttaagagtacacagggagattggagccatgaagcctacttactcttcccagtccatttggatggtactctgttcgacaatgctgcagtcatgcagtcaaggaaagagttttattcggtggtcgatgttttgcgaatattccaacagatttgtgaaggactgaagcacatgcatagtcttgatccaccatatgcccataatgatgtcaagcctggcaatgttcttgtaacctgccgaaaagggcaagcacctcttgcaactttgatggattttgggagttcgcggcctgcaagatatcgacttccttctcgttctgatgcttctcggtcgcaggcattgccggccgcgcgtagggcctccccagcattgctctgcaccttttcgcgcacctgaattgtgggactgcccgagtcatgctgatattgatgagaggacagacatttggtcgctaggttgcactctttacgctatcatgtatggtgtttttccctttgagtctgctcttggtgaatctggaggaagcttgcagctggccattatgaacgcacagttgaagtggccagcgctaccgagcccctaccctgacgcacttcacaagtttgttacctggatgcttcagccacagcctgagatgcgccctcccatcaatgacatacttctccacgttgacaagcttgtggagaaatactcgccttaaagccagcttgcatattctgttctgacttgtttcttctttatacgactgcaaaaggggacatgttgtaggactcatgctctaggccttttcatcctttggaataggctcagtgtcaattctttatgtaactttcaggctgttaccgatatgtcgttctctaactcttggaagttatattactctcctatcttgtacaaaatgtttgcaaatacctgtgttactggcttaaaaaaaaaaaaaaaaaaaaaaaaaaaaaaaaaaaaaaaaaactcgagactagttctctc

SEQ ID NO: 4910 - DNA, 741 bp, Triticum aestivum
  Clone ID: PAT_TA_4910
ggaactagcgattgggcaagagggaaaaggagatcgggggtcacgccacacgcatccttctctcccctcctctcccccagaaacgagaactgcttctcgtcattcccaatccgaccgccgccgccgccccaaccccaaccccactgccgccccaatccgaccgctggcggcctcctcctcccctagagccgccgctccagcccttcaccttctatctctatcccaactctattccaagggaaggaaagccccgtatcacgcgacaaggtgagggggcgcccagatccgcagcggcaccaccgcgccctcgtctacctggtcctcgtggtcggccatggaggtctgacccgacccatggatggatgggggcgaaaccctagccccacacccacccatggatggatggggatcgggcgacgacggcggcgggcttttctcggtgcttgctgatgtggtggccctcgacgccggtgatgggttgcagcacgtagacgctaaagactgcgggtgtgatggaggagcaccatggcgggcgtgcaggccatctttccctaccaagaatatttaggatgacaatcgttactatgctgggagtggggcacatcttatgtgcaagagggccgagaaagatcggattttggttgacaagattctgggaatggtagatgttttgaccacgaaaatcatagcttcgaaaatggaagatgaagagttcacatgatatgatggcgtactccttct

SEQ ID NO: 4911 - DNA, 1898 bp, Triticum aestivum
  unsure (1)..(1898): unsure at all n locations
  Clone ID: PAT_TA_4911
gcagacatgtagctctgaagtgacaacaagcactacagttaagacagagaatcatattgtagagattaaggccaggccagctgctgggactctggttgtttgcccgacaagtgttctacggcagtgggcggaagaactgaggaacaaagttaccagtaaagctaatttgtcctttctaatatatcatggtagcaaccgtacgaaggatcctaacgagctcactaaatatgatgttgtgctaactacgtattctatagtaagtatggaggtaccaaagcaatcaagtcctgatagtgacgatgaagagaaagggaaggcagacagatatggtgctcctgtttcaggcagcaaaaagagaaaggcttcctcttctaagaaaactaaaaaggccacaacagagaagagtaacttaccagagaaacctcttgcgagagtagcatggttcagggttattcttgatgaagcacaaagtattaaaaattaccgaaccaatgttgccgggtcttgctggaatttgcgagccaaaagaaggtggtgcttgtcagggacaccaatacagaatgctgttgaagatctctttagctattttaaatttctccgatatgaaccatattgtgaatacaagcatttttgcaccatgataaaaatgccaatcagcaggaacccaattaatggttacaagaagctgcaagttgttttgaagacagtaatgctacgtcggactaaagcgacaatgctggatggaaaaccaatcatttccctaccgcccaagactataactctcaaggctgtgaacttcacgagtgaggagcgtgcattttataacaccctagaagctgaatcgcgagcacaatttaaggtctatgcagctgctggtactgttaggcaaaactacgtgaatatcctgctgatgcttttacggctcagacaggcatgcgatcaccctcacctagttaaaggtcacgagtctagctggacctcttcattggagagtgcgaataaacttccaatggaacgaaaacaagaattgctggtttgtttgcaatcttgttcagctatatgtgctctctgcaacgatgcaccagaagacgctgttgttactgcatgcgggcatgttttttgcaaccagtgcatattgggagcaacttactggcgatgacagcatatgtccaagtctctaattgcagagtccgacttaatgcaacttcattattctctcgaggcacccttgaatctcctcgggcaaatcaacaagtgaattccagtctaatgattcctgtacagagatggtacatactgaaaatcaaactgggattgattcatcttatgcatcttctaaagtgagggctgccctagatatcattctctcattacctaaagttgaccccacccaaagtagtgatagcaaaaaaacaattgggcttgcctctgaaaataccaatgggatgagttcagaatatgctgacaccaagacgacagagaaggccattgttttctctcaatggactagaatgctggatttgctagaggttcatttgaaagcttctcatgtgacctaccggaggcttgatggaacaatgtctgttgctgctccggggaaaaaccgtngaatgacttcaaaacantccnagaggttcctgtaatgatcattctctcaaactgcgatcctgggtctaaataggtgggctgcctgccatgtgcttaagctcgatcttggggtggaaccctaccactggaggacaaactgttngatagacacaccgtattggccaaacacgacaatcacaatatcnagttaactgtcaaagatacggtggaagtcgtatcnggnacccaaganaaaaaccgggaatggtgctcaanctttggggaagaaaactggtggcggcagaccgant

SEQ ID NO: 4912 - DNA, 427 bp, Triticum aestivum
  Clone ID: PAT_TA_4912
cgcgggggctgctgtacctgcacgaggacgcgcacacgcccatcatccaccgcgtcgcctagacctagtacatcctcctcgacgaacgctgggtcgccaagatcgccgacttcggcatggcccgcctcttcccggaggccggcgacggccactcccacgtccagacccgcgtcgccggcaccaacggctacatggcgcccgagtacctcatgcacggccacctctccgccaaggccgacgtcttcagcttcggcgtcctcgtcctcgagatcctctccggccgaaagaactcctccttcatcccgccgccccgatccagcgccgacaacctcctcgattacgcctggaagctgtacaaggaggagcggagcatggagctgctggacccgtcggtgaagtcgacggccgcgccggaccaagtgctcat

SEQ ID NO: 4913 - DNA, 1002 bp, Triticum aestivum
  Clone ID: PAT_TA_4913
acaccaccccgaccccgaaggcagacacgacacgcgcgcgtcggcctcactgccaaacttcctccatccctcgcccgcccggacgcgcacggcgcgcgacagacgcccaccgcgtcccctcccctccccggcgaagcccggccggcctggcggcggaggacatgaagccccgggacctgctggagcggatccggcggcccttcgcctcccgccgcgggacgtcggcgtcggcgcggcgggaggaggaggacctggaggccatcgcggcgcgggagcagcgcgcgttccggtacgaggcgctggcggcggccacgcgcaacttctcggagaagcagaagctcgggcagggcggcttcggccccgtctaccggggccagctcgccgacggacgggacgtggccgtcaagcggctgggcgccgggtccaggcagggcgcgcgggagttcaagaacgaggccaaccggctgtcccgcgtccagcaccgcaacgtcgtcaacctgctcggctactgcgccgggggcgccgacgagaagctgcccgtctacgagtacgtcgccaacgagagcctcgacaagatccccgtctccgccttgtcgggcacgaccccgaccaacggcagcacgcacactccggcagcagcagcgatcccgcaaggccatcgaacgcccatctgacgtggcagcacggtccccttgcggagccgggggctcccgtcgccccgggaaaagcaggagttgcccaccggcagctgatgagctgaacccgcctgaagctccctgtaaatatgtccattctttttcgtcctctctttctgggtctgctcggaccagtataatgattgttttggtagtgggtaggaaaaagttaaaaggatctgtcggattatttttagggtgatgccagctcctagccggagggagataactgaactgtcggccgatgattactggcagtgacagggaatgtgcatagcaaatggagagagataattcccgtgtttcc

SEQ ID NO: 4914 - DNA, 1068 bp, Triticum aestivum
  Clone ID: PAT_TA_4914
gcgaggtttgccgtgcctactaggctcgcgagttctccgcctcgtctcatttccccctcttaccgacacgaacccggcggccaaatttagggttttgctcccgcaatctccccccgaagccgccgccttcttcccgcgccggcggcgatccaactccgcgtctccatccgccgatccggactttttttcaatctccggatctcgctcaagatgcttcccctctcgcttcttaagaccgcccaagggcatcccatgctcgtggagctcaagaacggcgagacctacaagggttgttgcgtgcatgcaggcctgtgagctgtacaaggaggagcggagcatggagctgctggacccgtcggtgaaggcgtcggccgcgccggaccaggtgctcatgtgcgtccgcatcgggctgctgtgcgtgcaggcggacccgcggctgcggccggacatgaagcgcgtggtgatcatcctctccaagaagcagagcacgctggaggagccgacgcggcccggggcgcccgggtcgcggtaccggaggagggcgcacggcctgcgcagctcgtcgcagtactccgacggctcgtcgtcgggcacgaccccgtcgacgtcgcacgcgtccgcgtccgcgtcggcatccgcatccgcgtcgaacgccatgacgacgtcgagcacgcgcaccttgcggagccgggggctcccgtcgcaacgggaagagcaggagttgcccaacggcagctgatgcgctgaagctgcctgaagctcactgtagatatgtccattctttttcgtctctctctttttgtgtctgctcggagattctagactagatagtatgattattttggtagtgggtaggaagaagtagaatgatcggccggattattttagggtgatgctactacgagtagttcgtagccggaggaaaatgactgaactgtcggccgatcgattactggcggtgacagggaatgtgcatagcaaatggagagctataaatctcgtgttttaacgtagaactattgttctaatagttctacggttggtgcttaaaaaaaaaatcctgtgttt

SEQ ID NO: 4915 - DNA, 1097 bp, Triticum aestivum
  unsure (1)..(1097): unsure at all n locations
  Clone ID: PAT_TA_4915
gcgcgcgggagttggggtggtcgctttgtcgcccccgagatccccgcctcggcgctacgccccctctgcacctcgaccgcccgccggccaatgatcggggtttgccgtgcctactagggctcgcggctcctccgcctcgcctcatctcccccccttaccgacacgaacccggcggcccaatttagggttttgctcctgcaatctccccccgaagccgccgccttcttcccgcgccggcggcgatccagctccgcgtctccctccgtcgatccggactttttttcaatctccggatctcgctcaagatgcttcccctctcgctcctcaagaccgcccaggggcatcccatgctcgtggagctcaaaaacggcgagacctacaatgggcacttggtgaactgcgacacgtggatgaacatccacctccgggaggttatttgcacctccaaggatggtgataagttttggaggatgccggagtgctatattcgtgggaacacaatcaagtatcttcgggttcctgatgaggtgattgacaaggttcaagaggaaacttctaagagtagatctgataggaagccaccaggtgttggccgcggaagaggaagaggagatataggcactaaacctgggggcagaggcatcggacgtggccaagatgatggcaaaggcggtggccgcggaaggggcggaattggaagtaaaggtggcaacaaaggcgggacgtggatcgtgtgtagggctgattttgagatgcgagaatgccgcttttttgggactgtgtttgtggggttgtgtagattgcttaggacatggtaagctttggagctggaattgttggcttttgtgttcaggtatggcaaactgtttgtgtggtatgaagttaccgaggaggagttggctgtcacctgtttgtgttgttcgaaacagttcacttaaaatttgggtatgggctttatgcgtactagtcgacatgtatttgccggtacccaattcncccctnataagtgaattcgttattacgccccgctcaactgggccgtccgttttaacaaantcctgaaccnggaaaaacctgggnggtncccnacttaaaac

SEQ ID NO: 4916 - DNA, 685 bp, Triticum aestivum
  unsure (1)..(685): unsure at all n locations
  Clone ID: PAT_TA_4916
ggaaaagaaggctgtggtggaggcgagaagaagactcaggagagggaagggggtttaacgccgcagcagctgccatggcgacggcggcgcgattcttgcgaaggacgctgcgagcaagcgaggtggcgtctcggttgttatctacctctcacagtatagttaggcgtgctgcatacactaccgggggaataattgatgttggccaaccaacacccaaatctcatcctgagttattagctgatgaggagattacaccaggcatcacaagtgaggagtacatgtccagaagaaaaaagcttgtggatgctttaccagagaagagcttggccataattgcatctgcagatcagcagatgatgactgatgtagttccgtactcattcagacagaatggtgattacctgtacattacaggttgtacacaacctggtggtgtagcggttttaagtaaggaaactggtttatgcatgttcatgccagataaacataaggaggatgtagtttgggaaggtcagactgctggagttgaagcagctgtggatttcttcaaggcagataaagcatttccacttagtgagatgaaaaagatccttcctgaactgattgggcaatcatcgtgcgctttcccctggcgaacgcatccacatcttcttatnnnaactttgatgccttccgcnnnncatnn

SEQ ID NO: 4917 - DNA, 910 bp, Triticum aestivum
  Clone ID: PAT_TA_4917
gggctgccggggcagccggaacgcacagccaccaccaccgactgcgtccgtccgtcctcttgttcctgctgttcttgcccccattgccgccgccgcctcctccgcagctgcgctacggatgagaagcggcgctaccgggccagcgactgcgcggtcggcctgaggccggagccgcaggcaggcgggctgcaaagctcggctcagaccagaggtggcttcatcctgacagcgtgaaagcgagcccccatgggccccctggagccgcgggacccgccgcccgcagccccgggcgactgatgacacagctaaaagaaggacccagaaaagtaaaagtttcaaagaggttgaaaagtttgatgtatttgttctagagaaaagctccggctgcaagttccgatccttgcaacttttgctcttcgctatcatgtctgctgcatttctgacacttctatacactccgtctgtgtacgagcatcagttgcagtccaattctcggtttgttaatgttggatggatatgggataagactatccctgatccgcgatatgtatctactatgcccgttcagtgggatgatgtgtataaaactatcgaaagtctgaatggtggtgagcagaagctcaaggtcggactcttgaattttaacagcactgagtttgggtcttggacacaattgctcccagaaagtgagttttcgatcataaggttggagcatgctaatgaaagcattacctggcagacactgtaccctgaatggattgatgaggaggaagaaacagagataccatcttgtccatcgcttccagagcctaatttcccaagagggacacactttgatgttgttgctgtgaagcttccctgtacccgagttggcgggtggtccagagatgttgcgcggttgcatctgcag

SEQ ID NO: 4918 - DNA, 797 bp, Triticum aestivum
  Clone ID: PAT_TA_4918
cgctactccggagtcatcagatggagccgccgccgccgttcttagcaatttcggtcaccgtggcgaccttggctgctggcgtattcgccatatatttctacgcaccttcatggcgcgtacgtagggtccccggtccgatggcttacccgctgatcggccacctgccgttgctcgccaagcacggtgccggcggtgttcacggtcctcagcagagagattcgggcccatctacaggtttcacatgggtagacagccgctacttatgattgcggaccccgagctgtgcagagaggtgggaatccagaagttcaagagcatccccaacagaagcgtccctagtcctattcgcagctcgcctattcacaacaacggcctcctcgttacgaaggactcgagatggcaatccatgagaaatgtcatcatctccatttaccagccgtcgcacgtggcaagcctcatcccttccttccaaccgtacattgaatggacggagcgcctcctccggcatggcgaggagatcaccttctccgacctctcgttaaagctcttcagcgacactattggtcaggtcgcctttggtgtggacttcggcctcaccaaaggcaccacctctccaccaccgaaacaccatgtcgattgtgctgagactgtcgacatgacaacggatttcatcgaaaagcacttctacgcctcgacgtccctcacgatggacctgtcaggctccgtgtccatcatccttggcatgctcgtgccgtttctacgggaacccgtgaggcagctcctgctgcgtatgccgg

SEQ ID NO: 4919 - DNA, 570 bp, Triticum aestivum
  Clone ID: PAT_TA_4919
ggtaggtgcatgtggtaaatcccatacaggtggagttattcctctttgaatgtgtgttgttcagttattgtgatcagcaagccgtcatggggtgaaatctcaacgaaacagtgggtccgctgtcgcctcggctcgtcgttgtcgtctttgtgggccttggtgacttttggacacacggcgttatacttttggcctattttagctaccacacagagctagaagcttcccacacctcccaacgattgcctatgaacttacttctgtttgctctcgtccttgttctcggaaaattacttggagcctttgaggtgttctttattttttttcctggtggaaaataatgaagcgcctcttcttttatttcattttttgcaaaaatagtactccctctatttcaaactactttgcgtattagttttgtacaaactctgacccaattttggtagcagaaagtaccgacaatcacaacactatataaatgtcattagatccatcatgaaatatcttctcatatttactagactagataattgcccgtgcgttgcatttggggggggggggggcaaaaaa

SEQ ID NO: 4920 - DNA, 548 bp, Triticum aestivum
  Clone ID: PAT_TA_4920
ttttttttttttttttttttttttttttttgactagaaccttttggcatgggtacatcttaccattagccaaattttcatattgtagaatcgtcatatttcacccgcaaaaaacttcatcatatttaaaccatatatagttatagaattacatgtcgtaaaggaccttgtattcaagggaagaagcaagctcagtagtttgtggacatgaactggtggtggaaattggaggctgagtatatgaacctcttaacaggccattggcaatgcctttgtatgtagcttctgtgggatggaagccatcccatgatgcatattcttgtgggtcatcgcataccttgtagtctccatgcccacatcctgcagttgcggacacaccatatggccctcctccaccgcaacaagccatcaaaggatcctctatgccaaattgttcgggagaagagaagatctccatggcagctccatagtaatcagcatagataatcaccactccaggatgaagctttcgcagattttccaactcatccacaataagtttgttgtggt

SEQ ID NO: 4921 - DNA, 660 bp, Triticum aestivum
  Clone ID: PAT_TA_4921
gctccggcggcgggaactgggtggcgcagccacctgagagaggctctggcgaccatggagttcctacttcagcttagaaacagttcccagttcccgcggtggccgaggttcaagaagcggcccctgcggcttcaagtgctgacgggcagatctacccggcgaaggcagcaggcgaggagatgggtcagtgctccgagcactcaattgaacaaattgacccgaaaaccggacgcgtggggcaaagagtgcatgtaggtgctgctgctctacgaaggcctccttgcccggacagggtcacggcgctggagaagactgacagggaatttgccgagcatccaggtgacatagttatggtgccaaagattggaacaaattttgacacgctcggagaagcttatgacttttaactcctggaagaaaggatttggaatacgatatggaaagagcaggctaaacgttagcaggactaagtgtatgcaagatatagtctgcggatgcgcggggaagccaattgttgaaaatactcgttcctgccgatgtgaatgcccatcactcataacactactgcggacaaaggacaatggatggtacgtagcagaacatcgagatgggcacaatcatgcactctcccaaacttatggacagacaatacactggccg

SEQ ID NO: 4922 - DNA, 902 bp, Triticum aestivum
  unsure (1)..(902): unsure at all n locations
  Clone ID: PAT_TA_4922
gcccgccggggtgccggcgccggatgctgggtgccgccgcggacttcgtcggctccagcgggtcatcccccccccccgcccctgtcctgccgggttttctcttggatcggcttccagattcgcctccgctcccacctcattctctggctgccctttgcggcgattttcccgggaagcttctgcctggactaacccgtcggcaaagtccaagttgctgtgcctcctgtcccgcaaatagcggcactgctggattcctgggggagatgcttagtgctgcctttaacatcgttggcttcagttggataacctctcctgctgcaactgagctagaggttatagtcttagactggtttgcaaaaatgcttaagcttccaagccaatttctgtcagatgcgcctgggtggaggagtaatccagggtactgccagtgaagcagttcttgttgtactattgggctgcacgagatagaacttttaaagaagcatggggaaaaagccccttgaaaagttagtagtttatgcatccgatcagacacattctgctcctgcaaaaggcatgccagattgcaggaattttccccaagagacttccagattngtcaaactgactgttataagactatgctgttgcacctgaaancatngacagagcatttccattgacttgtcatccggtttganacatcctcatctgtcaacanttgnacanatcttcatcggcgttgncccttcctgaactaggaacatacacaggccatacantggtccacatgatctcatatcggaatctttantccaaatacacacacttgangggngaaaacngtctcatatatccanaatgtccaaactcacgtcttcaggtaggaagatnntgtgactgcanancaanttcaaaaagnc

SEQ ID NO: 4923 - DNA, 799 bp, Triticum aestivum
  Clone ID: PAT_TA_4923
gagggtttgatggacgtgattcataaaagataccgatttaagaccattgtcttgctatcaagaggtatttgcttcttgggcagggtgattttgttcagtatctgatggatgttgttggtcctgagttgtcagaaccagccaatagaattagccccttccaccttgctggcttgcttgaaactgcaatacgtgcatctgacgcacaatatgatgaccgtgacatcttggaccggataaaagtaaagatgatggatcacggagatggtgatgttggctgggatgtcttctccttggagtatgatgctagggtccctctggacacggtgttcacagcttcagtcatgaagatgtacctcaagatattcaacttcctatggaagcttaagcgtgttgaccattccttgaccggagtctggaagacaatgaagcctaattgcattctttcttctccattttacaaggaaggggcaggcatcagggctcagtttgtttcagttcttcggaaatgccaagttctgtttaatgaaatgaaccatttcgtgaccaacttccagtactacattaatgtttgaggtcctagaggtttcctgggctcgtttttcagaagaaatggatgcagcaaaagatttagacgatcttctcctgggacatgataaatatctcacttcaattgtcgagaagtctctcctgggcgagcggtccctgggaattttgagaaatctttttgccttgtttgacatcatattacagttccgcagccatgctgataggtggtttgaacggatatatgagttgcaac

SEQ ID NO: 4924 - DNA, 1491 bp, Triticum aestivum
  Clone ID: PAT_TA_4924
tgcaggcggacgcgtgggccgaaaaatgttcgccctccgcaaaaccctgctccacggccgcctccccgcgccgccggccaccgccgcctccaggatctcctccttcctccgctccctctccacatctccggggggcgagggggtcggggacgaatggggctcctcctggtccaccggcatcaccaaggaccacttcgacgggtccgcctccgccgtcgggcgcccctccccgtccgcccccgtctccaaggagctggcggccgtccgcaccatggacgaggaggatgagatcctgcgctccgtggatcgcgacaacaaggaagggagggcgtacgtcgactcgtgggacaagcgttttcaggagacgtgcgagctgctgaagcaggtgcgggagccgggatcccggggcgcctacctcaaggactcggagaagcaggagatgtaccggctgcacaaggaggaccccgcgacgtacaccgtggagcggctcgccaaggacttccgcgtcatgcggcagcgcgtgcacgccatcctctggctcaaggagatggaggaggaggaggagaggaagcagggcaagccgctcgacgactccgtcgagatcctgctagacagctgcccagagtttttcaattcccatgacagggaatttcatgtggcatctcttccatataaacctgacttcaaagttatgcctgagggctgggatggcacgacaagagatcctgatgaggtcctgtatgagatttcaatgaaggaagatcagatgttatatgaggaatttgttcaacgcttggagttcaacaagaaaaaggtggcaggagaggtgaagtgccacaagtacagcaggcgacgaccagacgatggatgggcctacatggtcgagaagcttgggccacagggaaggcgtggttcaggagggggctggaagttcatcagtttgcctgatgggtcgagccgtcctctgaatgacacggagaagatgtatgtgaagagggagactccgaaacggcggaggaggatcattgctccatacaagtaacaggaaaggcccctctgctcgttataatgcaggagttctacgaacgaacgttcttttgtcgttctccagggaagcagaagcgtgagaggttgtaaccgccagcatcggtcgtgttttgttgcagcgccaccagaattcatcttgttttgctgcagcggatgtggtttaatgtattcttggcatctgtaacaagttccattccccactttaggcagatgaataatatgtctttgaaccgttggcgtgtctccgtctccacagcatttccgggcaagtcactgggtaggcagtaccaggcaaacacactttgcactcaacatttcatatagccttccattttttttgcttacaatgagtacttggacatgaaatttcctactactagttggactggaggcccaatagattatttctgatgttgagatgtatgatttcctttccccccgtgc

SEQ ID NO: 4925 - DNA, 544 bp, Triticum aestivum
  unsure (1)..(544): unsure at all n locations
  Clone ID: PAT_TA_4925
accttgctgcgctcaccaacagcacgcgcgccccccagatccccccctcacgcattccgccttctaccgaggctcgtagctgccagcacggacgatggccccttgcgcaactgccggcgtgcagatgctggccgcgcgcccctgcgtctcggcctcccagagcatgctcgcctcgagggcggccgtctcacggatcgacctgggcgctcggcgctggtagcttcgcgaagctgccccaaaatctcctgctccaggtctcttggttcttcccggagcggcgccgtcgccgtaagagcggtgtcagggagaacgtagctcttccggggntgcccaatcgattntnngagggaaaagggcantttattggctgggggtgcctgaatgaanaacgggntaatgggtgggcaatttgcnaaaaggntcctttgncgcancttgtgctgaaaatccctggtgggnanaatggggtgcctngcaacntaacaatatttgagaanaaancctgaaggngggggaaaaatttgcnaatcaacggnangctttt

SEQ ID NO: 4926 - DNA, 968 bp, Triticum aestivum
  unsure (1)..(968): unsure at all n locations
  Clone ID: PAT_TA_4926
gttacgataatgaggacactttatcaaaagtgcaagctggtctggcgatttgagtgaatataacattctttattttaagggccacttatatatcattgatgtttcgcaatctgttgacgttgatcaccctttggcgttggacttattaaaggaagattgtttgcatgtttctgacttctttatgaaacgaggtgtcgctgtcatgacagtaatggatctatttaattttgtgattgatcaaaacattgcggatgacgatgtagatgattacctagaaaaggttcagcaaaagatgttggagaatggagatacactcgcaaatgatgatgacatatctccaacagtcatggtgcagacgttggattatgcgaagcagtgtgaggctgatatagtcaacatgtcaatgttgcaacgaccatccctgtgttacgagccaccagcggataagctttataaccagccattgctaggatttgtgcgggctgaaaaaaacaagcgtactgctgaaaagcagaaaaaacagttgccacataataagtgctcattgctaagtagtggatcttgctctagttctgngtgaagattcgaggtattgaggctgatcccaagatggctggattngagagaggnccgctgatncgnganggaggacaagaatganangaaggagaanagagaactccggaagacaaaggagccgaaancgattaagaagaggaggaagaaatggcaaaagcgnanncaagaagtaacaatcnncgggttgattaattccgtnanaancttangattgantgtttanaacgantaggacatcttccccanngattacgcaaanaattcattggtccaatggggtttttttgtcatccncttttaatnccacctnaattcntatgcaacactgtaagggctgcaatgcacaattaaaatcagtantcttgtacttcactaaaagggggccgacn

SEQ ID NO: 4927 - DNA, 1673 bp, Triticum aestivum
  unsure (1)..(1673): unsure at all n locations
  Clone ID: PAT_TA_4927
cgccaccgccctctcgccgccgcgcctccgacccatgccaagccacaccgcccgccgtcgcaggcagcggccgctccgatgatgatggcggggccgtaccaccagccgaccaccctggcaggaggtccgcacgctctggatcggcgacctccagtactgggccgacgagaactacctctacggctgcttcgcgcacaccggcgaggtacaatctgtgaaattaatacgcaacaaattatctggtcttccagaaggctatggattcattgaattcatttcacacgaagctgctgagaaagttctacaggcttataatggcgcacaaatgcctggaactgagcatacattcagattgaactgggcatcgttcagctctggtgagaagcgtccggatgcagggcctgaccattcaatttttgtaggagacttggcacctgatgtcacagattacttgctacaagagactttccgagtgaactattcatctgttaggggggccaaggttgtcacagatccaaatactgggagatctaaaggatatggatttgtaaagtttgcagatgaaaatgagaagacccgtgcaatgtcagaaatgaatggtgtgtattgctcaacaagacctatgcggataagtgctgcaattcctaagaaatcatctggatctcagcttcagtatggagctgctaaagccatgtaccccgcaacagcttatgcaattccgcaggcccaaacagttctaccagatagtgatcctacaaacactacgatatttattggtaacttggacccaaacgtgacggaagaggagctgaggcagatttgcgtgcagtttggggagcttatatatgtaaaaattccagttggtaaaggatgtggatttgtacaatatgcatctagggcatcagctgaggaggctgtgcagcgtcttcatggcacagtgattggtcaacaggtggttagactttcatggggcagaagtcctgccaataagcaggatcaatcagcagcctggggtcagcagacagatcctaatcaatggagtgcttattatagctatggatatgatccatatgggtatcctcaggacccatcatatgcatatggtgcttatgcaggatatgcccagtatccccaacaggttgagggagcaaccgatatggcatcagcagctggcggccatgccccaggcatggaacaaaatgaggtgtatgatccaatgagcttacctgacgtcgagaagctgaatgcttcatacatggcggttcatggtaatgcgatgctaggacgccacctctggctgaagacctcaccattgtctcagtctgcttgagcaaagagcaacccatctatctatggcccattgccgccttcttttctgaagatttttgaggcccccctccgagaaggctgacggacagcttagctagcttcatatatgttgcgtcgcatgtactatgatgtaggaaacctcttttgttagtcctgtactggtttatctaaagttattgccaacgatgctgctaccaagtttctgccatgcagcatagaatgcgtttttctgtatncctgaccggcttgtgccgcagacattanggaaatattgccgcctggtgcggtcataatccgangttgttttgctgcctggtcaagcatcgttgggtcaaacttcaaaa

SEQ ID NO: 4928 - DNA, 725 bp, Triticum aestivum
  Clone ID: PAT_TA_4928
agtgagacccatgcctgaaaagggaaatctctccggcgtcggctcgagtcccaggcttgtcccctttcctgccggctcactgtatccactatctataaagttgtttgcttattttcttggcaaacaagtgttggaatattggctgctcgtacctatgtacagtaacttgagtatatccccagcacactatatgatcagcaatcgtacaaagtaatcaaaatgatgcgtttcctttcaaatggatagacaaaacgtggaccgagggcttttatgccacatccatggctactgctggatgttgattggtggtcttcacgtccagaaatgctagttttgtagattaggcaagtgtattcttcattttctgccattgctgtgtgcacggtgcacatgtgaattccgcctgcattcaatttcataaattaattgagcattctaataaggtgggacttgtttaacttttgtaggaagcaaacataaggactcgactcacaatgaaccatgaagccagcgatccgcatcaactgaatgttttacttctcatcttgtacaactgatgtctcatacttgctgtcttttcgctgtcctttgttgaacctgatgtatggtgtcttggtggttatgtttagaacagaaccgaagtgtatgtatgcgactattagttaatggaatgaaaaatgttttggtgcaaaaaaaaaaaaaaaaaaaaaaaaaaaaaaaaaaaa

SEQ ID NO: 4929 - DNA, 1157 bp, Triticum aestivum
  unsure (1)..(1157): unsure at all n locations
  Clone ID: PAT_TA_4929
aggaattcggcacgaggcttggctnaggatgggcagttcggtgtcgcagagttcacttcaaacaggagcatccatcaaagggaatgcagtgaactttcatcagaatatgatgctacctcccctgtgaggcaacaaaacatctttccagacaaggagaatgtgacacctccctccagagttctcaagtccattggtaggaaggttcttggctcaaggatggataattcagtgtcggctgaatacacaccaaacaggagcatcagtaaacgggaatgcaatgatctatcatcaaagtccaaacgtttccacacagtagatgcggaagccttctattcagataaggagaatctgacacctatatctacaggaggtatgaaagcgagaagttgtcttccgaagaacctgttcccagtggatgcagaccaagatcaggaggcattctgctccgacaaggagaactctacgcctatatctacaggaggtatgaaagcgagaagttgtcttccgaagaacctgttcccagtggatgcagaccaagatcaggaggcattctgctccgacaaggagaactctacaccagtatcttgtgtagctcagaaaacaagggatgtgtctgaaaaccgtgcacgaattgaaagtgcaatcacaaagaaaagggtggtggtagataggctccctttccagactcttctgtcaaattctcccttgagaccaactagctcatttgattgtacccaggctgatgctagtgaagctaatctctcaatcaggttggaagatgaactgaacagccttccacacaaaaaccacgaatcgaatagggttggagaagggatgaaagtctggaccatgttggctgataccgattgtcttcttgatgacgaatcaaggaagtctataatgctactaaaaggcataaaaggaactcatctgatcataccaaggattgtgatgagggagctcgaaggcatgaaacagcgggagggcatgttcaagaggtcatcaaaggccacctccataatgcaatggatcgaggattgcatggagaacgagagctggtggatccacgtgcagagttcttccgagatgttgccagtagcaccaaccccacctgcaactcctacagaaacgcaacgcaacagtgaaaagagtgaagc

SEQ ID NO: 4930 - DNA, 447 bp, Triticum aestivum
  Clone ID: PAT_TA_4930
gggtggtggtaacgaggcatcaacagcaggcggcggtggggatcagcaacaagaccaaggggtgggtgaggtcaggtaggatgctctgcgtttaggtgtgtgtctgtgttgtagtagatgagatgagatgagatgagatgagacgagatgatatgagacgaaacgggacgccattgcatttgcattgctgtagtagggaggggtttcgttgctgtactgtactgtatttgtactactttatacgtacttggtagagtaagaagaagatggattggaggctcaagttcttgagcctacaactataacacttagagtcgcagtgaatggatcaatcacagcctgtgcgttgttgttattgtaataatcagtagcctgtgcactcaaaaaaaaaaaaaaaaaaaaaaacggacgcgtgggcggacgcgtgggcggacgcgtgggcggacg

SEQ ID NO: 4931 - DNA, 1475 bp, Triticum aestivum
  unsure (1)..(1475): unsure at all n locations
  Clone ID: PAT_TA_4931
cgtccgcgccgttccgcgtggaggcgtttcgaaaagttgttccgtcacaggcttttctccccccgcacccagcccagtccagtccagcggcgccgcgagggagagggaggggagggatcgccggagggaaggaggggatggcggcggcgagcttcgggctgatggacaaggcctacttcgtggggcggggcgagatcctcagctgggtcaatgccacgctgcagctctccctcaacaaggtcgaggaggcggcgtcnggggcggtgcagtgccagctgctggacatggttcaccctgggtcggtgccgatgcacaaggtgaatttcgatgccaagacggagtacgacatgatccagaactacaagattctccaggatgtcttcttcgagcggccgctcgggcaggtacagtggtgattctcctggcttagctctctacctgtggatttatccgtgattgtgtcttgcattttgtcatctgggaaagcaaaggtgatttgtctatatagtagtttggtttatatatgccgtgtgtggggattcagtctggaacagtcgtgtgtgattgatgtccctgtttcccacaaccataagattagaattgtacaagtttagtactgtacacagcaatgagcataacctcagtgctgtgtacagtactaaacttgtacaattcttgtcttgtttccacacaacattaagattagagtcgtgctttttgaatgttgagccaatttttatggcctgtgtgctagcaaactgagcttagggtgcttcatatttgtccttcggcttctattcttatgacaattaaatagaggatctattttgctccctcctctgattggtttcaatcgatatttatctcatccagcactctgagtatcaatgtgttgttttaatcctgatgatgacgtggtagtatgaagtggacaccatattcctgtttaaatgcacaaggaataatttgtttcatcatgtcctggtttatccatgccagttttttgcttctggaactcttggtccttcatatctaaagtttacatgtactatacaagctctactttatgctaatacctgcttgtgtaacattttgcatgttatacttctaaatggacaagtacatgcggcgtccatcatcaacgatggtgcggattgattcaactgcagaaccatccatcatatcaacacaaagtcaggaagaagcagtacttgaagaagcagattacaatgttttctcgtcgtgaagcactagataagcttgttctatttatttttcctgttctggagtattccagtattccagcacctgaagacttgactacaacatgtcgtaggttgcttggatctgtataatatacatatgtggtggaaatttgtagaatgtgtgttctgagatatttccgtaatattcagctaattcatggtaacttgattccaaacttgttaaagggcgggcattggacacttggagtt

SEQ ID NO: 4932 - DNA, 1200 bp, Triticum aestivum
  Clone ID: PAT_TA_4932
ccgccccccccgcgcccccccgctcgcctcagccgccaaaccctccctcccctcaccgccccttcccccccgcacagacaagccctccacgcccgcgcggccgaccccccgtccccgattcagctgatctcgccgccagcgccccggcggcgagcttcgggctgatggacaaggcctacttcgtggggcggggcgagcatcctcagctgggtcaatgccacgctgcagctctccctcaacaaggtcgaggaggcggcgtcgggggcggtgcagtgccagctgctggacatggttcaccctgggtcggtgccgatgcacaaggtgaatttcgatgccaagacggagtacgacatgatccagaactacaagattctccaggatgtcttcaacaagctgcggataggcaagaatattgaggtcaacaaacttgttaaagggcggccattggacaacttggagtttctgcaatggctgaaaagatattgtgattctgtaaatggtggaatcatgaatgaaaactacaatcctgtagaaaggaggtccaggggttgcaaagagcgcacccacaagggtcccaacaagtcatccaaatcacttcaagccaacagattatctagtgctaactcagcagatggaggtgccctgaattctaatactgatcttgcttctccagttggaaaagtctgtaatgctgttaatgaagagcattacatggagcagattcaacaattatctgagaagattgcagatctgaaggttgctgtggacaacactgagaaagaaagagatttctacttctcaaagctgcgtgacatcgagatattatgtcaaagacctgagttggagcatctaccgatgaccaaagggataaggaagatactctatgcggctgatgcgaaggattcatcattacccgaggctaatgaaataatcaccaggtcaccaggcatgttctcagattcagcagaatgacagtgacaagtgccacgggatgcatcgtaccctccaaaacctttagtggagaactttgtggttctcctactatcaatctgagtagctcgtaatgtgtaaattagtagaaaataacacttggcatggggaactgctcatggccagtcacctgcaactgtcttctgttgtggcacggcttatcgaaagacaaattttcctcaagtaagaacacgtggctagttatgatgc

SEQ ID NO: 4933 - DNA, 722 bp, Triticum aestivum
  Clone ID: PAT_TA_4933
gtcgacccacgcgtccgggctaccttgaccgttgttggcgtggatcaggtgccggcgctggccgcgagtgcagacgcacagatctgctcgagcgtggtgtggttggcagaaggaagaactcgtcgccgccctcgcaggtctccacaggaaggccagcccacaagctcctcggtggttaaagagaacggctgcttcttcagtgcccaagcttgaaagatgttcatgtctatcgatgttgtgatatgttgatcggagcaatcagaaacgaggtgagccgtggatcaggttctcgatttctgtcttatctatggctcagaaagtcgatgctccatggattcaatgcaaggtgagtctgttcttccccaacgcggccgtcattttggaacttcagaagcaagggagggagtggacgaacacacgaccgaaagcgatggatttcctcctccaatcaggagatctactctgattgaggttggggagagtctagtgctggaaggttgccggcacatcgcaccaggcaaacagtggtcaaggtgacgctgcaggaggccgtgggtatgagcgccaaagggcggatctgcggcgttgctgaagcggcggcaatgacaaggggcagcttgcctctcacttccgagctgtcgacggggaagaagaatcttcaggttcctcgttggaacaagaggttgaggactggagcctctgccccaagcttgactccttgc

SEQ ID NO: 4934 - DNA, 1614 bp, Triticum aestivum
  Clone ID: PAT_TA_4934
gcgacccggctcgtcatgtactatcccgtgctttcacgccttggccatcgctgggccttgtttcctcggctctccgcgccggtgcctccactttgaaggggaaccggcctgacttcttcgtcgttaattcagtcggtcctggggcgtcggcgcctgtggtctgcctgcttctccctttcctccctatcttgaggggggctcagctgcctgagctgtcgtgccatttgagtctgggtccggagtgctccttggggttcggcgacgcgccctttgaatgtggacgtgcgcgattccgacctctgctctttacgtccgccatcatggcactccacatgtcccggttcgatttgatcgacctgtcgtctgctctgggtgctgcacctggagcgtcttccggcgctccgatacctggccccgcccttcctattctgtctccgtctttcccggtgtgccagcttttattctctgctttgcttttgggtaagacctactcgctgagacaaatcattggttgcttccttgtaacttctggtgtgattttagctgctgcgtgtggggttaaggagagtcatcttctatcaggagtcaaattgatttggccattattgattgttctttcatcggcatttcaggctgttgcatccattctgaaggagtctgttttcgttgatggtgcaaaacgtcttaaggggaaacggcccgacatcttcgtggttaattcatttggatctgggtttcaggctctttttgtcttccttcttctcccattactttctaatttgagggggattaagcttgctgagctttctggccatttaaatggtggtgctgagtgcttcttaaatgttggggagagcccaattgattgtggaggtgctccattcctaccattgctatttatattcataaacatggctttcaacatctcgttgcttaatttggtaaagatgtcgtctgccgtggttgcttcacttacagcaacttccgccgtgccaatatcaatctatatcctttctcttccatttgccctacatccctcaaggcgcggaattaagcgcttcttttatcttaggtggtatggtatggttgtcgggtctgattctgtataaccttccccaatcatctaaagtccctacctccgactgctaccttgtgccgtttgcgtggctttcaccacctcgtcccttaatttggtaaagatgtcgtctgccgtcgttgcttcacttacagcaacttccgccgtgccaatatcaatctatatcctttctcttcctttgccctacatccctcaaggcgcggaattaagcgcttcttttatcttaggtgattgagtgtatattaccacttcaaccgaaaatcaattattggtttggtcctgaacctaatattagatttctaggttggtgacgccagagtcgataaggactgtttgttgcgatgcatgagtacttggtatttctaatttgtaacagaatagcacttggtacatacatgtatgtaagaagctagatttggtactttgtgtactcattttcgctcccaatgtatagtgaacttcccatcctaaagagcattgcaaaagctgcaagtcatggtataaaacttaaaagtcca

SEQ ID NO: 4935 - DNA, 655 bp, Triticum aestivum
  unsure (1)..(655): unsure at all n locations
  Clone ID: PAT_TA_4935
agttcatgcaagcatatgacttgattgaagtgtactgcgaacttatagtggcacgcatgtccattattgattcacagaagacttgccctattgatctgaaggaggcaatagctagtgttatatttgcatcaatgagatgttcagatgtcacagaactagcatgttcggaagaatttcacaagcaagtatgggaaagaatttgccacatcagctcttgaagtgcgacctgacagtggcgtaaaccgtctggtaatcgagaagctctcagcaggagcaccagatgtacagactaaaaccaaaaccttgagctcaattgcggcagagcacaacataaaatgggagccaaaagcatttgaggagcagaagcaaaatgaagatcggatgtatggatcaacatattctggaggaaacattccaacttcggggtcacctgcttctagcgtgccaactcctcaacctgcagcagctccctattcatctgttcaatcagccacttctcgtgtgcctgcaggaccttcttatgaatcttctgaagctctagctaatagaaacccacatggcactgccaactctaatgcttccacacaggaaaatagaaggggttcagatgcttcagtgcctnctagctcccacatggtgcaactacttattcctc

SEQ ID NO: 4936 - DNA, 853 bp, Triticum aestivum
  unsure (1)..(853): unsure at all n locations
  Clone ID: PAT_TA_4936
ttcttgttgtgtagtcgccttcgtgcagcctccctttccctctcccctccaccaccttcggctgccactttcgccgcctccaccgccctcttcccaaccacaccacgccccctcgcggctccggcatcccgcctcccgtgaccgccgccatccaccttccggatcagatttcctcccctccgacgccaggcactgcgcctccactgctattttttcggcccgtgcagcggttaagcgatggagtggccgccgccccacatgctccttcttctgttcctgcttgccttctcttggcggcttcagggaggagcagggattgggggcttcggagttggagctgaggagttgagcagcaatggagcttcttttagtcgtagaagattgctgcagattggtggtgaaaaccaaggtgccgggtatcttttctcacatacacaagctccaacatcaggaccagtgtctgctccatcaccctcagcattcatatcatcaccaccagaaggtgcaccatcaccattttattcacgaccgacgccacagcgatcccctttacgccatgatccaccaatagtccttccacatgcgcttaagttttaangcccgcagcctgggggggagctggggcaatgatcattcnggttcaaactccaatcccataagcattcctggacaaacctaatggttttgttgcagcaggggttgctgctttccttatcatatcagcatctggtgctctgtactgccgagctaaaaaggtggggactgtgaaaccttgggtgacaggacttagcggacaattgcaaaaagcttttgtaacaggtgtacctgcactgaaacgatcagagctggaatc

SEQ ID NO: 4937 - DNA, 615 bp, Triticum aestivum
  Clone ID: PAT_TA_4937
ttttcacttctttgctattgcttaatacaatctcttgtttatcaacaaaggaattaactgagattcgcttttgttctgcaaatggattccaatcaaatttcagtttaacattttatagaccaacatttttcctcaaaatatgcttgcctcctttggtgccaagcatactgaaggtagtattccattgtcactgacattttatagttaaatgtatttctaattaagtttctacagaaatgtggttgtcgagtagcatcattgatttattataaggtacttattgttgttagtgtccctttctgcatgctgatgggatagtcaattgggttcatcatgatggatttttatggtaccataattgttggatgcccttttttatcaagtggttataaattatgtcaaacccatgtctttacgtgattttctaacatggaagtagtcacttcctggatatcgaagtatgtacatagaactgaaccgtttatcgcctcatgttttgctagagaaaaataaagcacgagatatgtgttaggatgatggatttcatattaaaaagaaggatgcaatatatgagcacttggaatgcagtagacatatgtttatagtagtgtaatt

SEQ ID NO: 4938 - DNA, 784 bp, Triticum aestivum
  unsure (1)..(784): unsure at all n locations
  Clone ID: PAT_TA_4938
ctctctcacacacagctctctctctctctctctctcccccatctctctctcaaatactccccatgcccatcgccgtcctcctttgaagaagccaatggccagcaatggcatggcgtcctctccctccgccttcttccctccgaatttcctcctccacatgcagcaagcaccgccgcagcatgacccctcccaagaacaccaccagcagcaccaccaccaccaccaccatgagcaccacctccctcccccccatccccagcacaaccccttcctcccctccccccaatgcccctccctccaggacttccgtggcggtctgtcgccaatgctggggaagcgcccggcgatgtacgggggcggcggcgacgggggctgcggcggcgacgaggtgaccggcggaggcggcggcgggggcgcgaacgaggaggagacgtcggacgacgggtcgcagctgggcggcgagaagaagcggcggctgaacgtggagcaggtgcggacgctggagaagaacttcgaggtggccaacaagctggagccggagcgcaagatgcagctggcccgcgcgctggggctgcagccgcggcaagtggccatctggttccagaaccgccgcgcccggtggaagacaaagcagctggagaaggactacgacgtgctcaagcgccagttcgacgccgtcaaggccgagaacgacgccctcctcccccaaaacaaggagctccaccccgaaacggggcgtctgagagccagcggagcggnttccnacttattaactccaanaagg

SEQ ID NO: 4939 - DNA, 903 bp, Triticum aestivum
  unsure (1)..(903): unsure at all n locations
  Clone ID: PAT_TA_4939
cccgccgcccccaacccgctcgcgctctcctcgccgcggcaagccgagcccctctccccgcccccctcgtcgaggttcgccgaccccagccatggcgacggtccccagcaagccggagcccctctccgacgtgagcgacctcaacctccacggttcgcatgctccagccacggcgacgctctccggcaagccggagcccctcctgagcgacctcaacctccaggacaaggaggccggcctcaccaatggcctggcggattcatcagacaagaacgacaaggaggcaccatcacctgagattaactctgaggagtcccttgagggtgacaaggttattgacataggtcagaaggttctcaatgcgcttgatgatctgcctgctgctgacctggctcccttcctagcctgcgatgacatcgaggggaatcctaacccgtgggttcaagtggagcctcgcggacgtcgacagggagcccatactgttgcaccggttgacaacactggtgatgtggatggcctgggggaacagggtgtagatgaatttgaggatgtattctggctgacaaagattcgacagcacagggtttcaaggaggagcaccaagtcccgcccacgtgccttggtgggagtaaggagtggccctggagtgttcgtcttcaactactgatctgggaagctgtatctgaaacttttttgggcaggagtctggagtggccctgaagtcttcgtcttgaactactgatctttgaggctgcatttgaaacttttttgagtgagggtcttgtttgaatggagctacataaattttactacatactgttttctgcttgatatatttttagtaagtggtgtttgccaccttgtgcaacagtgcaagccatgtttgtcacncttcgaagttat

SEQ ID NO: 4940 - DNA, 1199 bp, Triticum aestivum
  Clone ID: PAT_TA_4940
cccgctgctgcgctggatcccggtgcttgatgatcacaagatgtcatcaaattccacgctcacagaatcacttcatgagaaaacaatcgtctttgggcttaaactttgggttgtgattgggatcgctgttggagcatccctcctgggtattcttcttatccttgtgatatgcctaaccatccaaacctggatcagacggtcacgaaaggcattcaaggagcttcccatgacccagataccttctgcattcaaggacatcacagaagtcagggtggctgaccaattttcacccaatgattatgttgtacatgatgggcttctactcgccattgagaatgggcctgttgaatcaatggataaagatgcagttcaattggtgcaggaggacaattcgaggcatagagaagagaacaatctttcaggttctttagttcacactgatggctgtgatggaattcaatctgtttctgtctgtgaacagccttccgtacatgctactgccgattctgcgccattggacggcctacctgggttttcttaccttggttggggccattggttcactctcagagatctagatgttgcaaccgaccattttgcaaaggacaacgtaattggtgagggcggatatggtgttgtgtatcgtggcagattatcaaatggcaccccagtcgctgtcaagaaaatccttaacaatttagggcaggctgagcgggaattcagagtggaagttgaggcaattggtaatgttcgccacaagaatttggtccggcttttgggatattgtgttgagggtacccagaggatgcttgtatacgagtttgttaacaacgggaatcttgaaagctggctccacggagaattgtcccagtacagctctctcacttggttagctcgcatgaaagttcttctggggactgcaaaggcccttgcatatttacatgaggcacttgaaccaaaggttgtgcatcgtgacatcaaggccagcaatatcttgatcgacgatgagtttaatgccaaaatatctgactttggtttggccaagatgcttggtgctggtaaaagtcatattgctactcgagttatgggtacctttggctatgttgcgcccgagtatgctaacagtgggcttttgaatgagaagagtgatgtctacagctttggggttcttttattggaagttattacaggtagagatc

SEQ ID NO: 4941 - DNA, 717 bp, Triticum aestivum
  Clone ID: PAT_TA_4941
cgggagccggcggcggccgcgatgcccgggctggggttcgccgagccgccgccccccgccccccccccccagcccgccccgagcccgccgcggccgcggttcaggtcaaacgacggcggcgggtgggacgattacggagccggccgtgtcaccatcgaccacctcgaggggtcgacatcggagaaggagatcgttctggctgtcatagacgcggagaacaaggagacgatgctttccccccccatcaccccggacgacatttacaggaggcgacgagggacgttcatctcgtggttcgatcccgagaccggcttgtccatctccttgagcttcctggacgcggcggcgtgctccgatgtgtgggacacgatctgccaagtgcagagaaaactgaggcctgatggttggtagccggggtggcggtcgccccctgcctcctccagagcagtctgccccctgatgggtagctggtggcgctggaaatttaccctatgaggtgaagcagagtaccgcagtggccatcaaggctcaagatctgaaaaccaatcaataacctctgttttttcttcaggacttactgaattaggatgccctttttcgcagcgccatgtgcagagtacacacaattaattttatgtaataaacatcacctctgttgtgattattatttttgagctgcatcaacattgctctatatttaaaaaaaaaaaaaaaaaa

SEQ ID NO: 4942 - DNA, 729 bp, Triticum aestivum
  unsure (1)..(729): unsure at all n locations
  Clone ID: PAT_TA_4942
gccggccgggtcatgaaccacccggcaatctccagccaagcaatccccacacatctgtccactccccgaatcctctcctcaccaccagcgcagcagctcgccatggacgcctcagccaccgtagccaccgggaaggggaagaagggcgcggccgggcgcaaggcgggcggccccaggaagaagtccgtgtcgcggtccgtcaaggccgggctccagttccccgtcagccgcatcgggcgcttcctcaagaagggccgctacgcgcagcgcgtcggctccggcgcccccgtctacctcgcggccgtcctcgagtacctcgccgccgagctgctggagctcgcgggcaacgccgccaaggacaacaagaagagccgcatcatcccccgccacctgctgctcgccgtcaggaacgaccaggagctcggcaggctgctcgccggcgtcaccatcgcccacggcggcgtgatccccaacatcaacccggtcctgctccccaagaagaccgccgagaagtcccccaaggagcccaagtcgcccaagaagaccgccaagtcccccaagaaggcgtaggtgaccattgcttagttatgtcggagtagctgggatggatgtatgggtgtgcttcagctcgaagcagagtgttcttgttgtgtcgttgtatcttctgatctgtgaattcaatggaacaatgagttgctttgaaaaaaaaaaaaaaaaaaggcccctann

SEQ ID NO: 4943 - DNA, 757 bp, Triticum aestivum
  Clone ID: PAT_TA_4943
gagatcgacgcgcacctcagcggcgagccgagccgcctcctcgacaagaaggacctgccccaccttccttacctccactgcatcatcaatgagacgatgcggctgtgcccggccgcgccgctgctgctaccacacgaggccgccgccgactgccagctccacgggtacgacgtcgccgcgggcaccatcgtgctcgtcaacgcgtacgccatccaccgcgacccggctgagtggggaccggcgcccgaggagttcaggccggagaggttcgagcatggcggcgccgaggggaagctcatgatgtccttcgggatgggaaggcgcaagtgccccggggagagcctcgccatgaggaccatgggtatggttcttggcacgctcatccagtgcttcgattggaaaagggtcggggatgaagaggtcgacatggccgccagttccgggatcgtcatgttcaaggccgtcgctctggaagctctctgcacaccgcgagccggcatggaaactcttcttcacaagctctaaactgaaaatggttaaaggaagcagaaaataattggaacaaaagagtacacacactagtagaaatataaataactatagtgtaattaagtctttattaactccacagtatgtacacattgcatagtttgtactacctttcacagtaatgttcttgtgaatatatcttcgcagatgcacattgtataacatccctaaattatttcacaatttttggaaaaaaaaaaaaaaaaaa

SEQ ID NO: 4944 - DNA, 1023 bp, Triticum aestivum
  Clone ID: PAT_TA_4944
gcgcgccgcccccgccctcccggcccgcgccgcccccgcgtctcgccgcccgcgtccccctcctccgccccccccccgcgcccgccttctctgattgatattgtcctctccaagccaaccccccgctcgtgtccccaaggagcgccagcgccgagagaaccgcaatttgcatcccgcacggtgctggaggggaccgccacgccgcggatcgtccacgcgcgcacgactccgcctccgcgcctgcatttctgatccggctggtcggcggccggcgagatgttggggggcgtcctgtccaacaccctgctgctgctgttcgggtacgcgatgccggcgttcgagtgcttcaagacggtggaggcgcgccccaacgacgcgcacatgctccgcttctggtgccatgtactggattattgtggccatggggatagcctttgagagcctcatctcttgggtgccaatgtatggacgaaattaagcttgctttctttgtttacctatgggaccccaaaacaaagggcagtcgatgttgtatatgacacctttcttcggcccaattgtgatgcaatatgaaccaaacattgagcagaggttactgcatctgacggcaaagtctgggcagccacggcccgcgccaagccggcccggcgacagtacagtggcaagtactaacgcgccgggagaagtagttctccaggcaagtactaggggaaagggatgatcatggacgtacatggggtctatctggggtccctggcccacttaacggcggccgccttccccaccgcagccatcgcgctgtggccacccgggtcccgctgtggtcgccgtggttctgcgcgcgtcccccttcccctggccccgcccggctcctcctgcccaggccgttctgcggtgcgccatcgtatttctccccggtcttggcacccgattgtgtacatagaaatagaatgattcaagcaaaggtcaaattgaaagaagaaatctagtacatagaaaaacaatccagcaattaacccagtg

SEQ ID NO: 4945 - DNA, 565 bp, Triticum aestivum
  Clone ID: PAT_TA_4945
ctccgccatcaccttctggcgccgcgcgtcccggcgggcggttactacatggccccgccgccgcgccacggccccggcaaggccgcctccctctccttcctgctccaggggacgctcaaggcggcgacggatctgagccgcttcggcaacgactggatcgagttcgggtgggtgaagggcctcaccgtcgccggccagaacggcgccgctcatcgatggccagggcgccgcctcctggcccttcaacaagtgccccatccgaaaggactgcaaggtcctccccaccagcgtgctgttcgtgaacaaccagaacacggtggtgcgcgacatctcgtcggtgaacagcaagttcttccacttcgcgctgctgcagagcaagaacacccagttgatcaacctccagatcaacgcgcccgtgaacagcccaaacacagatggcatccacatcgagcgaagcacgggtgtggtgatctccgacacccatatcagcacaggagacgactgcatctccatcggccaggggagcgacaacatcgacatcgcccgcgtccactgcggcccgggg

SEQ ID NO: 4946 - DNA, 633 bp, Triticum aestivum
  unsure (1)..(633): unsure at all n locations
  Clone ID: PAT_TA_4946
ctcgtcgcctcgnaccccgctgnacccgtggtcttctccgccatggcggnatgcgacgaagcctctccacccggtcctgcaggcggttgacgacggcaacctccgcctcctcaaagagacggcgggcgtcgtggcggacgacggcatctggtcgcgcgcgctggttctggcggccatgaatgggcggctggacgtctgccggtgcctcgtcgaggacctccgcgtcgatgtcaaccagcgcaccttcacaggtgatacagctctggccatttctgcagcttatgggacagctgctatcacaaaatatcttctagatcgcggcgctgatccaactttagttggtgccctgtggccacctcttcatggtgctgcaatgagtggagaatgtgaaatactagaactgctgctttcagctggaattgatgtggattgtttcgattctgtgtacgggaccccattgcatgctgccgctgctgttggtgaagatggcgcggtgaatattttgttggagcatcatgcagatcctgataagattctcaaccttcatagcaccccgctaaatctgtccatactttccaaatcgctggaatgtgtgaagctactcattaaggctggtgctgatgtgaataaaat

SEQ ID NO: 4947 - DNA, 570 bp, Triticum aestivum
  Clone ID: PAT_TA_4947
ccacgcgtccgcccacgcgtccgatgcccagaaggccagaacccagaacagaccatgtcaagaactccggcgattcacctcaccccaaatccggcgtggagctgtcttctccgtcaaatccggccaacgggggagctcgcccgcttcgctccggaagtgatgccctcgaagttggtggccgttcgtcgtccttcctgtgatggaagcgactgccgccgtggaggtggatctgaccgccgcggcgcttgatttggcagcgcaggagcttgaatcggctgccaaggatctcgccttgacatggcctttgaccaccccttgagccattcgcatccggcgtcatcggcgatgggcgcgaggtaaggaggagctggttgggcggaaggagccagaggaggcgggttccactatgctggctactcctcgtggaaggttccacccgggcgctgcactccgccaccaatatcatcgaccgagctcggccaaggtccgggcgtcctccatccttccacagagcagagcagcggccagcatggcggggcggcttgccgccgcgccggacgggagcgccaa

SEQ ID NO: 4948 - DNA, 394 bp, Triticum aestivum
  Clone ID: PAT_TA_4948
gacaggagggacagggggcaaagcaacaacaacaactcttttcacaagattgacaagaggaactacaagtgccataattgtggtaatacaggccacttcaggtcagaatgcaccaagaagaggaagccgaatagcgaaaggaataattttcacaaggatgacagccgcaaggggaatcaatcccctgaagctacaggggtttactgatgctgattggcaaggggatcttgatgaccggaaatcaacttctggttatctgtttacactagcaggaggagctatttcttggagtagcaagaagcaagattctgtagcactttcatctatggaggctgaatatattgcagcgtcggaagctgtgaaagaaggtgtatggttaaaggggtttcttgcg

SEQ ID NO: 4949 - DNA, 602 bp, Triticum aestivum
  Clone ID: PAT_TA_4949
ctgggttggcggcccggggataaaccacagccacgcagcgggtcgtcttctccattccaatctgcatcagttcgtctaacagcggcggccgtgctgttccggcgccggcgagatgtctaccaatggtgtcgagattaatgggatttctgctgcgtccggtgcgaggagcacttccgtcttgccattggagtcccaggattccatgagcgtcccaaacgacgtgttcgctgccgccggttgtgctcggccgcatgtggatgcagtggtgggcgaggtgtgctctgaagccaccagcggctggacgcgcagggtcagggtgggtaaagctcccgaggagagggagatgaatccaaacaggatttcagctcccgaagtgtacaaattgtggtctgcttgggcatcgacgcaataactgtggcacgaggaaatctggaccttttgaaccgaactttctctaaggaactaaattcataagtcgtgctgtttctttgtcaggactgtcttattgtgcaatcatcattgtgtcatttgcactcggctgtcaattaaaactgttttatttggtctgttatgatcattattgtgttagtttcatttgaaaa

SEQ ID NO: 4950 - DNA, 867 bp, Triticum aestivum
  Clone ID: PAT_TA_4950
cgatttcctccgtgacatccaggccctgcgcgccaagtcgtcgtcgtggcatccaagcccaagctcggcgcggccgagaggagcagcgaggagaaggaggtgccgttcgacgagctctgcgacgaggacaagatcgtggccttcttcaagcggctgctgagcgagtggagccaggagctggacgagatgcccgacgcggagcggcgcacggccaagggcaaggccgcggtggccacctgcaagcagtgcgcgctacctagagccgctcttcaagctatgcaggaagaaggccctccccggtgacgtccggcgcgcgctgctggacgtggtgtggtgctgcatgcggcgggactacctggcggccacggacagctacatcaagctggcgatcggcaactcgccgtggccgatcggggtgaccatggtgggcatccacgagcggtcggcccgggagaagatccacaccaacggtgtcgcccacgtgatggacgacgagacgacgcggaagtacctgcagctgcagttcgtgaagcggctcatgaccttctgccagcggaggtacccgacggatccctcgagtcggtcgagttcaacagcctcgccaacggtagcgacctgcagtccctcctcgccgagaagggcgccgagaagaagcacccagaggagacgctccggctggtggctgcctcctgatgccgaatcaccatcgccaatctctgcattttagaagctcaacttcagtaccatttgagaaacagctgattactgaaaattgttctcttgctctcttgttgtatcttgttgtaagttcatcccggtggccgtattatcttgttgtagacgtgataaaaaaaaaaaaaaaaaaaa

SEQ ID NO: 4951 - DNA, 559 bp, Triticum aestivum
  Clone ID: PAT_TA_4951
cccgcacggtcacatcgaagctactggtgcgcttcagccccccccactcggccattgcgcacgcacagctgttccgtgcactccatgccgtccttcgtccctgtcccgccaacccgccagcgtatggcgtgtaacggcctggttccatcgaagctgctagcctgctacaagccccacgagtaggtaccacgaagttagctgcttctattctcgcacaccatttttcactcatgaatgtcccgccaacaaggttccctcgtccttcggccctcccttcgatcgatcactgctcatcggcctctggtcaactgtgcatcctgctctaaatgtcatgctaccctggagacttccacggacccaggcgtgccacacgcgcgggttcgatggcgcgctctttctgtcatggcgtcccctttttcactaaaaaaaggacctcaaactcgtttctcccgctccgggggcgtcgtttcgggtggtgcctgcttatgaacctgccgtgtcatgcttctcctgcgcctatcttttggtggtcctggtgcctgccccggcgcccgctcga

SEQ ID NO: 4952 - DNA, 690 bp, Triticum aestivum
  Clone ID: PAT_TA_4952
ttcggcacgaggcgccgcccgtcctcctcgacatttgctttctcttttcttccgcctcttcttatcttcttgttcgttcctggtattattgatgcgatgaagagctagtttctattgatccgccgtcttcaatggcggcggcgtgatgctcacctttactactggttcgtattcaccgagcatccacccagccagatctcccgttcttgtttttgatttactattttctttctctcgatccaaagatctattcgtgctagcttcttttcgttcctggtatcgatgccatgaagagctagtacctattgatccgccggcttcattggcggcggcgtgatgttcataggtttagggttacccgagcatccgtccagccagacagcccattcttgttcagattcagttttcttttctctcgatctaagatctattcgtgctagatttgtatgtaaatttcgttttctctcggcgaagatcccagcagagaggtggtgaatctccctcgttgaggcctctctaacaatttttaatcttcgcacagtgacgagacgacgtggattttgtggatgtgtgatattctggttctgtcacatctgttgccacggatacatctttatcatttagtatccaatcttctgtttttgatccgagggacctatggatggacagcccttcccgtgctgtgtctac

SEQ ID NO: 4953 - DNA, 1316 bp, Triticum aestivum
  unsure (1)..(1316): unsure at all n locations
  Clone ID: PAT_TA_4953
gcccgacgcacgagacagccgcatcccctcactccaccacctcacctgctgctgcagctcgccaaccctaatccccccagctcggcgcactagcgctcgccccaccccaccccactgcaccgcgctcgcggccggcggcaagcggggcggactcgcgcacgccgtctctcagctcccgcccccggcggcgcggcaaccaggcggatggcccggcgttgaggggaaagccggatcggcacgcttcagatccagcgacgccgaagggaaccgagggtttttatcctgtttattttgtgcgggtgctactgcctccaatgatcctgcgagttccactcttaaacttgtcctgtgactgaggaccttgtgtgcacagtctcatgcgtgcattgacatcttcaggttgaaaatggagcggggttccggttcttgttttcaaggtgtactgtgtcattggcttgtattggtattgatatggctctgtggctgtcagcatgttctgtctcagcaaacaacacttgaaccaaaagataaatttcttctgtctgacccacctattggtctctttgatccgatagagatctcaccatctgttctcccacacaataccaaccctgttgagccactgtcaccaatgtatccgaactacacatcctatgatccggttttggactgggaaaatgtcatgtaaacttttccaagctctcttttatgatggacaagacagcgtctgattgttctgtacctttagcaccactagttgccgatgttatatgttgtccccaagttagtagcttaatgaatatattccaagctgcatatggtggtggaaacaatacgctggccctcaacccagcttcgccgttcgcgtgtctctctgacaccatgagcgtactcgcaacccgaggggctaccgcccacatccccgggttgtgtactctgaggccatcaaatcttactgatgcttcttgtcccatgaaggatattagctcgtttgagagaatggttaatgtaagcaaactcctggatgcatgcaacagtgttgacccactgaaagagtgttgtaggcaatttgccaacctgcaatantggaggcagcggtcatatatctcangaggggnagcatgttcggaantcnacatactgggaatgcgctgggataaagcgttatgacgtaagggtggtnntccactgtcaagaacttcacagaatgggaaacgcttnaatatatcggcgnagnganaatcgccccngnttgngacctccacntangattgaaganaaggctnatcggcagtcactaatcataaaaaaatttt

SEQ ID NO: 4954 - DNA, 1177 bp, Triticum aestivum
  Clone ID: PAT_TA_4954
ggcatgatgtcctcatcgacgggatgctcaaggacgggttgtgggatgtgtataatgatttcccgcggccgcggcgccctgagctctgtgctgatcagcactccattacaagggaggagcaggatgcttatgccgtccagagcaatgagcacggaatagcagctcgagacagcggcgcgtttgattgggaaattgttccggttgaaattccttctggtagaggcagaccgccagttgttgttgacaaggatgagagtcttgcaaagtacgatccagtgaagctgaagaaacttgggccggcttttaagaagaatggctctgtaactgccggcaattcttctagtataagcgatggtgctgctgcaattgtgctggtcagtggggagaaagccaagaaccttggccttcaagttcttgcaaggatcagagggtacgctgatgctgctcaggcacctgagctatttacaacaactccagctcttgctatcccaaaggctatatcaaatgcaggtctccgagattcacaaatagattattatgagataaatgaggctttctcggttgttgcagtggcaaatcagagacttcttggcatctctcctggaaaactgaatttaagtggtggcgctgtttccctgggccatcctatcggttgcagtggtgcacgaatcatagtcaccttgctcgggattcttagacagaaacagggcaagtttggggttgccggggtatgcaacggcgggggtggtgcttcagccatcgtcgtagagtccatgcaagcttcgtcgcgcctgcgttcctcgctgtgatgtgaagtttaccgtgagcatgttggcaagaagagctgaggtgtaaaggttgttgtacgtggactccccctggggtggctgtaggccgacggtgtctcagggcgggccgtggtgcagcgcgcaacacgaagcctcgatgtaagaagcgagccgagcgcgcctcccgcatccgctcagcgactagatgtagtaagataagatgacgtgcagcagaggagatgaaaataattgggtttgcagcccgagcccgtaaatgttgtgaagcaaataactgtgtaactgggagttccttgctggatagctttgtactggtagatcacatggatggcttttggttcccatgggattaaaaaaaaaaaaaaaaaaaa

SEQ ID NO: 4955 - DNA, 1259 bp, Triticum aestivum
  Clone ID: PAT_TA_4955
gacacaaactaagacaagctcagtccagctagccatcctagtaagctacaacttgagcattagtattctccccgccactcacccatggccaaattccagattacaccgttccctggactcgtggaaaacaccgagtttaacttcggtagtctttacttgtacaacatttctaatcccccaagctatgccagcataaaagagaacaatgctaccactgggtggggaggggcaagccttgtcaactggcaaatatatgatggcgatggctcgggcgcgaatctagtcggtcatgcccaagggatgcaaatccatgctggtgcatcgcatcaatccttcacccttgtgttcgagaatgggaggtttaaggggtccacgctctatgtagttggacagacagtgcgcgttgaacaagcaggtgagtggtctatcgttggcgggacaggtgatcttgcgatggcgcgtggtgtagtcaaggtgaaattccatgaaaaagtaaaggatggaaacacatgggagcttcgcttccatggattttgcagcatgcagagcttgcccactctcacaaagactggcccatggggtggacatggtggttcagttacggagtcagaacaaccatggcgcatagagagtatgacaatcgtccatgaggggataattgcaatgttttcatgcagttacgttgacctatctggcaagaggcgcaccacaggttcttggggtggtggtaatggcatccgcacaaaggttgagctggggcctcgggagattttaaaagcagtgtctggaacatatgtcagcctttacaatgggcagactgttattgagtcacttaagtttgtcaccaacgaaggaacgtacggaccatatggccgtacaaccggtacacctttcaacgctgacgtgccgaaagaccaaagcatcgtcgggttctttgggcgtgccgatgatacgcagctcatcgcatttggtgtttacacggtctgaattatgatagagcctgccgacggtgacgcgcgcagtttctggtctatttcaacccagcgtacgtgttttgctttgttcgattcaataagatggatgaactgtccatggggacctccatgttgcagttttaattcgccccctgtatctgggtgcgtgctttgtcgtcacttgttatgtcgagtaaatctattatgtttgatgagaaataaagctcccccgttcaaaaaaaaaaaaaacaaaaaaaaaaaaaaaaaaaaaaaaaaccccctcgg

SEQ ID NO: 4956 - DNA, 824 bp, Triticum aestivum
  unsure (1)..(824): unsure at all n locations
  Clone ID: PAT_TA_4956
gnnntttgaaacccctnctcgaannctttgntacccctgctcgaaattaaccctactaaaggccactctccccggtcccccgccgcggtggccgcccgcgctcggccgcgccggcccccccggccgcgccgttgcggcgcccgccgccatggagatggaggagtacctcaactggaagaagaacgcgccggtgctctatgacctcatcgtgtcccacccgctcgagtggccctcgctcaccgtccagtggctcccctcggggtcgccggcctccgcccgctcccaccgcctcgtcctcggcacccacgcctccgacgactcccccaaccacctcatgctcgtcgacgccgtgctcccgctcccgccgcgcctggccgcggcggccgccgccgagggccgcgccgtcccggccccgtccgtgtccatcggccgctcggcgtcgcatcagggcgaggtcaaccgcgcccggtgcatgccgcagcggccgtacaccgtggccaccaagacctgcgtcgatgaggtgcacgtgtaccacctcggggaggacggcgacaagggcggcgcggatgccgtgctcaggggccatggcgcggaggggtatgggctggcgtggagcgccatgaaggaggggttcctcctgagcggctcgtatgataaagaagatttgcctgtgggatctcaaaggccgggaatgggagcccccggtttcttgggacgcgcaaccggtgtggggttcagggcgtcgtcggtggaatgtgttccttgggcgccctgttgccttgggcacccccttttggggatgnaaaaaccctnatttttggaat

SEQ ID NO: 4957 - DNA, 393 bp, Triticum aestivum
  Clone ID: PAT_TA_4957
acagcacccacgcgtccggtcttccccagatctccgccgcacacgctgacgccgcgctccccctcccctccgctcctctcccaaatttcaaattctcctacgctcccctcccattccatccgcctcctccccgaaaccctaaccgccgccgctgccatggggggctcgcacagccgggaggaccacgacctctccgactccgacgacgacgacacctcctcccgcgccttcgacgcctcctccgacttctccacccctccccccgcctccgcctccaaagccgccagattggcgaccccggcctccgtcgtcgacgacatcgaccaccaccttcgcaacctccaactcaagtactccgagcccatctccccgaaccctagccccgcccccaac

SEQ ID NO: 4958 - DNA, 595 bp, Triticum aestivum
  Clone ID: PAT_TA_4958
actcagtctcacacgcaaaaggctagaaacaagtagttttactttagcctgtgaccaccttaatcctgagacacacccatcagcgtcgtgctcacgagggacctgccgccattgctgcaacttggaacttcatcttcccatcgtgatataaaggagaagctcgacacgatgcagagcgcccagcagaaagcgaggaggaagaacgcgcaggtgctggacgggtccgacatccgggagctggtggagaacgagggggcgttcgcgaagttcgtggagaacaagttccggcaccttgacgccgacggcgacgggaggctgtcgctgagggagctccagcccgccgtcgcggacatcggggccgccatcgggctgccggcgaaggggtcgtcggcgcaggcggaccacatctactccgaggttctaaatgagttcacccacgggaagcaagattcggtgagcaagccagagttccagcacgtgctgtccgacatactcctcggcatggcggccgggctcaagagggacccgatcatgatcctcaggatggagggggaagacctgaacgagtttgtcgagagcacggcgtacgaagcgg

SEQ ID NO: 4959 - DNA, 525 bp, Triticum aestivum
  Clone ID: PAT_TA_4959
ggactgcacctagtagatgaaaggatggatcaacatcagtcatcatgtggagtaattttgaaggtgtttttgtgcccataatttttttctcttccattcctccatcccctgtgtagatagaaaacgaacatgcaacaagtgttaagttattggttttgttccatggtgggtagctgggcctcatatatgcaaaatatttgggcagacgggaggctgcggcaacccttcttcacctctgtgcagttcggccacgaagaagaaagaatacaggcagcaagtcagtcagtcagtcagtcagttccagtgttgtttcattgtccagccagccagcgattctttatttgttgaccttgatttgaatggagaggataaaatgtatgtaagtgagccgaaactgagagctgtcgtctgtaatgctatgcccgaaggatgtattattatgtatgtacaaactgaaaacaacttgtattttctctctgtcaaggcaagaatgccgtttgtaatagaggaagctgcacattattt

SEQ ID NO: 4960 - DNA, 747 bp, Triticum aestivum
  unsure (1)..(747): unsure at all n locations
  Clone ID: PAT_TA_4960
gacttcgagattaagcgatgggctgctggaaaagaaggcaatttgcgggcactgctatcaactatgcaatatgtactttggccagaatgtggatggcagcctgtatccctaacagatctgatcactgctgctgcggttaaaaaggtgtacagaaaggcaactttgtgcatccatcctgataaggtgcaacaaaagggtgcaaatctacagcagaaatatatcgccgagaaggtttttgatcttcttaaggaggcctggaacaaatttaactccgaagagctcttctagacattactatgaggaccatcttcacctgcgtgaggtactcgaggagaagtccgcccaccgcgcatcatcacctgctttggctgcttgaggtgctcaaggaggaacatccaagctggagcggctggtcatgccgtcaggggaaacaatgaagtgatcaagtgaaagccccacccgccattatttgttattgtattgctgtttgcttactgcatccatcttcttccttccaccttgtgcatgtgttgattcgacgactattcacagctgctacatgccagcgggccttcaaccagtaggtgtatattagcgtccttttgctcggttgatggtgggttgtgtgtagcagcggagcgggatcggtgttgtgatttttggggtccaatgtgcttcattttactttgggaaggccaatgttatatggattcatggcttgtcaaaaanaaaaaaaaaanaaaaana

SEQ ID NO: 4961 - DNA, 4260 bp, Triticum aestivum
  Clone ID: PAT_TA_4961
ctctggctgagaagaatgaacggcacatgaatgttcaaagagagcaggcagaaagagatagaatttcggaaagtttacacttcgagattaagcgatgggctgctggaaaagaaggcaccttgcgggcactgctatcaactatgcaatatgcactttggccagaatgtggaaggagataaatatgaatgcaatgggattgttggtttcttctacagacaacacacgcactctgaccccctcgtccgcgtacgcgaggggaaaagcgggttgggggcggcgatgagctgtgtcaccgagcgcccagggggacgccaccaccaccaccgaaccatccagtcccaacgttaaacaaagccacaccacaatcaccttcccgtggtaccgcctcaccgggcccgaagccccccgggcactgcccagcattggaaaaggcggcggccaagggtcggtcaaagggaaggtgccgagggccgggagaggcgcgcggcttcagcagcggcagcagcggcgagagaaaaatcggaatgaagcaggatggccttgagtgctttcatagaaggggtgcgcgatctggcaagtgcgccgaagcaagggggtccaccaagcggatcctgagctctgcgcccacggctaaaagtgtgtacgtcaagcaacctctgcctctccaatcttctagtgcggaaagggatcatctaaatcaacagtggacagaattcgcctataaggcatatatttgtcaggggggctccccgtgaccaatttaactcgcagtacccagtccaaacattactattgaggacgatcttcgagcgtgtaaggtacttagggaaggccgcccaccgtgcatcatcacctcctttaacgtgcttgaggtgctcaaggaggaacgtacaagctctgagagcccaatcatcccagtcaggtaagccaatgaggggagaaagtgaaagacgtaccgactttgatatatgaccttgttcctctttgcttagtcggcccttccacgtcactcctactgcccgtgtaggatgaacccctacttactgtgaaagctggaccccggagcgcttaccagtatgttcattattagggtgcatgtaacgttgcatatggagggttgctgggtgcatgcgggcagatgagaggggcccgattcgcggacagaaatgtgggtggtataacgtggagaagtggttcattggaaggagtcacgcctcgtataaatgtagcttcccaaggctgtccaaaagttacccctggcgtcgactcaagctacgccgtcacgacaagcgctggagaggctgaggagttctgcgactggtacaccttcattggagcagcccaacggagaaacgtgccaagcttgcagcggtctgatcttgcccatgaggggaaacggtgacgtgatcgaaagtgaaagcccaaccccccattagttgccattgtaagtgcgtggtttgccttaatgccatgccaattcttctcgccttccgaacccttgtgcatgtgttgattcagacgactattcacaccttgctacatgccagccggccttcacccagtaggtgtatataagcgtcctctgttgcttcgggtgatggtgttttgcgtgtagcagcggcgcgggatcggttgatgagattggtgtggaccgatctgcgtcattttaattttggaagaccaatggtatatggatgcagtgcttgtcaccttgttgttggtatggccactgtcatactcttccattgtgctagttcattgggaactgatagtaatttttttccctgtaaaaaaccaagttcgtgagcacgatgaaagctgggaagatagggttcaagtatgcaaaatttagaatcaatgccttggttgcggcagccagtatgctcctcaggacggatcgaccatgcagaagaaaaaatactggccggaaatcaatctgtgtgtccgcccgttcaagagttgtttcattgtggagccagccagcgattctttatttgttgaccgagatttgaagggagaggataaaatgtatgtaagtgagccgaaactgagagctgtcgtctgtaatgctatgccggaaggatgtattattatgtatgtacaaactgaaaacaacttgtattttctctctgtaaggcaagaatgccgtacgtcatagaggaagccgcggatgatatgtctagcttgatggatccgctgcaggaaagaaagtttgccacgtggagttctcacaaagattcgactccattgttcgtcaccatccttctgcctacaaccatgtcgtcttctttgatatcaacatgtaagctttggatggtattcaagggccccatctatgttgggactggatgtgtcttttgatggcaggcgctgtacggttatgttgctcccaaaagaaagaggtcaccgtcatggacttgcagctgctggctaaattggtttgcgtgcggtatccgctttgttaacaggttgatcgagaagcagctgaccgagcccatggcagaggagaagcggagattggttttcttgatggaagacaatcaatcacactgcgtatgcactaagtgagattaacgaagcagctgcaggagctgaaactcagaaggctggtattgtaaatcagcagaagttagagaagaaatttggccagtctgctgtttttgttgcatcaactcttcttgagaatggtggtaccctgaggtgtgatagtccagcttctcttctgaaggaagccatacatgtcatcggttgtggctatgaagacaagacagactggggaaaagagattggctggatctatgggtcagttacagaggatatcctaactgggtttaagatgcattgccatggctggcggtcgatttactgcatacctaaaaggcctgcattcaaaggttctgcgcctctcaatctttcggatcgtcttaaccaggttcttcggtgggctcttggatctattgagatcttcttcagcaaccattgcccgctttggtatgggtatggtggcggactgaaatttttggaaagattttcctacatcaactccatcgtctatccttggacgtccattccacttctggcctactgcacgttgccggccatctgcttgttaacgggaaagttcatcactccagagcttagcaatcttgccagtatctggtacatgtctcttttcatctgcatttttgctactggtattctggaaatgagatgggctcgtgtagcggttgacgattggtggaggaatgagcagttctgggtcattggaggtgtatctgcccatctgtttgccgtgttccaaggacttctcaaggtgatagctggtgtggacacgagcttcaccgtcacaacaaaggctggagacgatgaggagttctcggagctgtacaccttcaaatggacaaccctgttgatacccccgaccaccctgctcctgctgaacttcatcggggtggttgccggcatctccaacgctatcaacaacggatatgagtcatgggggccgctcttcgggaagctcttctttgcgttctgggtgattgtccatctttacccgttcctcaagggtcttcttggaaggcagaacaggaccccgacgatcgtcatcgtctggtccatcctgttggcttctatcatctcgctcctgtgggtgcgtgtgaaccctttcctcgccaagaccgacggccctcttctggaggagtgcggtctggactgcacctaggagatgaaaggatggacgatcaaaatgagtcatcatgtggagtaattttgaaggtgtttttgtgcccataaattttttgtcttccattcctccatcccctgtgtagatagaaaacaaacatgcaacaagtgttaagttattggttttgttccatggtgggtagctgggcctcatatatgcaaaatatttgggcagacgggaggctgcggcaacccttcttcacctcacctctgtgcagttcggccacgaagaagcaaggatacagtcagccaagtcagtgttgtttcattgtccagccatccagcaattctttatttgttgaccttgatttaaatggagagggataaaatgtatgtaagtgagccgaaactgagagctgtcgtctgtatgctatgccccaaggattgtattatgtatgtacaaactgaaaacaacttgtatttttctctctgtaaggcaagaatgccgtttgtaatagaggaagctgcacattatttatctagcttgttttggtaaactaaacgggtaaaaaaaaaaaa

SEQ ID NO: 4962 - DNA, 350 bp, Triticum aestivum
  Clone ID: PAT_TA_4962
cagcacatgcgcggcgagcaaggccgcgacatggcagtgcgacacacgtatggtgtggctatgatcgcacacaacggcgtgcacaggctcatccagcagtctgttgggagttagcgttgcagccagcagcatgtgcgaccatggcatgaggtggccagggggctgacctgatgcacagcgcctacgtggagaggaggagtgcaagtagggtaggaaggacaccatttttctttccattgccttctcttggcttgtgccatggccgacgatcttcagggcggcggcgacagcttgggagcgaggaaggcgataacgaacagtctcgttttctttgcgtgctatgtttttga

SEQ ID NO: 4963 - DNA, 805 bp, Triticum aestivum
  unsure (1)..(805): unsure at all n locations
  Clone ID: PAT_TA_4963
agcctgtgcgctaactctgtccttaacgagatcacatatcatccctggggtcgtggctttagcttttgggaagatggcattgtcgcagcctgtcctggcagactcacgaccatacatgcccaaaatggaaggcattgtcatgaggacacgagatactggcgagttgctgtcagccatggctagaatttagaagaaggtggctttctcttgtacgtcgtacccttgaaaaggcggggccagcattcattaagtggggtcaatgggctgcaactcgccctgatcttttcccagctcgtcgctgtgttgagcttgcaaagcttcacagcggagctccggtgcatggctttgcttacagcaaagcttctattgagaaggcatttggccgtaagctatctgaaatatttgaaacctttgaagagaatcctgtagcttctggaagcattgcacaaatacatcgggccacattaaaagatcgtcctgactcgaactcgaccagaaaaaagaaaagagatcaacatcctgtaaagcatgttgcagttaaggtgaggcatcctggtgtgggggaatcaatcaagaaggacttcttactcatcaattttatggcaaaagtttcgaacgctgtccctggattgagctggctaaggctggatgagagcgtccgccagtttgcagttttcatgatgtctcaagttgacctttctagggaagcttctaatttgcatcgtttcagacacaacttccgtagatggagacatgtttcattcccagaaccattgtacccacttgtccatccagctgtccttnn

SEQ ID NO: 4964 - DNA, 797 bp, Triticum aestivum
  unsure (1)..(797): unsure at all n locations
  Clone ID: PAT_TA_4964
cagcagcagcaattacccaanccagcccaccacccattgccgaatcagccaccaccacagctataccaggctaattcacatgtgagctcgcactacaattcccaaagtatgcaagtcgatagatcagctccatgggggcgtggcaaccaagaagcatcgtcggctggctcccatttccctggacaatttcaaggtctacctggacagatgacccaagggattggcggcatgcagacaggccgcctagaagcacctttgacagcggacatggaaaagatgctagtacagcaagtcatgagcatgtcgccggagcagatcaacgcgctgcccccggagcaacgtcagcaggtgcttcagctgcgagacatgctgcgtcaatgatgtacacgacgagcggctgcccgagtagaagaatggcagttcgatggagccgcgcagatcagatcaagtgctccatgctcgacttacgctgtcaccgtgacatcttcattgttcaagctgattgacatccctgctagcctgccgcgtgcctgggaatgtggttgtagaatgaacgcttagcccatttcgttatttataggcagctctttggatatacatttcgactgattgacaaatgtcgcggcatgatgtggtactctgctgctgctgccgccgccaagttttatgccgtgttgtgattgaattctggtccttgtctgatgacgggtctagctcttgagatgactgattgatataatatgagagtggtggtaaacgttcttgtttgtaaaaaaaaagaaagggagaaaaaaaaa

SEQ ID NO: 4965 - DNA, 666 bp, Triticum aestivum
  Clone ID: PAT_TA_4965
cgcgcttcatctcttgtcttcctccctccccatttcgatccgcggctctctcaaatccgacgacacccagcgattccagggcgaggtgatggcctttgcaaggcggaggctgggagcacgatggagagacgcgagaggtggcgtggagctgggcggggtcgtggcatgaagaggaggaactcggcggcatcggcgcctcggggagctcgatccgcgccgccgcggagctccaggcggcacgcctcccttcctgttgtggcggtgctctagggagccacgtcatgctaccccaccgccgcgcaagctctatgtccccgcgcgtggtaccccgatggcggctcctcctcgacctcaacgacgacatcggcggcgcacgaggtggagaggtggtggccgcacctcctcatcacagcagccgccgacatggctcctcatgcgggtatcgagccgccggcgccgtctgggataggagctcctccgcggggccatggcgggcttgaaggagaggggcaccgtccgagacaggagcggtggtggccattgtcgacgagttgctccacgacctccaccaacccacgcccgcaccctcctcccctgttgccactgagttcgtccctggatctttttagttcgttttgtttcctcaccggtacttactgaattagt

SEQ ID NO: 4966 - DNA, 973 bp, Triticum aestivum
  Clone ID: PAT_TA_4966
cggtcccgcggggccgtgctgcagggggggcggcggccatggcgctcgcatcgggctcgggcggcggcggcgggagcgacttctccgtgatggtgataggctccgacttcgcggtggacgccggcgcggcgctcctcgcctcccccgccgaccgcgaggagtggcacgactgcgcccccgacctcggcgacgacttctccgacctcgaggagctccaggtggtccgcgtgcagggcgcggacagatccggccggcccgtcgtccgggtcgtcggcaagttcttccccgctcctgttatagatggtggacgtctgaagaggtatgtgtttcacaagctccgcaccgagttgccagagggtccgttctgcatcttgtacgttcacaccactgtacaatctgatgataacaatcctggaatgacaatcttgagggggatttatgaagaacttccagctgactacaaggaaaggctgcaaatattctacttcctgcatccggggctttattccgccctcgccagggcctcacctggcaggctcgtcttatgcggagggttctattggaaaatcaagtatgttagtcggctggagtatctatggggggacatcaaaaagggtgaagttgagattccagattttgttactgaacatgacaagatccttgagcaccgaccattgacagactatggtatagaacctgatcctctgcatctcgctgatatacctgctgcggggtactcacttggtaggtatgaagacaaatggtctcctgaagatcgctggaattctcgcaattacatgtgacattgtggtgctgttgaaggcttgtaagttctctgtgtacatatgtcatagcaaatggcgatgcataccggattgttgtggaaactttgttcataataaggtagtgtctcaaattgtgggcgtgtatgacatatttgtagagacaataccaaatggatgacagattggac

SEQ ID NO: 4967 - DNA, 1262 bp, Triticum aestivum
  Clone ID: PAT_TA_4967
gaggacgatggcggcaacatggcaggcccagacctcccggtcatgcaagcacatcagagggcccggctctcggtgcccgccgctccagtggcggtccccgacctggcgtcggcctcgacgcccccgatcctcggggagctgaagctctcgccgctcaccctggcccgcgtgtcaaggcccgtcggccgctacaccgcggcgtcggcgccgcccccgaggcgcgagtcggcgccgcattcgccgcacgtgttcctcgtctcccccgctggcaccctggagagcggcaacctgaacgctggccggttggcaacgaacgaaccaacttaggaacggcttccgcttcacgtgccttgttacgtagcctggtcatcgaatccggaggagttgtaccttgtaggtggtcatctgagactaacctgttgttggcttctctgcttccggatgtggagccctttctttgtatcctttgctctgtaaccttagacatcgctgggtattgacgttgtgtgtgtggatggatttggtggtgctacgctgttgcacaatgctataacgtccagttaaccctgccagccccaacgagttggccagggccgcaagggcgtcgtgcggcaacgaacgaacgaacttgcgcaagtcttcttcttcacggaccttgttacagctcggcgtcgccctgaacaagaacaatggcggcaacatggaggccaagagctacctgtcggcgtcgctgaacctgatgacggacgcctgggactcgatgcccgctggagtcgtcgccggtgggggtcctgcagaggaccgccttcggatcggtgtccagcagcaccggcagcagccccaggcaggagtaccacggcgtgtatgatggtaacccgcgggatgatctcggctccatcgtcgtgaatcaccccagcatccgcctgatgtgagcttcttcttctgagctctgaccatggcagctgcaacgagaaggctggccagttgtggcgacggacgaacctgggcgagtcttcttcttcagggaccttgttacatatcaacatcagcatatccaggagcattttacgttgtagtttgtcatttgagactaatctgttgctgtcttctctgcttcgggatgttgagttctttttacctttttctctgtaaccttagacttcgctgggtactgacgtttttttgtgtgtgtgtgtgtgtggatggatttggtagtgctacgttgttgcataatgtcataatgtccaattaaaggtgcgaaa

SEQ ID NO: 4968 - DNA, 896 bp, Triticum aestivum
  unsure (1)..(896): unsure at all n locations
  Clone ID: PAT_TA_4968
cggcacccggctcgaggcttgcatgttatgatttgcccaatctgctcttcctacacccatggatagggacaaagggcaggtacacaaatagccaagaacacaaggagacgtgcaggtctgcgtttctgagttatatctcttttagcaccagcaattaaatggtgtgtagctggtcaggcgtgcttgcctaaaatgtactttagtagttgctagatccatgctagcttctatgttgttcttgcagcctcagctagctaattttatttaaagcaaatgttgttctatccttccaattactgttattcagttcttcttttcttttttctgttgtcgttcacagtacaaatgttatgagaatttcatgaattttgtcatatctttctcccagttaccttaattttgtaaattgtggtctaattcaattttgagtttgttttcagaaaagcctactttaaagctgtgtaaatccattatttcctttgagtttgccgtggaggtgagttgggaaccttttttatacttggtggatgcactgatgtagtgacggagacttgcctgaatgttgttttcctcagcgcgaagtgcttacaattctcaaaggcgtcaacaagtccaggaggagattgacaaggtgcaggcaagatctcaagttcattgctgtctttttctgtttgaacattttcttatttggagttgcagccgatttatggtgtgtcaaccgacttggcttaggatgtattgtagttggtttggttgcatcaaccaacaagttttattatgtattgcagttggtttggtaccatcagccgattggccagttggaaaaccagcggggaaaacatgtactgtgagctcccctcgcattcagagtttagagcttgatnaacaatgttgtg

SEQ ID NO: 4969 - DNA, 721 bp, Triticum aestivum
  Clone ID: PAT_TA_4969
tcatgccatggatgtggataagcatggcgatgttgcctgctcatcaacatcacagcaccacgacgaacacgtcctcttttgacccggtgacgccccaactctcaacaaattatcatccccattatatattatgatgaactcacatgttcatcctgaatcatcaaatggaatattcctaggtcacgactctgtcctgaactcaactcatgagtaatgtaatgagagcaactccaacgggtcgacccaaacggacggcgtttttatccgctttttatccgtttgggtcggccgcccgcccgccgtccgccctcttttaaatttaggtcggcagtgcgtccaacgggtcaacccatttcatgaccgcgcacgctttagatcatgctagcggccatgccgtcgctctgtttttggcgctccagcggacgggaaaagttcgcgcgcgcggacgaaaagcggcctagcgcatgctggttttggcgctccagcgtgcaggaaaggttcgcgcgcgccgcggccggcgctcgttataagaaggagcttcctccacactctgtttgtcgcccactcgtctcgccccctctcactagcctcgtcgcctctgcgccagcatgtcgatgcgccgcctgggcgctttggatttttgcggagtctgcgagcgtcgctccagcgccttctcctccgagatctggtttggcgagaaacgcctcatcctcggcacctt

SEQ ID NO: 4970 - DNA, 1234 bp, Triticum aestivum
  Clone ID: PAT_TA_4970
gcaatggcggcggcgctccgcctgctgccgtcgacggcgacgcgcctccgctttcgtccccgcctccctctctccaccgccgcgtcgctcttctcaccgccctccaaggccgtcctctacgaccaacacggcccgcccgaccaagtcctcagggtggaggatgtgccgccggtggagctcggggagcgcggcgtctgcgtgaagatgctagccgcacccatcaacccctccgacatcaaccgcgtccagggcgtctaccccgtcaggcctcccctccccgccgccgtcgctgggtacgagggcgtcgcccaggtccacgccgttggccccgccgtcacccgccccctctcccccggcgactgggtcatcccttccccgccctccttcggaacatggcagacctacattgtgaagccggaagatgtgtggcacaaggtccgtgacgatgttccggtggaatacgctgccactgtcacggtcaaccccttgacagcgctcaggatgctgcaggactttgtgaaactcaaacctggtgatgctgttgtccagaacggctcgaccagcatcgttggtcagtgtgttattcagctcgccaaagtgcagggaattcgcaccatcaacatcataagggacaggcctgggtcagaagaagcaaaagagaaacttaaacagcttggtgcagatgaggtcttcaccgaaagtcagctagatgtaaagaatgtcaagagcttgctgggcgctttaccagaacctgcattaggatttaactgcgttggaggaaatgctgcatctttgatactgaagttattaaggcaaggaggcaccatggtgacatatggcggaatgtccaagaaacctgtgactgtttctacttcgtctttcatatttaaggatctttccctcagagggttctggctacagaagtggatgaattcggacaagtcagaggaatgcagaacaatgatagactacctcttgggccttgtgcatgaaggcaaacttaaatatgagatggagttgacccccttcagcgagttcagcctggctcttgataaggcccttggaaaacacggaagccagccaaagcaggttcttaggttctgatgagacgaagatgatgacgaggtagctagtattgtgttggccctggtgcaaatatttgtatggtcgtatcacttgtgtgcatgcgtgtgtgtagttgctagtcggtggttgagagttttttggtttgcta

SEQ ID NO: 4971 - DNA, 1159 bp, Triticum aestivum
  Clone ID: PAT_TA_4971
cctgactgaccttctcaatgccttcaccaacgacattgtgtgcgaagctgtgtccggcaggcttttcagggaacgaggccataaaaaactctttcgagagctcgtcgaggccaactcattgctcctgggcggattcaacctagaggactacttccccatgttggtgaagatggacatcatcaagaggattgtttgcgccaaggcccagaaggtgaacaagatgtgggacaacctgctcaataatatcatcgatgagcatgcaagaaagtcggtgccagaacacaacaacgaggatagtgacttcaccgatgtgttgctttctatccaacaagagtacaaactcacgagagaccatattaaggctcagttagagatcctgttcgaagctggcacagatacatcattcatagtgttggaatatgcgatggtccagctcatgcgaaaaccccacctcatgaacaagctacaagctgaggtgaggagcactataaccaaggggaaagaaatagttgccgaagacgatctcgatagtttggcctacctaaaggcagtcattaaagagacactccggctccatatgcctgggccactcctcataccccacctctccatggccgactgcaacataaagggctacacgataccatcaggaatacgtgtcatcatcaacagttgggctcttgcaagggaccctagtagttcggagcatgcggatgagttcatgcctgagcggtttatggaatgtggtagcgccgcaactatggactataagggaaatgacttccaatacttgccctttggggccgggcgaaggatttgcccaggcatgaactatgcgactgcgagcattgaaatcatgctagcgaatctcatgtaccacttcaactggaagctaccagtagagttgatggacgaaggtggcatcagtatgactgaattttttgggatgactgtgcatcgaaaggagaagctcctcctagtccccgtagtgccagaagattaatacatcggtccactgtattgtgtgtgtgcatcagaatgtgtacctaccataatagtatcgtgaatgtagcgtttgtacttcttattaagcaccggtgtaatgaataattatttgatgggattttgtacgaaatgatacaagttaatatctgtgcat

SEQ ID NO: 4972 - DNA, 677 bp, Triticum aestivum
  Clone ID: PAT_TA_4972
atgaaggccaccgcgcaggagctggacagcctcgagagggtcagaagagcttcggtggcattaaacgtgtggcaaccacaagttgttcatgggcgtcagaaacagttggttcagcaatgcactgttcctgttgattctcgtcttagtgctctacacatggagctgaaagtttgtaagcaacaaatagcaacttacaagaatgcttacaacaaggagaagctcaagttgaatgagtatgaggaagcattgagacgagctaaatatcatcctatgcagaatagtagtgatacaagcgcacctggaaatgagccacaagcaaagaggaagagactgaagtaagaccattgttcaccatcggatctcatttgcctcaagataaaggatccgcagtgcagcaagtgccaagatatccgtttcggggaaaagatccaaatgcactgtggatcctccgtcggttcatttgtttgggcatgtgtgcccacatgatgtacgtggcattgttcctttccagccagaatgaacgaatgaagctcagctgctcccttccgagcgccctacccttctttgccttttcgtttgcccccaataccccttgtccctccccttcctgccgcgacagtgttattcctatcgaatgtataccgtgcagccgccagctactccgtgtggacgccagc

SEQ ID NO: 4973 - DNA, 1134 bp, Triticum aestivum
  Clone ID: PAT_TA_4973
cccgtccaaaaatgtggcgccgccacctcctccgccgcctcctaccatctccggccaccgccggcaccccctccccgttggttcgccacctctccacgacccccacccccttctccaccaccgataccacctccatcgcctcctccctcgccgcggcggtcaccaagctctcatccaccccggcccccgccacctccccggacgcctacttctccctccacttctccgacgtccgccctaccaacgcgctcctcgccgagacgctctccctctcccctcccgccacctcgcgcgccgccgctgacctcttccgcttcctcgtccgccgctcgctccacccctccgacggtgctctcgctctcgtcgtccgccacctcgcccgccgccgcgactttcccgccgtccgcacgctccttcaggagttcccctccgcgctagggccagacacagtcgacgcctacctctttcatctggcgagagctgggcgcgccacggacgcgctcaaggtgttcgacgaattgcctggggagcttcgcacccgtggggcgctcacttcgctggtctcctccctctcgtccgagggcttcccacagcttgcagagcgtgctgtcaagaagatcgcccatgagatcttcccggatgacaatatttgcactttgctggtatctggttatgctgatgctggtaagcttgaccatgcgctaaggctgatcggtgagacacgaaatggtgggttccagccaggtttggatgcctacaatgctgttcttgattgtgtctgccgtctctgccgcaagaaagacccgttaaggatgcctgtagaggcagagaagttcttagttgacatggaggccaatggcattccccgtgatgcgggaacgttccgggtgctgataaaaaatctctgtaagattcgcaggactgaggatgcaatgaacctgttccgacaaatgggcgaagtggggatgctcgccagatgctgacacatatcttgtgcttatcaagagcttgtaccaggctgccaggatctctgaaggggatgagttgatgatttggatgcggtctgcaggttttggagataaacttgataggaaggcatattatgggttcatcaaggttttatgtgggattgag

SEQ ID NO: 4974 - DNA, 418 bp, Triticum aestivum
  Clone ID: PAT_TA_4974
gccttccgtgcccgtttctacatggagccaaagagctccgacagcggctctatggcaagtgggcccggtgggcgtggaccgacgtccggctcgtcggcgtcacgcggtactcgggcccccggcggtgcagctgtcaagccccttccagctctgaaggacaatgtgaagaacgtcatgttctactgctgaagcccgtgaaggcggagcttaaaatgctccttaagtcggcgggtcgccccttgtcattgtaattatgtgaagaaagtagtaataatccgccggccgctgtctcgtgcgccgtactatgctggcctatgtttgctgaagtaccatctatgcgtgtgctttgttatgttgtaaatgttgaacctcgagtacttttaagggtctggagcttgaaaacccgagcattcaagcc

SEQ ID NO: 4975 - DNA, 1089 bp, Triticum aestivum
  Clone ID: PAT_TA_4975
tattcctctggtcaccgacagacctacgatcatatttggtgctgatgtgacccatcctcatcctggcgaggacagcagtccctcgatcgctgctgttgtagcctcccaagattggcctgaggttacgaggtacgcggggttagtttctgctcaggcgcaccggcaagagctgatagaggatttgtacaaggtccggcaagatccccagaaaggaccagtcagtagtggcatgattagggagctacttatatcctttaagaaatcaaccggtgagaagccccagcggataatattttacagggatggcgttagcgagggccagttttaccaagttctgctgtttgaactcaatgcgatccgaaaagcctgtgcttccctggaggcaaactaccagccacaggtgactttcatcgtggttcagaaacgccaccacacgagactatttgcgcacaatcacaatgataagaactcgatggacaggagtggaaacatactcccaggtaccgttgtggacacgaagatctgtcatccgactgagtttgacttctacttgtacagccatgctggcatccagggaacaagccgtcctgctcattatcacgttctatgggacgagaacaaattcactgctgatgagttgcaaactctaacaaacaacttgtgctacacgtatgctaggtgcacccgctctgtatcaattgtgcccccggcatattatgctcatttggcagccttccgggctcggttttacatggaaccggatacctctgacagtgggtccatggcaagcggtgcccgtggccctacacagggtggacgcaataccaggccgtttgggaacgttgctgtcaggcccctccccgccctgaaagaaaacgtgaagcgggtcatgttttactgttaaggtcggatggtcattgtttacactattatgcaaacctgaagatattcgactgagtttgggtgtgttaaaagtatccgcactgcattggtggcactgggagatctccgccatgcaaaaactttaagtggtgcgcaatgtgaaactctgtaaccgactacctatctgtggtcgtatttgaactaccc

SEQ ID NO: 4976 - DNA, 2930 bp, Triticum aestivum
  Clone ID: PAT_TA_4976
gccgtcgcccattaaacactcctcgcccccggccctgcaagcttgatcctccttttagtctgatgcctgagcacgaagactctcttgatctggatttgaagcgcatgtacgacgtgcttctcccgttcttttctcgaggctgttccccaagtcaggtgtattaattgaagcaggtcctaatgatccgccaaccgcgcgctcacgcaaaatagcacggtcgcggccaggaacactgtcttggggcatggattgtcgaggcgtatccccctggtgacagatagacctaccattctatttagtgctggcgtgacccagcctcaccctatcggctatatttttgcctcaaatgcaaccagctgcacctcccgaggctggcccggggtttgacggtgcgcggggttaatttcctcgtgcgtgctactgcacagtgagtcatacacattattctccgatgctagtgagtcacaacaaaattggggcagggtcggcaagttcgcgtgggcttttgtagtagcttcgcccgaaacgggtgaggttttgcggtactggtgttctgtcttgtgctggatttatgggccctatttcctggatggtctgtggttcggaccctatgcgccccgaaaagcctgtgaggcccgtgacccaaactagcgacctgaggagacttttttcgtaattcagaaacgcgaccacacgaccgtatatacgcaccatgactaggataagcactcgatgggcataagtaggatcatcctctcgggaactgtagtgcactcgaaagatacgtcgtccgactgaatttgaattccaattgtgcagccatgctggcagcaagggcaccagccgccctgctcattcatcatgtcttgtgggacgtgaacaacgtcacggctgacgcattgcagacgcttaccaacaacctctgctacacctacgcgaggatgcactgattcgatgtcgaatgtccgccctgcatactatgctcatccgggcgccttccgtgcccgtttctagacggagtcagaaagctgcatcacagggcatattacaaagatccataggcggaggaatttggcataaaaatagatgagcaacttgcatcggttgaagctcgtgttctgcctccgttaagcccctaagatacccatagatagattggcaggacgagaaggatggtcttacccagggtcggccaatggaacatgatgaacaagaaaatggtcaatggtggtagagtcagccactgggcatgtattaacttctctcggaatgtgcaagataatgctgccaaggttttctgtcatgagttggctataatgtgccaaatatctggaatgaactttgcacctgaacctgtgctgcccgtacttagtgcgaggcctgaacacgtggaaagagcactgaaggcacgttatcatgatgccatgaacgcaagcaaacccccgggcaaagaacttgacctgctaattgttatactgccggataataatggttctctttatggggaccttaaaagaatttgtgagactgaacttggattggtatcccagtgttgtcttacaaaacatgtttttaagatgagcaagcagtatcttgcaaatgtagctctcaaaatcaatgttaaggtggggggaaggaatactgttcttgtggatgctttggcaaggaggattcgccttgttaccgacagaccgaccataatatttggtgctgatgttacacatccccaccctggagaagattctagcccttccattgcagctgtggttgcttctcaagactggcctgagataaccaagtacgcaggattagtgagtgcccaagcccataggcaagagctgatacaggatctttttaaagtatggcaagatccccaaagaggaactgtgactggcggcatgatcaaggagcttctcatatctttcaagagggcaactggacagaaacctcagagaatcatattttacagggatggtgtcagcgagggacagttctatcaagttctgttgtttgaacttgatgccattcggaaggcctgtgcatccttggagcccaattatcagcctccagttacctttgtggttgtccagaagcgtcatcacaccaggcttttcgctaacaatcacaatgatcagcgtactgttgatagaagcgggaacatactgcctggcaccgttgttgactcgaagatctgccatccgacagaatttgatttctacttgtgcagccatgctggcattcagggaacaagccggcctgctcattatcatgttctgtgggacgagaacaaatttactgctgatgagttgcaaactctcacaaacaacttgtgctacacatatgctcgatgcacccgctccgtgtcaattgttcctcctgcatattatgcacatctggcagccttccgggctcggttctacatggagccggacacctctgacagcgggtccgtggctagcggtgcacgtggcggtcctccacagggcggtccacgcagcagcaccaggttcgggaatgttgctgtcaggcctctccctgccctcaaggaaaacgtcaagcgtgtcatgttttactgctaagataagatccgggtggttaccgtgagggtacttgaagcacctgcgagtagtattggtgatgctgttcaacaccattgtgcaaacctatatcgaagtatctgttgtactctgttttattgcttgcctagggtattctaagtacttgcaccggattggcgaccggtgcacaaaccttttaagctatttgactggattgggtgtcatttatctgttgtgctgctccagtggtgcggctagaagctttcgctttcgcggctgtgccttgtgagatgtctgcgtagccatatatacatttgtatgactggtgtttgaaatatttatgaacttgtgtcatggaatcccctgctgggg

SEQ ID NO: 4977 - DNA, 572 bp, Triticum aestivum
  Clone ID: PAT_TA_4977
ccacgcgtccgtgaactgacagtagcgagcgacgaacccctgatccggaatccccaaaacctcgcctcccggtctccccgccgcagccgctgtccggcgccgcggcgccccggccggcgagatgaagagccccttccggccgcgcgccgcccccttcgtatccgcgctcgtcctcctgctgctcgctctggtcccgtccccggaggcggccgagcccaccacgccggggacccggacgcgcaaactcggccgcgacgccggctcctcggtcttctcgctcttcaacatgaagccccagagcaagttctggacggaatcggtcatgcggacagagttcgatgacttggagggctcgaagtcaagggactccatcaacattgggcttctcaacttcacgagagctggtaatgttgcaaactatatgaacctggcggaagttgattcgatatatttttcaatccctgtcaacttcatctttatgggatttgatggcaaagggggccatgagtttaagttgggacgtgaagaactagagcgctggtttacaaaaattgatcacatatttgagcata

SEQ ID NO: 4978 - DNA, 472 bp, Triticum aestivum
  Clone ID: PAT_TA_4978
tactacctctgtccaaattagttgtcactaaatggatgtattttgcacgtcaatccttacctaccaccacaaggtgcgcgggggtcaagtgaggtggggggagcaacgatatttcttttgcacttttgaatattttaacgatattgataaaaatcttggttatgtaacggttattgtctatgttatcttatgtccagtcatgagttttacctcttaaggagggtgcaagttatccaagccccttttactctatcctaagtagcttgttggcgggtatttggagagaaaattatatattatgttttgacatgatgttcaaacctttcttttgttacgtgctgttatatttggagttgcatgtttctatatcagaagactagttacatgttgtggtgctggcaagcatagaaaggatcttactggcatgcagcgagatgacgtatggctgaatagtttatctggtgtatgtttc

SEQ ID NO: 4979 - DNA, 482 bp, Triticum aestivum
  Clone ID: PAT_TA_4979
cccacgcgtccgcggacgcgtgggttagtatcacaggtttatactaattttccaaccaggagaactccagttctgaaaggtttatactcaccggcgtcctattcccagtagaaattactggataggagcaaaattgtttttcaagatcatgttagtattttttttataatagagccataggctacaccaaacaaattggattgttttgatttcattgtgtggttgtgcttgcgatccaggtgacttgagctgcggcttggatggggatgttggtgctgttcaagaggcctgctggggttgcctttttcaagggtctgaaccagggcaggatctatggaaggagttcacgactccgactcgacgcgaaatggttgtgcttcatttttttttttaggtgggaaaatttcttttctttatgaaacaattaatacttcatatattttatttaaacagatgttgcgtaaacaattggttctttttat

SEQ ID NO: 4980 - DNA, 955 bp, Triticum aestivum
  unsure (1)..(955): unsure at all n locations
  Clone ID: PAT_TA_4980
gacatgatctaacaatgttttacgcttcaatgaccaaacacaagtctcgttcagacttacacacgatgtattgaaaaataaggtaacatcaggcataagcaatgttaggtactcgtactaataacagattgccgacattattttggactctaaaagactcgcagataaattggttctgggaaggtctcagactactcaaggtgaggtagcttctctcggaaaacaccgctacttgttgtaaaaagaaattccttagatacagcactatcctgcacttggttggctgcccctccctccctcctacatcgcgggatggaaccccgcggattgcaagagaaccgccttgatctcctcgggctgaagaccagggccatccttgcattgctcagccttgaagacgtccaaggcaaagccattgaagcagctgataacggcctgctgcacatccccaccgggggcttcgttcgcctttcattggcagagagccacaaagcccngggccttgcgagggcacagcaatgtggatgtttgacgggcccggccnttcccggagcctaacctcaacggttggctgctggccggttagggctttggcagcgcactcgggcaaagctcctcctttcaacgcgggatggcagcgcgggcaacgtcggagtcagagggtggaagcttgtgggcgtcggaggcagcgagggcatggaaggagacgactcaagctcattctgaagatcactgatcttgtgcaggagctccttgaggtactcgatcgcgtcgccgagaatagaagccctgtccatcttgctgatcttcggcacgacggacctgagcatgtagagccggtcattgagcttcttccgacgacggcgctccgccatgaggttcttggctggcattcccttcttcttccccggccccgcggccccacccccaaattccggaccggtacctgcaggcg

SEQ ID NO: 4981 - DNA, 1525 bp, Triticum aestivum
  Clone ID: PAT_TA_4981
gaattcgccgcgcggtgcatcctgccgcggcctgcgctgccctccaggggttcgttctcgtgcgccgtgcctctgcggggcctggacaggccgttgcgccgacgtctccgtgcattgcctggtgcagaccctgtcctgacgtccgcgcctttcaggaggctcttcccaatggtccctccgcgctttcggggggggtctttgggtgcttgctccagtccttcacgtcgcccgctccctgcctggcggagccccggggcagctaggcggtcggctcatggggcggtgcaagcgatttttgcattgcacattgcctttttggaatgggatgtctatgaacgggatgaactgccacagtggaggcgtggggtctagacgacttaagtatacctcattcttccacaatatcaatgcgagttcacttcgaactgcaaagatgatgtgtccagatccatttgatgatcttttgaagactgtgataatgaatgatcagctagcttgtgatcctgatgttggcggttgcggaaaaccaaatcatatacaccacattctttctagttcccctcatgtttttacagttgttttgggatggcagaacagcaaagaaagtgttggtgacatagctgcaaccttggctggtatttcaactgagattgacatcagtgttttctaccgtggtctagatcaaggaagcaaacattttctggtgtcagtggtttgttactatgggcagcattatcattgctttgctttcgaggatgagcactgggtcatgtatgatgaccagactgttaaggttattggtagctgggctgatgtggtcattatgtgtgagaaaggtcatttacaacctcaagtgctcttctttgaagctgcaaattaattttcttcaaagttcaagggtgctgtgctgtgccgtggcgtggttaacgtgtcttctgagatataggtttttcctggtgactgaaggttagcgatagaatacaaaattcgttttgagctatgggggataatggtggtaattcagcagttgcactggcctgtcggttttgtggagccctgccttaaataaatggtcatccgagcgtttgctaaaaggagagaagtggtgatatatattttccttttgaactttggatatatagcctgaccccatatcctgtcgaatgcgattttgccgtggaggactgtaagcggggataactctagtagatcatgtgccgccccagagaaattactcacgagtgctgctgaatatgctgggagcctatcaatatatacggtttttctgtgcttatgatgtgaaggaatgttgtatcgtgttgtgtgtgaccaacggatgggtatcatgaaaggagaagggctgctctcatttttatttttgtttcaaattcttgggatggggtttcttatcattccgattgacaagatgtattatctcagaatgttgtgaagtccctttgcgctggccatgacgaacacataaaattactgctcctccccccaaaaaaaaaaaactcgagactag

SEQ ID NO: 4982 - DNA, 1214 bp, Triticum aestivum
  unsure (1)..(1214): unsure at all n locations
  Clone ID: PAT_TA_4982
gtcggacccatgccattccagtccatgaccccaaccaaacacatccgatccgttcactcgtccggttcgcccagtgcacccaagcaaggctcgccccaagcatacaagccggagcagattaggcacacaagaatcatcactgccgcgaatcccgtaccaaattcataagccagttcccgcggcatcggcagcgagccagcgaccacctccgaatctccaccccaggaagagtagaagcaggccagaagagaaggcgcgcgcgcgcaggaggccacgaatggcgcttcgctgttccctgcccgcgacctgttcgatgttttgccccaaacggccagagcaccccagttggcacgcgctccctccgcgcttcgtcgtcagcttcggctcttgcccgcggtccaggccgagcctgggacccgtgctcgccgcccgcgcctgggcactgcgtgcgagcgaccccaaggctggccggctggtgatcggcggcgggccgcgcagcgccgaccccgactccgactccgaagacgacgacgaaggccccgtgcggatgacggaccangagcggaggacgctgcggaggaagatacgggagatgatggaccggatgccggagacgccgggagcttgactgacccggaggagaanaagccaagatganggagctggttgaccaagtaccanctgggttgtcnaggangaagaacccggagtgggccccgagggaccccaagaacgggtattgggctttngggccttggaaccaatttttttngacaaagantnacccattcaaancccttgaaaaaanaaggggatggaacgccccacnnaacnaatnantggggggtggggattgaaatggcnaaaaaaaagggaagggggggtncttgggggaagggattgaaacaaactttacntttttaaaanccccgggtncaagggggatttggttnaaaannaaaanaaaaagggaattttgggggaaaccaaaaaaccccgnggggtttnnaccngggaaantttttngggncccccnnnttngaaaattnggggggccttcnngggggccaaaaaaaacccgggggnnnncaaaaganaaaaaaaattttttggggggnacaaaacccnaanaattgggggcaaanaaaaactttggggcctttcnnnnnaaaangggggnnaatnnngnnaaaaacgnttttttngggggaaaa

SEQ ID NO: 4983 - DNA, 1034 bp, Triticum aestivum
  Clone ID: PAT_TA_4983
gcagggaccccaccggtgcaacaccgggactggatccacaatcgctctcatagtcgtaaccgtactcctgatgtttgcttgaggctgggtccccacctggctggctatccgcggcacacagttcgccgcccattttcaatcactcgacctggctgccccgggcctcgccttatggcatccgtcgcgctgccgaagggacccaagcgcccttgtccggatccccgaccagctgagcttggcctgcgattttcggactctgccgcatttgtctagagcaaggatcattcggaaccatggttgtattctccttgagctgtgctcgggtgagacattattccagacccatgaaaacttggagcacttggcgatgatggagagggttctaggtcctctcccgcggctcatgctggaaagggccgaccgccatgcgcagaagtacatcagaagaggaaggttgaactggccagaaggtgcaacgacacgggagagcatgagagctgttctcaagctgcctcgcctccagaacctggtgatgcagcatgtggatcactctgccggggacctcatcgggctgctgcacggcctcctggcatacgagccttcggccaggctgaccgctcaggaagccctgagccaccgcttcttcaggaggcaccgtgaaaggcggtcgctatgaccaagcaacaatgtccgcggctgacccaaacaaacactgacagaaacctatgaggatttgcaggcttgcagcaaggaaataacaagcttgagagttgtatctgaatctccctggatataacaggacagggagcagtagccatagttaaaagttcagaagaggcttcgtgtgttgtggctttatgtactatagcgctgaaagagaattcaaaagtctcactgtcttgtattcaaactctggcatgttccctcgcagcggaagctggggcaaattaaaacaaaccgtcgaagctgtgtatgtttacgcccctagaaatggtatggtaaaggatcaaaaaaaaaaataaaaaaaaaaaaaa

SEQ ID NO: 4984 - DNA, 401 bp, Triticum aestivum
  Clone ID: PAT_TA_4984
cccacgcgtccgcggacgcgtggggttttttttgggtacttcaatatggactacatacgggctgaaatgtttgaaatcttatattttgtgaatggaggttgtatatttttataaaagcaaagaaacaacttgcataagtgcaccctgtgttaggattaacttgattttaatcttgaaatactgaatgatcggcgatgtaatttcatgtttgcttcaaaatgaggcatcaaagatgaataactctggaatgccaccttttctcatgtatttttccctcaagaaaaagtagtatgaaaatactgattgatccctcttcatcttttcgatgttcttttgcatcttatcaaaaatatgtgcaagtcttcaggggtcaattaatgtttgtaattggctacattaag

SEQ ID NO: 4985 - DNA, 897 bp, Triticum aestivum
  Clone ID: PAT_TA_4985
ggaattcggtacgacccacctgacagcctccccttgcggccgggtcgcacgtacgacccggtcgtacaggattattttgctataaatggggctcgccttccccattgctcatcatcacctcgcgctcacccctgcatccttgtgtccgttcctccaatttttgctccgcccatgcccatgcctgttcctcgccggaggccactagacaagctctgccccatcacttgcgcgagaggaagccacggcggcgcgccgctggctgccacgctgttgactccggcggtggctgcggcactcgcgatggcatgctcagcttccttgtcggcggcgaggaggccatcctcgcatgcctcgggctgctctttgcccaccttggtcgacttctacacggccggtcaggagcggcgagcagcaaaatcgcgaggacagttggatcaacgcgcagctctggcactcctgcttgaagatgtgtgacgctgacgcctcggcgtctgcaaggtggagcccaggctggaggccgcgcgttctgcccttgcgcgatggctgcgacctatgcgctggtgattggtgacgaggaagaagagggtggagggcatgccctcgaagaacctgatggcaaatcaccgccgtcgcaagctaccttgatcatcaaggtaaagagaccaaacgtcaatcgaaagaataggggtagaatcctgggaataaatctgcatgtgtgttcttggttttgggcatctagatggatagaacgtctagcctggggagggcacgtttagttcgctcaggagggcacgctggatctgtgtccattgcagttttccactaatttggttcctgatcaattttatcggtttgtcgggcggcggatcgtttctttcagctgcttgcatgatgtgt

SEQ ID NO: 4986 - DNA, 898 bp, Triticum aestivum
  Clone ID: PAT_TA_4986
tacagcgacgccggggcgcgcaccaaggccggcggggtgggcgccgcgatcaccacggcggcgaggcttaaccaggaggacgacgacgacgcttgaatttgccacgtctcgtgtgtgtgtaccgtacactcggaacaatcggaacaagttcgtgtgcaaccttgcaggagagcatcctgtcgagtgaggcgaatcaaggcagcaggggggtctgcccgccttgtgtgtaataaacgaataacagtgctggcccggctgcgagtctgtacatgttttgcttttctctccggagttgtagtatgacgtcgtgtgctttttactccgtttcgctcaagttgaagtctatttccgctgtttgtcgagaagtgtgaatttgcggatttcgtatttcgacatggacacggtccgattgccgcttgcgccagtgtctagggcacgcagcgagcgccagccatcgtgactctggtagcctaacatggccagcaaacgtcaggggccggttcacagtcctgctcatacatccatcaagtcagcatcggcagcatatgactcgaaatggactgcctcgatgctaggcgactttcctggggcgctttatttggggcgcatttcagttcagctacttgtgagttgtgactcgcaaggccaggggctattgcatcagactagtattgtgtagtaagtagactagtaacatgcacatgttactaggaaatattactatctctatatgcacatgttattagtctatattactatcataatgaggagtaacatatgaacatttcatttattagactatagacacatctagactatagacacatcttgccttgatatatatgtgatgttactcatactattagtaaatgttattattttcctctcaaaaaaaaaa

SEQ ID NO: 4987 - DNA, 762 bp, Triticum aestivum
  Clone ID: PAT_TA_4987
tctacatccaatcattccaacacctgctccatccgtgcttgcacacagaaattgcttcactgaacggaacggtaaagctggtgcatcatagaactatagcatgcgtgttgcttgtggttcaaccttcctgtatctttcagctgcgagcgtgactgacactcatggtgttggtacaatctttctcgtcttgacagtgtatgaacaagccgcagggtgtttctcaatgcgcaggctatctaccttacaaatcttcagagtcatcttgtagactgagccgatgaattgcaaccccattctttgctgttgcgactcggccccattttccaagacgaggttctcggccaacaccagcaacaatgaagcgtcctgattttgctattgcaagagaattgacaaagccatccagtggcaagtcgaacaatggctgcatcccttttgaatcaggttgaattgtccaaaggcgaacaacaccattagctgctccagacgcagccagatcagaaccttttcttgcagcaacagcactaatccatgaatgagctgatgaaaggctttgaggcttacaaattccattttctttgggcaacttttcatcagcactgtcaagtgaactaggagctaatgctggatgggcattttttattatgtgagtaggtttctttctcataacactccaaagctcgaggcttccatcatctgatccagacccttattccttgtcaccgctaaagcagcagcactccaaagacacagcagcgcacg

SEQ ID NO: 4988 - DNA, 940 bp, Triticum aestivum
  Clone ID: PAT_TA_4988
gctcgcgcgctgcatgacgtgccagctctgccaccgcctgctccgcaacgccaccaccatctccgagtgccttcacacattttgtagaaagtgtatctataagaagcttaatgatgaagagtgtgaccattgtccagtatgtaaaattgatctcggctgcgccccaattgagaagcttagggccgatcacaataaacaagacgtgaggtcaaaaattttcccattgaaaagaaataagatcgatgctaaaggatctccagttacactgcctattaaaaggaaagagaggtctatctcttcattggtggttgacacacctcgaataacaacgggtttgactgggcgccgaacaagagccgttactaggaaggctgctgctgcattacgtggccttggtcctatccttgatcctgtagaaagggataatggtagcgccaataagcatcctgataatttaagcttgctggacagcttgagcaaagtgcctcaaacaagaagaaaggcatcatcaattgcagaaacgtcaagtcataactctaataaagataaagcaggtgatgataaggacttggacaaggcagatctatggaaacctctaaactgtcttgtagaagctgcaagcaaaacaaagtccttcaggtcaagtccatctgtcaaggggagatcagcccaatggatctcctagtagtgaacatgctagcaaagagaagtctgtggagaatctacggaaaaccagatttcaagatgacaagaaagatgctccacagccagtaatgcttaaaaagaaagggactggccggacgaagaatgcaacttctgttgccgcagctagccagaaggcccagaatagtagggcactaaaccctgtatggttctcattgattgcctcgtttgagcagaaggcctcccacccttgccacagatacctgcccactatttg

SEQ ID NO: 4989 - DNA, 934 bp, Triticum aestivum
  Clone ID: PAT_TA_4989
accccgccgtgcggcctgttgtctggaagttagcagcttctcttggggtacttgccaatggatcatgctctgtgggcgtacgaactggaaaaaaagcggtcccagtacagtgctttcaaagacgagcttttggttaacccttcagaagttacccgaagaatggaaatgactatttcaaaaaggaaggaacataattctgaaggaactggatttctcccaagggcggaaatcgtccaggacgaacatcctctaagccttgggaaaactagtgtttggaaccaacacttccaggaatctgaaactgtagagcagattgatagagatgttaagcgtactcatcctgagatgcagtttttcaatggcggttcttctgatgccttgtctaatcaggagtcactgaagcgaatacttaccatctttgcaaaattaaacccgggtataaggtctctccacagcccgattcctgtttctgccccgctcctcgttcccctcgccagtgatcccgcccagagcccctctggtagctctcccttgctccccattggctctggactagccttctccgtgttcttgtggggtggcgccgccctcgccgtgctgaggaggctctgatttgcctgagagcttctccgtgtggactgtcctgaagcgtcctttccgttgtgctgttggtggatgctacccgtgatgatgcaacgagtactggagtttgaatctttgtatcgtatagtaaatgatgtgatgcatctgtatatactcacttcatttcacaatgtttggcacttttggtcatgatatgcttcctgcacagctggtattttcaaccaagatatccttcccaaatgtttggagctttgcacctttgcattcatcttttatcatcttgcccatagttgattatgcattctcgttgtttgttttcttagacttttct

SEQ ID NO: 4990 - DNA, 935 bp, Triticum aestivum
  Clone ID: PAT_TA_4990
gtcacacccccatccccagccccagccgagccgaggtcttccgccgacgagcgaaaccaagccgcataaaagcccccacgcgcaccgatggacgcgaccgcggcggcggccggaggaggagacgggacgcagaggacactgaatccttatgtgactggtaattcggtgattgcaatgaaatacaaggatggtgtgatcatggcatgtgacactggagcctcctatgggtcaactttgcgatacaagagtgtggagcgtatcaaggagggtggaaagcatagccttattggagggagtggggagttcagtgatttccaggagattttgcgggatctggatgaattaactttgaatgatcatatgggggatgatggcaactcattgggccccaaggaaatccatgcatacctgacaagagtgatgtacaaccggcgcaataagtttgaccctctatggaactccctggtgcttggtggagtgaagaagggcccaaagggcgatgagaagtatcttggcatggttaacatgattggtacacactttgaggagaaccacattgccactggatttgggaaccacatggcaatcccaatacttcgtggtgagtggcgtgaggacatgacctttgaagaagctgttaagctgattgagaagtgcctgctggttttgttgtaccgtgaccggtcatccatcaacaagttccagattgccaagatcacgaccgagggatcgaccatctacccgccgtacgccctgaagaccaactggggatttgccgccttcgagaacccatccaagggtgctgtaggaacatggtagacatactctgctgctgaagcagtttcagccccgtgtgagtgtttgatccgaacatgactggaactctacatctgctttgtgtgacatgctataatttgatttcaagttttatgaac

SEQ ID NO: 4991 - DNA, 1186 bp, Triticum aestivum
  Clone ID: PAT_TA_4991
cgtccgcacgcggcgagggagagggagagggcaagccacaacaccaccccagaccgccaccccgcccccccctcccgccgacgagccgagccgagccgcgagaccagagcaaccccaccccctcacgcgaccacgcggaccccacggcggcggcgccgggacgggcagaggaggcgatgggacgcagaaatccctatgtgactggtaaatcggtgattgcaatgaagtacaaggatggtgtgatcatggcatctgacactggagcctcctatgggtcaacggttcggatccaagagagtggagtgtataacgtagcttggtaagcatagtcttattggatggagtggggagttgagtgatttccatggagattttgacgatatttggatgaacttaactgagaaactatgaatgatcagatgtgagatgatgggaactgattgggccccaaggaaatccattactacctgcacaagagttatgtacaacagtgcgcaataagtttgaccctctgtggaactcccgggtgacgctgggtggaaagtgaaaaagggcccaaagggcgatgataatgtatcttggcatggataacatgattggtctcacactttgaggagaaccacattgccactggatttgggaaaccatcatggcaattccccaattaatgcgtggtgaatggcgcgtaggacatgacttttgaagaagccgttaagctgattgagaagtgcttgctgggtcctgctgtaccgtgaccggtcatccatcaacaaatttccaagattgccaagatcacgtaccgcagggatcaaccatctacccgccgtatgccctggaagacctcactaggggtttgccgcctttgagaacccgtccaagggtgctgtagtaacatggtaggccatgagcttggaaacaaagcaaactgtcctgctgaaacagttttccccccttgtgagcgtttgatccgaatacgactgaagtccacatttgctttgtatgacatgtttataatttgacttaaaaatctttgtgaacgtttaagctagattgtgtgcacatgtctagataatttcttttcactggttcaatctggagtgctgccgagggtgcctgctcaccctgcccaaaccgacttgttttggctgccctttcatagtcgaaacctgttatttttctctttaaa

SEQ ID NO: 4992 - DNA, 904 bp, Triticum aestivum
  Clone ID: PAT_TA_4992
ctccgcgcgacacgggccgaggaagctcgcggggcaggacgggggaggagtgcaagggcgcgggggcggacgtgaacgccggcgtcgacccggcggttgatcgagaagctgtacgaggacgtgccgccgatgccgctgatggcgctgaaccacatctcccgcctctgcaagtccgtccgtcgacgcctccgtccggttctacgtcaaggctctcggcttcgtcctcatccaccgccctcccgcgctcgacttctccggcgcctggctgttcaactacggcatcgggatccatctcgtccagagagacgacgcgcgacgggccgccgacgtcaaccccggcgagctggaccccatggacaatcacatctcgttccagtgtgaggacatgggcgcgatggagaggaggctgaaggagatggggatcaggtacatgaagaggaccatcaacgaggaggagggttcgccgatcgaccagctcttcttcaaggacccagacggcttcatgatcgagatctgcaactgcgagaacctcgagcttgtccccgccggcgcgctcggtcgcctcaggctgccccgcgaccgccacaacccgcctctccggatggacggcgccgacgagtagcaccaagccaaacgtagcacggggcctgcgcgcgcgtgcgtagctaagcaagttagctagtggtgtaacgcactgccgttacgttttaattctgggtagtactactaccaagtttctctttactatgttgcgtcgtgtgtgtttcccaatcagctggtagctgcaccctgattttttgctggccagtgctcggttcccgcttcgcacaatgggaaatactgtattatgctaccagagcctttacagccctctcactaattttcccctcgcgccgaattcctc

SEQ ID NO: 4993 - DNA, 595 bp, Triticum aestivum
  Clone ID: PAT_TA_4993
gccagttcgagctgctgctgaccccgctacgtttgtggtagccatctttggggttgtctctggggtatttggcatgaacttggagggggtcgccgtgcttaaggtgcctcacgctttcgagtggacgctcatcataacaggtgtttgtggcgcggtcatattcgcctgcctcctgtggtactttaagaagagaaggttcttccccttgtaaaatgtattcttgcaaccacagcatagtcatagccacacctggctcctctctcgacccttctctacagtaaaaggcggccagaggagtcctggttttccggcactggatctggcgatttctccccgtcgagggccttgtgctcgtcggcgggtgagaaaccgtcggatccagcggcgcggagctgtatagcagtaggtttagggccttgctgttttgtttttcggccgtccgtcgctcgccttcgttggtgtgctcgacggcggagtttgaataagttctcctccagatcccttcagacgcggagctgtccttcgtcggccatggatctgggaggatggtgtgccatgcagggtttggcgtgccggcggcgacgaccctgccgag

SEQ ID NO: 4994 - DNA, 527 bp, Triticum aestivum
  Clone ID: PAT_TA_4994
caggccgctccgctctccccctccggcaagtcgaatcgcgtgacccccaactccgtcgacggctcgatcgatctcggcaaaccgcccccctccccgtctccggcgacgcggcagcggatcgcgccggcagcgaaggcgcggggaagagatggacgcggagctcctggagctgcagcggcagctggaggcggcgcagagcgcgcggtcgagcgtgcggctgtcggagcgcaacgtggtggagctcgtgcagaagctgcaggagcgcggcctcatcgacttcgagctcctccacaccgtctccggcaaggagtacatcacatccgaccatttgaagcatgagattaaggtggagatcaagaagcgagggcgcacatcactagtcgatttatcagataccctgggggtggatctttaccatattgagaggcaggcacaaaaggtcgtcacggaggatccggccctgatgttgatcaacggggagatcatgtcacagtcttactgggacactgtgacggaagagataaatg

SEQ ID NO: 4995 - DNA, 535 bp, Triticum aestivum
  Clone ID: PAT_TA_4995
aacgagcgacgattccatggagaagaaggacctgctcggcgcccggacgaagccggcggcagggaagcggcggcgcaaggtggcggctggcccgggactcgccaaggcgatcgccgagtacctcgcgtccgactcctatatgtacgcgccgctggtctcagaacctcaggagccgcctccgccgccgccgcccgcggctgcgcctgcgacaagtactcctgcttctgcagagaaaggagcagctctggtgcagaaatacagaggctcttgggcgtgggtacatttgctgcctgctagaagcatttgtggcgatgttgctgtgttgccttttagcataagctttaaagctttcccgatgttgttttattctccttcggctatgcacatatgctttctctaacaatttacgtttggtctggggccactgtctcccggaaaggctaacagttagttaatccaggggcatatgcaactatctgtaccttatcttgtgtcttcactgatgcaaccggactctcggtgtatctcgtatgat

SEQ ID NO: 4996 - DNA, 980 bp, Triticum aestivum
  unsure (1)..(980): unsure at all n locations
  Clone ID: PAT_TA_4996
gaaatnatgtccttggttttgtgtaggtgcatcagtgaaactgaatatgaagttatgcatgtgtgccaaatatttgaccaaacttgaagctaggccctacataacaagtttaaaggatcatgcaattgtggatatttagatcatatgggaatgtttatgccgacattctataaaggtgattggcatctactataagtcgataaatgatgctttgttggttgctgcacaacgacaagatgatcgcatcccagctactttgtatgtataagatttgctacttcttggtcaatgttgatgagatgaactgctaactaagtgtgttgccacgggccgttccatgccgaaggctgcaacgccatgtttctttatgcttgtatcatgtgcatccacaactcgtaacactggttgtttcaggccctaaataagcacatacacttcaaaaattgtcatggactcatggccgtggacttaaaagtgtttttgccatgtctggtagctaggaggaattacatcaaagagctcgttattttgctttcacgtatatgttaaccaggtcatatcacaatgaccatcaagtctcaagttcaagctatttgatttagattgtgccatgcataagtgaatattgttttgcataggaaaataagattgtaaatgtatattatttgcctccatcaaatttatgaaatgacaatcctttattcggaagaacaagtgaatacatagatcaaaacatcttaaaattggtgacaaattagcggttgtttccttttatttattgccttatttctggtatatgtaccttcattgtgaaatataacatgacgtaccttgtcattaactttctttaatgggaactacttatatttgatattcatcataaacaaattctgaaggtactgaaatctgtgtactgaattttgattgtgagttgggatgtgtccttgattgcagtgatgggatttgattcgataagtgaa

SEQ ID NO: 4997 - DNA, 563 bp, Triticum aestivum
  unsure (1)..(563): unsure at all n locations
  Clone ID: PAT_TA_4997
ttactgggcgcacgacccccacctcctcctaccttcttccccgcacgagttcgcacgcgcatcctcgcagccggcgcccccatcccgtggccttcttcgctgccggcgtaccccatccagccgctttcttcgccgccggcacgccctatcccgccgtctccttcatcatcggcgcgccccatcctgcgcccttcttcgctgccggcgcgccccatcacgcggcccttctgcgccgccggcgcgccccatcccgccgccttcttcgtcgtcggcgtgcccttcttgcggccttcgccaccacctcccgtcccactccaccctccctcgttcctccacctccttgccccgatccagaccgcccagaccccgacgcctccaccaacggcgcgcgcggacctccctccctctaccgcctccctcctctccagtggctggcttcccaaagcgccgacgcgcggccatctccccaatccccggatcagctagggggatcccgcgctcacagncgaccacagggccccgcgctaccatatgcgaactncgcggatcccggcctcctgatg

SEQ ID NO: 4998 - DNA, 1018 bp, Triticum aestivum
  Clone ID: PAT_TA_4998
ctcccccttccccccacctcccactgctttgaggctctcatctatggccaccaccctggaatcgactatctcccagagtgctggtactggcgttctctcccaccgcctcccttcaggaacagcaaccatcgtctcgatgacaaccaatttattggtggaggctatgcagatgaggatggcgacctatctagagtcactgcctacacggttgtgaatgatttagatatctgggtgtcacagggtggaaccacctactcctttgacacggtgagcagtgcatggaccagtcttggagagtggacgctgccattccgaggccatgctgagtacatcccggagaacaagctctggtttggcttgtcatctgatggggacttgctttgcacctctgacctcagtagcacgtcaaggcctcctcagctgcacaatctgtggaaggagctagcgccacctaaggaatggttccttcacaactcctaccttgtgcacttaggctctggcaagttttgcatcgccaagttctttgagacaggtcggatatccaacactcagtacaatgagaggttcgcagtgctcaccggcgtggaggtgaagcgctgtggcaagcatggaacagagctccggatggtcaagcacgggtccaggcgctatagcctgaacaaacaatcttacttccgggtattctagctgaatggtgaattagaggtggaacgcggcaacaatgtttggcagatagatggctctacagcctgaactaccaatatttctttcaggtatcaacaataaatcagtcgagctggagagggaacatttctcaggtatattacattatatgttatatcaatggtatatgttctgagtcgttgctagtacgaattgcttggatcgaaccttgtatcctgtagtttctgtgctactcttcagttcggtgtgcacaatctgatcgcttgtaactgaaggttgttaatgtataaagtgatcaatttcggattaaaaaaaaaaaaaaaaaaaaaaaaaa

SEQ ID NO: 4999 - DNA, 619 bp, Triticum aestivum
  Clone ID: PAT_TA_4999
accgttggggtgttggtggcacagttgtttgggccgctgtggtgtcggctcgggggggtggccggggctcgtgtagggccgctggtcgtggtgcgctgctcctgtgagtcctttttcccctcgtcaccttcttcctcacgtcaagttgcgttcgcgcttcttctggggaagtctgcttggcatgtcgtcggaaccgcgcgcttgtccttgttgtactgatagttccgtcccacctgagcactagacttgctcccggctcatatggtggcgcctggtcggcctctccttcgtcctccgctggatgtcgtggctctgccttgagagccggccctcttttcctcttgacgcgcaccaggctcgtatgagggcacgcggcctacctcagcggcgtccgcgggtggtattctgggctctgacttgctagtgcggcgatttcccctgatggttgcgcatggtgggggtcagcggctgcgccgcttccgtgggtcgtgcgcggcagtgggttttccggtccagtactgtccatcgctgctgttgctctttcacggttgctcgtggctgggttcatcgtctccttcgtttccgatgcacgggcaattcggcgtgtgttcctctccga

SEQ ID NO: 5000 - DNA, 646 bp, Triticum aestivum
  Clone ID: PAT_TA_5000
gctggaccgcatggcccgcgagggggagaccggcctccccggcggcgccgctcgcaagggcctcctggcgcaggagcgcctccccgacgggcgcagccgcggcggggagactcggaaggagcagctcggggaggaggggtaccgcgagatggggcacaagggcggggagactcgcaaggagcagctcggggaggaggggtaccgcgagatggggcgcaagggcgggctgagcaccatggaggagtctggtggcgagcgcgccgccagggagggcatcgagatcgatgagtccaagttcaagaccaagtcctaagtaatgtaggtcaagatgtcccagtgtctagctgagtagctagctagtagtgagcaagctgtctgctcatgtttgtagtaatgaataatgtaggtcaaggtcaggtcttggcatgacgagagcacgcatgtaggcgatcgcatgtactgttatcatgtgtgcgttaggtgtcttagcttgtagtagtgaccatgtgttcttcaggtgtcctagcttgtagtaggtgtcgttgtggcccgtgagtcagcttgctaatgtatgtgagtcgttgttaaatcaggtcgatgttgaatcagaacgtgggctcttaaattgttttcttgaaaaaaaaaa

SEQ ID NO: 5001 - DNA, 1136 bp, Triticum aestivum
  Clone ID: PAT_TA_5001
gcgggggacggacgcgtgggcagaaacagaactacgagctcctcgccctcgcctcccccgctccactccgattcctcctcctccgccgccgccgccgttcgatctccggggctccggtcccaagctcccggcattctccgcgaggaattgctatggaatgcttgactgcgagtttcgccgcgaggaatgcgggtagggattataacttcgtatgtccgagtaagcccgcgggcgagaagcaatggattcaaggaagggttctctgctattttacagcttacacaaactctagccgatgctgcaaggttgccactggggtgtaccccatcagcccagttgttggcagacgttcacgctggagatctttcgcagcaagtttgaatttagagaatgggcctgcaccatcgagttcgacatcgtcttcatcagggcaggctagtgagcagctgacctcagcccgaagttgaaatctcttttggctgataaaagaacgaagtaagcttttgagaaagctaagtgaagcaaaccagctgaaccggtttctcaaagagacgcgcccgcccgggcagggctgaagagattgctaattttgatgttccatcagggtcaaggaaggtaaatggaaaatatattcagtctcatcttctctccagattagaagctgtccatgacaaggttatggcacagataaaggacatcgagtctttaagacctcgagaaatcactgtccattgggttggcatggctgagaacgtgcaaattatgggctccttcgatggctggtcacatggtgaggcaatgtcgagagaatattcaggggattatgcgagattctctgcgactctgaggcttagacctgggagctacgaaatcaagttcttggtggacggggagtggaaactgtcatcggaatacccgattaccggcgagggattgacacagaacaataaactcgtcgtgcaatagcagatttttgctgccccttagaactgtattaggaccgtacctcggccccgccctcgctgttctcctgcgaaattcgtgttctatgaaatgcaaagccccatttgcttgattgggtccgcatgctgtctttgtaaaaaaaaaaaaaaaaaaaactcgagggggggcccggg

SEQ ID NO: 5002 - DNA, 1469 bp, Triticum aestivum
  unsure (1)..(1469): unsure at all n locations
  Clone ID: PAT_TA_5002
tttgaattcggcacgaggaactcgccccaagcgtcgtccactcctgcgagcacggaaagtcaatggcggaagcttctagaacctccgaggcgcgccgcgacgccgtgttcgcgcggtgggtgattttctcgccggcgcgctcccgtcgccccaccgacctcaagtcccacggcccggcaaaccctagccccggccccgacgatggcgcccccaagccgtcctgccccttctgcctcggccgcgagtccgagtgcgcgccggagatattccgcgtgccgcctcccgacgcgtcgccgccgtggcggatccgcgtgatcgagaacctcttcccagcgctgcggcgcgaggcggcgccgcccgcaccggaggacgaggagcccgtcggcgcgggggaatgcgccgtgagggggttcgggttccatgacgtggtcatcgagacgccgcaccatgaaagtccggctctgggatctggacgcggagggggtccgccacgtcctgcttgcgtacgcgcgtcgggtgcagcagctggccgagcacccagcggtgaagtatgttcaggtgttcaagaaccagggggcatctgccggagcttcaatggcacactcacacagccagatgttgggaactccttttgtccctccatctgttacctcccggcttaactgcatgaaggaggtcttcgagaggtcaggaaagtgcagcctctgtgtggttccgtccaaggatatcttggtcagtgagacgcacaatttttctgcatttgtcccttttgcagcttcttatccatttgagatatggatcgttccgcggcaacatagctcctacttccatgaaacagatcaggataaggtattggatcttgcgggtctgttgaaaagcatgcttcataagttgtgtaagcaactcaatgatcccccattcaactatatgatccacagcgcaccgtttggactctcctcatcttgtctaccttacacgcactggttcctccaaatagtgccacagttgagtgtaatcggtggattcgagatgggaagcgggtgccacataaacccagttttccctgaagacgctgcaaaaattctgagggaaatcgacggctcagtatagttcggtacttacatgtgatttgtttctcagtcatgtaaaaaggaagtttgtatgtcgctaataatctgagtggactgttaactttacgtactgctgagaatttgatcaaacctggaagttttaaccttactaacgttattctgttacctggaagggtggtcttgaactcaagttatctgagcctcgtaccgaattggttgtcatagcatagctatgatccagtgttcattgacctgatggtacaactataaactacccaagatgttcggctggttcctgaagacacgctcagagccaggaagggtagagcacttgtattgtcgaaccatagttttcnaaaaaacaacaggccattccat

SEQ ID NO: 5003 - DNA, 1168 bp, Triticum aestivum
  Clone ID: PAT_TA_5003
gcctcgggccccggccgcccgggctgcggccccctcccccggtggtgcccgccgctggggccgtccgtcctccccgacctcgctgccgctggcccatgccttgccggagacccaactgccgggatctcgttgaggagctccttcatcccttgaggcgaacccgaaggcgaggatgttggcggtgctgttcgcgacggtcatggcgtaccacgtacacggagaaggccaccgcgatggacgaccggctggccggggtgtacaagttcggccacctctctctcctgcatcaggtccagctgccgtcggcggcatcgtcctcctcctcaataccggcccccggcaagcccccgtatggagctcaaaggcactggagacccgttctgcaacgtccgccttcccgagctcctggtggttgcctcgacgcccaccggcgttgctccggctcctgccgccggcgtggtgcgtcgtcagtttagcgagaggatgaaggcgcatgcacgcctcgctgtccgctggatcccatccgtggcccaagcgagagcattctcccctatgtgtccggccggcgtggcggcgtccctctccacctttcttgttttcttttgcagttttgctccttcttcactctctttttgagcagcgtgggattggcggccgcggtggaacggactactccgtgcgcaacgccggctgtatccggtggccagcgcctgtgcggtgcagaggacgctgatgccgcgacccacaatggcggacaaccagtcaaccatacgccggggctgggcgctgcgccgcgggagtctcgttcgcgttactggcgaactgtgtggacgcggtcgtgacggtagcaggcttcagcatcagcttgcagaggtgagcaagattcagaaggccttcaacaaaacgtcagttggctttgttgtgactgcgtgggcagtccgcatgaacgacgctcaaattgtgtcaggcagttttgggcgtttgttgtgaacacttgtgatggaggaggggtgcagcaacatgcagggatggtgggtggcggcttcgacatactctgtactgcctataaagcctcgcacgggcgatggtggtgcagcaacttgtgatgctatgtttcatttgccccatctcccatctctgctcttattttaagtaaatgcccagatgc

SEQ ID NO: 5004 - DNA, 925 bp, Triticum aestivum
  Clone ID: PAT_TA_5004
gagttcggcacgagctcccacctccccgacggtgaggcggaggccatgccgccgcggccgctgcggcggcgtccaggccggcccctccgcgtgctcctcgcctacgctggggctccagacgcatttttcgttccgtcttgggcgtagccgagcgccagccggctcaacccgctcgaggtgtcaggtcgcaccgccgcaacaggcttccatggcgggccctcctccgtgctcctcaccgatcgacggggcaccatgacgccatgttatcccgttccgccttgggcgcagccgcggcgccgcccgccccccccgcgccaccgccgtggcgcctcgaggagcgcctccattcaagcgcgccccccctgcacgcacgaagcaccaggcccgccggtttcttcgtgggtccaggctggtgatggtgcctccagccagcgccccgagctgcctccaaccccgccgcccccgctcccgccgctcccttcccccgcgcccgagggaggatctttcgtggaggactacctactcgggcacgacgaagccagccgacagctcgccccgcgcgctcgatgtgcgcctccgtcgcggcaccgccggtcggccggcggcccgccgggcggccgcgaggcaggcggggtgcgcgcagcgtgccctcgccgcgcgtgcgcgccgggcgcggactggccgtgtttgggctggtccggcgcactctctgccctgccccgctgagcgcgcgcggtgtctggcgttccggtttagcatggggccatggagaatttagtattaagttttttcaatcccatggcaattttttaacaaaatctatccttaatcatggcaaatttgtatacagtaaatcatggacatggcgattacacagtaatttgttgggagttcatggaatttgttcataccttggcaaatttgc

SEQ ID NO: 5005 - DNA, 947 bp, Triticum aestivum
  Clone ID: PAT_TA_5005
gtcgggcttctcgctagcgcctgctgcccggggggccgctcgctgcggcggcggctgctggcgccgcccgcgcgccggggtgctgctggctgcggcggcggcagcaggcgcggagcaggacgatggggcggtagccactgctgtcccggaggtggaggaggcggatgaggcccgtctgcgcgtcgatgatccggaggagaacgactcagtgcgacctcaagtgccaacaccaccaagttccggcgaggaaaaagcagtgcgtcgacgagtgccacagccgggagcatcaccagccccagcagacgcatcttgcgagaacaagtgtagccactggcaagacccgacgaggaaggaccagtgcgtgcaacagtgcatgcgccgcggcctcagcctcgctgtgggcggcggcaacgacgtcgacgagcaccgccacgcccaagaggaggaggtcgccgggcgtccgtgcgacagggagtgccaactgtcttgccaaaggaagtgtcagggctggaaatatcggaccaagcaccaacagtgcgtgcgacagtgcgttcgcggcagcaacatcgtcgacgacgagcacctccgcggctgggaagcggtggccggcgccatcatcgaggcggtgtgagtgtcatgtcacgcacctaataataataataataatgtaagggtatatgtcttgctaggcaaaggcgcgagaataaaagaccaatagcgtgcggtagctgcatgcttggcgtcgttggcgatgctctcctaggactaggagagagctgcatggaactctgttccttttccttgtagcggttccggccgtgctggggcccttgcttgcgttcctcccggttttccttcctttgttatctggcccgttcttagtaaagtacccctctgtcgtcccccttaaaaaaaaaaaaaaaaaaaaaaaaagtcgacgcggccgc

SEQ ID NO: 5006 - DNA, 1409 bp, Triticum aestivum
  unsure (1)..(1409): unsure at all n locations
  Clone ID: PAT_TA_5006
gttcccccacctcctgcctcctccctctcactcgcccgcccgcacgcgcccgtcctcccccgcgacgagcgccgcgccgacgagcggggagggcggaccgccggccggaatgcccgcgcagaagcgcccgcacccgtcgcccgacgcggacgacgcccacgtcgaccaggaggaggaggctgccgctgccgctgccggggccgcgggctccggcacggagggcggtgccgccccgagggccgccaacgggggctccgcggagctggccaaggacggtggcggtggcgattccgatgcgggggaggacgaggacgaggaggagcagcggaagcagcagcagcagcaggacgagcacgaggaaggcggcggcagcggcggggacgacgaggacgccgaccacagtcagtcgtcggagagcgacgccgccgacgtggacgagtttatactagtgaaattgatggatatacggaaggaagtgcagtgccctatatgcttaggcattatccggaaaacaagaacggttatggagtgtttgcaccggttttgtagggactgcattgataaatccatgcggcttggaaataatgaatgccctgcatgccgcacccactgcaagagcagacgttccttgagggatgatcctaattttgacgctttaattctagctttatatccagacattgacaagtatgaggaagaggaacgtcctcccgcgcgtccggagaagactcgcaacaaaaagattcaagattccattgctgaaacatttcgaagacaaacagaagcacttgtgaagaagcgctccaatgcaaaagcaatagcttctacaagaaagacccgtgggagtatgcggacaaagaagagaggacggactagttctcctgacaatgccccaactgacattgatgacgacgagagagaagaaaatggcaatgatggcagcaaagaatcgtcttctgttgatgatcgttcaccagatgtcaagatgaaaagagctcggaggtggcctgtgccacggtcatcccctgccaagactattggcagtgttgatagcagctacgaggagaatgatgatttgggaggtgccagagatatcttggccacttctccactgcggggagagatgcttgcctggggcaaaaatggcacccgcagccaaactcgacatggcagtgccggtggctccagtggaaggatggtcaagggtgggcgtgttgccaagttggtggatcatctccgtaatgctgatgaatttgataccaagttcaacctgtacctcgctctaatctccgcttgatggacaaangcatgcctaaacctggaaaagttcctaatctcancctgccaagccaacaattcctctggttangccacctatggccangtttggtttgcctccttcaancctg

SEQ ID NO: 5007 - DNA, 1690 bp, Triticum aestivum
  unsure (1)..(1690): unsure at all n locations
  Clone ID: PAT_TA_5007
gcgtccctcgcgtccgctccttgtgcctgcgctccctgccgcctccaccccccccccctccccccccccccccccccccgccggcgccactgcgccccccgtggcgccgcgtccccaggacgtcggagggggcgccgccgcgcgcggcgcggcgtttcctcctgcttgtcttcccccggggcgcgtggcccgggccggccctcctcgtctcctctccgcggcatcgccggagaggaggtgatggcgagctctatcaagcagcagcagctgctgtagcagcggagggggggggccgccgctgccgacggcgccccgccggctgctgctgccgaggagaaggtggtggtggcggtgcgtgctgccattagggagatctccaagacagccatcgtctgggctttgacgcacgtcgtgcagcccggcggcagcatcatactcctcgttgtcatcccggcacagagctctggcaggaagttctggggctttcctctatttgcgggagattgcgcaagtggccataagaccatgttggatcagaagtcagatgtctcagagctgtgttcgcaaatgatgctcaaacttcatgatgtttatgatgcaagcaagataaatgttaaggttaaggttgtttctggatctcctcctggtgtcgtagctgctgaatctaagcgagcacaagcaagctgggttgtgctagataaggagttgaagcatgaagagaagcgttgcatggaagagttacagtgcaacattgttgtcatgaagcgttctcagcctaaagttctccgtccacgcgtccggggatctcccgataaagagtccaaaggatcctgttcacttccagcagtgttggatagttctgttggtaaaacagcaactgatgtaaaggagccgcggagttcagttcgaggaccagctgtaacaccaaatagcagcccagacttagagacgccttttggaagtaccgaagcgggaacatcctcagtctcaagttcagatccagggacttccccattttgtgcttctgaaacaactgtttctctaaagaaagaggtacaagcaacaaaggataagatccagcattcggatgtcaatatttctgataccgacagtgaaatattgagtccctcagcaaccttctcgcttcagccatggatggtcgacattctacagggatctgcatcctcaaaaccaccacgaaaaactcgcaccccaactgcagatactttgcttgagaagatctccaagctagatcttttgcatgaaataagttctatgagaagcagatcagacttaaactttagaggaaatgtcagggacgctgtctcgttagcaaggagcgcacctcctgggccgcctccgttgtgttcgatatgtcagcacaaggctcctgtgtttgggaaacctcctcggtggtttagttacgctgaacttgaacttgcaacgggtggtttctcccaggcaaatttcctggctgaaggtggatttggatctgttcatccaggcgtccttccctgatggtcaaggcaatttgctgtcaagcaacaataaagctttgctagttcccaggggggtggggtattttgtttgcccctggagggtgggagttgtccgcatctccggcacgttctccggctctgggggttttgggcccagggggggtggggtgttctgggttatggggncnttt

SEQ ID NO: 5008 - DNA, 577 bp, Triticum aestivum
  Clone ID: PAT_TA_5008
cggctgtggtgatcaccacgtacgagggcaagcacacgcaccccatcccctccgcgctccgcggcagcacccacctcctcgccgcgcaggcggcgcacctgcatcaccagcaccacggccacctcggcatgctgccgcagatgggcatgggcggccgcgccggatcgccgttcggccggagcagcggcggcggcatcgacgtgctgggcggcctcctgcagccgcgcgcccaccacggcatgacgccgccgatgatcggcgctggcgcgggccaccaggcgtcgacccagggtctgcccggctcaatcagcagcgtggcgagcgccaccgcctcgtctcctccgtcgctccagatgcagcacttcatggcgccggacttcgggctcctgcaggacatgctgccgtccttcatccacggcgccggcggcaacaacaacaacaaccagccctcatcaccgtatgggaagcttcattagttagctagctatagctagagataattatgagatttggttggttcttgctgccttattaacatcccccaatcgatcttgttttcaaaaaaaaaaaaaaaaaa

SEQ ID NO: 5009 - DNA, 1597 bp, Triticum aestivum
  Clone ID: PAT_TA_5009
ctgaatcaggctgcaaccagcactctgatggcgagactggaggcacagagagccatgtgtcactcatctgaaaccgagctccgcaagaagtaccagcacagggatgatctggagaggcaggtgaagcctttaattgatcaagcaaggaagaggtaccaggttgacgatgaaatcccagaggaaaggcactgtgagagtttcaggtactagccagaaagagtgtcgaggagcagccctctgaagcaggagctgagggttttcttggaggaggctcagaggacttcagatgcatacaacatttccctggagggggaagagattggagaagggacttcaacaatgagttatgtcaacacggagcaaccttccaaggtgataagcttcccaagaaggtccatctccactgatgaaaacaggagttacactgaaagaggaagagcgtcagtaagggagaaactagaacaatcggcgatcagagagcggcatcgtagcaggggaagggaaagaaaggagaccatggcatcaaggggtgttggtacacctatcaagtcaagagatggtaagggcaaggcagccatgctcgagtccgagaccgaaaggtctcatcatgcaagccagacagtctcatttccaaggaccccctcggttccaccaagtcctccatatagagcgaccggcgtgtacgggacgccgaggtaccacacagagcagtcactaccagtccaaaaggatgatgaaatgcttcatcctcgacgtgttgccagagcagaagacaacgcaaacatgaactacagaggcaagggcaatgttgataagtggctccatatgctcatggacgaccaacaagaaggaaatgaagcggcataccgttcctcggaagatcacaatgccgccgagaagaacggttcggacgatgagcaagaaattcaaagcagaatcgatgacgatgacgagagctgcaggaatgagatcaccgaatgtgttgatgagatcactgaaagtgttgacaagatcgtcgacgtcggcggtgagagtgctgctactcaccatggcaccccaagatgcagggatagctttgacatcaaggaggagaaagtggaaaggaagatctggttcccgaggtccgacagcggtaggggtttccggtccctgccatcctctccctccaagatcctgggaatgaggagaggctcggactgtgcaggcaggaaacctaaggtgggtcgcgacgatgatcacagatacggctacgaggattctgtatctacgagcagcagcaagttcctcagcaaatgcaagcaggcgatcaagaaaacggtacacaaatgaggcaatctccctgtttattcttttccatgtggtgtttgttgcatttgtctgaagtgctactattttgtttctgtagctgaataagttagcgatgcatagcttgcagacgactgtctgaggttctgcctgtggaacatttgtggttagtttagtgatcacgtttatgtgatcacatgccgtgtgtgtgtgtttgtgtacaactatttgttgatctgtgaaaaaaagatagaaccaatttctttgaataaaaaaaaaaaaaaaaaaaaaa

SEQ ID NO: 5010 - DNA, 632 bp, Triticum aestivum
  Clone ID: PAT_TA_5010
aacctccgaaccctagctcgacagcgattcaagcccgttccaaacccaaggcgccgaaattaaccgaggccatgtcgcagttcgacggcgggctcgccggagtgtaccccgaggaggaggatgaccgcctcgccgacctggcgggggactccgactgcgaggacgacgagtacgtccaatctattagcaaggcgtcagaagatacatctgcgatggatgtcctgaaagggaaggacatacagggaattccctgggaacggctgaccatcacaagggacggatataggaagtccagactggaagggtatacgaactttgagaacatacctaattccggacaattatcggagaaggtatgtacacctgtggagaaaggtcaactctactacgagtttgcgcacaacacaagatcggtgagaccgaccatttttcattttcaggtgagaaaatgcgggcgcccgacaccaggttttcatggggtcctgctgtctccctgctctgcgcggcaggggtctccgccgtcctctgtgaagcacgaggtcggtgatcgtcttcgtcccgccgcgcctgccgagatgcgcctggggtcctgctgtgtttatctgttgcagattttcttttttgatgttcag

SEQ ID NO: 5011 - DNA, 1185 bp, Triticum aestivum
  Clone ID: PAT_TA_5011
ctcaggctgccgcgtcctcattcccgtccgctctccccgtcctcctctgccaccccgggccccccctgccgggcccctcccttctggttcatgtgttcctgttgacattgagtggcctcctagcaatgagcacatcatctgactttaatgcaccattctcagctaacaaggatagtaaatctggagggctgtctaatgatggggttgatgatgttgatccttttgccgactggccccccaaaccaagcagcgcagccagcatttcagcagtggagcgcctgccaagcacaaatcaaagtatttctgggttgaatacagggaacatggggtttgggtggtcgcagtacttcgcttggcacgaatgaaaacaaaccaggtgagctggtcagcgaaacctaacaatacaaatattatgggcatgaattcaactgccagctatttgaaccaaggcaactcatctctgggatatggaaatcccattggcaggaccgagctcaggtctccccaatgcagctagttccattggaggccagagcatcaggcaaccaaaatctgattttggttcactatcacagttatccaggtggcgcacacgccccaaccaggcttggcaatgctccaacggcgggtgttggaagagggcgtggtagaaatcaagggcagtcagccctctcccgagcatcacggactcccaattccaatgtttcatcagagcagccaccttttcttgatttactgtagcaaatacaggagtgtccatgttcttcgttctgcaaacggcactggatagctcacatcgttcaagccttgtatatgatgagcattacactttcctgaaacatggttgcaggcgatagtgcattttcttgtcagtggaaactgggttgcctttgttgttagccccaaggaagctgcttcaggaaagagccttcctgaggttagagaatgtattcttgcttagggttttctcgatttcagcatcattggggtggtgaggcagcattaattttatttgtgtatatctttgtccaggctctgctgtaatgtctagagttcacaaatggttgtggtgatgtgaaattttgaatgttgagaatgtatcaccaaaatctgatgggcctcgtgaaagtggaaacccccacatgatgtattcatttaagccgggaagggcccatgtcgtaaaaa

SEQ ID NO: 5012 - DNA, 760 bp, Triticum aestivum
  unsure (1)..(760): unsure at all n locations
  Clone ID: PAT_TA_5012
cggcacgagcttgtcttcctctttaacagcaatatttcacatctgatcggcggtttgtgttgaaccttcctagctatttctgttttgtttttcattttatttagaagtgacatttttaatatggtgtgccctcagatctgattacgaggacttcattagggacttaacaagacaactttgtcgactatctcccgtcagagttgacagctacctagaatctgctatccaggcatttgatgcaccttggccggtcattcaagcaaatgcagtttgcttggttagttgcatgctatcctttttggatgatcaacgcttccttgctccttacttctcccaggtgttcgctatgttggttggcagaatcagccaatcaccagaggccgttgttcgagcagcagcatcttctgcattgggcctcctgataaagaggtctaacatgctcaagtcattgagttcacggtttgatcgaacagatccgtcacagagttctcaacatggagagcctcacgctaaaacatcgtctgagcttcaagaagaggctgcagcaaagccaaatggcgcgcaaggagagcaatagaagcaattgaagccgatctctctcggatgtaatccggttgtacatgtacagagttcaatgttcatgctgcctgcctgtacattntgtgcctccttaacaatagagcatagagagataattctgtagccatgtccataggtttttagtgcgactgtacagcatactgccgtggcagaattcgct

SEQ ID NO: 5013 - DNA, 894 bp, Triticum aestivum
  unsure (1)..(894): unsure at all n locations
  Clone ID: PAT_TA_5013
gagaagcacaaagacaagaaaaaggacaagagcaaagataaaagcagggaatctgaaggggctgacagacatggtgaggctctccttggtcagaagtttggagagagcagcaggaaatctgaagaaattaaggatcctatattcagggaggaattggctagaaagacacaagatcagaaagtggtggagaatcgagctgtnttaacaacttcactatctcaaatgaacgaagtcgtgaaggttttagtgctgcacctgcactggagaatgacaggaccgcagctcgcggcctccggccgcactctattgatgcttcaaggagaagtgagggcttggggcaacagaccatcactatcaatcaacagaaaaatgggacatcgattcgacgcagcgagaacctcaacagttcatctcaaggaggctctgatggctttagtacaacacctatggtggagaaggaaagagtcaaagtcacgagacctctctccaactctactgattctgtgccaaggaaagagggaacggggcagcgtatcagtaacattagcatactggtgcagaagagaactgagagcccaaataaagagactgcaaggaaagaaattggcaccaactctccgttgctcagaagccctgctaatgctctgcacaagggaaatggtaaggttggtcgtccggctggacagcgcaccaacatccatgcagaggtttgagagtccatcaacatctggcgcatcaacagggatggatagaagtctacctaggtcaactatcccaagcccaagtattacaatccgaaggccaaatgggatggttaggccaactgaaagcttgcccatttccgctagtaagcccaatgctggaggtgtttcacctgccatgggcaaggaaaag

SEQ ID NO: 5014 - DNA, 280 bp, Triticum aestivum
  Clone ID: PAT_TA_5014
agcacgcacgccgccgccgccgccgtcgtcttcgtcttctccactgctaacccaacagaggacgaaaccaaatagcgcaaattcctatccgggcctccaacaagcaaccccgcggaagctctgcccgtcggcgtgtctccttggttcctcgcgcccgattctccccgatccgaagcaagcaagcgcgagtgcgtgccccgcccgcgccttgccgcagatcggggagtcccgagagccccaggtagccttttcctcttcggttgtggttgttgttgcgggt

SEQ ID NO: 5015 - DNA, 1391 bp, Triticum aestivum
  Clone ID: PAT_TA_5015
acgaggctcaggttctccgggccggcctccccggtcccgctgcccgccggccagcccaagctcctccgccgcctcgacatcgccccgcccaaacgaatcaagccctcagccctccgccacgtcatcaacgccgccgccaaccacggcctctccgagctcgccgtccgcctgcaccgccgcgtctgcctgcccaagaaggtcttcgccatccgctctctcgccgtgctatccctcaacacctgcagcgtgccgcccctccccgccgtcgcctgcgcccgcctccggacgctcaagctccaccgcgtctacatcaaacaggtggtcctcaccgccatcctctccgcggcgaccgggctccacacgctggagatggtacactgcacgggcttggacgccggatgcacggtggagtcgttgaccgtgaggagcttcttgttcatgcccaacgtgaagcagcggcaggtcacgctgagagcgccggggctgaggacaatcacgcttcacacgcgacccaagacgcagaaggtgcacctggagccttcgccggatgtcagcaaggcttacctgcacgtcgccaagtcccaggaaaaggttctcttcaggatgcggccgttcttggatgctgccacagggctagcttccctcacgctcagaggctgtgcctgtgaagttgttagctggtgaatataaagatattgcgaagttgccaattacatttgaagggttgaggatattgtcagtgagcttgaatttctcgcgtgaatcagaagctgttttcctggtcttgctccgtcagtgctggccttcccgccacccgttgaccgtctcggctgctgaaaataagatgacagaggcgtcctttagttttgctgatcacaagaagatgcttgcaaaggcatcatgcctaactaatagcctgttgaagattaagtttcttgggttcaagtctggagaatatgagaaggacctccttgttttcctattaaatcgaaccaataagctgaagaagattggggtgcagtttccagcaagcgaagaaaccgctgtgaagtgggctttatctgtgaggccagccccaatcgagagaagatctactatgttcaacaagggctacctgcagttggagtatacctgatagcttacacgataggcatacaccacatgttttcagtttcgctgcacatacttccctttggtagaacttttgtccttgacttgtggacatgacacgggcgtgatggttgcaatctcgagtggttgggttcaacccttctttacatagctaggtgaagttagaacagagtttgagacagatatatgaaaagagcagagaatatctgggttgtgttgtagttttcacaagacaagaacaggagatgagttttacttgt

SEQ ID NO: 5016 - DNA, 396 bp, Triticum aestivum
  Clone ID: PAT_TA_5016
agggtgtgcaccaccagaccggaagccgtgtgctggttgggttagtgcattcgaggaaacctagcaatacgctaataatcctactgaaatgtggtgaagccagctcacaaaggagcgagagtgcaagagcatgctgaagacatacatgcgacaagcagtccaatgcacactttctcgaggcagtacacgagacttcaatttgaccgttagtcgggcaacaagtatgagaaggaaatgacaaggattctaagttttttttttggttttaatttgtttggtcataaaactgaaaatggtagactaattactaatgtgaatgtgtgtcttattaacagagtggagtggtgccatagagcagcacgcaagcaagggtgggggtcgggtcaaggctgttgt

SEQ ID NO: 5017 - DNA, 717 bp, Triticum aestivum
  Clone ID: PAT_TA_5017
gcacgaggaagaactatcggtgattgatccaatatttgaagacgataatgaggacataccggccattggactcttggggatggaggatggcatgctgctgttcgccactgtgctggagcctagactctacctatggtcaatggaggctggctccaatggagctgcgccattggcacagcgcagagtcattgagctcgcaccgttgctcccttgtcgtgccctcttggatgtgtcagtggttggttttgcagaaggtgttggtctcatcttcctgaatacagaggctgggttgtacacaattgagctcaactcaggccgaagcaaggaggtacatagagcgacatctttcaaaagagtcatgccctacacaagcttctatactagagcttgggggagaatgccgacctctgactaagctacctgttggtgctactgctacatcagtataatcaaatggcgtcaaaacgatggatctgtttgcttttgctgcccaggaagaatttgtaccactgaacttcggtgtcttcttttgctggatgtgttggattgttcggtcagggtgtatgcgcttttgttctgtttgtgcttgtgccaaaacttgagtccgcagtcactgtgtccgtaacaccagcagggtatttatgtgttttacctaaggaattaaggtaaggaagtagaacatgatcaattgtgacagtaacttatgagtgtagactt

SEQ ID NO: 5018 - DNA, 1430 bp, Triticum aestivum
  unsure (1)..(1430): unsure at all n locations
  Clone ID: PAT_TA_5018
gttccgacaggagtaccgggcagttgttgtgagaagcgtatagcctgacaccggctcttgacgagattgacagacaaatgaagagttaatcccgcccgctctctctctctctctctctcgcctcgccgcgcctccggccccgccgccatgaacaacctactcaccgattcctttgagcttcctcggcgggattcctcaagagatggggacgttgaaatgggaatgcatcagcctgatgcttctgataatttaaaaggcttcttgaagaaggttgatggaattgagagcctaatagctaagctgacgaatctcttgactaagctccagactgcaaacgaggaatcaaaagcagttacaaaagcaagtgccatgaaagcaattaagcagcgaatggagaaagatattgatgaagtggggaaaattgctcgtatggcaaaaaccaaagttgatgaactggaaaaagataacctatctaacaggcagaaacctggatgtgggaaggggtctgcagtagatcgatcaagagaacagactactggagcagtcaaaaagaaattgaaggaacggatggacgattttcaggtattgagagaatcaatccggcaggagtaccgggaagttgttgaaagaagggtatttactgtaactggcaatcgccctgatgaagagactattgatgatttaatcgagacagggagaagtgagcaaattttcaaagatgctgttcagcagcaggggagaggccagatattggatactgttgctgagatacaggagcgtcatgatgctgtcagagatctggagaggaagcttctggagttgcagcagatattcctggatatggcagtattggttgaggctcaaggagacatgatcaaccacatagagacacatgtttcaaatgctaccaaccacatacagcaaggtgtgggcgctctccagaatgcaaagaagctgcagaaaaactcgagaaagtggatgtgctacgccatcatccttctcctggtaatagtggttatcatcgtggtcgcggttatccagccatggaagaagtaactcttgagcatgacctggaacccaagatctcggcggaatatatatatatatactgtttttgtgtttgtgcaatctgtgtagttctgtgaccgattcaaactcttctatcgttgtacctatgctcaaccagacaaagccccatattgtttgcccctggaggtgctgctattcatttgtgtttcgtgtactccagctattttagcggtgaaagtggtgaacgcgaaaccgaaatgtgcattcttgttcctaaatccatttattgcagtttgtgcaccatactaacatgtaagaacgttttgctgtttgttaccggatctaatgctcattcatctttgttcctccttgcaaaagaaaagctcaanaaaaaaaaaaaa

SEQ ID NO: 5019 - DNA, 1030 bp, Triticum aestivum
  unsure (1)..(1030): unsure at all n locations
  Clone ID: PAT_TA_5019
cctgtctcgggttgcccatcgtccttcgtccttcctcccgatacagatccaaaacttccccatctctttcgtctcagtctccccctggcctcctccatcgttggtcgcctctgggctctggcactgctacaccaccgcatcgacgacgccgctcctcctccacgaggcttcctgcgcgtgtggccatggacggagctcgcccagccgcccccagaggctgcctttgaggtcgccgtgctcctcgacctcaacatcgtcgcactcgagagccaaccctcccctctccctttcccttggctgatgctgtccccggcggcactgctctcccgtgaggagtgagcctcatcaccacggtcaagcctggtatttggaatatcggaagaaattggatgaaaaaaatctgctactcaaattcgccagaagagtcctagtcggggatggcgagaggaggaagacaacggggagcatagacctccggatctccagtccgcttctcctcgggaggctgtcgcagtgctcctcgacctcctcacctagctcctgccttccgtcacgcagcttgaggaagtacgcagagttctaggtcgctctccgaaaaaaatgagttctaggtcgctgccgctccacgacctcggggcatggctcgtggtcggccactagatgctcttcgacttgatttttgggtgcgaagacacgtcaaggccagggaggagcatgactcttgtatcctctttttttgtgtggactggaaggggttgcggcttgatagattttgtatattgcattcaagatttgtgttatcagtgattgtaattttttgttgatagcttaccaagttgaccacttggttcaagatttgtgttatgctcgttcttagcacttttccggtgaagggcaggtactagagaacttagtttgttcttagccaaagtgctttttgangtgaagcagacaacattgcttaaagtactaactgactgattaatattttaggatttgcagtacttagtacctcatgactccgcactnn

SEQ ID NO: 5020 - DNA, 645 bp, Triticum aestivum
  Clone ID: PAT_TA_5020
tgattgaaaaatttataaatgccaagtggaaactggcaagagctaccagcgaccccttgaaatcaatagtgtattttaacattctgcccacctgggcaaaatcttcacctttggtttctctcataacctgtaaatacaagactttgtatggcatgttttattcctccgagtcaccaactacttcatatcgcccataaagtacggactacttcgtattgctctccccgcccaattccttcactattcgctgtgattcacctagcagaccctgcatctgcggtgcattcgagatgtctggatcgtgctgaacaataagcgtgaggctgtgcaagcatttcaggtagtgctgcctgagggctttcgacaccacgtttcttgtatgaggctcgttgtaaagtgaaatacacctgcgcagagcttgttcaacgtgttgataatcaaacgctggtgcctgtattctctttcttgcagcttcaagaagtccaacaacttcaagtgcttgcaaaagtacaactattgccccaatcttctctctttccatggcaaatgtgctatttaattttttccgattctcccttgaaggattcaatattccttccgttatccttattgaatcattggacaagttggtttgcctttgacaag

SEQ ID NO: 5021 - DNA, 639 bp, Triticum aestivum
  Clone ID: PAT_TA_5021
gggaggcgtgggtttgttccgaagttttttagatccaacggcgaggcacgaccccgcatctaccccgccggcgaccatcagggccggccaaccgcgccgtcccgccccgcggccccattcctccgtagatcctcgccgccccggccgccgcccgcgcctctatgaccgtccccggttcgccggtttctcccggtgcaagcaagatgagcagcgtcccgtggaagcggctggagctcgccgcgctgtgcgcctacgcggtggtgttctacagcgccatggtccagaggtcgcttcgcctcgcccgcgattacaccgggaaactctacggcctaagagctggatcaatccccggccgtctgaacgactcgtctgacgcgcaatggagaaacttccgtgggaacttacctattctcaccgttgtaatggctgcatttctgatcgtggcgaaagggctgcgatacggctgtagcttgaagggcagaggggcctcgttggtctggcttatattgtccctgatctatctatgctacctacatggtgcttgtgttggcttcattcttgtaatagcaggggttaattacgccatagtcaagttatttgctcgatataaatattgcactggcatcatatggagcttca

SEQ ID NO: 5022 - DNA, 389 bp, Triticum aestivum
  unsure (1)..(389): unsure at all n locations
  Clone ID: PAT_TA_5022
gggggaacaactatcatggacaatacgtcgatgatgaacagaggaaaaatttctaaactcgggcattcacaaaatgaaatcctctgggcaggatgatgaatgataacccctggnactttactgcagaaatccaacaagnaagccaagnattcttcgactaaaattctgaatcacaagagaataacagcaagcctatgatcttaactacaagctaggagttctttgctccttgttcctttgaattaccaacttcagcagtcagaagcacttgcatcttgttgtccttagtttcactcgaccagaagtcttgaacttgtttcgatgccactacaccttgttgcccttctggttagcactccacctggttagcactccatcttgtaagcctt

SEQ ID NO: 5023 - DNA, 889 bp, Triticum aestivum
  unsure (1)..(889): unsure at all n locations
  Clone ID: PAT_TA_5023
gaattcggcacgagtttaaactcgagctaactctggccgatgtagatggtttccaatataatgctacataatttccccttttgtattcgtcacccttgtttggcactactttttttatcagcatatgcaaactttcatgtaacatgcaaactctcatggatctgtagtacgtgtgtttgtaagaacttgaatgctggtttgatgatttattttctacgaagttgggcatatattcatggctgtttcttgataacattgcatgtaactgggtttcttcattgcacttaaataagtctgtttttagctttggcctatatgctgcctaattaaacttgaaaattagagagaaacaagaaaactaggagaaatgcatagatttaattagagaggaagtgcaatcaagtatttgtttactttttatttaagcaagccagtttgttgtacatcttctgttttttgatttttggactcaagagcaactcagaagtttgaacaaatgcgcctgggctcatattgctgaaacatacgagtgattttgcaggatataatggcagaaggtatcaaatcgaagatgttatggcttttcttcatggcatgcatggtcgacctactttcatcatatggaagttgttgttggttcgatgaacaaagacttggtgtgttccatagtgttttgtatagtgaccagacatgagtctcttatgaacttagcccgtattttgtaacatgtcacagcttgtatgtcgacctatgtatttccttagtggttgtagctaacttgagtgaagaaaactagtgaatncttnctatatgttgaatatatatgtattcatcaatggtatcttgtgatgaatacaagtgtgcaattgtttatataaaanaaaacgcc

SEQ ID NO: 5024 - DNA, 589 bp, Triticum aestivum
  Clone ID: PAT_TA_5024
gtttttttgtgcttgttgtttgcaggtcttctgaggattaaataaaaagcttgctcattggatgcatttcccatcagtgaattggctcatttcctactcgaatactcccaggcactcgagtcctacgagaagtttgaacgaaggcgtgtgaggcgttgcacagggaggatgatctaagcgaaattgtgcagggagaaggacacaatcaggcactgcaaaagaattctgaattattgtctgttaaacactgcacaagattctgcatccgggaaatggctagtcattatcatgcaccttagcaaggaatagtagatggtatgacatgtaaaaaagatgcgttgaagtggttggtgctgctctcctggaagatgattgatggctacctcctcccgctggcggagctctatcgctgcagctccctggctgttcacagccgccaccctgggtcgttcagcaacacaacgctaagccgttcgacaccgcagcttgggaggtgcccgctttttcccacccccctgtgtgtttttgggcagtacaaatacatcgctatagttagtacagatgtggcgccttgcggagtactaaaaag

SEQ ID NO: 5025 - DNA, 459 bp, Triticum aestivum
  Clone ID: PAT_TA_5025
gaattcggcacgagcgggccctcatctgggccgggctttggcccggtaccccccccccctccggcaccaccatctcgaacagcacaaacatggccccctcgtacaggctccccatcggcagcttcgcctgcgccgccgcgccatcctcgtcgtcagccatggtctgcgcggggaggtgggccaccacgtcggcctggcgcccagggaaatctccctccggcctcgcggtgagcagcaccacgcgcgtgccggcgcctcgcgccacgccgcagatggcgtcgacggtggagaacgcgcccggtcccgcggaggcgacgaggaggtctcccgataaggcgggcggcgccgtgacgtcgccgacgcagtgcgcggtgaggccgaggtgcgccaggcgcatgcagagggcgcgcatcatgaggccctcgcgcccgacgccgtgcacgaacacgcggcctcccc

SEQ ID NO: 5026 - DNA, 1131 bp, Triticum aestivum
  Clone ID: PAT_TA_5026
gaattcggcacgagccgccgcgctctggcgtggaaaccaggccaacgtcatccgatacttccccacacaggcctgcaactttgcattcaaaggctacttcaagagcttcttcggctatgacaaggagaaagacgggaaatggaaatggctagctggaaatgtagcttgtggtagtgctgcaggagctacaacatcgtccctgctataccatctggattatgcacggacacggctagccactgacgcgattgaatcccgagctaacaaacgtcagttcagggggttgctagatgtctacaagaagacacttgcaactgatggtattcgtggattgtaccgaggcttcagtgtgtctattgtgggtatcactctatatcggggtctttattttggcatctacgacaccatgaaacctattgtactagtagggccattggagggaaatttcctggccagttttgccttgggatggacaataactacattctccggggcctgcgcctacccatttgatacactccgacgaagaatgatgttaacttcagggcagccattcaaatacaggagcgccttccatgccgtaaaacagatagtttccactgaagggttcttcactctattcagaggggtcggtgcaaatatcctctcgggaatggcaggagctggagttcttgctgggtatgaccagctccaacggtttgcaggccagcatgattacaaaattgagaacaagatgaaaggggcattgaaatgatgtgcatgtgatggatctgcatgtgcctgggcagattcttgggttttcaggttgcgcgctggccagatgggatgtgttgtgagctacaattaccgagctcacagatcagaacttgaaatgcgtgcaagagttaatgggaatgaattgatcaacacaacaacatttcctggaggtgaatcttcaccaggataggagatggcatcatggtgcaatagatgattcgtttctatacgaagttttgaataccataacgactagaccttattcttgaagtgtaaattaatatggtttcgaaagctgatgtcccccatgtacactgttaatgtaaactgtaaatagtactgtaaagaataaagagtttagggcctctttggttc

SEQ ID NO: 5027 - DNA, 858 bp, Triticum aestivum
  Clone ID: PAT_TA_5027
cgcgcgtccgcggacccgtggcccacctcccaggcgaaacacctctccctctcccacctccgaagcagcagcagccatggcccccaaggcagacaagaagccggcggcggagaacaaggtcgagaagcgcggcggagaaggcccccgcgggcaagaagcccaaggcccagaagcggctgccggcgggcaagacggcgggccaagggaggaaggcggcaaggcaaggccccgcgggcaggaagccaagggccaaaaagccgcggcgggggaccagggaggccgccggcagcgagggcaagacgaggggccggaagaagggcagcaaggcgaagaagggcgtggagacgtacaagatctacatcttcaaggtgctgaagcaggtgcacccggacatcggcatctcctccaaggccatgtccatcatgaactccttcatcaacgacatcttcgagaagctcgccggggagtcggccaagctcgcccgctacaacaagaagcccaccatcacgtccagggagatccagacctccgtccgcctcgtcctccccggcgagctcgccaagcacgccgtctccgagggcaccaaggccgtcaccaagttcacctcctcttagactgaacatgcgtccgtcgcctgtagttggtctctgtatctgcacctgtactgtcgactctgcttgtctctctgcaagtagtgctggtagtctgctgggtgatcgccaacgctttgttggctaattaattggttgtaagaactgaagttgttgtgtttggcagactgatatatctatctagaactgaacttgtggtggtactaaaaaaaaaaaaaaaaaaaaaaaaaaaaaaagcggccgctct

SEQ ID NO: 5028 - DNA, 1538 bp, Triticum aestivum
  Clone ID: PAT_TA_5028
cttctccatcgcttcttcccccgggaagaaaggaaccgccatggcggaggagtgctgcagcgcggacctgctggagtggatcggccctgacgtctcagcatgcgtcttcggccgccttgaccaccccgccgacctcgtccgcgccgccgctgtctccagaacctggcgcagatgcgtggtcgagagcggcttgagcaagagcctttgcctgcggctgtgccccgaggtcgccaccgtcgccgcggcggcagaggtggccagatcgccgccttcaaccgccgcccatgaatcaggccacgagagggactacaggatatactccaacctcgccggcgcctacgtctccgactccgccgccaagccctccgcggaatgcatcttggactgcatcggggcctccagcaccgacgacttcccagcagagaccatggaaaacaccctcgacgaggaggagattatcaatttccgcccgtcctattggtcgagcggcggggcggacgaccccgaggcgcccgagagccttacctacaggctcaactctgacatctgcattgtcgatgagattcgggtgcgaccgtaccaagccttttttccaggatggtgaccctatatactcttcaaagatggtgcgatttcagatgggccattacgacgtgtgggcttcaaaggtggtgcgatttcggatgggccattacaagcttccgcgaggatcagagacgtttgtaatggatgattatgagaataagatggtaaatgctgatgaaaaatacatgtggacttacacttcgccagagttccctatgttacagaaaaacgaactacaatccttcaagctcccacgccccgtcctttgcattggtggtgtggtgatgattgaactcttgggcagagtacagaaacaagaagcagatgataggtactacatatgcgtttgccatgctgaagtgatggggcgttcactctcaccacttttcatggttgaaatctcggatcctgaaggttattcaatcctcaagtacttaccgggtgccaaagacctatccatcgatgactttttgcaagatgataccaaagactcgccggagtggcactatcttgttgatagatacaggcagatgaatcacagagcagtagtagtgagtgcacttctggagcctgtacattacatgcatgatgtaggtggcatctcagacgatgatcatgaagatgatgtaggtggcatctcagacgatgatcatgaggatgatgtaggtggcatctcagacgatgattatcttgtgtagatttgcgtgctggactgcagctacaactctgccgtggttttactctttgtagtttagtgaacacctcggaactctgcaagcttttgttgcaagcatttctgaagcctcggttctggaacctagaggacctgatcgagacaagttgctcttatggtttgcaactctgctcaagcttgctcgtgttttctcttgtgtttttcgtttagtggtgaatatttgtcatatattacttttcaaataaatgctgtttgcgga

SEQ ID NO: 5029 - DNA, 1152 bp, Triticum aestivum
  Clone ID: PAT_TA_5029
gccgacccatctgctggccccggcccgctgcggcctctcgctctcgctgcgccccgcgctgccgtcggcgcgcgggccgaggggggctctcccgccgtctctgccgcctctgccaccccccctcgggcgcctcgccgtcggcttctgcgcgagcgcccctgcctcgtcgccggtggcagccctcgcccgctccgccggctcgtccaacgccgcgaccgccggccgcaggcacgaagccgtcgcccggcgggtggaagagagagtcttcaggtccttcccggcggcgggacacactttgctgctcgtccatcgctgtatcttcgccgaccacctcccgctggcgctcgccttccgctgcctcgtccggctggacgaccgcgagcctcccagcttcctctctgattccgtgctgcgggccgccggcgccccctatgtggggaggttctgtgtggccggggcgcagccggccatgggggtcgtggccatggccgaccaggggacggtcgtgggcctcgagatgggcaccaaaggggggcagtacgcggctgaccccatgaccggcccaatgggggacggcatggtgctgtggaatccgcagatcacgcttgacggccggcctgatgccttctgtggaggatgggttggattcttctcatatgatacggtgcgttatgttgagacaaagaagcttccgttttctaaggcgccagaggatgataggaaccttcctgacattcatttaggcctctacaatgacgtggtcgtttttgatcatgttgaaaagaaaacacatgttattcattgggtgagattggactgctatcactcaattgatgaagcatatgaagatgggaaaaaccggttggaagctctgttatcaagattgcatagcagtaatgtcccaaccctttctgctggttccattaagcttaacgttgggcaattcggctcagcactacagaaatcaacaatgtctagcgaggactacaagaagtctgttgtgcaagcaaaagaacacattctagcaggtgatatttttcaagtagtactaagccaacgttttgagagacgtacattcgccgacccttttgaggtgtatcggcgcggttgcgtattgtcaaccctagtccttatatggcctatctacaggca

SEQ ID NO: 5030 - DNA, 1115 bp, Triticum aestivum
  Clone ID: PAT_TA_5030
ttttttttttttttttttttttttttttaagtatcacaaaatcattgtaaaatggcagaaaaaaaaggtgaaagttgacaacttcagtgagtgatgagctggagatgagatgaacagaactacacaacctaaatgacttgcatctttaagcatcacccactacttactatagtaacgcatcattctcccagatttcagttgaaacaaattacatcagctatggctgtaatctcatacccaccttagctggtaaatgtccagtctgctgtacattttattgactgaacttattccactagctacaactgtttattcggtgaagcaaagaacccacatcaaacacactccgaaggtttctgctacagacttcaaaagagagaatgtggacgccaatctggtcctatgcgtcggacaagtccaggaacgtcgactcggcgagatcgattgcgcgagcgagcccggcggccttgttctggcactcctgctgctcatcgtccggcttactgtcggcgacgatcccggcgccggtctggatgtgcgccacccactcctggcgcgcgttgctgctgtctgtgccatacgagtacatggtgtcgaaccgggacgccgtcgggaagacaatggtgcgcagggcgagagcgatgtccatgtcaccgcggaaggagatctggccaaagccaccactgtatggcccgcgcatcgtcacttccatctcgtcgatcagctccatcgctctcaccttgggagcaccactgacggttccaacaggcaatgcagctcgcagggcatcccaacatgtaagttcgtcacgcagctccccagtaaccgtcgagctaatgtgcatgacatgcgaatatcgctcaatattcatcaatttctccacctttactgttcctggtttggacacctttccaacatcattccgacctagatctaccagcataatgtgctcggcacgctgtttttcgtcactcaacaggagctgttctagaaccttgtcttcatcttttgtttttcctctcctgattgttccagcaagaggtcgattgacaactgtcctctttgcgacccgagtaagaatctcaggacttgatgctacgagaatacaacctcgc

SEQ ID NO: 5031 - DNA, 1448 bp, Triticum aestivum
  Clone ID: PAT_TA_5031
gtcccgcgcctccgggctcctgctccggcaaggtggtctctttgtaaacaaggatgagaacttgttaactaggctgcaaaacataaatctgtgcttccactttgaggtggaacagcaggttaatggggcattcctcaattttttcgggttcaacggaaccgcgggagtgtggagaattaaggcactcgaggactctggaggatggatggagagaacgacagttgaagacatggatattgctgtccgagcacatctaaagggatggaagtttctgtatcttaacgatgttgagtgccagtgtgaattgccggagtcatatgaagcatacagaaaacagcaacatcgatggcattctggtccgatgcagttgtttagactctgctttgtggacattatcaaatcaaagattgggttctggaagaaattcaacctgatattccttttctttctcctccgaaaactgattctgcccttctattcattcaccctcttctgcgtcatacttccaatgacaatgtttgctcctgaagcagagctacctgcctgggtggtgtgctacattccagcaaccatgtccttgctcaacatcctcccagccccaaagtccttcccattcatcgtcccctaccttctgtttgagaacaccatgtcggtgaccaagttcaacgccatgatctccggcctgttccagctcgggagcgcctacgagtgggtcgtcaccaagaaatccggccggtcttcggagggcgatctcgtcgccctcgtcgagaacgagaagcaatccaagcagcagagagtagggtccgcgcccaacctcgactccctagcagcaaaggaggaattgtacccgaaatcggaacctaaaaagaagaaacacaataggttatacaggaaagaactagcattgtccttcctcctcttgacagcagcagctcgcagcctgctctcggttcagggcatacatttctacttccttctgttccagggggtgtcgttcttggtcgtcgggctcgacctcatcggcgagcaggtggagtgatgatgataggatactacagcaagcaagcagtataatggggttttctcttttttgcatttgatgaagcgcgtggaatgtgccatttgaagcatcaccgaacgcgagaggtggctctggctgatgatcatcaagagagaggctgaaatggaatgaaatgaaaatgaaatgttggggttgtagatatatggcttgggactcggcctgtgaggtcccaattcttttgtaagaatcgatggatcgggtcttcggtggataacctagattgggttaattctctctttcttgactgttcaccgtctaatcctgtgatactgttgagggggatgctgtgtgggtgggtttcaaaaaaaaagtaaaataaaaaaaaactcggaagggggggggcccccccccctccccaaaaaatttt

SEQ ID NO: 5032 - DNA, 613 bp, Triticum aestivum
  Clone ID: PAT_TA_5032
gaattcggcacgagccaccagtgcgagactcctcccacggtcgcgagtcctggccaaatcggcctccgcttcttatcccttccgccgtccaccgctcggctccttgcgcttgctactactcaggcgattcgagagggagacacgagaggaattgggcatgtggaggctgtgtgggagagagaaggcaagggatcatggcggtgattgtgtcgacaggagatgagaggggagcttgatgcgttcatctcaaggtcaaaagacggcttctccagggtcaagttgtggcgacggctgtgtcgacgcgcgcgcgagagagaagcatgatgcggccttcttcacactattgcttccagtttgttcgttcttgcagatctgcggatatcataactctggctgttgttgacggacattagattccgaacagtgagaagcccacctgtatcctcgaggctcaaattttattttatttgtttatcgcatgctatgccacattgcttcttgtgagttccaacctgaggcattctgaatttttattttctgctgccagagaacaaggacctgtttgtcaaacccttgagcaaagaacgaaagctatttccatttcatactcata

SEQ ID NO: 5033 - DNA, 653 bp, Triticum aestivum
  Clone ID: PAT_TA_5033
gaattcggcacgaggaaacattgatgtggcagtgcttcgaatagtcatcacggatcaaccaagctgtgaaagtgctcagaagaaaaagtcaagctatgcttgtggcgatagcagcgatggcgtcggtgtaccatctggaggctactcctgtagctcccgccctgacacaaccggcaacaacccgtaccttatggatggttgtcaacaaggtaggctcacgaagggtcgaaatatcatgaagcgtggggtccacacaacatgtgggtccaggtcaatttcatacagacacactgtccactcggacaagtagcatactatccactcgaccaagcaacataccatccactcggatgacagttcaccactcgaccgtacgactcactcggatatacgaagaccagcaggcagcaaagcagtcggcatctttctaatagtgaaggcttaatagtgggctgtcattatagcattcataccccactttgtaaaataggaggtgaggaggtggcgcactctatataagccaccccccaccactagacttggggcttcttcttccacctctctcttttttcaccattagtctcaggacttagctcaggcatggggatccgttcctctctctcacacacattgtaatctccggatatatactc

SEQ ID NO: 5034 - DNA, 850 bp, Triticum aestivum
  Clone ID: PAT_TA_5034
gaattcggcacgaggcgaattcagttataattcaaccaaatggaggccaagcgttccatttgaggatcaattgaaagctttccaggagctaattgatgaaggaaaggtacgctatatcggtgtttccaatgaaagctccgagcggccgcccgggctggtacaggctgccaaacttcaaggacttccaaagattgtgagcatccagaacagttatagtctaattgtgagatgccgctttgaagttgatcttgttgaggtctgccacccaaataactgcaatgtggggctgcttgcctactccccactggcgggtggcgttctcagcggaaagtatcttgatgctaactctgctggtgcaaagaggagcaggctgaatctcttcccgggatacatggagcgctacaacgcgtctttggctaaagaagcaacggacgagtatgtcaagcttgccaagaagcatgggctaacaccggtccagcttgccctcggctttgtgcgtgaccgccctttcacagctagcaccatcataggagcgaccaccatggatcagctaaaggagaacatcgatgcatttaccagcgctccgcggcctctgccaccgcaagtcctcgatgacattgagattcttttcaagaaatacaaagatccagcaatcctctagatgttcattcaccttttcgctacaaaggacaccaatcctcgacacgtacaaagacctagcaagcggacatggattacgcaattttgttcatgtttattacacattgctttgtttctttcaactgatatttcccaaatgtgtatgtttttttttttgaaatatatgtgtacagatagtatatctcggagt

SEQ ID NO: 5035 - DNA, 614 bp, Triticum aestivum
  Clone ID: PAT_TA_5035
acatatatgcatcttgttctctgcttatgtactgtatgcctttgaatgtttgaaacaatcgtcggtcaaataacagtaatagacagataagatttacactctcttgcagaagaaagaacgtcgggacaatcagcagcctttcacatgtgcgtctatatatggatcattcttacatacaaaaagggtttagatagccatggttttttttcgtcacgtcagcgcaaccaacctagaggaggacgtcgccgtcgttccagcgcacgaactcttggttgcccgccaatgaactttacggggtgggggtgcccggggatgttatctgccgcccttgtccccacccagggcctgcccccgcctggtggtcttcaccaggacgccactcccaccgccagcccatgcctcatcctttgaccggtagcccacgtccagaattccaaacccgcgactttgcaccgatgcttcctcaaagtcctcaactatccctgttcctttactgaggaagggtcccccgccgccgacgaggaccagcggcccccctcccctcgccctccctccgccgcgccccgccccgcctctgcggttgccaataaagctgcccaggctcccatgtcaag

SEQ ID NO: 5036 - DNA, 823 bp, Triticum aestivum
  unsure (1)..(823): unsure at all n locations
  Clone ID: PAT_TA_5036
gttttcttgaagaaatgaggaacaagatgagggagaagcgagggttgggtagagaggaagctgagagagaaaagtgaaatgatggttgcttcgtccgtccaacttactgctggaaaggagggggttctgtgatttgacggctcattggacattactgcggcgcttcgatcggggtagtccgccgtcactctactacggagtaatttaatgcatggctggtggaccccgatgctggctatcccacacgtcggcgaaagtgagtaatttagtgcatggctggaggaggatccgcacggtagagcgtgtccactgtttttctgaagaaaaaaaatgattacagcaagcgtttccactcttacgacggaggagtgcgaaacacggcagccacttgaacatacacagtgctcctactactaggcatgtgcagtggtcatacgtcagtactacacaatcttgttgcaagtgtataagatatgacgataacaaatgatgttgtgcgcatctcaactactcctatatgtaacatactaccgctttctccgctggcccagcgacaggcaaccgtgccaccaatctagcccataccaccgccacaccgcccggagtgcccgtgcttcacttctccccgacacaggtaccatatgaagcacgaatagtgttaggcaaggtttatgaaggtgcacgggatgggagcaaaagtccttctcgaccactttggtgttggcagatgcatgaaggtgcatgagtcacactagtaggtgcaaaatacacaagaggaacactatatngatgagatnaacaacaaccacacgcttggctaagg

SEQ ID NO: 5037 - DNA, 935 bp, Triticum aestivum
  unsure (1)..(935): unsure at all n locations
  Clone ID: PAT_TA_5037
ttttaattcggcacgagctcctcgccccgacccggggacacaaaccgcccgcgtcgcagcctcctctcctccgcctccggtgggcgaaacaatggcgctctccctcgcgcgcagcccgcaccccgccgccgcggcggccctcccgctcccccgcattcaggggcgcatttcccagtacgccccgctcctccactcccctcgccgcgcctaccccggcctccgcctccgcctcccggccgccgccgtcgcggcctcctcgcccccggaggcgctggccgccgagcccgcggccgccgcggagggggacgaggagctgggggagacgcggcggaagctcttcgtcggcaacatgccgtttaccttctccgccgcggagacggagaagctcttcgccgagtgcggcgtcgtcaaggacgtcgaggttatcaagatgaaggacgggaggaagagggggttcgcgttcgtcaccatggccaccgccgaagaggccgccgccgcagcggagaagttcgacggccatgatgtcatgggaaggatcatcaaggtggaattttcaaagagtttcagaaaaccagctccaccaccatctccggacaccattgtcgcgaagtacaagctttatgtttccaatcttgcatggaaagcaaggtctgctgatctgaaggagttctttttacagttcaacccagtttctgccaacatagtctttgaagatagaaaatcaactgggtatggttttgtttcttttggaacaaaagaggaagcagaggctgctctcactgaactcaatgggaaggaacttatggaaaggcctgttatcctaagatggcgggaggacaaagaaactgtgaagctgatggtgaatttaagcttaaggtttgtttagcaaaagtgtacgttattacttgttgttaaggganataaagattatcntt

SEQ ID NO: 5038 - DNA, 780 bp, Triticum aestivum
  Clone ID: PAT_TA_5038
cgtccgcggccgcgtgggggcgactggcgagagagcagcggggcagcgggccggcagacggagaggggcgcggccgtcttcccaaacccgagggtcctcaccatggatctttccagttcactggcttcaaccagtgatgaagagacaagggcacttaatgcattgcttgatgctttcagttgtgccttttcacttgaagatatagccaatgcatactgcagagcaaatggcgatgtcaacaaagctggggatttcttgactgaccttcaactttcgatgccccagagtgatgaagttgactcgagcgttgagaccaatcttccccagtttggtacggcagttgaggaaaattctctggacaactcaaaccaaacaaggaatctttcctgtgtcgggaaagcagctgaagaaagctctgtggagaattcaagccaaacaagaacacgtgagaagtcacagaagtctagtgcttcatttggcactgtatccagcatgttaggaaaaggatctgcccgagctactacagctcctgccaatacagcaccaggaaaaggaaaacctataaaggttgaactgccagagtacatgcgagatgatttgaaaacagatgaatctgattctgcaccaaagagagagactttgaataacagagatgttgaggaattcctattttctatgcttggagaaggatttaagctcaacatggaagtgatccgtgatgttttatgcagctgtggggtaccacatgaaaaacatcctggaggaattaatgtctttttt

SEQ ID NO: 5039 - DNA, 255 bp, Triticum aestivum
  Clone ID: PAT_TA_5039
gggacagcttctttacacaccttcaattcaagaccaggtctcaaaacataacatatgctgccactactagcctgcatagctgtcacggagagaggcaactaaggagcggacagacaagatgagccccattccagcctatgccatgggggagcttatcagctaagagagcattgtgggggcagcaaaccgaccaaaagtgaacttgccagccaatgccaggtgcacagctcatgcttagcctttgcaagatctaag

SEQ ID NO: 5040 - DNA, 404 bp, Triticum aestivum
  Clone ID: PAT_TA_5040
atactaagcccagtaatttcagatgctggtgtgttgaaaggagattatgggatgcatgaaggcaataacaatgttgattccagtgatgatataaattcatttcctaccatggaaaatgaatccagcacttcagaagcggaggtttcagttcatccaggcggtgagcaatcagtgctatgctgtctatccaaagtaaataattccgagcaacatgtcgtcgaagcgaattccatagatgaagttaactcgttattcaggagccgcatggaggaagtgctagtgcagtccgtttcagagcccgttatggggcaacctttgacagttacacttgaagatgactcgagtgacccggcgttatgtccaaaccccgggatgcatgccattgaagcgagttcagttgaaga

SEQ ID NO: 5041 - DNA, 1594 bp, Triticum aestivum
  unsure (1)..(1594): unsure at all n locations
  Clone ID: PAT_TA_5041
gcacgagggaagagcagccttcttctgaacccaaaacagatngtgccgtcatggacggaaactggggctcgccttctcgtaacaaggtttctcaaccaatatgtcaccatcggtaacatgaccattcttgaagaaggtggcactatgttcagtttcggtgaagtcgacaaaaaatgtcttgtcaaaactgtcttgcgagttcatgaccctctcttctactggaaggtcgcaaccgaagcggatcttgcgagggctgatgcatatattaatggttatttttcttttgttgatcaaagagaagggctcctgaatcttttcctgattctcattgctaacagggatgcgcagaagagtagtagcagtgctgccggtaaaaggggttggtggacgcccatgcttttgacagctgggattgcatcggcaaaatatttcctccgccacatctcaaggaagaatactgtcacacaaactcgccgaaacatctctcagcactatgatctgagtaatgatttcttctcgattttcctggatccatcgatgacttactcttgtgcagtattcaaggtggaagatgaaagcttggaagtagcccagcaacgcaaagttaacctcctaatcaagaaggctaaagtggagcggaatcatcatgttcttgaaatcggtagcggttggggcagcttggcgatggaagtggtgaagcaaacgggatgcaagtacacagggattacgctgtctgaggagcaacttaaatatgctcaaatgaaagtaaaggaagctggtttggaggatcgcataactttcctgctgtgtgactaccgtcaaataccaagtcggtgtaagtacgacaggatcatatcatgcgagatgattcggcgcgtgggtcatgaattcatggacgatttctttggctgttgcgagtctctattggctccagatggcctatttgtcctccagttcatatcgattccagaagaacggtatgaggaatacaggagaagttcagacttcataaaggaatacatctttccagggggttgccttccttccttggcccggatcacgtctgccatgtccgccgcgtccaggctctgcatcgagcaggttgagaacatcgggtaccattactacccgacgctgatacgctggagggataacttcatggccaacaaagatgcgattttggctcttggctttgacgagaagtttatccgtgtatgggagtactatttcatatactgcgctgccggtttcaagtcacgtacgcttggaacttaccagattgtgttttctcgacctggcaacgacaagctggcctacgccgacaacccctacgcaagtcttccggcagcctagccagctcactgaacaaatgcacaaccattcaaactcatacctatacatagtaggttgcatttaattatccacaaattaaggttgagaaattgtaatttccataggagtgtgtgaagtgtcgatcatagtgctaccaccagggtgattcattgattggttcatgtataaggcgtggttcaccatgggtcatcggatacaccttgacccttttgtccgccaaaaaaaaaaaaaaaaaaaaaaa

SEQ ID NO: 5042 - DNA, 529 bp, Triticum aestivum
  Clone ID: PAT_TA_5042
cagaagacacaaatctattataaaaggtcaccagcattacaaaggaccctaaacataatagaaattatactaaggtcccttcaccaccgaaggacgagtaccaccaccagaatgagccgtcttcgcgccactgtcgcctctcccataccagtgcccccccggcccaagggtcgccgtccttaatccgccgtcgccgctggtcccccctccacccgacctccagcgccgccaccagatcgcgccgtcgcgcatgtacgccgagaaaaccctaaccttgctggccctagttcggcttggtagcttggcgttcttgttatactgaaggctcaaattttctcccaagtataaaaatcatgcgaacatcgtcagattttcctcggagacaaaagccacgccggacgcgggtgacgagtgacggctgatagggagatggcgacggcttgcaaggaaaatgccgagagggggaagaaaaccacgaccttgagcaagccggcggacaaatgtctgatggtatatatgttcacccatg

SEQ ID NO: 5043 - DNA, 1130 bp, Triticum aestivum
  Clone ID: PAT_TA_5043
tcgtgtgcggctcggaatccgccatgacgcggatccggcccgcccctaaaccctagggcgcctccctccccggggcacggcggccggccggcgagcgagccagcgagcgatggaggacgaggagatggagaggaaggtgcagcagtacctgcaccgcaagggcttccgcctcaccgagctcgcgctgcaggaggagcgcaaccgcctctccaccacctccctctccgacgtctcgctctccaggccggataacgacccagcaagatactatgatggctacaacaagctaagatcatgggcatacaattctctggaccaatacaagcatgaattactccgtgtcctttatccagcgtttatccattgcttcatggatctagtgtcagaggggcatacactagaagctcgggcatttttccttaaatttcgggaagatcatgaactgatgcattcaagggatctccaaaagctggaaggcactctttctcctttgcatttggaggaaatggatctggcacgatctttaagggaaaataaattcagaattaaattatgtgagtattcatatgaattacttctccagtatctccagaaaacacaagctcttgtgatgctcggaataatcaatgaacggatacttcttgaagtgtccgttgaccagccttcattgatctctgatgatgcggatgttgttgctctggttggaaccagcaaggacttggcaaaacagataaatcagaaggaagtgcattgggggttgcttgaagattcagttgaggagcgtatggagaaagcactcttagattctgatagagctgaagcagaaagcaaggatgcagatgcagaagataataacaaggcaagaaactctctcgtagtatggaactcttgttatatgatgtttgttatatgctctctgccattgaaacctggacattccttttttgtcaacactcagcagcatgtttttgttcttctcttcttctgctgttatcttaagaacaggaatgctatccatatacccttttctgttactaacttggatctttcattatttcttattatatttgctacagaaaaaatcctcaaaaggtggaaagcagggtggtcctctgaacaaaaagctcaaa

SEQ ID NO: 5044 - DNA, 600 bp, Triticum aestivum
  Clone ID: PAT_TA_5044
cgtccgctcaaggcctccaacggtggaggcggaataaactccggccactttttgtagccgcccggaatttgatactcccccggtcctcccctatataggcatgcctccttccacctctccccttcgccactttcctgccttcgtccattgctcgccgcccttaagccagctcaggtagcaactagagccgacatgatggcggaggcgtgggtggacgtgctgccgccgccggcgccctacttcgccgggcagccgtgctgggccgtacagcaagagcgtcgtggaggcggcgcctggacactggaggagaacaaggtgttcgaggaggcgctcgcggcgatcgacctggacgcgccggaccggtgggagatggtcgcgctgatgctgcccaggaagacggtcgccgacgtggtgaaccactaccgggccctcgagaacgacgtcgggttcatcgaggccgggctggtcccgtttcctcactacgacagctcgtccccttcgtccgggttcactctggactgggacggcggcgccgccggcgccggcgggttcaggcgcggctactgcctcaagcgcgggcgcgccgaccaggagcggaag

SEQ ID NO: 5045 - DNA, 568 bp, Triticum aestivum
  Clone ID: PAT_TA_5045
gatcgggataacaacttttgaaaaagaaatagcaggcatccggcacttacttattgaccgctagctagctagctagctgctgctagtcactcaatttacaactgcaaaagggcgcgggagaaataaatctaatctacgaaagccaaactgaagcaaaatgccgtcactatgggagcagcagaattccatggatatatggacaacatactgtagctaagctagagttcatcttcagacttatccttgtgttttcgtagcatctggataacctggtccaggggtgggtctccgggcctccggaaaaactggtccccgaccttgaactcgtatgcctccggctgccctagaatgaactccttcaactcgcgcatgtctcgccctctctccatggtgaacatgagcgtgccgaagtccacggccacgaatttcgccgctaccgagccggtccgcagcacgttgctccaccgcgtcgcgatcccccccacccccgccccggcccgccggtccccggcccggagcttcacgaacccgagcgagggcccgccgtggccgcggaggatctccgccc

SEQ ID NO: 5046 - DNA, 613 bp, Triticum aestivum
  Clone ID: PAT_TA_5046
gtttcactccaattgcatccttccatggctggagctccacagttcttgcccaatttgtcgatttcagttgcctaccgaggagtcaaagaacccatgtgaatcaggcagtggtggtgggacagtgagtgctgatggagatcatgctgagtcaagtaatagtgatatagaaggtgctaaccatgatggaggcaggctgcttgatggaagttcaataaatgacagagatgtgacgtctgcgttgaacgcgatcttcggagatggatcctcctcatcctcatctgatgaaaatggcccacgtgcttctgagagctgaagccagcatcgccctggctcccgtgcttccaacatgtagacggagtcccgaaagaagactctcgtgaggccggcgtctttatgctgtggtttcctgtaaatatttcaattcgaccctgcaagacaaaagctgtttatcttcgcttcttatgaaacctacgtggcttgtaaccgtttaatgcccgccaccgtgtttacagtatgcgtgtgtgtgtgaaataaaagtactctagtatgttgtttatgtgaacgggataattatccaactggcagttggacgaaaggaaacctgctcctgctg

SEQ ID NO: 5047 - DNA, 792 bp, Triticum aestivum
  Clone ID: PAT_TA_5047
tcgtcccctccgcctccccccaacccctacccaaccaatttgctgacgcccacactgacgagcgacgctccggcggaagaatcatggcctgagccgagcccgggatcctcgacgcggaatgggtgctgtaaaggatagcttcgctgtgctgctcaaggaaggcatcttcttgtctgtgtagttattagttgtttgggtgctattaaaagtgtttcggccgtggatcaggactgggagatactgcagtaagggtaaggaagaagaaagcatttggagagtcacaagatggaagaaggtcaagaaagcaggtactggtgccacagctgcgccgaggtgatcgttcctgtggagccggagaagaagtgcccagactgtgatggcggcttcgtggaagagatggggtccgagggctttgagccgtccacgaacgtgaggtctgagcggaacctctcgctctgggccccgctgctgcttgggatgatggggggttcgtctcggcgatcaaggccccagagggatatgatggattcttcttctgatgaggactcacgccaagcaaggatcaggagtgccctgagggatactgatgatgaggatgaagatgatgatgatgatgattctgaccgtgagcttgaagacatgattaggaggcgaaggaggaggggctcatcgcttgtcaggctgcttcagaccctccgtgatgacttaaggggcttggatggcattggcagggacagggacagggacagcgagagagaccgggagagggagagggaaagaagggacagggag

SEQ ID NO: 5048 - DNA, 2498 bp, Triticum aestivum
  Clone ID: PAT_TA_5048
cgcactccgcgccctcccctcaaccactaccaaaccaaggcgctgacgcccaaagggacgtgtggcgctccgtgacaacaaacatgacccaagccgcacaagggctcccggtcgacgtggaggctgcgtacttggtagcggccctgagctgctctagaaaggcttggtcttctctgtgttgttattttgtgggaccgctactgtaaaggagccttctttcgttgacttgaaaaccgtgacaatccaatatgggtatgggcaatgcaatcattttgaaggtggtagaattgtagaagggtaaataaggaggtgccatgtccacataagtttcaagctaattgcatccttagattgttaggctgcgttgccggacttgcccactttgtctcttgcaaagagccgatgggggccctcgaaggaccccatgttgcatccatggcagtggctcgtgggtctggtggctgcggttctacttggattctgaggttgagtaaaacggcagacagaacggtacaagccattatgggacacacgcttgcttcaagagtaaggccagcaaagattgacattgctcttggcgtccccgatgatgggggagattcggatgatggatccgcctcttgccgcccgcgatgagaatggccaagacgagggatgcgcacggcgccctgccttgcacttgcacccgagccaccccgtcccgccctgtgtacgcaggctggcatctgatgaggccggggactgtagggtgtgaaggcctgaaaatattttaatgttaaacgacaatatagaggccgttgatctccgagaaacagagggctataggggcaaccaagagaactcgagcaacacaagtactggcgtttcagttggtgagtacattcttggtcctggcctagatatgctcttgcagcgtttggcagacagtgacctgaatcgttctggaactccgcctgccaaaaaggaatctgtggcagcattgccaactgtgaacatccaggaagtactgggctgtacagtttgtcttgaggagtgacaattggggacgtaggcgtaggagatcgcttgccaaaaaaaatttcgctccaactgcaccctttcatgactgcaactacgcatttctctgccaattttgtctttacaattgcgaaccgaggagtcagacaacccagatgaatcacgcactggtggtgggatcgtgattcctgatggagatcatgctgagccaagtaatagtcataattaggcggtttaccttgatgaaggcggtctgctagatccaagttcaataaatgattgatatgtgacgtctgcgttcagcgcgagcttctgaggtggcaactcatcgtcctcatctaggtgaaaatggtgcacgagcttgccgacatgtgaaacctgcatcgacttggctcccgtggttccctgatgtagacggagtccccaaagaagactcctatgcggcccggtgtctttaaactgtggtttccggtaattatttcaattggaccctgcacgctaaagctctttatcttcgcttcttatcaaacttacctgactagaatcgggtgaatcccgccccctgaatctatggtttgcgtgtgtgtgtgtgaaataaaagtactctagtctgttgttttatcggcgcttcttatgaaacctatgtggcttgtaaccgtttaatgcccgccaccgtgtttacagtatgcgtgtgtgtgtgaaataaaagtactctagtatgttgtttatgggaacgggataattatccaactggcagttggacgacaggaaccctgctcctgctgaatggtttatgttccggggcgtcggtccagcggtggcttttctcgccgcctctgcgtacacaatgatgcagctcttgcttcatcctgtggtcaaatactcaaattgctgttattccttcgaagttgttcctactgaattcaggattcaggatattgctccaaacttgtgtggtggcaagtggcaacctgtggtgttgcttcctctggtcttaaatcctcacaccagaaggatacttgtggtcaaattgctgttgttcctttgaagttgttgttccaactgaattctggactcagattgatccaagagttgcgggggtggcaagtggtttgctaacgatgcaggtgccgcctcatctgatcttgaatctcacttgctcagtttgctgccattttcttgttatttgcaggggtacttgtagggaacatgagaaggatctgctgtcacagtttgttgattgtgggatcataagctgccagcttgtcttgcttgtttgtttggtactccctttgtcccataatgtaagatgttctacactacgttagtgtcaaaaacgtcttacattatgggacggacggagtatatttgtgttttgcagcttcagattggaaaatgggtagctgttccagacaagggagtggaattgttccttgtatttgcatgagaaggttcttgtgtatgatatgtaatataagcag

SEQ ID NO: 5049 - DNA, 679 bp, Triticum aestivum
  Clone ID: PAT_TA_5049
tttttttttttttttctatttccttcccctcccatcatcatacacgctctcaatacataaaagagaccattgaggagcaaggagggagaggaatccacgggccctgacaatgaattaaaccagggaaggaaacaaaggacacgaatgacatgagaatcagagaggagaaaaaaattaacccaacaacgaagggttaagatctcgatttactgacaaaattgacacatacgatagcaccagtggcgcaccctcacgccgaagcacgcaagggtgacgttgactccatgggaggcgacctccgggcagagggcgtccagcggatcctggccctggacccgccaggaggcggtcttggggtggcgccgggctcaatgacttgaccagcggctggaggcgagcctgccagtggccaaagcacgcaggggttacgatgcctccatgggactccgggcagagggcgtccagcggatcctggccctggacccgccaggaggcggtcttggggtggcgccgggctcaatgacttgaccagcggctggaggcgagcctgccagtggccaaagcacgcaggggttacgatgcctctccatgggaggcgaccttcgtggcagcggcgcgaaggggatcaggatgagggagagagtggttgtggtgagggtttcacagagactcgtgccga

SEQ ID NO: 5050 - DNA, 433 bp, Triticum aestivum
  Clone ID: PAT_TA_5050
cgtccgctggaaaaggaaagaaccagccccgcgattccaggataccagcttcgctttcgatccaagatataaaagaaaattcagcgaaagcaggagctgtgaagctaccctggcggaagaatcggctgaaagcggcagggtgaaggaaggatccactccactgccggggaaagatgcggccttactttgatcccgagtatgagaacttcaatcagcggatcaaccctcctcgggtctgcatcgacaacaacacatgccgcgactgcaccctggtgaaggtggacagcatgaacaagaatggcattctgctggaggtggtgcaggtcctgagcgatcttgacctcaccatcctgaaagcgtacatcacctcggatggcggatggttcatggatgtgttccatgtgctggataagcaagggcacaaggtgaccga

SEQ ID NO: 5051 - DNA, 835 bp, Triticum aestivum
  unsure (1)..(835): unsure at all n locations
  Clone ID: PAT_TA_5051
gtctgttgagtcaccatggatgaggcagttgttaagttgtgtgtcgtaggaataacatgcgtgtatctaacccagctgattcagcaactataagctctgaccgcagttgcagcctctaaggcactgcacctgcccaagtttcccacgcacttgcagaacaaacaaggaaaatgccagtttgctgttgatgtactgctgtgaagagaagcgcagactctttttcatgtactgctgtgaagagaggcagggaaacttttttaccaaacgaaaacgaaaacgtaagcatgtgccaaaaaccctctctaaaactctttagtcccactcgtcgccgacgatgatgtcttcctcgtctttggggggccggacgacggtcaccacctccgcggcggcctggctaatgccttcctccaacaacttcttgcccctctccaccactacgcttccctcccttctccagcacgtatatcccctcgtccaccacctccttccgtttccggtcggccaccaccagcactctctcgttctccgccgaccgccacggcagcacccgcccgtccgccaactcgatcaccaccgcctcgtcggccaccgccatgacgggggcccagcccggcagcaccgcccagcgcgcccaccccttgtccacctccacgatgccgaggtccgcgcccggctgccgcccggcggaggccgccccctggccgtggcacagggagatcctcgcggggttacggtgtagcgacgcgcgcgccgcgacccgggcggcctgtcccatctncgggcttcnaggcccaaccantcacggcctgcntgccanatcnnacccaacggatgg

SEQ ID NO: 5052 - DNA, 1261 bp, Triticum aestivum
  unsure (1)..(1261): unsure at all n locations
  Clone ID: PAT_TA_5052
tgagtgcanctgaaaaagagttgactgctgagctttctgaattggagaagcaaagggatgaacttgaggctcagctgaagaaggtcaacatttcactgaatgctgctgttgggcggctcaagctaacaagggaagagagggatcagtttgatgaagcaaacaatcagatgatctttagtttaaaagcgaaggagaatgaactttcaaaaactattgcctcatgtaatgtggaggctggtgtagtcaagacttggatcaatttcctcgagggggcgccccggctccagtcgtcatacgatgaacagattgaacagaaaaccaatgctgagctagagagatgcacaagcaattttatgaagttgacgaaatatcacctttctacattcaaggaagttctaagcccatcgattgagcggatccacacatacgtggataatttggcattcttaaattcaagggatgactcaacggaacttgaagacgaggaggtgtcagaaaagacaagcccacagaaagcccttgaggaggaatatttggaaactgaaaagaagatcgtaattgccttcagcatcactgatcacatgaagaagctattttattccgaacaagggtacagttctaggagagatgatccagaggtcaggagcttattttcggagatagagaaactgagagaggcattcgagtctatagaaaggccgacactagaaatcgaaatccgcagagcaaaggtgccaacaaaggagcgaatcgagtcgagctcttcgcctgttcaggcaccctctacgcctaaagctgcgcccgtgggctctccaaaatctccagtgaaatccgagcaaacactggaccttggtgcggagctcgcggagttggagttagaatttgggtaaatccaacaggtactcccctgaagatataagcgggtgggagttcgacgagctcgaaagaggagctgcgagccgacatatccaaatcgagcgatacgaaatgaccacatgcatctacaccggcgagatgcataccatgggtgcgcccctctggggcactgcacgaatccccgaacacccgattgtacatagtgttgttttattgtgtccattgctgtcctttttttttgcgggtgcattgctctgtccttactgtatgagaaatgcaaatgtgttaagactaccgttgggggccttgacaagcattgtatttgtttggtcctgtcaaggacatgtttgcatacagaaacagtgaaacatactngacatttgtt

SEQ ID NO: 5053 - DNA, 614 bp, Triticum aestivum
  Clone ID: PAT_TA_5053
atcgtcgtcctctgcggcaacggcgacgtgcccttcgccttccacagcctcaggagcgacaactacagcgtctccttcggggtggtcaggatggctaggtgcctcctgacgagagtcctcagctcgccgtcggtcttcttctccaccatcgacctctccatcaccttgctcctcttcctcgtgctggtgtacgagcaggtgtgggagtttgtggtcttcctcttctccaactggttcctcgtctccatgctccacgggtacgccgccaagccccactggcgccggagcgccgccttcagctgggccgtccgccgcatgctgtgggtgcggagcaagatgagccacccggacatcaccatgaggcagttctccgcgctcaggtcctgccgtctcggccgccagctgaggatggtgccggccgtctcgctcacgctgccgaccatcgccgtgccaagggacgtgaagcattccatcgcggagtacctatcagcgacgtcgctgcaggaggaggacgactacgaccccgccaccagtcgtcgcggtcttctcagcaacggtcagctcgcggtcgtcgagtacggggagctccgccgtgcgtgcaagaccgagagcat

SEQ ID NO: 5054 - DNA, 634 bp, Triticum aestivum
  unsure (1)..(634): unsure at all n locations
  Clone ID: PAT_TA_5054
gaattcggcacgagaaccgatgcaacctttttatgttttgcagggaaaaacaaaaacgatgcaagggcagcacacgccgccgcttcctcctcctcaccttccctccacagccactcctcccggcaagatgcccaccatcatctcctcctcctagacctcagccgggccagccatgaccgccaccgccgccgcttccctttccctccacctccgcctccgccctcctccccatgcccaccgcagcccccttcgccatgccccgttcctcctatccccttccccgtccaccccttggcctcctcaccaccttcacgtcgctaatggccggctccctcccccttgccgcccctctgtgaaggcgcgggtaggtaccatcgaggctccgagcctcgcgcgccttgggggcgccgtagagaccgaccgcctccccgccgacgtgcgcgaccgcgccatggacgccgtcgaccacttgggcggccgcgtcacaatcggcgacgtcgcctcccgcgccggcctgcagattgaccaggcagagcgcgcgctccaggctctcgcggcagacaccggggngcttcctggggggtttcggggaaggggaggtgctgttcntcttccccgaagactacanggggaa

SEQ ID NO: 5055 - DNA, 356 bp, Triticum aestivum
  Clone ID: PAT_TA_5055
cacacgccgacgtagaaagactaagatggcgccactgattttaaggctgttggtagcttacctgctacaatttatgatatcaagctcaatgtggtcctgcacaaaaggcatgacgaggagaatcctgctataacggtagagtatagggtgaaaaacactgtgtactctgacaatgttactggtccacatcaatgctgcactgaaggtgacttcagatatgatcaaggtgtagaaaaacatttagagtcttcaccagatggatgtgttgaggcatatctcccttttggagcgtccttcacaaatcactgcatctgcgatacagatctatagatagctgaatcaatggtgtatgaatg

SEQ ID NO: 5056 - DNA, 603 bp, Triticum aestivum
  Clone ID: PAT_TA_5056
gaattcggcacgaggtcacatgttgaaggtgctcgattacagaaatatcaaggagttgcctcatatatatctgttgaagcgatggagaaggactgccaagtctacagatgaagacagccaaggccatgcagcaaacgataacaggtcatcattaaacgtctctgtaccttctgcaaatcaccatgggctccaaagcatcaatgcaaggattcaagacacatcgctttccaatatgcatgagaacccatttcatagaagctcctaatgaaggtcgcttcaccgcacggatgatgattccatgtgtgccttgccagatgttataatattgacagttgaagcagtgagaatatgacagtggggagctcccctcccctgaataagtttctcaacttgtaaattatgcggctgtaggaaattttcagcttttgagccgctcatccttggtttagtctagattctgatacagcctcgtgcctgtactgcgctggaaataattcagaaattttgtgcgtcgtgtaaacatgatgtggccatcctagcccatttatcccaagcaaaaatgattgttcagccagcccaatcaacttgtcaatctagcagctc

SEQ ID NO: 5057 - DNA, 605 bp, Triticum aestivum
  unsure (1)..(605): unsure at all n locations
  Clone ID: PAT_TA_5057
gaattcgccgcgcgcagcgcctcggcagaccgtgccgccccgccaccgtgccctggccgtccaccggccccgggccgacccccggcgcccgcccgccaccctgcgcccccccgccaccccccccccccgccccgccgccccccccgccccccccccgcctccgcccctgccgccgccgcgccccgtccccctggcccccgtcgtcgccgtgttcccggcctcgctgctctgcctccccctccgcctccgccgcctcccccgcctcccccggcgcgcgtgccgccggccgggtcctcccgacaactaccctcctccccccaagggcctcaaagagggaaaggcatcgaacgcgctccccaccgtctccttccccccggcggcgtcgtcgccgtcgccgtccgcgagttccgcggcggtgcccgcccgcggagggccgcgcgcccgcgcccggcctgcgccccggcgcccccgcgcctgcgtcggccctggtccggatcgcgcaantgccgtctgccgggcgcatcgtgcacccatgagatcagtaaagcancgggggccacntggatntcttgangagtaaacnccganantgcaagtaggnccgg

SEQ ID NO: 5058 - DNA, 799 bp, Triticum aestivum
  Clone ID: PAT_TA_5058
cgaatgcattacgcgccgcgcgagcaaaccctaccccgcgacttccctccggttgcttccgccgagcgacttccaatccagtctcccctcgattccgccggcccgatcgcctcgatcaatctcgtccccggctgcgcccttccgtcggttggagatggccaagacttgcttcaagaccgagcaccccctggaaaggaggcaagctgaatctgctaggatccgtgagaagtatgctgacagaattccggtgatcgttgagaaggctgataagtctgatgtcccggaaattgataagaagaagtaccttgtccctgccgacctcactgttggccagtttgtctacgtggtgcggaagaggatcaagctgagcccagaaaaggccatcttcgtctttgtgaatagcaccttgccaccgactgcttcgttgatgtcagcgatctatgaagaaaacaaggacgaggacggcttcctgtacatgacttacagtggcgagaacactttcggctctgcctaatccatgtgcgctgccactgtaaataaatgaatggatgttcaggttgcgacgtctgtgtacatactatcactagtatgctggtggattgctctcatggtttaatgcttttaagtgtggtattttatcatctgaatgttagaacggcctgtaaaactcttatctattactataaagggtcgaagattcatcatgctctgggatgatttcaatcgcaaattactggcagcagaaccgagttttttttttctttcgcaaattagtggcagcagaaactgagtttttttt

SEQ ID NO: 5059 - DNA, 561 bp, Triticum aestivum
  unsure (1)..(561): unsure at all n locations
  Clone ID: PAT_TA_5059
atactaaatcacaccatccaattccacagaggccagttcaccatagcagcagtccaaaaagttacacaccggccactgcaatcgctaggtaaatatagggacggggacactactaatataggagtagcatacggctcggtagttactactggcgactgcaagaaacggccgtccactactgcgctaacgttgcaagctacggtagctagccgcagatcggtcggtcggtggtagagcccggcccccctctccgtccggccggttgctggggaggaaccgaactcacctacgtaccgcgctctacaccgcagggacacaacaagagaaatcgacccaaatcctcgctacgtacgtcgtacgtactcgttactagcgtagcagagtgctcatgccggggggcggtgtgaccgccggcgagccgctaggcgtcccggttgatgaaggcgacgagggtggccatctcggcctgcgcctggggcgtgctcatnttggtgaggaagtagacgtggccctcgccgggggtctcgtacagctccgcctgccccggccagccgctggncc

SEQ ID NO: 5060 - DNA, 1579 bp, Triticum aestivum
  Clone ID: PAT_TA_5060
tttctccgtgggtgattttttcatgctagacgacaccattccatccccccccttcgaggccagggcagcagcggtgcagttcctcgagacactgcacgctccaatcgctcgctaggtccagctagggggaccgtcactattaacgtcggcgtctcgttcgcgtcggctgctggcagcggcgactccgcggccagcccgttacttaccgatcaaacgttgcaagctaccctagcttgcagagcgtcggatggggcgtggtagaagcacgtcccggccgccctccccacgctgccgcgggcggggcaggacaccactccgcacacctagctgaagccgcggcggaccgccagagaaatccgccccaaaccaacggccgtcccgtcggcggtgtccgttcgtagcgtggccccggcgtcgcggagcgcgcctgtggggtcgccggcggggccgccggcgagccactagacgccgcggttgatgaaggcgacgagggtcgccatctcggcctgcgcctgcggcgtgcccacgtcgccgcggcgctccccgcggccctcgccgcggcccccgtgcgcccccgcgtggccgggccgcagcgtgctgcggaaggcgcggtaccacgcgccctgccgcgcccgccgcggcaccgtgcccggccccggggaggagccgccgggaggccccgaggcgctcccctgagccagtgggccgccgcaccgggggtcgcgggcgggcgggcccgcgcggacgtgcccgcgcagatgaaccgccggctgcgcgccccccgcggccgccgcgtcggcgccccccgcgcgccgccccccgcgctccggcccgggcagcgccgcgcccgggggcccccccccgccggcctcgccccgccctccaggccctcctcccggcgcgcaatgccaggttgtgcgcgatgttgccccccgcgctgtcgccggcgaggaagaggcgggacaggtcgccgtactgggacagccactggtccgtcccggccgccgcattggcgagcacccacttgagcgccgcccacgagtcgtcgtaggcggccggcagcgggtgctccggcgccaggcggtagttcaccgacacggccaccacgccggccttggccgccagggtgttgaggtaggcgtggtagatggggttgaacgccgactccaccacgaacgcgccgccgtggaagtagaccaggacgggcaccttggtgctggcgcggaagctcgggaggtagatccgggcgtcgacgccggcggcggggtcgatggtgacgtccctggacgtgaccgcccggtgagcgggtccgcggccgcggagacgcggtcggtgcccatgagccgcttcaccacgccgctcttgtactcgatgaggaagggcgagaagtcgaacttgacctgcgagctggactcgccgccgcgcgccttcctcgccgcctcgccgcaatgcgagcagaggaggaggaggagcgccgggagcaagatccgggacgccatgggagtggcagaggtgctccgggggaggggagtggcaggcagcgcgtggagtgtgactgtgaacgagtgaggcgtgagtg

SEQ ID NO: 5061 - DNA, 777 bp, Triticum aestivum
  Clone ID: PAT_TA_5061
gaaccctagtgcatttgaatgtgattggctctacagttgacccacttgaaagagatttggaggagctgcaaagtaaaattagtgcagaaatagaaagtggattatctcttggttttgagttaaaggttcttaatgaattgaaagattctttggtgacacttggatggatgttgacagcactatctttctgctgcaggattcccttgttacaggctattgatcgagcaattgaagaagctgtccaccttcctgcatcattgtcaagctgccctttagctacattgttgatgagcggattatcttggctaaggaaagcacttgttttgcttcctggttctgaaaactctgtaaaatatagactggaagatgtcgaaaatgttttggcagaacatcaggaaattgctgttccttattctatgatgactgccaagcttgaggatgctataaacaaacataagtcatgcacagagcaatgtaatgccttctttacgtcgcgtgatcaccaatcctggactgaactactaaggctcagagacagtggccggtctgtcgcacttgattgttgtgaaatggatagggttgttctcgatattaaaaagattgatgggtggttcaatcagtgccgctgtactctttctcctgatgtcactcatcttcggtcccggctctccatccgtccgtaccgtggggttcattgggccatccttctatgtgggatgctgtttaccgtttttttaaaagctacaacttctgaaccgaattaccctctgtttttac

SEQ ID NO: 5062 - DNA, 1268 bp, Triticum aestivum
  Clone ID: PAT_TA_5062
gaattcggcacgagcccggccactacctgccgccggttccttcctttcctcttcggccccggccaatccagaacccatccaacgcttgtcccacgacgcggacacagacgcaccatggccgcctcggtcgagccacggcagtcgtcgttcggccgcctcgacgcgccggccaccgcgccgccggcccgcaacggggcctccaacggcggcatccggcgccgcgccgactcgccggtgcgcggctgcgggttccccccgctcatctcgccgccccggaaggccctcgtcgaggaagaggagcacgacgacgaggacgaggagccggaggaggactggcgggaggcgtacggctcgcagctgcagctggaggtggagccgtcgacgcgcgacccgcgcgacgagggcacggcggacgcctggatcgaccgcaacccctcgctgatccgcctcaccggcaagcacccgctcaactgcgagccgccgctggcgcgcctcatgcaccacggcttcatcacgcccgcgccgctccactacgtgcgcaaccacggcgccgtgccccggggcgactgggccacctggacggtggaggtgacggggctcgtccgccgccccgcgcggctcaccatggacgagctgtcctcggcccgccccgccgcggagctgcccgccacgctcgtctgcgccggcaaccgccgcaaggagcagaacatggtgcagcagacggtgggcttcaactggggcgccgcgggcgtgtccacctccgtctggcgcggcgcccgcctccgcgacgtgctgctccggtgcggcatcatgtcccccaaaaagggccaggccctgaacgtgtgcttcgagggcgccgaggacctccccggcggcggcggctccaagtacggcaccagcgtgacccgggagtgggcgctcgacccgtcccgcgacatcctgctcgcctacgcgcagaacggcgacccgctgctgcccgaccacgggttcccggtgcgcgtgctcatccccggctgcatcggcggccgcatggtcaagtggctccggcgcatcgtcgtcacccccgccgagtccgacaactactaccacttcaaggacaaccgggtgctgccgtcgcacgtggacgcggagctggccaacgcggaggcgtggtggtaccggcccgagtacatcatcaacgagctcaacaccaactcggtgatcaccacgcccgggcacgacgagatcctccccatcaacgccttcccacccagcgcgcatacaccatg

SEQ ID NO: 5063 - DNA, 574 bp, Triticum aestivum
  Clone ID: PAT_TA_5063
acttcaggttcgtctactgcaacgacatcgtgccccgggtgccctacgacgactccacgctactgttcaagcatttcgggacgtgcctctactgcgtccgcctcgacgctgggcagcaggtgaccgcggaggagcccaacaagaactacttctcggtgctggcggtggcgcccaagctggtgaacgcgtggggggagctcgcccggagcttcctcatcggctacgcggaggggcccgagtacaccgaggggtggctgatgcggctggccagggtggccgcgctggtgatgccggggctgccgccgcacgcgccgcaggactacgtcaacgccaccaggctcggggcggcatcgctcgggccgctggaactagccgagcagccattgtaactttatttagtactgccttcatccggaattaactctcgctgaaatgagtgtgcgatagttaattctagacgaaggttgtaatttagaatcagattaaacatatataactgtcgctgaattgttcttgttccatcgttcattgctcgagcaaatgattgagtggacatgctaataacagttcgttt

SEQ ID NO: 5064 - DNA, 670 bp, Triticum aestivum
  unsure (1)..(670): unsure at all n locations
  Clone ID: PAT_TA_5064
agcccataagaatttactatatgattgcagcaaagagtcattgggaaataattaggtgtgagactcgactgctttgcatatttcatctaacaggattgttatctacttgtcctcttgagataccgaatgatactgtaacaaagggaggcttcagccaattcgacttcgcaacagaaagcaaaacattacccttatttactatgttagctagatgttaagccaactccccatctctataatcagatctccttgtttgttgctcgcaaacttcaaagtttgatgcccttcgcctttacatttgccatgctagccagcccactcgctgtctctgaacccaccatggtcggcgtctcaacaggatccacgaggtcgaccgccctgtgtggcttcctccttgcgtatgtgtaagggaatctatgtccttcaactcttgtagcagagttcatgaaaggaggtgccttcgtcttcagcccatcatgatgctgtttgagcactgtttcagactgcatcgggaagttataaggtgggtttgtgcttgcaccaagggtaagcatctcagaaataatgtcagcatttcctgggttggacattttcatcaatccgttcgtcttgaggccaatggcggttctcacatacaaaccangagaactttcaggaaccatggcacccc

SEQ ID NO: 5065 - DNA, 574 bp, Triticum aestivum
  Clone ID: PAT_TA_5065
agacaaccatgcccatgggcgggaaattataagtcgctgcggtacagaaatagtgctagacaagaccagacaggtcccattactacagcagtgaaaagatcatagagttcatcaacccttcttcatatagctctccattcttgccctactattgtttcggtgaaccggtttgtcaatcagttaggcaacaactggacatagttgcatgggttgcctgcatgagagtcaaaaaagaacgagaaccagcaagacagctgaagttagctattgaaattctttaatgtcaaagctcggcaaagttgtggctacaaggattagtaggaaagttgcaccactagaacactaaccaattgaagtggaacaagaccagtgcatgcataaatgaagagaacatatcacagtcagcaattctggataaattggcatattctcaagtgtgcagcttaacaaaattgctcggaggatagataagtcgggaacaatatgcctcctctgcaagttctaaggaaacaagatcagattcttcaatatttaaagagaactggcttttaactcatttgctcttctacaaaat

SEQ ID NO: 5066 - DNA, 1857 bp, Triticum aestivum
  Clone ID: PAT_TA_5066
cccacgcgtccggcatcctaaaaccctcgccccatgtcgctctccaccctcaaccaccccgccgccgccgccgccgccgggcgggggaggtccttctccccggccgccccggcgccgtcgacggtgcgcctgcccaggagacaggcccccgcccccgccgccgcgtccgcgctcgcggtggaggcggacgccgccgccgacagggtctcggcgctgagccaggtctccggcgtgctggggtcgcagtggggcgacgaggggaaggggaagctcgtcgacgtgctcgccccccgcttcgacatcgtcgcgcgttgccagggtggagcaaatgctggacacaccatctacaactctgaaggcaagaaatttgcccttcatcttgttccatccggtattctccatgaaggaacactctgtgttgttggcaacggagcggtgatccatgttccagggttctttggcgaaattgatggtcttcaatccaatggagtcagttgtgatggaagaatactggtgtctgaccgggctcatttgctctttgatctgcatcagactgtagatggacttagggaagccgagcttgcaaattccttcataggaacgactaagagaggaattggaccttgttattccagcaaggtcactcgaaatgggctgcgagtttgtgatctaaggcacatggacacttttggggataagcttgatgttttattcgaagatgctgctgcgaggtttgaaggcttcaagtacagcaaaggcatgctcaaggaagaggttgagaggtacaagaggtttgcagagcgtttggagcccttcattgctgacactgttcatgtgttgaatgaatccatccgacagaagaagaaaattctggttgaaggtggtcaggcaactatgctggatatcgattttggaacttatccatttgtgacttcttctagcccttccgctggtggaatttgcactggccttgggattgcccctagggttattggcgacctgattggagttgtaaaagcttacacaacaagggttggctctggccctttcccaactgaactgcttggagaggaaggtgatgttcttaggaaggccggaatggaatttggaacgactacaggtcgcccaagacgttgtggctggcttgacatcgttgcactgaaatactgctgtgacatcaatgggttttcctctctaaatctaacaaaacttgatgttctgtccgggttaccagaaattaagctgggtgtttcttataatcaaatggatggagagaaactacaatccttcccaggggatcttgacaccctggagcaagtacaggtcaactatgaggtgcttcctgggtgggacagtgacatatcttctgtccgaagttacagtgaactcccccaagctgcccgccgttacgtggagaggatagaagagctcgccggtgttccagtccactacattggtgtcgggcctgggagggatgctctgatatacaagtaaagggcaaactcgatttggtactattgtatcggacgaaataattcagtcttaactaggccgatgcgagcattgctgtgtcagcacacccttgattgccaatcgtagcgggtaatacaattgacaagctactggcgggcggggtgatgtaatacctgcaataatgatttccgggaaatgtcccgatatatcaccataaggatgcagtgttagagtttggtggtaacattttgtctttcgactccaccaatggtttggtggtattttcacaattcaccgtcatattttgcgctgattatgaatgatgaatgctttcttgtgggcaagaaaaaaaaaactgaatgcccaactacggggggtgcgtta

SEQ ID NO: 5067 - DNA, 646 bp, Triticum aestivum
  Clone ID: PAT_TA_5067
cagcaaatgtcaccagaggaagaggagcgacggagcgcgctgccaaggcggctgcagaagcccgaaaaacggccgttgccaggggtgttaatctgcgcaacgggcctgctgcgagcgtttctgacatcaatcaaattctcaacctcatcaactctgctgcttccgcgtctgctgcttcttccggcaatgctcaggcaaccgaatctgaagtgccgcagtccaacggtcctgccctgaatggcgcaaaggagtccaaggatacaagtcggccgtctgccaaggctgacggtcaagccccagtaggattaggtgcgtcattggagctgaagaagcagaagtccaagcagaaggcatagaaaggactctgcaatggctgttttctccttacaattttggacctctagggtgatcattttttggcccatagcattgtcacgtccacataatggcagagtaattttatttatggtgggatggggttcgtagaatgagtgcaataataataatagcaacgaggatggggtgaagacaaattcttgtggcgatactgctgattgatgagataaaaagccttccatatctaatttctgtaaactggctacaccaatttgtttggcacacagaaattaacaagctgaaggttcat

SEQ ID NO: 5068 - DNA, 3087 bp, Triticum aestivum
  Clone ID: PAT_TA_5068
tcggcacgaggatctataaagaaatccccgtcccggcaggtgcccgccggtccccccccctcttttgggcgccaaggctctgtcggctgtgccaccgcttccgatgcctcggctgccgctgcgtacgcacaccgcacctccagtgccacccctgccgcgccatcggcagacactcgaggcttccccgcataatttcttgacacgccccagatattgaccgggtaccagcctgttcgcgctctacagtcttgccatggcaatgatgctttggctagagggctcggggcgtgtcgcccaggtgcggtcatcccggggtttgctctggagcttggcaagcttgacgcccccccttttggtgctgttgcttttgccaagatgctgcattgcaacgagttattccttgcgtagctgggcgaggctgcaggccggctccagctgttgccgcatgtgggggtcgttggttcggccgagcctgttgttagggctgctacgcttgttggcaagggcatcctggggcgtggccccggccattatattgcgcctccgatgagagtgactcctcgagattctaactacattggactgcagcaccgtttctgtgtgttgagacctgaccttgtagcctcatttgtcgagggtgaatgcataaagaaatcccctacgcagaaagttccggatgttcccacagaatcgaatgggcaagaatctgatgacattgccagtggttctgatgctacggctgtttctgcggaggaacatgacaagtctgatgaaacccctgtttctacacctgccgaaagtaatgactcgactgctgaaattcttttcaatccaaatgtatttacggagtacaagcttgctggcagtcctgaggagattgaagccgatgaagctttggttaaaaaggttggttcgtatctgctagatacggtgatcccgaagtttgttcaggatctttgctctcttgatgtctcccctatggatggtcaaactttaactgatgtgctgcatagcaatgggataaatgttaggtatctaggcaaagttgcaggcttgatcaagcatttgccacatctgtgggacttattttcggctgagataattgttaggtctgcgaagcatgttgtcaaggacatactgaggcaaagcccggaccataatattgcacctgctgttgctcatttcttgaattgtttctttggcaaagttttggctgcttcaacaaaaggtagtactggcagcccgcagtcgaaaacccagaagaaatcaagtcaatcagcttcttcaaaaaagggtcaatctgcattttcccagctaacatctgacggagtttggtctgacattaaggagttcgcgaaacataaataccagtttgaagcgccggatgatgtgagggttggggctaaaagagttgcagttctccgcaatctttgccaaaaggtgggaataacaattgctgctcgcaaatacgatctgcattctactactccattccaaccttcagatatcttgaatctccaaccagttgttaagcactcagttcctacctgtactgatgcaaggaagcttatggaagctgggaaaatccggatggctgagggaactctaaatgaggcgtatgcactattttctgaagctttttctctacttcaacagatcaatggtcccatgcacaaggatgctgcgaactgttgccggtaccttgctatggttttgtaccatgccggcgacacagcaggagcaattgtgcagcaacatagagagcttatcataaatgagcgatgccttggtctagaccatcctgatacagcccacagctacggtaacatggctttgttctatcatgggctcaatcaaaccgaacttgcgctgcgacacatgtcccggacactgctgttgctgagtttagcatctggtcctgatcatccagatgttgcagctactcttataaatgtggcgatgatgtaccaggatgcgagcaatatgagtactgctcttaggtatcttcaagaagcacttaagaagaacgagcgccttttaggcccaggtcatattcaaacagcagtttgctatcatgctctcgccattgcattcagctgtatgggtgcatacaagctttcagttcagcatgaaaccaagacacatgatatactggtcaaacagttggggagtgatgattcacgaacaaaagattcagaaaattggttgaatacatttaaggggcgagaacagcaggttattgcgcagaagcaaaaaggccagggaactgtcccctctgctaacgctgtggaattcttgaaggctcatcctggattattccaagcaatgaaggcagctgcgatccaatctggtggtgacggaccagcaaatgtcaacagaggaagaggaggcgacgagcgcgctgccaaggcggctgcagaagcccgaaaaacggccgttgccaggggtgttaatctgcgcaacgggcctgctgcgagcgtttctgacatcaatcaaattctcaacctcatcaactctgctgcttccgcgtctgctgcttcttccggcaatgctcaggcaaccgaatctgaagtgccgcagtccaacggtcctgccctgaatggcgcaaaggagtccaaggatacaagtcggccgtctgccaaggctgacggtcaagccccagtaggattaggtgcgtcattggagctgaagaagcagaagtccaagcagaaggcatagaagggtctttggagctgaagaagcagaagtccaagcagaaggcatagaaaggactctgcaatggctgttttctccttacaattttggacctctagggtgatcattttttggcccataggattgtcacgtccacatagtggcagagtaattttatttatggtggggtggggttcgtagaatgagtgcaataataataatagcgacgaggatggggtgaagacaaattcttgtggcgatacttctgattgatgagataaaaagccttccatatctaatttctgtaaactggctacaccaatttgtttggcacacagaaattaacaagctgaaggtttttttgagtcttattcaaagaaaaaaaaaaaaaaa

SEQ ID NO: 5069 - DNA, 2169 bp, Triticum aestivum
  Clone ID: PAT_TA_5069
gttcgctgttaaccagcatcgctactacaggaaaggctccatattccagtgttattacccacggttttgtattggacaaagacggtttaaaaatgagcaaatctgttggtaatgtcgtggatcctgagaaagtgattcttggtgggaaagattctaagaaagagcctccttatggagcagatgttctccgtctatgggtttctagtgtagattacactggagatgtgttgattggttcggaaatcttgcgccagatgtctgacatgtataggaaactacgaggcacaatgcgttttctgttagcaaatctccatgattggaacccggagaattctgtgccctacagtgatctgccgaaaattgaccagtatgcacttttccaactggaaaatgtcgtggcgtccatgaaggatggttatgataattaccagttctataaaatatatcagatcacatgcgttgcacaattgttatattatgtgatgccatatgcttaggatggtccacttcagatatacatcgacgcatgtgtctctatttcagacccttcagagattcgccatcgttggtttgtccaatttccattgtgttcttgcaaaagaccgactttatgttggtggccgagttagctgcacgaggaaaagctgccagaccgtacttgctgcacatctactctaccttgttagggccattgctccgattatgccacacttagcagaggatatctggcagaacttgccctttcaacacaccttggacggtggatctgttgccaagtttgcttttgatctaaaatggccagataagaatgaagaatggtgctcagttcaaaaggatgatgttgattttctgggtgttatcctggagttgagatcagaggtgaacaagattttggagagcgctagaacagggaagctgatcggcgctagtttggacgcaaaggtttatctccatgctgaaaatcccgatacggtatccaaactgaaggagctggcttctgcaaccaatgatgcagatgctcttcatcgcctatttatcacgtctcaggtggagattctcccatccctgagtgaagaaaccacatcgggtgtgtcctatgcgggaaagttcagcgacccacgcacgggagagatctggatcggtgtgactcgtgcggatggcgtgaaatgcgagcgctgctgggtttacaccaaggacgttgggtcgttcgttgaccatcctacgctatgctcgcggtgccacggcgtcattgatctgcaaccgcaagcatctcctgccgccgccgccgctgtcgcttgaagagcggcgacctggatctaacctccacttcattgtgaagattgcaggtggaattcatcgttttttgttccacgaagaaagctttgaccgttatactgaacaaaatagaagagaagatttttaggggcttctgaaaaccggttttgaaccccattttctttgtatgtagtacaactacacacaggctttaccaatttttagtaattggagtttttgaccttcctgttgctgaaattcagaatactttacactatctggtaaagaagccttctgcaaccaatgatgcagatgcccttcatcgcctatttatcacgtctcaggtggagattctcccatccctgagtgaggaaaccacatcaggcgtgtcctacgcaggaaagttcagcgacccacgcacgggagagatctggatcggtgtgactcgtgcggatggcatgaaatgcgagcgctgttgggtttataccaaggacgttgggtcgttcggtgaccatcctacgctatgctcgcggtgccacggcgtcattgatctgcaaccgcaagcatctcctgccgccgccgctgtcgcttgaagagtgatgacctggatctaacctccaattcattgtgaagattgtaggtggaattcatcgactttttgttccacgaagatttgaacactgaacaaaatagaagagaagattttgaggggcttctgaaaccggttttgaaccccattttctttgtatgtagtacaactacacacaagcttgaccaatttttagtaattggagtttttgaccttccaaaaactgtattgcagaactcttcccactatacagtagatgaaactattttgcgcctaaaaaaaaaaaaaaaaaaactcgaactatc

SEQ ID NO: 5070 - DNA, 769 bp, Triticum aestivum
  unsure (1)..(769): unsure at all n locations
  Clone ID: PAT_TA_5070
gaattcggcacgagcttcctttcattcgccagagttgcacagtttaggaaactaacactgtgcacctttccggccctctcactcctccgtcctcccgggccgttccttccattgtgtagcgcaatagcaggcacggctagccagccacgatgctaacggcgaccaagtctctggtaggcggtgcatgtgccgccccgtcgccggcccggcggcggacgttcgtggtgcccgaggctcgccggaagccaggcaatggccgccgcaccagtgtctccaaggtcggcagcaccagcaccaccaccactaccaccaccaccttgtcgaccgactccaatgggacggccgttggcacggtcgcccgcccggacgcccacgtccgggaccgcacgcagaccaccgagatgaaggccaccgtgacggtgcacatgagtaaggcggccggggttcgtgatttcctctacgatctcatcctcaaaacttggttgcacgttgacctcgtcagctccgagttggatccacaaacggggcaggagtgggagcccatctccggggccgtcaagcactcaggtagagtggacgtcgagtggcacgcactnaagngccggatcttgnccattgggcgtcagcaaaactcacacaganatttctgggaancagctccacggcagagacnctantcangatccgtnacncatgacccaaangntnttcgggtcaatctcancaggnggggtgccccacggccngattgggggggcattnnatnttt

SEQ ID NO: 5071 - DNA, 822 bp, Triticum aestivum
  Clone ID: PAT_TA_5071
ccacccgtcccgccccggtactcggcccgagaaaaaactctctctcatgaacctcacccccaccctcggtccagttcctctcccccactatctccgcgccgccgccgccacccacgtcggccggttccggcgagctccggccgcgcgcaacatacccccaagctccgcccctctatccccccttccagatccgcgcctcaagggttgcacccttgcccgccgctagggtttcaggctcctctcgtgttcttgccagaatccaccacaatcggcgatggcgaggccggagcttgcgggatccgtctacggtgttgcccaggtcaccatggtgcagagacgacaatgatggcaagagggcacaaaccttgccctgatcgaggaggaggaggaggaggaggggcgcacctagatgccagccctgctctgctcgaggaggaggggtgggaggggtctgctcctagggcgaccaagaggtcctgcccgagctcaagcatggccatgatgacccaccacagcagcgatgatatccttgtgatctactccagcaactgtgttgttggagcactgccctcatgatggaatgatatagtgttttatgtagtttttgatatcttagctctgacggtaacatcatatcagttaggagtagtgtttaggaacaattagaatatgttatggtcgtctaatagagagagattcaagggccttcccagtttggacaatcaaatgtgttcacaaatgacatccacgttggttatctaggtcctaatggtgatgctacggattttagtacattggttgagacccaagttgatctgtgct

SEQ ID NO: 5072 - DNA, 1102 bp, Triticum aestivum
  unsure (1)..(1102): unsure at all n locations
  Clone ID: PAT_TA_5072
tcttcccgtaggtgattgcacgggtcgttgatgtggtcgcggtggtggttggcgtgcatcggtggggtgcgggtggtggtggctcctcccttctcctgggctcgggtcggcggcgcgagttgttcgcgtggcagagatggccacgacatggggctcgtgctcgggcggactagattgaggcccgagagttggagctttcgctctgggtaggcgatggtgggcttggtgcgggtggtgcccgcgggcgatgaggtccctctccttgcgggtgcagtgttcgatggtggtggttgggactccgctgttctatcgggcagatctgtgtcgatggccacggacatggcattgtgagcgtgcttggcagcggtagttggtagtcacggggttgtgtctcccttggtccattgggactggctggagatgcaggcatgggcacctcctaccgtggaggagccgacctgactctgtggcttatatcgggctaggagtgaaaggagacgcctttttctgctcctaccgtggtgggtgcatcgtgatgtgggcggttggtggcgtctcggacatggatgccggggcggcagctacggattgcggtccgcatggtgggctctgcggtnnnnaccagggcggtggcggtggcttttcctcttgatcgtgtgggcggcaagaggtggagcgacaagtggctcggcgcgctctctgtcactgacaatggcgtcgcctcgattcggatctggagatctgggctcgctgggcttgtcgtgaagacctcgtggtggcatgggggagccaccgagtgaaaactctgcgctttgtcgccgatgatgatgacgctagcgggcgccgctctcttcttgaagacgttgtggtggtgatcctctccgtgtctgggttccggatgaaaatctttgtccagtgtggactcgggagcgacgatgcttagtgccattcttcctctcgggggcgttgtggtggagcttaggtgatatagggcgtagcgtggtgttgtactcggttctttctgtgctatttttgggtagcatagttgcttgcgttctgcatggtttgattatcctaaaatcggcattgtatgacggctacc

SEQ ID NO: 5073 - DNA, 823 bp, Triticum aestivum
  Clone ID: PAT_TA_5073
ttttttttttttttttttttttagtgcttttgagcctttcaccaatgtaaaccattaaaacacactgtacacattcaatctttgtgaagagaaggcttcgaattaagttttagaaatagaagaattcgaattagatctacaacttgctctgctacacatgacacataacaacttcggagcaataactagcaactgccttttacgctacaaataaccaagattgataaggtctccaaaacatcacatctatcagatgaagaaaataaatactaggctgatcttggtgccagtttatctaaccaagataggattatcgcagctcctttctcccacgagcaatctaacatcatatcatgtgctaccccttccacacagacaggttgcacgttgtaaaatcttgcagtttcagaaagcccttccgcatcaacaatgaaatcattgcttgcacccatgacaaggatttctaatgtaccatctgtggcagaaggtacaggcaatgatgcattgagcttcctcaagtcaaatagtggcaactttgagctttccttcattagattttggtacctcaggacaagttcatcatccatttgtgatgagaaaaatgtttctttgcagagaggcaatgaatttgcatatgcttttgcggccaagctgagtgtaaccttgatagcagcaattggtttagtcaaaaggtaacgccatactaatccactgtttcccgagggaggtacagaacagacaagaacagcgccagaaagctttggatgaagaggttctgaaccttgtaggcatgacatatattgctgcacaatcaagcctccaa

SEQ ID NO: 5074 - DNA, 521 bp, Triticum aestivum
  Clone ID: PAT_TA_5074
tttttttttggggagagtcagatggtcagttccatcatccatctcatatatactcatgtatctgcaatgcagcagtgtcaagtgtatcgatcaatttcaacattcccgatctgtctccatcccatcagctggcagaacaaacgaaaaggaaggaaggaaggaaggaagaaatgcaaagcagagatgcatggatgaatgatgatggcagtatagatcactgttgcttctggttttgcttgctgcggtagtatgccatgccccggatgccgtcggggtccatggcgaatcccagcgggcggtagaacccgaccaccctgggctccgcgtagagcacgatgttgccgacgcccttgcgccggagctccgccacgaggcgctccatgacggcgcggccgagcccgaggccctggcacgacggctccaccaccacgtcccacaccaccgcgttgaacaccccgtcgccggccgcgcgcgcgaacgccacggggcgccccgtcgcctccgacgccagccatgccacc

SEQ ID NO: 5075 - DNA, 691 bp, Triticum aestivum
  Clone ID: PAT_TA_5075
aacccattagcgcgcatcgccatgttgtctgatcatttcctgtccctaattcacggggttggaactgctcttggtactaatgagcagtttctgaccgtgtgcgtgcgcccagctgtcgtgcgttcgacgcctgcgcggcgccgcggccgaggttacatgtgatatcttcactcgtcgtcttctatgtggctggtctccaggacataatccctcatgagctttatgttgccttcatcaaccatcttgaacgatagcttcttcaggttgtcccactcgaaatcattcttcatataagccgatcgaacctccaaaatcctcatagctaatgccttgtgtcttggcgactcgcggatcaggtttttgcagaaactatcagcgtcgttcacggagttgcgggtggtgaactccttgagctcaacataggcttctcggttgtaactctcaagctgtgccagcacaatcctgacggccaggtaattgaagaagttcagcagactaatcgccgcctttttctcttagtgagccctctcccaaagccgggaacatacatcttgtggcaccgaggcggcgcctcgaagctcacgagccgcctccgccgcctcctctccgtcccccagaacgcctgtgcgggtaggtgttgccggcgacgaggggccactccggcagggtggggcaggacggcgcagcgaga

SEQ ID NO: 5076 - DNA, 730 bp, Triticum aestivum
  Clone ID: PAT_TA_5076
gaattcggcacgagcagcgaattcggcacgagggtgagttcatcgcagcagcttgcttttgtttcctttcttattatgcttcttatacagcttctgtttgataagcatatcttaagatgaagggtctcttaatttctgaatcttcaaaggtagcatccgctgattttttgtcttggggatgctgccttcccaacatttcttgtcaggagccgtccatttctgttcaaaattttttgtttttgttcttccagcctgtccgttgttgagctgaagcatggacgcctaagaacacctcagtagtcttctagactcgtcatgaagttcacactccatttttgggttcttttctgttgtctgtatgcactaagcaagaatatctatgcgaggcccgatacagtgagcgttggagctcttttcacattcaattccacgatagggagagctgccaagattgccatttctgctgctgtcaatgagatcaacaccgattcaagcatccttccaggcacaaacctggttgtcgagatgcaagattccaactgcagtggcttcgttggcattgtgcaagcattgcaattcatggagaaagatacagttgcaatcatcggcccacaatcttctgtcatcgcgcatgttatttctcatgttgcaaatgaacttcaagtgcctatgctgtccttcggtgcaactgatccaactctcacgtcacttcagtttcctttcttggtga

SEQ ID NO: 5077 - DNA, 982 bp, Triticum aestivum
  unsure (1)..(982): unsure at all n locations
  Clone ID: PAT_TA_5077
cggcacgaggacgacacattcttaaatgcaggcaaggaggggtggcttctgctcctcctcctcctcctgcaacggtacaagnagccagcgccagcaccatcacttccccactcctccactagccactgcccctccctccctcaccccccacacacgctctcttcctccatccacccctccctccattctcccaaagaaagcttgcaaacagtggtggctctgcagagatgaccaaagatgaggacttcaagctggtcaagatccagacccatgtcctgagggtgaacatacactgcgacggctgcaagcacaaggtcaagaagctgctccagaggatcgaaggcgtctactcggtggccatcgatgtggacaaccacaaggtcacggtgaccggcagcgtggactctgagacgctgatccggaagctcaccagagggggcaagcacgcagagctgtggtcgcaccagaagggcggcaacggcggcaacaacaacaaccagggccacaagggcggcggcggcggcggcaacaacaaccagcagaagcagcagcagcagcagcagcagcagaagcaggctgcgaatgtgagcaaggatggcggcggcaagggcaatggcgggcagaaggagcagggcaagcttggtggtggtggagttgggagcctcatgcagggcctcaaggccttcaagagccagcacagcaagcaccagctccctgagctgagctcggacgacgacgacgacgatatgtatgatgatgaggatgatgaggaggatgatgagtttgacgatgagtacgaggacgacctccgcttcctcggggacaagatgagccagctcggcatcctcaggcagcgtgccgaggctgcggcggcgatcaacgccaagaacaagaacgccgccaatgtcggcggcaagaaaggcgccccggcagggaacaaccaccaccagagcaaccagaaccagaagatgaacatgggcgc

SEQ ID NO: 5078 - DNA, 791 bp, Triticum aestivum
  Clone ID: PAT_TA_5078
cgtccgcccacgcgtccggccacgcatccgcaaaggtcaccacatcccgaatgtctagggttttcgtccagcgaatcgaagaatcaagaaggagtcgccatggcgtcgcggccgtcgctgaagcggaagcgaagggcgaagggcaagggtgggaatcaggggctcgtccgcggccgaggacgagcagtccaccgcggcggtggcggtgcagctcgccaaggagtggagcacgtggacgatgaagacggcgaaggtggtggcgcactggggcttcatcccgctcatcatcgtcgtcggcatgactaagggagacgagcccaaacctagcttgttccagcttctgtcccccgtctgatccaatccccggcgagccctagactggatcgatccatctccttttagttactatactagtagatgtttttgctgtttattgaatcctggtggttgagttcttgatccctgggtggtgatcttttatctgatctgtgtctaataatgttatgtggtcggatcgatcctggattggatcggatcttgttagatacctgagatgctacggatctgctattaatatattgtactatgttgaactttcagtgttaggagtctaaagttgtatttctctgcctgatgcgtgtgtatgttttaattgaactaattgctttgattgattaaaaaaaaaaaaaaagggcgaaaaacatttttttttttttttgctttcaagggtgcattcttaccctaaaaatacatgcggtgggaaatttactttttcctatctaaataccagt

SEQ ID NO: 5079 - DNA, 841 bp, Triticum aestivum
  unsure (1)..(841): unsure at all n locations
  Clone ID: PAT_TA_5079
tacccacgcgtccgggaagccaccgctggcggaaaagcttcggcctttgtccccattgcccgccgcggccactccctcccgctgcccccgatgatcccgcactccatgtgaccccctcctcctctgccagattcggccgcgggtgattctcagggccgaatcatcgagcgccgcgcatgagcagctggagattcgtggcgggctccaacgtctgggtgaatttggtggcggtccctgccaatttcgccatcgccgtggtggaattcgcgctgtggagctccgcctggtgcttcctggccatcttctccgccaacttctgagccagaatctcacgctgtttctgattcccaacctgtcggtgcagattggattaggattgctgtaattggggctgaaatgattttttagctgatttttaagaggggaggtcattttgactggattgggtttgaggatggaggagaggctgtatgatgccggcgatggctccgctggcaatccgagcgctgaggatgccgctggcaacccgagaggcgaggacgtcgccgccaactcgagaggcgacgacgacttcaggagctgctgtggggacgaggaggagtgggagggcacggaggagtccttcacggccggcgtctccgaagcggagctcgacgagacttcagtgcggctcttcttcaagggcgtgtcgagctcggacgcggatgggaagaagctgtccgggatcggcgtggtgatggagcggacacctggggtgcctcttcatagggtgcagaagaagctggatttctatgtggatgagctggtggctgnncacttggcactcatggatggcctctnn

SEQ ID NO: 5080 - DNA, 738 bp, Triticum aestivum
  unsure (1)..(738): unsure at all n locations
  Clone ID: PAT_TA_5080
gcggcgccacggggcgcacgcgacagtgacagaccctcagcgcgagtcccagcagctagctggactgaacttctctacatgaagtgtgatttcacttctccacgttagttctcaggttgggatttccgtacactacccccgctgtcatcacttgcccacacctgtcttcatgccgatcccatgacttcccgaccgtgcacagttatcctgtgaatcagcttccagtgagttctcgcactaggtactccggttatttagtggagactgtcacgtgggtggacgaaagcgtgggtcaactcctgtagtagatatctttcatttgcagtcaagtttagttatggttataggatggaaactttgtattattttgccatcttctttcctttgtgaaactagctgcaacagttaggagtttaaattgatgcgaggaagtaagtaacacaaactgcattcttcttatttattattccctcggaacagatttttcaattcagcaccagcaacaagacaccctctctcttccgccttctagctggcccagcggcgttgtgcgcaggttagctcatgcatggtctggcgctccagactcggcggcgtctgctttcttcaggtggccagcctcgtcgttctgccaatccaatgactttccatttccaacaatggaaagtcatccgaagaatcatgtcccggtgagtagtccagctccagcaacaagaccacatctgatttccaccaagn

SEQ ID NO: 5081 - DNA, 2084 bp, Triticum aestivum
  Clone ID: PAT_TA_5081
ccgcgcccccccgcgctggtgggctgggaagggcgacgcaaaccccccaactcgcgcccaccttccaccccagatctcgcggccgccgccgccgccgacgagatgctcctcctccgcggcctcctcctcgccgctctcctcgctgtcgcgcggcagcccctggcgtccgcctccgagtccgaccacaagtacaaaatttcacgaaccatgttaagctctgggtaaacaaggttggcccgtacaataatcctcaggaaacatacaactattacagccttccgttttgtcaaccatgctgaaaaccctgcacacaaatggggtggactcggagaagttctcggtggcaaatgagctgattgatagtcagattgatatacagtttcccttttttgtggactaggcttctctttgcagaatttgttcttgacgcttaaaatcttctaccattcatttgcggccataccatttggaacaatgtttgtcatatttgtcctctgggcttttatctctttcccactggggctgtcgggcacagtcgatggtagcaactgctgtcgtgccccacacaagactatcggtgtgaagtccatccctcgcccgattattgaggtcaatctcactcaagagccttctgtgctccctgtgatgggtgggcttcttcccttcggcagcattttcatcgagatgtacttcgtgttcacttcattctggaactacaaggtgtactatgtttatggcttcatgttgctagtctttgtcatcctcctaatcgtaacagtatgtgtcactattgtgggcacttatttcttgttgaatgctgagaactatcattggcaatggacgtcgttcttctcggctgcatcaaccgccttgtatgtatatctatacgcaatatactattatcatgtgaagacaaggatgtcaggcttggtccagacaagcttctacttcggctacacgttgatgttctgtctgggactaggcatactacgtagatggcagctcttatcctgcttctaattgtatttgcaattgaatctatgcattatgttggtgcgggtactattatcctttcctttattgtgttattagcacttacatctttcatttctgtagatgttagtggcggcctctactctaggaatggcggcaaaaactggataaagtctatggtccttaccgcgtccctttttccattcttgtgcttttcaattggattagtgttgaacaccattgctatcttctaccattcattagcggctataccatttggtacaatggttgtcatatttgtcctctgggcttttatctctttcccactggtgctattgggaacagtagttggtcgaaactggagtggtgctcccaataacccatgccgtgtgaagacaatcccacgtcctattcctgagaagaagtggtacctaacaccttctgttatctcattgatgggtgggcttcttcccttcggcagcattttcatcgagatgtacttcgtattcacttcattctggaactacaaggtgtactatgtttatggcttcatgttgctagtctttgtcatcctcctaatcgtaacagtatgtgtcactattgtgggcacttatttcttgttgaatgctgagaactatcattggcaatggacatcgttcttctcggctgcatcaaccgccttgtatgtatatctatacgctatatactattatcacgtgaagacaaagatgtcaggctttttccagactagcttctacttcggctacacgttgatgttctgtctggggctaggcatactttgtggtgctatcggctatctggggtcaactttgtttgtcaggagaatctacagaaacatcaaatgcgactaaactgcttctccgattctgtaggctattagcacttagcagatcatgtgttgttgagtaacgcttctaagattctaattaacttttggaaactatacaggaggtggttctcccttcgtttaccttaatatacttttatttttggtctatatctacctccgtcatcaaactcgcactataaatgtatacctatattagttcggaattagtctcagcactggg

SEQ ID NO: 5082 - DNA, 502 bp, Triticum aestivum
  Clone ID: PAT_TA_5082
aaggcggcaaaatctttatctttacctactaataaagcagctatcccttctggtcgtccgttattagtacttttgcataaaagcccttaaagtttatatgaatcaacccgcagtccaaggtcaacccaaacagttacgagcgatagaaaaaaaaaaaacactcccaatcgcatctccatctccagcgctccgccaccccccgccgcgagccgccggccgcagccccgccgcagcccgccgccaccgcctaccccgctggagacactcgaggacgcggccgttgccggctcccacacccgcgggcctccgtcgcaagcggaggcgaggaggtggcggggttcttggtggtcaccggcgtggcgagggccgaaggggtcgccggcacgggtgtcgggcgcggtcggagcataggaacgcggccggcggcgcggcgtaggaaggcgaggctggtgctgaagcttgagggcgcggacgccatggcatgcgtccagatgacggcgga

SEQ ID NO: 5083 - DNA, 769 bp, Triticum aestivum
  Clone ID: PAT_TA_5083
ttcggcacgagcttatgcggttccataccatgaaaatggaggagataaataaaataattaaggaattgtggcagcagacatacagaggccaagatattgattgcataagcatcaattctgattctgagggtgcaggcactcgatcatatagctaccgtgttgtcatgcaaaatggtggtgctgagctggaaatgcgggggcgatgcagtgctggtcagaaggtgcttgcttctcttataatcagactcgcactggcagagacattctgtctgaattgtggcatattagctctggatgagccaaccaccaatcttgatggaccgaatgctgagagcctagctgctgccctattgagaataatggagagtaggaaaggccaggagaacttccagctgattataatcacccatgatgagcggtttgctcagcttatcggtcagaggcagcttgctgagaagtattaccgaatctccaaggatgagcagcaacacagcaaaatagaagcccaagagatatttgactaactatgtttgcttggaacatatatgctcccagtgctaatcctcctttaccggccaagtgtgtgcggttcattatgatgggctgtcatggagagaactgggtaccagcgaactggtagtaggttctttagtttggtttctgtgcatgcaattgcttgcttattcttgtatataatctggaggtggtactgtgttgtgacttttctcttctcccttattcttgaattgactcctacaaaaaaaaaaaa

SEQ ID NO: 5084 - DNA, 925 bp, Triticum aestivum
  unsure (1)..(925): unsure at all n locations
  Clone ID: PAT_TA_5084
gaaagagacgtggaaacggaccatcaggttggaccgcagctaccactaccacaccagattggaccccttcggcctcctaatccaccccccctccgtccgtttaatcttccctcgtctccggtccaagttccagcacaaaaggaagcccagcccctcgagtcctcctcctccccctcgccgcggctccggcctcaaactccgccctttaaattatctgcggcgtcttcttgggtacgcgtcaagaatcctgccgcgctgcgtcgccgcggttggtttttgccggaggttgtgggtaggttgccgccggccggtttaggatgaccgaggacgccagagggcgagcggtcaacccggcctgccccaacgccgccaaccccttccaccgctgcgccgagtactgccccgtcgccgcccccgcgggcaagtccccgccgccgccgcagcctggccgcgcggcgcacgagcgggaccggagcgcgcggcgacggagcgggaggggcgaggcagcaggcggtcaacccggactgccccaacgccgacaaccccttccaccgctgcgcccgactactgccccgtcgcggccccggcggtgaagtcgccccctctgccgccgggccccgggggccaaaacgggaagacgcacagcgacggcgaactgcagccaggacccccgccccgacaaggccggcggctcccgcggcggctcccctctaagtctcctgccttaagntcctccgacgggaagnaanaagggttcccggtgcccaacgcgccaacccttcaagtctcacaaacaatgctcccaaatatcaaggtgcccnctccgagggggaatcccaatcctctntccgcatcggcgccactctctcgaaatgaacttatccgggaaaaagggnttaancccattcgacctttaaagtgaaan

SEQ ID NO: 5085 - DNA, 477 bp, Triticum aestivum
  Clone ID: PAT_TA_5085
agctgatgacatatatggagctgggttgcttattgcatacatggcatttattccgttttgcgaacacgggcatcatggatagcatttccttgcagaggctcttggagaacactttccgtctcgacatttatgctgctcggcacgagtgcctggaagatgataaattgtcggaagctgtaaactttctagatttaggtgatggtgccggctgggagttgctgcaggcaatgcttaatccggattaccgtaaacgaccaattgctgaggctgtactgaaccataggtttattacaggggctctattatagaagtaatcatcagctagatgcgcttatacattcgtacaatagatggtggaggcaggtcccattgtgtgaaagaaatgttcaaatctaaagacatgttatgatcaggtacttaaatagtgtacctaaactagaggaacattgtaaatatatgcatgaacatcatttttgg

SEQ ID NO: 5086 - DNA, 378 bp, Triticum aestivum
  Clone ID: PAT_TA_5086
cggacgcgtgggcgaggtactcggaggtggggagctcgaggtgctgggtgcgggagctcgaggagctgacgccggcgacggggtcctagtgctagggatggagctcaaggttctggccggcgggagatcgaggttctggccggcggacggaggttccgcgcggtggatcgcgacgagcggacggagaactgggtactggattgtaatgatttcaaatttcggaagggccttattgtaaaattgatttgttcacgattccgcctcccctggagtcatctattaccgaacggagggagtattaaataatcatcctagataaaacactcacatcttctatatgggtctgagcacggcaagatacttgacactatttttgga

SEQ ID NO: 5087 - DNA, 782 bp, Triticum aestivum
  unsure (1)..(782): unsure at all n locations
  Clone ID: PAT_TA_5087
ggatgcggcccgggccaaaagggaagagacgaagaccaaaagccaacaccaaaagcagcaagatatatacaatcccaggagcgttcttggttattttaagcccacaccctcgctgctaatcccctctttagaatcctcgggatcggccctctccccccggccggtcctctgcctgggcctccctgccagttcttcccggggcacttcgcacccaagatggaggggctctggctccggcttggcctctgggccggtgcttgccctcccacttcgacaccgaaagtcgaagccttgcgcctttccgagcgtcgacggtacggtgtgtgccctcccggttgatcgcccgcatttgcatctgaagaggatcgggatggccacgttcttctccacttcacacgatcaagaggggcttcgccggcggtggcggaggcggcggcgacatgtcattccaccaccactaccccatgtccaacccaatacccagactcgtcgaccggccgcctgatcccgctcccggcgtccatcctgcagcagaggccacatcgcgcacggcggcggtggcgacggccgagatgacgagccggccgcattcatgaactcgagggacagcgccgaactcggtggcctgcagacgcagatgctcatgggagacggcggcgcgtcagcccttcntaactcggccaagtccgggcctcacataggctcagcgatgtgggcgttccactnataccgacatcgnatgcatgngaanagacccaggaatttctnaanccggtccaggg

SEQ ID NO: 5088 - DNA, 742 bp, Triticum aestivum
  Clone ID: PAT_TA_5088
tcggagtctgtgtgttcgtaggctgatatcagcggacttaaagaacctggtatgaggactgctttatttgagctttgctgggttcttttttgcttctgttttgtttttgtggttgttttggtttttttgtggttgcttttgttgtgtgtgtaagcttggtggtgtttgttgttgttgttgttgttttgtttttttgggtttgggtggttgtgttggggtttgtttagttttgggattgttaggttgtcctgcttatgtttagagtgggggtcggtttgggtgtcattcggggtttgcatctttggttggatttttgaaggtgggttgtgtgagaatttttgtgctgatggcggggggtgtgtggtgttgttctctggtttttgttgttgttgagtttgtggtttgtcggggtggccttggttgttcgggggtatttggggtgggtgtggtcggggtcttgtcgaggcgtttttttggaagcttcgtatgctggctgagtctgtagggacgagtggcgctggtagctctttcgtggatcgtgtcgtctgtcttagtctaaaggttaatgtggtgacgctactgtgtgtgggggggcctaagttggggtccgggggctgggcgccgcgttccggccctattcccggcgacgctcggattctccgcgcgggtcccggccctgctcatttgcgcggcggtcctttagagtacaccccctacctcacacgggtcgcgcgcgcacgca

SEQ ID NO: 5089 - DNA, 765 bp, Triticum aestivum
  Clone ID: PAT_TA_5089
gaattcggcacgagtccaagcctacctgtagaggaagaagcagcagtggcagcggcagcaatggcagcagccgctctccagtgctgccctctgctgagctcaccgccggcatcatccgtcttgcccccgcccccggtaagaacaccggcggttagcaggacaggggaggccaggacgaggaggctgcagcgatgccgctgttcccagtctgccgaggggcgatcgccgggtagctcgcctccgcagctggagcgcctcttctccaatgtcaaccaggccaccatgaagcacgagcctgggagtatcaccggttccgtcttccttgtggccggcacaacggtcggggcaggtatcctcgcgatccctgccgtcacacaggaagctggattcttggcctcagcgggcacatgcgttttctgctgggcatatatggtaatagaatcgcaattgactgggtaaactatcaaacccgatgtattagaggtgacatgcagtcagagaagcctctcaaaggttgtaacagggctgttagttgctgaagtaaatgtcaatacaatgtgtgaactaggatctggaagtgtctcgctggtttcaatggccaagcgcactctagggacagctggagtaagaacagtttggtatgataaattcaatacggctgaggtttatttatgtataagacctccaaatcgtaattgggattcataagcctatcttttcatatttgtttatacattatgcacttcttgttgcgtatgtggcacg

SEQ ID NO: 5090 - DNA, 707 bp, Triticum aestivum
  Clone ID: PAT_TA_5090
ttttttttttttttttttttttgaaaccaaggaaataaatatgttaaatggtcttcactctatagttaatgatatgtaccgggacgagcggacccttttgacaactccgggctcacaaaaccggctgatgatatcattctaccactcaactccacgcatcgatgctcgaacaaaacaaaacaacgtgactcacttgattgatctgccggccgggctacgaagggccgctatgaccgtcggcctggtttcttccccgtgagtcgcaacattgcacaaaaatctgcagaagcatcagtagtggacctttgcacgtactgattgtcaatgtagtccttgtaactgcattatgtccttgaaaatctctgaaaatattacaagcaaggcaccccccataacaaatgagagggttaatttccctcctgggactataggggatataggagcttccaagtcatttgagtatctctctgaccaagacatggctgcagggaaaactccaaagagtaccagaactccataagttcctgcaaagtccaatgccttgaaaaatatctctggatcaagcagtgacaaaacaagcggaggcagcagagttactaggtacggcagcggtttgttctggccacttggtagtttgagcaagtctgcgatgaagtctgagagtcctagaacaaatccaatgtatgatgtgcctattgccaaaaatg

SEQ ID NO: 5091 - DNA, 1287 bp, Triticum aestivum
  Clone ID: PAT_TA_5091
cggacgcgtgggcggacgcgtgggccctccccgcaggacgccaccaccggcgccgcgagcagcagccagaagagatccatccgtccggccaagccgagagcagagcggagcaggggaaggaaaccggagagaggcccagcagccatgatgttctcgagccaggtcgacgccttctcgccgtcgcagttcaccgcgtcgcagaacgccgccgccgactccacccccaacaagttccggggcgcgtcgggcacgatgccgctgacggtgaagcagatcgcggacgcgcagctggccggcaccggcgagaagggcgcgcccttcgtcgtcgacggcgtcgagacggccaacgtcaggctcgtggggatggtgagcggcaaggcggagcggaacacggacgtctccttcacgctcgacgacggcaccggccgcatcgacttcatcagatgggtgaatgatgctgcagattctgctgaaactgctgcgattcagaatggtatgttcgttgctgtcatacgtagcctcaagggagttcaggacaagaagcgtgctaccgcttttgcagtcaggcctataactgattacaacgaggtcacgctgcatttcattcagtgtgtacggatgcacatagagaacacaaaatctctgtgaagtagtcctgggcgcaagcgactagcggaacaaacgcctcgctccaacagattgagcgaagcggccactccaccctccgcgaacccccacccggcgccagtgaccagtggaacaaacggatcagcgactgatttctacacacaggtgctgaatgtcttccgtgaaccggcaaacatcgagagtgaccatggcgttcatgtggatgacattgccaaggcggcctcaaactaccagcactcaagatcaaggaggctatcgactaccacgtcgatgtcgggcacatctactcgaccatcgacgatttccactacaagtcagcgttcgtcgactaagcctgtgcccggggccccctcggcatccccccgtgcgtcgcctctgtctggctccgggtgccgccaccgctcgctcccacccctcctgaggtggcccctggggcttgccccccgttggatccctctcagtgctggagttgagagagacatgacgcaccgttagcctgaatgtagcgaggacgctccaggggcatgtattactttaaattcctgtcaacttgttgccgtctaagtttgacagttgcatcgttttacatctgaataaccgttatgtgttcttttgagacaaagtgcaaagattgccgct

SEQ ID NO: 5092 - DNA, 933 bp, Triticum aestivum
  Clone ID: PAT_TA_5092
ggttcgccgaatgccaccctagcccgcctccacgcaggctatgcgcttccggagagcgcaagccggagcgcagctcctctgtcgtcgcatcccgacctcggaagtacaaggctgggaatgcggacgcctcctccacctatctgcccccgccgccgccacgcccgccgccgacgacgatggcaactaccgcctcaccctccaccacgaccactccccggtccttcctctcgtcgccttccttctcactcagggcatcgaagtcgaaccacctccggacgacgagaaggctgcccgttaatgtacgctgcgccagtagctctccggccgccgatacatcttacacgacgaaggtttcgcggaatgccaacatagccaagctccaagcaggctatttgtttcccgagattgccagaagaagggcagctcatctgctgaagcatcctgacgccaaaattataagtctgggaataggtgacactactgagcccattccggaggtcataacaaatgccatggcagagagagcacatgctttatccacagtggatggctacagtggttatggagctgaacaaggtgaaaagaaactaagggcagcaattgctgcaacctactatgcggatcttggtatcgacgaaaccgatatatttgtctctgatggtgcaaaatgtgacatttctcgtctacaggttctttttggatctaaagtgaagattgcagttcaagacccatcatatcccgcatatgttgattcaagtgttatcatggggcaaactgacttatatctgcccgatgttctgcccttgggagacagtccccccttggcctgctggcctgaaaatggatttttccctgatctttccaaggtcccacggacagatatcatattcttttgttcacccaacaatcctactggtgctgctgcatctaggg

SEQ ID NO: 5093 - DNA, 1066 bp, Triticum aestivum
  Clone ID: PAT_TA_5093
ttccgggcccccttggtccggaggaccctttgggggcatccggccggcacaccggttggatctacccaagtgcgtgtgcaccgtcttgatttccttctgaatggccacccttgcatggtatttactattggcttttgcaatacaattgaatcctaattgctttctttgctcacctatgtagctatatattctactgtgctcaattcccattacatatttgtggctctggagatgtagctgtctggctgagctttgtcaaaattccaggtccccgacacaactgtgtcatcagctcgcacaccgaacatagctccaaagggcgcaattaaaattgatgaattgtgccccccgataatcccaatgatttcgacaatgcgactttcacatcacatctctccctttgctgaatcccaccagcaagcttgacatccacatttttctccgggattgtctagattgatattcgggatggatccgaacctagttcttatagcttgtatagcagctacagcttctattccacctgcagcacctagcaagtggccagtcatcgactttgttgagtttactcttagctgaggattctgcccaaaacagcggccaagagcttcgaattccttgaaatcacccaactgtgtagatgtagcatgggcatttacctagttaatcctgcatcagctagtgcattttcaacacaaagaataacccccttcccttcaggatgtggttccgtcatatgatatgcatcacacgtaaagcttcccccccgtaatgctgcctccctgtctgcccccctttgcttcgcctccccgctgcgttcctccctcaagttcttccaaaagaagcacaccagccccttctcccatgacaaacccatcacgatccatgtcccaaggccgagaagcttttgttggatcactatttctctgtgaaagagctctacatgccacaaaacctcccaatccaattggtataattggagcatcagaaccaccacacagcatcaaatcagtttcccctctcatgatatgattggctgcactcaggatgcagaagttcctcgtgc

SEQ ID NO: 5094 - DNA, 480 bp, Triticum aestivum
  Clone ID: PAT_TA_5094
ggaacggcgagaggaggaaaatcatccgtgggctcacgtcgaggcatccagccgcgacaccacacgtccccgtcgcctgccagccctccgcttcccaccacctctgcttctccggaggcccaggcagcagccagcagccagcagcgggagcgcctcctagcccggggccagtcgggagctgatacgaggaggcggcggagatggcggacgcgaagcagcagcagccgccgcagacggcgctggcggccagcggcgtgtggaagacggtgaagcccttcgtgaacggcggcgcctccggcatgctcgccacctgcgtcatccagcccatcgacatggtcaaggtgaagatccagttgggcgagggctctgcaactagtgtcaccaagaagatgcttgctaatgagggagttggttccttttacaagggattgtctgctggtttgctaaggcaagcaacatacacaaccgctcgactgggat

SEQ ID NO: 5095 - DNA, 1238 bp, Triticum aestivum
  Clone ID: PAT_TA_5095
gaaaattgcccgtgggctcgtggctcacgccgaggtatccagccgcgataccacacgtccccgtcgcctcacagccccctgcttcccaccacctctgcttctccggaagcccaggcagcagcgcgggagctcctcctagctcaggatcggtggggagctgatacgagggcggaggagatggcggatgcgaagcagcagcagccgccgcagacggcgctggcggccagcggcgtgtggaagacggtgaagcccttcgtgaacggcggcgcctccggcatgctcgccacctgcgtcatccagcccatcgacatggtcaaggtgaagatccagttgggcgagggctctgcaactagtgtcaccaagaagatgcttgctaatgagggagttggttccttttacaagggattgtctgctggtttgctaaggcaagcaacatacacaaccgctcgactgggatccttcagggttctaacaaataaagcagttgaagcaaacgaaggaaaaccactgcccctagttcagaaagctgctattggtctcactgctggagcgattggagcttgttttggtagtcctgcggatttggcactcattaggatgcaggctgattcaaccttgccagcagcccagcgccgccactataagaacgcttttcatgcactttaccgtattattgctgatgaaggtgttctggcactttggaagggcgcaggtccaactgtagctagagcgatgtcactaaacatgggcatgcttgcctcctatgatcagagtgttgaggtacttagagacaaacttggtgctggtgaactttctacaatgcttggggccagtgctgtttcaggattcttcgcgtctgcttgcagtttgcccttcgactatgttaagacacaggttcagaagatgcaacctgatgctactggaaagtatccatacactgggtctcttgactgtgcaatgaaaaccttgaagagtggcggtccatttaagttctacactggctttccggtctattgtgtcaggattgctccacatgtcatgatgacatggatattcttgaatcagatccagaaggtcgagaagcgcgtcggcctttaaagtgtcgtgctatgctatcctcacctacaaattataatagtgtagctgctttgtacctataaaccagcagttggttctgatatacaaaatctgtacttatttccttggcatatatgctaccatgcttctttgttccttcc

SEQ ID NO: 5096 - DNA, 1615 bp, Triticum aestivum
  unsure (1)..(1615): unsure at all n locations
  Clone ID: PAT_TA_5096
gcgctcatggccttcatgcgctcgtcgtcctcatccatggctctggctctgctgccgctactggtggcagccgcattcttcatcccctccatggcttcatcagcttcaggtaccctggaccatggcttggatggtgaggcactgctgatgctggggaggttccatgggtggatggcggcgcacggtcggtcgtacgccaccgtggaggagaagctgcaccgggtttgaggtgtaccgggagcaacatggaagttcatcggaggccgggcgaatctgggcccacgccgggatggagctacagcccccaggcgacgaaccccggttcagccgacctcacccagcgatcgacgttcatggccaatgtacaagcagcaatctcatcagggagctagtcgctcttggggaggtcgcggaggatgacgacggagatcataactccctgctagggccccgtccacgaaggcacccgcccccgtcgaagagccaggtctgacatactaaagccaatctgacggcggtggtgactgcgagggtcgtttgcagggagacagaggtagtcacagcagcttagtctataggggattcttgttcgtcttgctgggcgttcacgtcggtggcgacgatggagagcgcgcatgcgatcagcacgggcggatcgccaccggtgctgtcggagcagcagctggtggactgtcggattaacggctgcggcaacagttggatggacaaggccttcgagtgggtgatccagaacggtggcatcaccacggaggcggcctacccctacaccggcaaggtgggcacgtgccaaagggccaagccggtcgcggtgaagctcagaggctacaagaagatttcaccacccggtgacgaggcggcgctgatggcggccgtggcgcagcagcccgtcgccgcatccttcgactacagtgacccctgcttccagcactacatccgcggcgtgtacaacgccggttgctccaggtcgggcgtgtacaacaaaggggcgtgcgggacaacgcagaaccacgcgctggccatcgtcgggtacgggaccaagcctgacgggaccaagtactggattggcaagaactcgtggactgaccagtggggcgacaaaggcttcgtctatttccttagggactcgccacccttgggcttgtgcggcattgccaagtacccgctttaccctatcatctgatgatccagccgccgtgcacctccatcatctttgtgtgactccgtgcatctctacttatattatatatatgtaatgaataattgcacggtacctagctattcaattgtctactccatgtctatgctatgcatgtaaaggttcgggtgctacacatgcatccttgcctataataaataaacaatcgttttgttttttgtaaaaaaaaaaaaaaaaaaaagcagggggcctatataatacattatgttttactaaaaaacaaaaaaaagtgaagtncggtatttacngcggcgcctccaactgggccggtccgtttttaacaaanccgtccgtgnaactngggganaaaaaccccctgggctggtttacccaaaactttaanttcngccctttggccaggnaacaatcctccccttt

SEQ ID NO: 5097 - DNA, 515 bp, Triticum aestivum
  Clone ID: PAT_TA_5097
agatcgcggccaaggtggacgagtacgcccgcggcatgatcagcggctccgggtcgtcgctcttcgaggagctcgggctctactacatcggccccgtcgacggacacaacatcgacgacctcatcaccatcctccgggaggtcaagggcaccaagaccaccgggcccgtgctcatccatgtcatcaccgagaaaggccgtggctacccctacgccgagcgagcctccgacaagtaccacggcgtggccaagttcgatccggcgacggggaagcagttcaaggttccggccaagacgctgtcctacaccaactacttcgcggaggcgctcatagccgaggcggggcaggacagcaagatcgtggccatccaccccgccatggggggcggcacggggctcaactacttcctccgccgcttccccaaccggtgcttccacgtcgggatcgcggagcagcacgccgccaccttcccgccccgcctggcctgcgaggggctcaagcccttttgcgccatc

SEQ ID NO: 5098 - DNA, 1638 bp, Triticum aestivum
  unsure (1)..(1638): unsure at all n locations
  Clone ID: PAT_TA_5098
ctcacccaaatctctggtggtttcgggatctcgcatgggttgatggcgtgctcaagtttattgagatggagaatcttgctcctgaaagccagagcgacaagggtgatgttatctacgattcagacttgatcatgtcgctcgagcgcaaggccgtggattggcattgcaagcagctgtccattgggggtgcctggagggctgtgacatggactcggacagtttcgtccaactgttggcgccagacatgtgctgccaatgtcgctgacatcttggttgtcgacggatcagcacattcatctttgtcgcccgggttaaagggcgaaaagttgacattcagggacctctactcagctttccccatcctgagcccggatggtgacgatattctttatctcaaatctatggtggaacccagtaacaaggatggatgtgtggccgctgttgacttacgaaacaaggctgtgaaagcagttggcaagtattatcttccggatgatttttattaccactttcgctatgaccctgaacatcctttccgtgtctgtacattgtcccgccatctggatatgactccaggcattgaagtcacagcgtgtcgcaagatcacaggggatgctagcagctcttcaaattttccaagaaacacggcacgaggtgtgagtgagctcaattcctgcgaaccaaggagcaaaatccaaaggccattggaattggctcagaaaaacaagcgtgcacgaaatgctgctgggattattatgcagaatgatcatatttccaagcttgacgataaggtgctggagctagagcgggagctagagcagaagaaagagcagaagccacaacagcagtgcttcaaaaagtgggatgcggcaagctatccccctgggcattcattgtggccccaaaacaatctgccagtgcggcaatacttcagcaagccaccaccatcgttcgcccctctacatggtcgtcacaactaccaggcactgtggcagcagccaccaccatcaaaacagcagttcacttataacagtgagtttgaacctcatgaggcacccctgccatccttcaacaattgcagtggagccggctaccattggtattcacagcaattttctgcccctaactcatttgactatggcgcacacacaggctatggcaactaccaacaccagtgggagcagcttcccagtactctggagctgcctattgcatcttggcagcatccacctcctccgttgcattgtgatccaacacctagtgaggggacatcttccttactaccgttgggagatgcatgatgtctctttccaatagtcaaggcaaggtgaagaagtttcatgacctggctagcatctacagcagatcttaacagtagccaagctgctgatcgaagaagaggcctgatgacgacgccactggagccgttaatatatatgtatttatgtagtatttgtctccctccgtccgtaaaagattgtccctgtaggatggtctccctccgttctacaaagatgagcaagaccatcctaccttccagtgtggtgtgtgtacgggcttaatactggactgccttattatagtaacctacctagctgttgaattggnatcgtgtggatgtttnnctncaagtttagg

SEQ ID NO: 5099 - DNA, 516 bp, Triticum aestivum
  Clone ID: PAT_TA_5099
gaattcggcacgagagatggtcggtggcgtgctcgcggccggggtacgaaggagcctgcgaaagcgcattcagaacgtgaaggtatcaactgtaggtgtaggtgctatgggatacattggtaataagggatcaatagcagtaagtatgtcgatatatcagacacacttttgctttctttgttgtcacctgacctctggagaaaaggatggagatgaacaaaaaaggaatgcggatgtgcaagagatccatcgaaggacagtatttaattccagagtgagcacgcctaagacaatatatgaccacgaaaggatattctggctaggggatctcaattataggatcaacttatcatacgaaaaaacacatgaatttatctccacccacgactggaatgggttgtttgagaaagaccagctaagagtagaactgaggaaaggacgtttatttgatgggtggagcgaaggagttatcagctttcctccaacatacaagtacctgcccgggcggccgctcga

SEQ ID NO: 5100 - DNA, 681 bp, Triticum aestivum
  Clone ID: PAT_TA_5100
tcggagtctgtgtgttcgtaggctgatatcagcggacttaaagacctggtatgagtttcctctttgcccggcttgttccttatccgttacttttgctccgcgctctcgtcgtcgccttcccgttcggttgcgggcgaggcctgcgctgctactggtcgccccgggtgggctgggtgctctgccgtgtgggctcgttctgagggtgatgtcgccccgtctccggtggctacggcttggccctctttgcgcgccccttcctggcttaccccttggcgtgtttttgcctctggctatcggcgggcctgccggtctccgccgccgggtgatcggtggtcccctccccgtgtgggggttgcctctgctcctggggctggcggtggcgacgtgtcgctgccgggcgacgtccgcggtgtccggcccgccgcccttcgtgccgcccctttcgattggggctaggcccgcggcggtcccccggccggcggttggtaggcggctactctcgttttaagtaaagacgttttcacgcccgcggccggcgctaacgaggataagcatattctagatgccaataccgctctaaacgtcagtcgtattatcaatcgttccgtcttttcagtaaagactaccaacgataatcctggcaccaccgagggcccgacgattatcgcctacgttactatc

SEQ ID NO: 5101 - DNA, 542 bp, Triticum aestivum
  unsure (1)..(542): unsure at all n locations
  Clone ID: PAT_TA_5101
cagctatggcgtcggccggcggcagcctgctggtcctcccggccgtcctccacctccgccggtcagacgccgacttcaccgccgcgctgcgcgagcggttccgcgtcctcgacttcttcgcctccggccagccccgcccggcgttcctcgccgcggccgcggccgcgccggagcccccgcgcgccgcggtcgtcgtgggcggcggctccgtgcgcgtggacgcctcgttcctcgacgccgtcccctccctccgctgcgtcctcaccacgggcgccggcgtcgaccacatcgacctcgccgagtgcgcgcgccgcggcgtcgccgtcgccaactccggggaggtcttctccaccgacgtcgccgactacgccgtcggcttgctgctcgacgtgctccggcgcgtgtcggcggcggagcggtacgtccggcgcgggtcctgggcggcgcaaggcgactatccctcgggattcaagcntggtgggaaacctttttggatcatcgggttggggaaaatngggtcancggnttgcaaagaaggcttt

SEQ ID NO: 5102 - DNA, 680 bp, Triticum aestivum
  Clone ID: PAT_TA_5102
gagataaggctactcttggttggatcaggaattcaggatttagttcaatgttgtaacagagttatatatgaacccttaaagaaaaaaagattttatttacagagagtatctataaaaatgctgcagtacacagatttatggtgaaaacgtcaactattattctgaagtggcagagaggcagggatgaagatatagtgatattctgaagtggtagagaggcagtggcgaaggcggccatggcgtccttgtccaccacacctccaccctcctccttcgccggcgccggccacggcaacccaggcgagcttgtcctggaccagctgccacgcgatggccttggggagctccttcgcctccgcctccgtcatcgccgctgctagtgtaggcttggccttgggcgcccctcgggcggctgcagtgctttggtcttgcccgccatagatcaatacactgctgttggtggtggctggtgaggcgacatgggaaagcacggaggcatcgtcgaggaagaagaggacacactatatagttgtccaccactgctcacctcgacagctcggacgcctctgcgagcatatacgtatcatacaggatgctgcaaagtatatcttttcagatggaaatagttgcagaaccactctaaccttgacctgacacccacgaaccctcgtgccgaattc

SEQ ID NO: 5103 - DNA, 711 bp, Triticum aestivum
  unsure (1)..(711): unsure at all n locations
  Clone ID: PAT_TA_5103
cccgacgtgncatgcntcncccccgccatggcngggggcgggaattngatgtcgagcgccgncccgngaggtggagcccaaggntgtgactcccaaggaggacttgccacccccacctcctccaccgcctgccaagaaggaaangcaacggtggtccaagaaggccagcttgaagaaggntcangtcttgactaagaatgagctgttggcaaggcgcgctgagcaggaacaggatgagcagcccgcatttgtccaaaaggtgatggacatgcgagggcctcaggctcgtgtgttgacagacttgaaggggctcagtgctgaacaggagatggaggcgaatgatgtgccgatgccggagtggcagtacgatgtgcggctgcttgttgatgagactgaggctgatattgtcaggttggatgggcagctgcggcgggagcaggagaaggtggctagtttggtgcgggagaaggagaaagtagcaaagcaggaggctttgcagaaacgccagctgcaagttatggagacaattgcagatgtgctggagaaggtccgggttgatgacaccgctggtttgctcactctgggggggttgcttaagaccttccaggaattgaaggtgcgctatgaggaggagttcaaaatttgcagtgttgcatgggttgcttgccgatttgcgcatccactacttatccgggtatttcaggggtggca

SEQ ID NO: 5104 - DNA, 1255 bp, Triticum aestivum
  unsure (1)..(1255): unsure at all n locations
  Clone ID: PAT_TA_5104
gggcggcaaaaacaattttcttttattaccggcaacaattgcacatatttaaaacgaaacaaagatgacgctcagttccaaccaagctcattatttagttagacagagggcaaatccaaaaaacgacttccaaagacgctcaagtagctttccatgaagccatacaaaacttggaagcaatggatgcttcacatcggcaatcatggaacggccggccgctaaccaactcagtgtatttccctcctagctaccatacgtccccctgaccagcaaagggaaacaaattcccgaagcaccacagtccacagccagcgctgcggcgaattagaccttcagaaagaatcttcttctagtgtaagaaagggagggttttaatcttcgtattccatatcgtagtcatcgtctagctcggaactatcgaccccacccatgatggacaggaaggcgagaaccgagatgagttgggccgcgaggaagtactttgttcttcgcctagatttcttctcctcctctgtccgctccttcttagctttgggtttcggcttgtaactttgtccagaagatgatgttttcctgggcgtggatgatgatggcatatcagatgatgctgatcctgctgatgatgagccaacttccaccaattggaccttgatatcctcggcatactttaccaagttgtcatagttctgcaaatagcttcgcagcatagatgaagcaggtaatgcattaaggacaaaaagaacatgtccaagcaaaagagcatcaacatctgtagggctatcgtcgaaaaaaaaggattgatcccctaatttcgtagataaagcatcataagcaagcaatagccctccgggatatctccccctctttttctgccgccccccggccggacacagccctaacccaatttcccccccggcccccattcggggggcggaccatccctgcgtacgtccggggccaaanttcccccctaaaaatggagtccgtaantaacaaattcaaccngggccgtccctttttaanaacgtccgtgaacnggggnaaaaaccctgggggnttaacccaaacnttaatccnccnttgcaagcaaaatcccccntttccccaancttgggggtaaaaaacgaaaaaaggcccggaaccgatttgccccttcccaaaaatttgnccaancctgaaatngggaaatgggccccccccctgttaccggcgcaaataaacncnggggggtggtggggggttaaccccaaccgtt

SEQ ID NO: 5105 - DNA, 1226 bp, Triticum aestivum
  Clone ID: PAT_TA_5105
gaattcggcacgcggccgagggaaaacctagagactatccccaatccccaatcccaatcgaggatccatggaccccaatcccgactccaaatcgaggatggatgacggccccagctggtcgctgtcgtcgcaagcgtcttccgcgacgtcctcacgacccgtggacggcgggccggcggcgccggcgaggaagaggaagccggggacgtggaggaggctcccgcgcaccctgccgctggaagtggagctcaggatgaagctgggtttcataacgcatgaggagctgaggcggcagcacctggcgcgcgccgaggagctggagaggatggacgacagcgggtgcgactccgaggaggccaaggtcgccttccgggacttcaagaaggagcatgtccgctggtaccgcaagctcgccgagggctggccggagaatatagtcatcaactacgaccccaagcccagcgacacagaggaagagtacctaaccgctgaggacatggaagcacgcttcgctcatcgtgaccccacttcgcttcacctagaacaacttaaacactttgctaaccttgccttggcgcattacaatgccagaaagaccgagcacaagttcgacatttctcaagccttgacgtccaactgcttttccgaggcatgtggaacaacatatgcccatgttaacttcaccgccaaaccccagaagagtgatgaccctacaaagaggctcttcttcgctgagctcatgctcattccaaagctccagctgcaggaagatgccgagcctatgcgtgtgctgcatgtctcgattatcgatgatgctccttgttttggcggttgccatgagatatatcggaatatcaaccataggatgaggggcgccatggattatgagcgttgtcatgcatgtcacgacattctgaaacatccaaaaggagatatgttcatcggagggcatgatagcacgaggatgccctacatctctgcaacataggatgtgaattggtactagtttggaggttgaaatcaccatcacgagtgatgacataaatgccataaattattgtcatatatgttgtgaacacattgaaaatcagctcatgtgtgatgtttgcatccttagaatttagagttaaaattattgctatgtgatgtgatgacgtaaattattggcatgtgatgtttgcatgtttactcatcagatattatttaatttcatgtgtggagtgact

SEQ ID NO: 5106 - DNA, 647 bp, Triticum aestivum
  Clone ID: PAT_TA_5106
gaattcggcacgaggctgggcgggcacatgcgacgccacaggccgctacacgcgcccgcagatcgcgccatcgcaacaaccgccgtgaccgcgatcgccgcgtccacgacgaagaaagagaaagacagcaccccggccggaatcaacctggagctcgacctcaacctgccggcgccgtccgacgaggagtgcgtctcacacccgccaccgccaccaccaccatcatcggcgccaccggtggtgctcggcctcgggccgttcgacagcggcaagaaacggctgatgctcacggccgcctccgccgcgctgggtggattgccattattgatccaccggcacgtcgcatgcagctggcctggcctcacgaattctttacttttcttaacaccgattgattgtccgatcattcttcttcttcttcttcctcttcctccttcctatacaaaattacatacttacaaatttgctccctttgggacatatcaaaggaaactggtaacatacattgcattctttcgatcctttgggcgtaaggttggcctcgtgccgttttcggccccccgcgtgcacatgcacgtcggcctctctctgggcctctatggggcgctcgaagccatctcccgctccactgttcgaacgagcgaaac

SEQ ID NO: 5107 - DNA, 726 bp, Triticum aestivum
  unsure (1)..(726): unsure at all n locations
  Clone ID: PAT_TA_5107
cccacgcgtccggagcacgccgtcgatcgaatcgagccccacgcgtccaagccaatccgagccgagagtttcttctccgttgccagcgccgccgagcagacgacggcgacgacgatgggcaagatcaagatgccggccctcttccgccgccgctcctcctccaagtcgcgctccgcgtcgccgccgcctactccccaggaggaagagggcacccggccggcgtcgggcgcggggtccccggcgcggtcggcggaggaggagatggagcgggtgttccgcaagttcgacgccaacggcgacggccggatctcgcggccggagctggcggccctgttcgagagcctgggccacgcggccacggaggacgagctgacccgcatgatggcggaggcggacgcggacggcgacggcttcatcagcctggaggagttcgcggcgctcaacgccacggcggccggcgacgacgaggaggacctgcggctggccttcaaggtgttcgacgcggacggcagcggcgacatctcggccgcggagctggcgagcgtgctccacggcctcggcgagaaggcgacggtgcagcagtgccggcgcatgatcgagggcgtggacaagaacggcgacggcctcatctccttcgacgagttcaaggtcatgatggcctccggcttggccgncaagatggcctgacccgtccatcctcttggtgattcagcgatttcgtccacg

SEQ ID NO: 5108 - DNA, 950 bp, Triticum aestivum
  Clone ID: PAT_TA_5108
cccacgcgtccgagcacgccatcgaatcgaatcgagcgaaccaaagccaagaagagtttcctcgttgctagcgccgccgagcagacgacgacgtcggcgatgggcaagatcaagatgccggccctgttccgccgccgctcctcctccaagtcgcggtccgcctcgccgccgccgccgcaggacgagcagcaggagggcacccggcctgcgtcgggcgcggggtccccggcgcggtcggcggaggaggagatggagcgggtgttccgcaagttcgacgccaacggcgacggccggatctcgcggccggagctggccgccctcttcgacagcctgggccacgcggccacggaggacgagctgacccgcatgatggccgaggcggacgcggacggcgacggcttcatcagcctggaggagttcgcggcgctgaacgccaccgcgcccggcgacgacgaggaggacctgcggctggccttcaaggtgttcgacgcggacggcagcggcgacatctcggccgccgagctggcgcgcgtgctccacggcctcggcgagaaggccacggtgcagcagtgccggcgcatgatcgagggcgtggacaagaacggcgacggcctcatctccttcgacgagttcaaggtcatgatggcctccggcttggccgccaagatggcctgacccgtccatcctcttgttgattcagcgatttcgtccacgcctccctcgctccttcctctcgcgtgccgtgcggtgcggtgcggattaagtgcgaattaagtgtacataattcaaggattaaagggcggccattagagtagattatttctttcgtttcttggtggtgcgagtaataactagaaatctctcgcgaataactgtgtcgcgaatatcgatctgagatcaaagagattgacgacgcttgaaggggatataaaaagcagtggttgatggtc

SEQ ID NO: 5109 - DNA, 1093 bp, Triticum aestivum
  Clone ID: PAT_TA_5109
cgtccgggctcatcctcctccatctataaatacaccacgtctccctctggaacgaaccggcacgcgccgcagagcacgccatcgaatcgaatcgagcgaaccgaagccaagaagagtttcctcgttgctagcgccgctaagtagacgtcgacgggcgatgggcaagatgaagatgccggccctgttccgccgccgctcctcctccaagtcgcgctccgcgtcgccgccgacgactcctccccgggaggagcagcaggaggagagccggcaggccatcggggtccccggcgcggtcggcggaggaggagatggagcgggtcttccgcaagttcgacgccaacggcgacggccggatctcgcggccggagctggccgccctcttcgagagcctgggccacgcggccaccgaggacgagctgacccgcatgatggccgaggcggacgcggacggcgacggcttcatcagcctggaggagttcgcggcgctcaacgccacggcgcccggcgacgacgaggaggacctgcggctggccttcaaggtgttcgacgcggacggcagcggcgacatctcggccgcggagctggcgcgcgtgctccacggcctcggcgagaaggccacggtccagcagtgccggcgcatgatcgagggcgtcgacaagaacggcgacggcctcatctccttcgacgagttcaaggtcatgatggccgccggcttcgccgccaagatggcctgatccgtcctccctcttcttggattcaatccgtcgtcgtccgcggacagattgatttcgtccacgccttcctcgctccttcctctcgcgtgcggtgcagattaagtgggaattaagtgtacataattcaaggattaaagggcgggcattagagcgtacgtgcgttagtagattctttgtttctttgtcttcttggtggtgccgagtacgtaataaccagaaatctctcgcgaataattgtctcgcgattatctaaagatctgagatataatggaattggtgaggttgccggttaatcgactcttttgcctgaaattaatgtggatggaggggggataccgttcaaaaaaaaaaaaaaaaaa

SEQ ID NO: 5110 - DNA, 936 bp, Triticum aestivum
  Clone ID: PAT_TA_5110
ccatcaggttccttgtgttttttcatgcatatgctcgttcttcttttcgctattgcaaagccaagagtgcaacgcaacatcgcccctttaccacgaaaaccaccatggctagaggctacgcaggccggatccaggccttctccaaagccgctcttcttggtttggtcctcttatccatggtgacctgggtaccgcatgcgtgttcttgcctgagggccttcctctttgtgtcacttccttctgctgcttcagcgatcgccacacccaagtgcctcttcatcttctccaacatcatcgtcctcttcctcgccaccgagtgcaggctctcgcggaacggtgctcgatccacgagcactaatgaggatgacatagatgctgtggtccgtgagcttgtggcttttacacacgcaatcaaagagacacatgctgcacaagagatcgtcaaagcagaacaagaagttagtgtacgcatgaccacgcagcagctagatcaatgtgaaaaggaagaagagagcgacgtcgcactggttaacaataatgttggtgatgacctgcaagaagaggtgatgaaggaagaagactgtgaagaggcaacggagctgcctaccgaggagctgaataggagagtggaagacttcattgcaagattcaacatggagaggcagctcgaggcaaggatggtcgtgtgttgctgctgaggaaagtggcttaatcatgtttgtctttgtgtaattaaggtatttgccaaaactggtactagtaccttatcaagtcacctgtgtttgtgtaattaaggtatttgccaaagttggtactggtaccttatcaagtcacttgtgtgtgtgtgtgtgtgtgtgtgtttttttgagaacaagtcacttgtgtttgtgtaattaattaaggtatttgccaaagctggtactggtaaaaaaaaaa

SEQ ID NO: 5111 - DNA, 703 bp, Triticum aestivum
  Clone ID: PAT_TA_5111
gaattcggcacgagctttcttctcctatgcatttgagttgggacaggttgtctccacgggagagtacaaggccctccgctgcgttagcgtcaatagctggagtcacggctctgagccgatgatctctgaggtcatcacccttggtggtggcggtggcgatcgtcatgcaagatggagggagagaccatgtcctccatgccctgtcactagtgcctcgaagaaaagtgtggttgtcaatggagttgtctacttcttgttggatttcggaagccaccgctttacatatagtggagaccgcgtcgagccatgtagcgttgcttgtttcgacctggagacagaggagtggatgggcactctccgacgtccaatccaagtgcgcagctttgtcgagtccttcaatggaatgtgcagttacagtgatctatactgtaagctctcgctggtcaatatgaatgggttcttggttatggtccaggatcctttggcttaccctttggacctgcctttggacctgtggtttttgatcgacattgagaaatgtctctgggataggaagtacagcatagcttttcaatacgaaaatctctttgcacaatccttgctgattctggaagacggtagaatagccatcggtgcatcaaatttgctgcgaatatatgacccagtttcagagagctacactgaatttcagatggcaggatcc

SEQ ID NO: 5112 - DNA, 608 bp, Triticum aestivum
  Clone ID: PAT_TA_5112
gtggcattaagacagcacagttggtccaaaccacaagaggacccgccaacactgatgttgacaaaatagaaagttacgttgcaacaaagcatatagagcgccaaaataataccgaaacacaaaacattgagtctggcaacatgcattttgtcacaaactaaggcactccacgtgcagtctagaccaaatacatctcaaacggtacataacctctagaaagtggataccacaccacctgcgtctcaaataggctgaaactgagaactatttttcagggaaaagaggggtgacactcaagcttagtggcattcgtgatttgtggtactctgaatagggatcctccgacagccaatacagatgccacatacactcttcgcaatgttggtcggcttcggggataaagtagcacccgcatgtcgcacaacgttttgcctgcaagaacaaaagaagacagtcggacctcatgcaaaccaagtgttgacgattaatgccaaaatgctgaagtggcgaaagatcactgcccaccattgggcaatgtcccttctcgtttaagaacactctgtcaaacagaaccaaggatgaataaaaagggggtaatcaagcttttt

SEQ ID NO: 5113 - DNA, 666 bp, Triticum aestivum
  Clone ID: PAT_TA_5113
gtgtctgggctgcttgtttccgtcttcgtgggttttgtcgccacacctaacattcactctaacaacatagtagtacatgaaaacatctatgcaaatcaaagttacacaggctatacaaaggaacatgatcaaactaaactatctaagaaccttccagaatcctagcttccaaaaccgtttctggtatagcagtggtgtcttcaaaaagcactactcgaagaaagctataactatcatcaatctaaccgttccattgtgctccgtccaagtttccaacttacttctggactgcgccgtctgcacgtgatgatacaacagcacccttcccagaagactggaagtaatcgttggccttcaggtgctcctgtcaccgtttcttccactccattttgcggccaagtaactcatagccacctatggagaaaatatcccgatagcttgtattactaacactttcttttgtgcaaaatgtttcatttttgtattgcatatatgactgatcacatgtaacactagaaggccatttcctgaagaactttcagtgttgtttgatgtacccattctagatgttgtgctgtaataccagatgtgttctttgcatatatgccgcctaagaccttagaaactgtctccaggaacattccaggccggacaggctgtggcttg

SEQ ID NO: 5114 - DNA, 961 bp, Triticum aestivum
  unsure (1)..(961): unsure at all n locations
  Clone ID: PAT_TA_5114
tctgttctgcagcctgtctaaggctgccagggaccaaatccttgtcctgcacaaggtgcaccttgccccacctgcatccgaagttaaccctgagtccaccgatgtcaatcctgatgctgactctaatcttgacttgccgaaagagtgccccgggggcccacacgttgtttcctttgtcgtggatgggctttctggtcggcccgaggctgagnattgagatgctgtttgacaataaaatgaggactgtggtgagggacggcaaggatccatgtgtcgcggcaatcgagcagatgggcaggaatttggactctgctttgcaaggggtaaagtggaaccaacagatatgctttgagaaactggatgcgagggctatttcccagagtctgctcctggaggatctccacaaggccagtaaacaagtgaattttgtcgaagccgccttgagcgaggctgggagaaggatgttccacaagaaagttatctgggcaaagaggagcctactgacactggtgccgtatgccagcaggtactacttttattgtctgtccgcctatagtctgctgatgtgcgatgtgcctcttcgtccggtcgactatgccttgattgtggttggagcccagtggatggctagcgatgaaatgaggggaaaattcctggagtcatacaattacttcaagaatggtggcaaaaaggtggatgctggtgatgctggcaagaagatttgaggctcttcttcctctggttcttggtgtagttcaattgagatgctccaactcttgcccactgttactgtgtgtcgtgttttgtaagcttgattggctatgtcatttgctatcttcgctacagcacatttctcctttattccatgtgtagcatctactgagttatatcggattatgagcagagtgaaacttttggtattttttgtctatggaacagtgttagacatttagctgtgttt

SEQ ID NO: 5115 - DNA, 1451 bp, Triticum aestivum
  Clone ID: PAT_TA_5115
ggcacgagccggcacccgcccccgcccaggcccgccccctcgtccctctgcgcgccgccgtcgccatgggcgcgggcgcgggcgcggcggaggagccgtcgcagacgcggcgggcgctggtcgacacgctcgcgggcgccatctccgggggcatctcccgcaccgtcacctcccccctcgacgtcatcaaaatccggttccaggttcaattagagccgacggcaaaatggggtgtacttcggagggatgtctatggaccttccaagtacactggacttatgcaagcaactaaagatattctgcgagaggaaggtttgccgggattctggagaggaaatgttccagccttgtttatgtatatgccgtatactgctatacaattcacagttctacacaagctaaaaacatttgcatcaggttcatcgagaacagaggatcatctgcacttaagtccttacttatcttacgtaagtggggctatcgcaggaagtgcagcaactgtagggtcatatccatttgaccttctcagaactattcttgcgtcacagggtgaaccgaaggtttaccccaatatgcggtctgcacttgttgatatagttcaaactcgtggtgttcgagggctgtatgctggtttaactccaactcttgttgaaattataccatatgctggcttgcagtttggttcatacgacactttcaaacgttcaatgatgtcatggaatagatacagatatggaattgaggaggatgactcggcatcaagcttccagctatttctttgtggattcgcagctggaacattttcaaaagctgcatgtcacccacttgatgttgttaagaagagattccagattgaaggattaaaacgtcatcctaggtatggggcgcggattgagagcagcacatacaagggcatgtaccatgccctaacagagatagttgttaaggaggggtttggaggcctctataaagggcttttcccatcggtggtgaaatcggctcctgctggtgcagtgacatttgtggcctacgaatacatctcggactggataggggccaaggccggagttgagtgagtccttcaattggataaaggagctaacagcacccgcattctcgtcatcagcgggaactttcagttgtttggagaccgcaaggtcgatggagaaagaaagtgcatacgatcattcgttgagagttgatacctgtaaagccttacacatagagcgagctattttgccgttttctctcccttgattttttttgtcccccatcgcctaatgtcgtgatagtgcattccttgagctgtaacagtgaggctgagtaaaactgatatagagcctgtgacttgtgataaatgtcaagagcagcaggcatttttgttgagatgcgatcatcgtacccgccccggcggccccccgaaaaaaaaaaaaaaaaaaaaaaaaaaaaaa

SEQ ID NO: 5116 - DNA, 505 bp, Triticum aestivum
  unsure (1)..(505): unsure at all n locations
  Clone ID: PAT_TA_5116
gaattcggcacgagtttcgccccgctttatttttaaggccccattccacaaccgnatcgaaaccaccaacaacacaacacaccaacacactcacccaaggccggatacataggtgccaaaggccttacaaccccacccccccgaacaacttgaggtagacactgaggagccatcgaagctcttcccggaaggacacatgaagaggtgaagttgaatgacgacgaactgagagctccaaggacagtgccttcaagaaggacacgacactaaagcgccgccacagcccgatccaaagatctagattttcatcttggagcacggacggaggagagaggagtaaccacaacggaagactttagaaagataacgacgtccgcgggcgccgcctccgtcggcctagccaagccagacagggtttttgccccggcaacaaactccaacttccccaccacagatcaccacaacgccagccaccacgtcgcccacacggccatggtcgctaacc

SEQ ID NO: 5117 - DNA, 1316 bp, Triticum aestivum
  Clone ID: PAT_TA_5117
gcaagacgcccggagcgcgggcgacacgtccggagcggcggggtcctttcccggcgcgcagcggtgcactacggcgtccaccggagccgtcccctgctccgtcctcctgctcctcctcctagggccgcccagcccgggacacgacacgggaggacggcggaagaagccttcccccggcgcccacggttgccccaggcctcccccgggggccgccccctccccctcccccccgctgcgcccccctgcgcgttcccgctgtgcccaggccaggccggacggccacaacgtcacggacaccccgcccgcgcccgcgcgcgcttctccccgctctgcgccgccctggctggcgcgacccccagccccgagctcgccgcgcgcagcccgggccccgtcccccccctcgacaatgccgccgtgccgcggcccccggagcggcgcctccaggccggacgccctcgcgcgcgtggctctccctgcacgtcctcctcgactacctcggcgtcgaccaggctggcgcaccctcgacggcgggttcacggcaggccggctacgcctctaccaggcccacggcgcgccgggggaccggcccggcatgcgtcaagcatcaacggtggagcatcacgcggaggagccaaggtcgtgcgcgtcccggccacgcggagggggtgaacgggacagccgccgtgttctacgtgaagtcggtcaaggaggcgccctgggacatcgccgtgctgcaggtgagcgcacgccatctcgtccttcaccgccggaggcgaaggtgcccacgccgccgggcccggccccggctcctgctcccaaggcgcctgcgcctgcccggtcgtggcccctgcacttgctaacggccccgggggcttgggctctgtcggccctgcctccgtcgccaaagaaccacaccgcgccaccgccgaagccggccaaagagcccgtgccttccccaacgcccgtggtggagacgccggcggaaggacctggggcggacggagatcagccgcctgccgacgagcacaagagtggcgccagcgactcggagccgtggagcctcggcgcggtggtggcggtggccgtgccggtcgtcgtgtttctgctgtggtgagcaatctgtgcttggaatgaatgcccgctgtcaggggcgctggatcccgcgattagtgctcgctcttacccgatggaaacagtggttaatgagcgctggttatcgctggcagatttgagcagaataattgtacgatgctcgcgtttagtcaaggagtgcatggctatgtttgaattgcgctagtaatttatttctgcgttgc

SEQ ID NO: 5118 - DNA, 782 bp, Triticum aestivum
  Clone ID: PAT_TA_5118
cacaccgttcgccgcccccccctcccccccctccactcctcccgattccgatctgcgtcaagcgtgaggcgagatttctgcggcgatccgctcggtctcacgccggctggccacagccggagccgtccacggtgcgcagggtggtacccttgctgtcgccgccccagttcgtcgcccggtgataaccctccctgcccgtggctattctgcttcgtctgcagggattacttcaattgctaaggagactggccagaggttgtacaaagctgttcttcggtccaccccattcatggcatcagtcaccacctatgcaactgtggtttcggcagttggatactgggtcattgagactgttgagggtggagtgaataagaagcttgttgagcagaataacactctcgccgtgaagcttgaagcggagaaggtgaagcgtgagggctttcagagcatagctacccatgcccatcacgagagtgcccgcaggattgatgaatcaatgtttgatgtacgtcttcagctcaacaaactgttcctccgctggttggagggacatgaggtcaacttgaaaagaatgaaggacatggagcaaaggattgatgcattgacaagggaggttgatgcattgaagaaatctccttctgcaaaggatgatgatacgccaatcaagaggagctgagaccagacctgaccgcgcctgtgggggtaagcaccccaaggcgacctcttcgctagttggggtgagaacccgaaggcgacctctcttccctttggggtgagcaccc

SEQ ID NO: 5119 - DNA, 817 bp, Triticum aestivum
  unsure (1)..(817): unsure at all n locations
  Clone ID: PAT_TA_5119
gaattcggcacgagccccaccccccccccattcctccccccgctcctccccctcccccgattttttcccttcgccagggttcgttcgctcgttcgcagcgccgcccgattgattgattgattgattctcgtcgcagcagctcctcgatctcctcctcgccatgcctcccttccacgattgccgcgatggcggtctgcttgttctggacccggctgcggcgatgttcggcggcgtgaggcagcggaagcgcgcgcgcgtgacggccgtgcccccctgcgtcttcgccgccgcggctgcggaggaggaggcgctcagggcggcgccggcggccaagaggcagaggctgagggaggcgccgaccctcgacgcgctcccggacgggtgcctcttcgagatcctgcgccgcgtgcagggcgcccgcgcgcggggcgcctcctcctgcgtctcccgccgctggctcgcgctgctcggcggcatccgcgcctccgagatcaagcgggtccaggccccggccgtgccggacctcaaccaggtcttcgtctgcgaggacgaggacgaggccgcggccccgcccccgggcccgttccaagaggaccctcgagggcgagggcgccacggacgtcgccctcaccgcggaggccgacgccgacggactccgcggtagcctggagagcgtcgttgtccgggggagccacccgacgcgcggagtnaccgacagcggacattttcgggttcgcccgtgggttgcccgtcgattcgctcgctttgccctgtggggatgtgccgcaaggtgaccgaacgccgtggctcgcttaaa

SEQ ID NO: 5120 - DNA, 846 bp, Triticum aestivum
  Clone ID: PAT_TA_5120
gcgattcggtgcgccgccccggcgcgaacccatcccgaggcgaattggtgacaagccgaggaaaagaaaaatcctttctccttcctccctcccgcagctgcgaatctcctccgccgcggcctccttcctcggatccatcgcatctactgcgaacgaccagccatggccgggaagctaattgcaaaccttattgtcatgggctctgggattataggaagagctatgcttcaggcataccgaaaagcacttgaaaatgcaaataaaactggtgtggcccatgaagcagtcaacaatatccgtagggccagcaagacaatgaccgagcaagaagcgaggcagatattgggtgtgactgagcagtcgacatgggaagagattgcacaggtcttctcttatcttcacttggctcctcgctattcgcatgtgcagtgctgactacaaccccttatcaaccatgttgaatgcagcggtatgacaagctattcgagagaaatgcgacatctgggagcttttacctccaatccaaggttcaccgggccaaggagtgcctagaaaacgtgtaccaaaagaacaagcaagatggaactccgacctgaaattcgcatctttagaatccactgcctagatactgttactatactccctttgtatcaaaaaaacgtcttatattttgatacagagggagtatattctttcctcccttttgagaatgtacataccaacaatggttgctgctgttgtatcatcaataaaaattgagcgcagcgacggtgagctctttagagaactaattgtaagccatcactgaattctcgtatggcattcagtatgaaattttgttgtttt

SEQ ID NO: 5121 - DNA, 377 bp, Triticum aestivum
  Clone ID: PAT_TA_5121
tttttttttttttttttttcacacacattgcttaaggattataaggagattagagtgtgattacatgcaaatttcctgttcttagtctagctagtacacatgagatgggtggattcagcaatagaagaacatccaagcgaatgaagtcatgccaatggctagcagcagcaacgtagccatcaggttggtaacgctgagcatgatgttgaccctgatgagatcttggataactcgagctcctaaagagatctccgcaggggcggcagcatgtggagctgttgtagtgggggcatggctctcgtcggtgacctctgcatccttgtcaggaagcaggtacatctcgtatccctcctgccagtcgtagaactggcatcgcc

SEQ ID NO: 5122 - DNA, 1643 bp, Triticum aestivum
  Clone ID: PAT_TA_5122
gtccccgcagaagagacccgaggctcggctcgcccctccgccgccgcctccgcctccgtcgccgtcgtcgccgcccgatccaaccgcccgcccgccagcccccgcgcacgggccagggagccacctgcgaagacataatcgccatgagctcgctctgcccgttcgcgaaagccaccacgggcggcgtgtgccccatgaaatccgacaagaagcccgacaagagcggcggcgctgcgtgccccgtgacgggcaagagccatggcagcgagaacaaggagagcggcgccgaccgagccgccgaagaagagggcgcggaggaccctcgcgtggtgcctgcacagtgccccttccgctacgactccagcaccttcaagctcggccccctcagctgcatggtctgccaggccctgctccacgacgccagcaaatgcctgccgtgctcccataagttctgcaaggcgtgcatatcacgctttaaggactgccctttgtgcggtgctgacatagaggggatcgagcctgatgccgagctccaggccctcgtcgatcgcttcattgacggccatgcccgaatcaagagatcgcttgctggagaggccgacgaagcagcgggtggcaagagcaaagtgatatacgaggtatatcgcatggagagaggtgcttttctagtgcaacaagccatgagggctttttcgcgcacagaacattgaaagtgcaaagtcgaggctcagtatgtgtgcagaagacatcagggaggagttgaaatcttcagaagataacctagacctgtgttctcagcttggggcagtgttgggaatgctcggggattgctgtcggaccttgggagatgcgccttcagcgatcacttactatgaagaaagtgccgagcttctgtcgaaattgcccaaaaaggatcttgagttggtccatacgctctcagtttctcttaacaaagttggagaccttcgctactatggcggggacctgcaatctgcaagaagttattatgcccgttcattagatgttcgcagaaattcagtaaaggaacattcagctgtggcctcccaggtcattgatctagcaacctctctagccaaagtcgcggatgtcgatagaaacctcggtaacgaagatgcggctgttgagggttttgaggaagcaatcaagtgccttgagaagttgaagctagattctgagcaggctagtctagaacaacggcgtcgctcggttctcgacttcctgcagaagcaattgcacgacaagtaagacagatggtccctagtgtgtagtacccataacgccgttgttgtgttgcaatatggaaggagttgttgtggtgcataagggaggagggaggtgctctagtaacggtgccctgtgtgtaattccaaccacttgaattctgtcgtggcacaaacaaatgtaaacaaggccgcgttgtacctattctaggagagttctcttcagtgtcgccaatatatgctccaggctctagctagctccctgtggtcttctcccaagccgaaacaacaggggtaaggtgaaacttgtctgaagctccttgttgcatgttgaatccgatcgaccccgttgtatatcgacaataacacacatagaactgctagaatctggccattttgctt

SEQ ID NO: 5123 - DNA, 969 bp, Triticum aestivum
  Clone ID: PAT_TA_5123
gcggtcgcctcgggaacccccctccccgctctccgctgcactcctcctcctcccttgtacccgccggtctcctcttcctcgaacacggccgccggccccgtttcctcgaccacgacgcctccaccgacgccgtgcgaatccccatcgccatgtcacctggagcgtcatgttccggcgttccggtaccactccgcccggccggaacccacacattcctcctgccggcggctcccccgttcgtctcaaagtgcaccatcaatcgaagagatcctcggacggcctcttcttgttttggtaaagcaataacgccaaagcgctgctttgtcgtggccggcggacttacttgggttgatggggttgaagaagagctcatggagctacaaaagacacaagagcaaagttcaggcaagttaaagaagaggccgcctttgaggcgtggaaaggtctatccccaacttcctgtaccagaacacattccaagaccttcttatgtgggtgcaaacataccacaagaactacccgcagttcgccaaatacacaatgccgaaggtatcgctgggatgagagctgcttgcaaacttgcggcccgtgtactcgacttcgcgggaacattggttaagccatcagttactactgatgaaatcgacagggcggtgcatcatatgatacttgaggcgggtgcttatccttcctccacttggctatggtggatttcctaaaagtatctgcacctcagtaaatgagtgtgtctgccatggactacctgattcaacacagctgcagaatggagacatcataaatattgatgtaaatgtgttcctaaatgggtaccatggcggaacttccagaacatttgtatgcggagaagcggatgaatctatcaagcatttcctaaaggcagctgaagaatgctcggagaagggtatttctgtctgcagggacggtgtaaactacagaaaaattggcaag

SEQ ID NO: 5124 - DNA, 486 bp, Triticum aestivum
  Clone ID: PAT_TA_5124
ttttttttttactggtgtgagatatctggtggccagtgtttagcttaagtttggggtcacaaaaaatctacaaatggttcttttgattaaaccgggaacaaacattggcaggcaacttgaagaaattttccgcgtcgttcctcgtgccgtgccacccccactacttccagcaaaccaaactaccacatatacacatctggggattcttctagaaactacatccatggtaaattgtcgagccacgacctctccccacaacgggatcacaagcaatgcaaatttgcaatgcaatagcatgtccccacatttatcccctggccggttgctacataaaggggaggcttctcacatgtggatctggctgctggggctgctttatgaaccacctcgttctgaaagtagatggctcaacaacttcttactacaatagcaagggatgtactcaaagttttgtcaatatctctacgcccgtcctagtgaccaata

SEQ ID NO: 5125 - DNA, 669 bp, Triticum aestivum
  Clone ID: PAT_TA_5125
gaggctccttccttccttctccggctcttcaaacccgcagcagagagacgaggtagagagagcgagagagagagagaggtagtagtaggcagccgttgcttgctggcctagctagctgctgctgcggcgtgcttggctctggcgggcatctagatgctctcatttcctttcgcggcagctgctcccctacgccggaatccctccgtctccgtgccttccctccctcctctcatggcctagattcgtgccagtgctgctcgtagcaatcaatcgggagccgtttctttcttctttcctcgcgcctagtacgtagcgtagcctgctctgctgcggcctgcgcgctttgaatacgcgccctcctcctcaaaacgctcaaaccttgtccctttccgcaaacccctgccgccttttggtcgctctactctagcgtacaggcaggcaggcaggcaggaaggcacagtactatactccccgggcgccgcgccggccgccgggctctttcatctcgtctcggctcaagggggcggcggggccggcgccccgcgcccgcactgtgccctcctttcgcccccctctctctctctcttccgccatatattccgcccccgcttgtcaccgcgcaggaaggaggagagaagagacacgcttgtgacctgtcggtctccatca

SEQ ID NO: 5126 - DNA, 567 bp, Triticum aestivum
  Clone ID: PAT_TA_5126
gttattggtttgggggggatttgcttgtctacctccgcctgcgtcgtcgggctccgacgttggctccttgtctccgcctcctctcccgctggcttttctcggggccttctgccaccacacccctcccgcccccgcgcgaccagcagccgctcctggccttcttcgtccccccggtggggcgtgggggggaggctctcgttggcggggaggtgctcgaccagctccggcccctcctcgcgctgcgacgctcccgccatgtgccccgctcctcccgccgtgccaaacggcaggccttcctgctcctcactccacccgcccacccgctcctccgtgatccgcggctcccgctcctcctgcgtgggccgcgccggcgtcgtcggcgtcctccccgccgtcgccctggggatcctcccttcccggtccccgcccaccgcccgcttgcggaccccggcctccgccggcttctcggcgtccggccccaccgccatgtcggaatccttccacaccgcgttgatgctattgcggcagagaacgtagggatacggcagtcctgtggtgttggcatgc

SEQ ID NO: 5127 - DNA, 993 bp, Triticum aestivum
  unsure (1)..(993): unsure at all n locations
  Clone ID: PAT_TA_5127
gccggccgttcctggttcaccctggaaaggatattgctatttggtccaccaggaacaggaaagacaatgctggcaaaagctgtggctaccgagtgcaaaacaacttttttcaacatttcagcctcatcaattgtcagcaaatggcgtggtgactcggagaaactagtaaaagtcttatttgagcttgcaaggcatcatgcaccatctaccattttccttgatgagattgatgctatcattagccaacgtggtgaagctcgtagtgaacatgaagccagtcggcgattgaagactgaactattaatacagatggatgggttgactaagacagatgagcttgtttttgttctggcggccacaaatttaccttgggaactagatgcagcaatgttacgccgattggaaaaacgtattcttgtgcccttaccagaggcagaagccaggcatgctatgtttgaagagttccttccatcgactccagacacaatggagattccatatgatgttcttgtggagagcaccgaaggatattccggctctgatatacgccttgtttgtaaggaggcagcaatgcaaccacttagacggttaatggcagttctagaaggcagacaagaagaaatgccagaggatgagttgcctgaagttggcccaatagcggcagaagatattgaacttgccttgaggaatacacggccgtctgctcatctccatgcacatagatatgagcaattcaatcaagattatggcagccatgtcatcggctaaaggagcatgttgatatgacctcgtttgcaccctgtatggagctttagtattcgtcagcagaaagaataattaccatacatgtatttccagctcgtaagcattgcttgtgtataatatttattccatcatcatttatattaccatttatatcacaagcaataagccctttgggcattcaagctctaaaaaaaacctgcagcccgggggatccaggtcnttctagag

SEQ ID NO: 5128 - DNA, 1062 bp, Triticum aestivum
  unsure (1)..(1062): unsure at all n locations
  Clone ID: PAT_TA_5128
gctccgacctagccctagccctagccctccctgccagttgatggtgggcgggctgcgagatctgtagggctcgttggctttcgccggcgggaggagatggaggccgggaacgacggcccgtcgaccccggtgctgctcaacgtgtacgacctcacgcccgtcaacgattacctctactggctcggcttcggcgccgcccgcgccggaatcgaagttcatggcatggaatatggatttggagcacatgatttctcatccagcggtgtatttgaggtggaatcgaaatgttgccctggatttgtctatagaaagacggtgtcgctaggcacaactgacatgtctcgggaagatttccgctcgttcattgaaagacttgcagggaagtatcatggcaatacatataatttgattgcgaagaactgcaatcatttcacagatgatgtctgtaggagcttgactggaaaacccatccctggctgggtgaataggttggccagagtaggctcagtttttgactgtctactaccagaaagtgtccaagtttctcctgttggacgtgtcccaactcttcgtccagttattgatgatgatttggattcggtatcttcttcggacagcgatgagggtgatgacaagcacctgttggaagcaccatccactgacttgcaacctgtagaagtgccattaaagctagccaaagatcttctttgacatgttccatgcttttttttttctgcaaaattgacatattacaactgcaaccactggagcccgggacgatgatgcgatgtttctgggtggttttagtgacaggacggaaccgtggagcttgccactggtacaacctatcacttttcacagagttttggctttctagcaggtgtacagataggaattggccatcatgtccaaaagataggtctagttacttgctgttttccagttcgtgcagtgactgctgtatcgtactcagaaaatgttgagcctggaactgatgttagcctgtatattttattaaacgagctagaataggcattgtcgagaatgtttgncntggcgatg

SEQ ID NO: 5129 - DNA, 730 bp, Triticum aestivum
  unsure (1)..(730): unsure at all n locations
  Clone ID: PAT_TA_5129
ttgaaacgaaggcacaaaaatccatatcctgaacttctgttactgcatctgcttcaatgtttttcagaatatgaaagaacggcctcggtcagagaagcgttttaaaaatatacgtatattgtgttagaaacacaaacgtgtcaaaactcagaagtctcacttacctccctacactcttggcaaaagaaaaaagaatttacaagctggaaggcctagaactagaagatggtctgctcgcctagctcctgccccgccattccttcccttatcaccttctcgaagaagtgctcgagcgtgtctttgccatagctcggcgtcttctcgtcgctgtactccccggtctcgggatccagcactagcatgctctccgacgcatagtacctcccaatcttgccgaactcggcggcatcctccagccccgggaaaaccttagccagtccatcgagcacccagatgacaccatccatgatctgaatgggcaccctgatgaacctgggttcgcgcccgagcagccggaacagcatctccccttgctccagcggcgtgagggccttccccggccctccaattgggagaaccttgttagccttctcccggtcgaagatgcagtccgcgatgaaggaggcgaggtcctcctcgctgatgggcttgcacgcgcagagcttgccgtcgccgaacatgacgtaggggttgcccttncttgacggcctcgaccggcctcgtgccgaat

SEQ ID NO: 5130 - DNA, 610 bp, Triticum aestivum
  Clone ID: PAT_TA_5130
ttacaaatccccgcagcgccgccctcctcactcctccatctttcctcgtcagccaccgctgcaccattccacttcgctcctcgctgtccgctcgtcgtgctactaggaggaagccgccgcagaagaggacaggggacgcccgttggcgagcttccgggcaggaagccgacggggagcacgccatcaacgagccctcggggagaagctattggccgatcctgagtcgtccaccaaagaccgccggttgcgccgtcatgagaggagcagcatgggaggagatgaggatatgtcgtcggcgtcggaatccctcttccctggctgcatcttccccgaataaatgttctagggttggagaagagggggttgagcagcaactgagcttaggtgagtgctcagtcacgtagatcttgggagtatggtgcttcgatttggttcctgtggtgaatttgagatgaaccatttctagagcgtatatggagagcctagaagcagcaggggtcggtggagcagcagatgcggtcgatggagtagcaggagcaaggagctcgagatggttcaggaagagtgtctacagagattatagaactggagagaggtgccttatgatagt

SEQ ID NO: 5131 - DNA, 464 bp, Triticum aestivum
  Clone ID: PAT_TA_5131
gtgccagttgtgaactctacgactttgaaatgttgaatctctcttcgaatgtgctatcaggttcattaccagccactgtcggcaagtgtgtctcggacgcgtggggtgggaacctgctttctggggaattagctattttgcgttcttgggatggcatagtggaggtgattgacttgagttcaaacaagctggaggggagctacccgaatgatgcccctcagtttcagaacttagttaccctgaagttgcggaacaattcgttgaagggatctgtcccttcagtgttgggaacctatcaaaagctatctttccttgatctcagtttgaatgcacttggtggccctgttttgcctgtttttattctgtcgcctactcttacagtgttgaacctttctggaaacaacttctctgggactattccatttcagagcccttattcaacagagtccataatgctatcttct

SEQ ID NO: 5132 - DNA, 1021 bp, Triticum aestivum
  Clone ID: PAT_TA_5132
ttttttttttttttttttagtaaaaagaagacaggctacacttgttacaccaattccaccaacaaatgcccaataaatacatccgccacctgaatgaacgcatctcccaatgtcatgttgttacctcttatgaaacagttgcctggtttacgccaatccccagacaaatatatcgcctctatgatgtcaacatgaataatgtacaattcacaatctcctgttcctctccttattccagtctcccgatcctagagacgaggccaatgttgctttcctcagtttctgctggttctcgtattccttctcaagccgtgcctgagacgatacatgaatcggatgccttgcggcattgctgtggttttgtctcatatcaagcataaggcccttctcgggtttgacaggagatacagcatcttcaataggaacaggccacctaataagccctttccctgggttgctcatgcacgcagcagaatcgttcttcctatcgaccactttcttggtagaatggtttccgctgcgagctggatcactattccgagagcccgaggagctctcagctgtaccaaacggtgatgacggcttacgggctttcaccttatcaggaggtgactttggcaaatttattgtcccattgctatatacttggggactccacccttccgtgcttcttctcatatcacatagggtctcagctgcgcacaatatcttccgtgatgcttgacgtgctttcagaagagaacgttcactgtcattcctctggaagctatctgaggagcccacatggtctagtggatgcagttgctgcggaccatgctcgctttcagtttttcttgagtaaatagtttgtccgagggatccggaagttgattccgtgcagcataaattagattgtctgctacatgaatcaatgatagacgactttgccatatccatttcctgaagaagatcatcaatttgatggacaggtaaatcttcataatcctgagcggttggatatgatccaactccggacgcgtgg

SEQ ID NO: 5133 - DNA, 979 bp, Triticum aestivum
  Clone ID: PAT_TA_5133
gaaaaccaaatttatcctccttacaaccagagaggggatgaattagctcatccaaccgatgaacagaggaagatagtcatggactaggattcagatcctctgacatcgggagggaaatcaggggcagctacagtaccctgacattccttccccagatttccctaaaccatgatttaaacagtaattatccacagtaattcacaaccagtgtttgctctacagttcgcgtccagtgctagcccccctgacggatctttgttttatacagagttcactgtagctccatgactttccttgtgcatgtcataggatccggctcccatggaccatcacaatcaacaatcgcacagaaaactgaaagcgctaggatatgtaaatcattcatgttctacgcatcttggacaactccatgcattcagctcgagtccaatgttttccagtcacattccttgacatagacaaccagtccaaattataaatagcagtggcatgtctgacacttcctagatgtggatgagcagaacaaggtcagccacaagattaacatatcaaggtcagccataagacaatgagtagctttagtcttgtttgatactactacatgctcgatgatcagaacaagacgacagtaatctattgcagtacccttcctctactcacggcgggtagatgatcatccctatccgcatcgagtagaccatgataccaatatggccggggcacaggccacctgtttatccgtgacccctcactggcatctcgtaagtgcacaggaccgtcatcccgccttactgaaacaccttgtcttaaaacttggacaatcttgctctttggaaggaaaggagttaccatccttccatcaaaatggttcatgccaacaaaactcccatcaaaattaataagaggaccaccaattccagccttcttgatcttacaagtggacagcttaagatctttgcaatcaagttcgcaatccttg

SEQ ID NO: 5134 - DNA, 1138 bp, Triticum aestivum
  unsure (1)..(1138): unsure at all n locations
  Clone ID: PAT_TA_5134
ttttaataacagcaaaattcatcttctccttcattgacaccactggcctccatacatccgaatgatgaagcatcataaaagaaaatatgctcctgagccccttcctcacatatgcgcgtgtgtgtttggcatattattcacaagcacatgtcgtctggcccttgcctatcccacacaacacatcctcaaagattctactactcatattatcaaaagatacatgccccatccagcaatgatggatcacctccttcttcttgttctccatgatggccgcagcccacaccaccggctgcacctcctggtccatgatgtaccagagccccctacgcctggtgccagtcccaaccgtctggctcgtctgccgctccttcatcagtggaggcccagggagcaaagcctccataggcaacatcagcatcttttccttctgaggtccccctgttgcctgccactgccgtcttggccctccgctcccccccgtggcctccggagccgcctcctcccccagtagccgcccccctccaggtcgccgcggagtatccacctctgcctctaccacgcctgcctctgcctgctccccctctgtcatatccccggcctgggccacgagttggacacgcccacttccagtgacctgcctccccacagatatgacatttgttgggatcgctccactccatgcgctcagtgactgcaaatgtcgaagacggcacagccttcatgtctgcatgctcaagagatagccgcacctcctcttgagacatagcagcaatagtctcctcaatagagggcaggagaggttggtgcaacagggatgccctcctgccatgaaaacaacctctaagcccctccaacagtttcagcacacgcctgcgtgcaatccacttgcgccctgactcgatgcaagccgcatcgtagagttccagagggtcgcagttatcctgctctgcccacagagcctgcagctctgccacgtatgtnatcactgacatgccatcatcttgacgcagcaacctaatnttgtcctcaatnngagcaatgagcatgacattgcccttgccagagtattgagtggacagaatnttccatatnncagcaggtgaggatagccccccncagagcgtccaatggaggg

SEQ ID NO: 5135 - DNA, 1041 bp, Triticum aestivum
  unsure (1)..(1041): unsure at all n locations
  Clone ID: PAT_TA_5135
cccccgggccgagcgggaaacaggatgctgctctcctcctcatcatcgtcctctcctctcccctgccgccgccgcgccccgcaaaccctacccctcctcctcgctccccggcccgccgcccgccgccgcgtcgccatgagtcgtcaacctgaggtgctctgggctcaacgctcggaaaaggtttacctgactatctcagtcccagacgcagaagatgttgtgatcaagactgaacctcagggaatctttagcttctcagctgttgctcatggggaatcttttagcttgaatttggagctatttgattccgtactgcctgagggaagcaaaacaaagacaaaggtgggttcgcgaaacataatctgttcgatccagaaagataagaaatgttggtggaagcgcttgctgaagtcagaggcaaaacatccatacatcaaagttgactggaacaaatggtgcgatgaggatgaagagtctgagaattcgggttcagacgatgactttgatggtggtgaggaaaatgacgaaagcgatgctgatgatggaatgctgtatctccctgaccttgagaagctgagagggaaatgagcaggcaggatatatgaaggaagtaggttgtgctgctgtagcaagtaggcaatcgttaacgctatatagcaagtaaccgttagcgctagaaacctgggatggtggtaccagacttgtgacatggtgccatgtcttcttatctaccgattactactctttggtcgtcgctgagctagggttctgaaatctgaatctagtagccatgagttgtggtttgtggccgacttggttatcggtgttatgtggcaagaagatgtcggacatgtatgctgagcacctcccggtttctctttgacatgatggcaggatcatactcatgtgcacttgaagaattagcggtccttcttttttcaggtctgtggaggatagatgctggctatggattgcctaatggaaacatgatatttcgatgatttttacagtttgtggttgggtncctgggtgccaatacac

SEQ ID NO: 5136 - DNA, 724 bp, Triticum aestivum
  Clone ID: PAT_TA_5136
aatttgaaaataaaattaattgtattaaacacaattaatctcggattcaacattaattgcagggacttttgaaaataatattattgtcaaactagacgtgagtgcacatacacgatcactagtgcatgaaacagataaagtctttgcttttcacgcagacgatacatgacaacacctatacttggtagacctattgatttgatattgtgaatgttgatgttttttctataaacttgataaaactttgttttttttaatgtaagacaaacctaaaatgggaactaaaaagagacatatagaacggggggtcaaaagaggaccagaccgcgcagcatatcacgggccgacaccgcaggaaacggattcaaagccatgcacgcactctgctctcgaagcagagcagccgcacgcgaagcagcgcttcagttggtgctcttgtcgctgccgcctctcttctccttgatgagcttcaggaggctgggcatcatcttcttcttcctcttgatggtgaacgacggcgacttggggttccagttcgccgcggacaccgacgaccgcccgacccttggacctcttcgacgtcgccgacaccctgctcgacctccgccgcgggtacgcgcactgcaggcccacactctccgccgtcgcgttcaggtcgtacagctcctgctccagcgccttctgctcgcccaccgtcttctccgcctccgctcgtgccgaattc

SEQ ID NO: 5137 - DNA, 1462 bp, Triticum aestivum
  unsure (1)..(1462): unsure at all n locations
  Clone ID: PAT_TA_5137
ccacgcgtccgaaccctcgtcccatctctcctgcctccggtccgctcgccgcccgatcccgccggccgccgctcaccggcggcaaccacctcctacccgccgctctttgcccccgagtccgccccgcgtcccaagcctccaggccagtcgatctcgcccccctcccattccccatcaatcaatcaaggagcaaggggcagcagacggcggccatgggcgacgacctccggctggacctggacaagctccccatcaagcgcctcgaggccatcgacgaggccggcaacgagcactacccgccggacaccagcagcgaggagcagcggctggcggccatccgccgggtcgacttctcctgggtcgtcgagcgggacgccaagaaggccaagaaggcggcggccgaggacgccgcccagaaggcctggccctggcagggcctccacgagagcctgcagctcgcgcagcaggagctcaccgtcgtcctcgacctcatctccacggtcgaggtgaacgacaccgtggccgtcgcgaccatttccaagcccaggccgctgccggacgaaatcctcgtagacatggccgtctccgccgccaccaagctccagcggcttcggcatctgggacggtacttcaaacaatcggcaaagacgatgcagcagcagttccagaaggaggctaggttctacggctcattgatcaggttgcagcagaactggaaagtcaagaggcagcgtgggaatgctccaggaatcaacagcttcatgtttgatgtggttgacacttctcagttggacacggcagcgatgccacggatgtcgtcgttgtcactggttccgatcgaccaggactcgtcgggcactttgtctgtacaagtcccccaaaagtcgtgccgtttcttgagccttcagttccgccgggacagtgccaacggcccggaaagctacgcttgcagaacaaaaggtgtctcaagcaccacttcttctgcagcggaagatgatgcgttggaggatgatgatgatgtcaataagtctgtcaaacaggcacattccattcttcgcaatatccacaagtcaatatttgaggagcaggtattggatatggtgatccgtgagacgtttgtccaaactcaaggtgtcaacgtaactggaatgcgtgaggattttctccaaactagcaattnggcgaggagagttggttgtgcctttcgcttggtggatccctggacaggatggtgactccagaaatggcaggcctggagcacattattattcaanaggcaatcttgtgctaaccacaacaatgggaaacaagacctncaaaaaggacactcangttcttaaccnaaaatcnggngattactgctaaccggtcaatganaaatccaanaaaatcagggagaatacgtatatgtccacaaatctgccatccnaagtcgcantaaaatgtgctgcaantattngat

SEQ ID NO: 5138 - DNA, 743 bp, Triticum aestivum
  unsure (1)..(743): unsure at all n locations
  Clone ID: PAT_TA_5138
ggttttttttttttttttttttttttttttttttttttttttttttttttttttttttttanagaanaatcaaccggnaacttaaagagatttgactacgatacaacattgtttcccattgtcaagtagggcacattagatgaagtactcgtaaatgcaacaaaacccctgataccagcccaccagaaataattaatgcatccttgtgcacaaccatgaacaaataatgttgttctgtaaagggaaagtgaaaaactccctccctctgatgttatccttcaatggtggggtttaagcattcttcaaccaccaaacaatcctatagaccatccagaccttaaatttccatactcttccgaagaactgcaagagcagacatcttaagctgcaatgcatctctggacgccaaggaagaggatggcaagttcgcagtggcaccctaacaactccaggacgacaatgccacgcacccttccgacgcccacgctaccggggggcaaggtcgctcatgctcatttgcagccgatgcaaagatgctttccacgttaagaccaaaccacaagcatctaccaataaatttaccagtagtcatccgaatattcatatccagaccagcgcgagcgtggtgcacctttgtttgattgccccgcagattgccagtgtcgagggttaaaacccccgtcataatgtcttctgtagttctgttcgggcgacctcggtgtacctcggccgcgaccacgcta

SEQ ID NO: 5139 - DNA, 1086 bp, Triticum aestivum
  Clone ID: PAT_TA_5139
cttgatgccattcactactatatcttcacaaatacattgtcaaggattgcttcctctttatcctgttacatcgtccgatgcctcgccatcaaccagtactccagcatcaattgcgttctataaggataaagattctcagcatagtgcttcttcatatagctcgactgactacatatgcttcaagatacctgatggatcgttaaatttaagaaatttcgttgctgtgataaaggacttctgcaactcacgtagtacctccaacacaccatcactttcaggttttctgttgcatatacctgtagaatacgagtgtgttgatctgtctctttacaaggacaaccaggtggttttactacttagtggaaagtccagctctgaaagtgccgggagatcttggatggttatgctgcagacagagaacctctctttttcacagctctcaagaacattccctgcaaattattacaatctccaagaattggaggcgctggaactccaattggatacagattatggaaaagttcgtagcatccctcaccctttgtctactccgctggcagtcagtgcctcaagaggagtggcttgcgtcttctcatcgcggaggcatgctttggtctatatcctcgatgaggacgaagacgaggatgaagatgaagattctgagatggagtgaccatggtacaacaccagcagcttcagctcgccatgtagcagaaaagattgtggaattgcactatcctgtgctgaaaacagagcatgcgtagctgtgagtcacaatgagcaacctgcggtcatgatcaccgggagcctggcgcaggacacctggtgccgcccgtgccccctagtcccacagctatgcaaatgcttgctctgattttgatttctgaagatgcgtttgatcgcccagttgctgcagctaaatggtgtcggtaccggcttggtcaggtctgaaactcacatttcgggtgtacacctgcagagtgaacttaggacggtactctgtaaatggtggtgttgcaacagaaatgttgtactccctgcaactttgtactagaccagcgacaagaataggttcggagggagacc

SEQ ID NO: 5140 - DNA, 1068 bp, Triticum aestivum
  Clone ID: PAT_TA_5140
caagaacagcgctctttctagagcgtaaaaatgtagcccgccctgtcccaacccgccgtcgaagaattaaaaatatctttaccaacacaaatgtaaggatggtccagacaatatctttaccgcaatttcccatgcggaacacaattattggtagggacgcgtgaacatcacaaaaatcaaaaacaaagaacatgtcaaactgcacaaataatctagtaacattggtgtgtttccacacgatgaatcgacaagagtgaaaggaaaaagtcaccacaaaaaggctggttgccccatgttgtgctatcgcatcgcggctccctcacacataaggagctcttgcttggcctgcattgaggcggccgtggccatgtctgtgccgcctgtggccttgatcttctggtggtgggacaactgccgtactcgctcaagctccgcggggggggccccttccggaccatctttgaagatcttgtcttgtgcaagggcggcaattctttgcctgagatggcgcctgccctccgccccggcgctccgctgatgatctagaaaggccacgcggggagagagtgctgacacctccatctgaaccaagtaaacaaccaatcaaattttgggatttcatcaatggttaaaattctcgttttgttgtctctgaactatctcgagtaatagtgaaaaacttggtaattgctcttggagactgagctcatccactcccaaatgaacagtaattttgaaaaaataaatagcaaacaacactgaaaagaaaacggacattgaaaatgttctgagtgtgctaggtgtatgcataagtcgtggacacttatttcttcacacacacaaaattagggactatttgttgggaatgcaagacagaaattgtcgaagtattcagtatgcgcaagactagtttcttggttcttctgatatctttctgtagttcttcgttgaggtccgtttacgagagaagtagagtgaatacctggagaccggtgacgctgcgttcaagctctgagatgtactgcaacttccgaactcttgacctctgcgctgactgccctcgtgccg

SEQ ID NO: 5141 - DNA, 1106 bp, Triticum aestivum
  Clone ID: PAT_TA_5141
cccaaaccagcagcagcccagcgaccaccagcatccaaatccaacctccatcgggaggaggccatggcgggtagggaggaggaggaggagaggtggacgatgaggccgtgcaccgccgtcaggtctacgatggccggcgaccatggtccggcgacgcgggttgtctccaagtccaagagggggaaggcggtggcgcggtccagccgcaagaagggtgagcggaggcccgagtgtgcggcggcgggagcaggagatcgggcgttgccggatccacacgggaaggctgcgatgccgaccaagaaggttgtcggcgcggcggcggcagcacaggctggaggcaaagggaagcgtccgctcaagaaaagcgagatcaggaccataatcgcgctgaagccggagcctttccccgaagacgactacctggacggcatggccaagtactacccgccggagtggctcgagcagaagaagagggagcacgcacaagacgccgcgtatttcgggaagattgacgccgactacgaggacttccggaagaaggtgatcgacggggtcaaggagaagggctacttcgaggtcgacgagggctacatggagaagaagcccgatcaacacccaaagccacaactgcagaaggtcgatttaagtgaactcatgcgctttgctgctacccctgaagaagagttgcggcggcgaggtggtaatggttatcatgagtactctactgatgaagaggatgatgctgttctggctcatgtgcgtgatgaagacgatgatgatgactttctgagtgattcttctgtgagcgatgaggagaatgctcaaaccgagggagcggatgttcacaaggttgctgctattgtggccagctgaaggcatttggtccatctctatctgtcttcatctaactagtagtatatgtttacttactggcagatgtctctttgctggatccgtctgtgttaaatgtacccctgttgtgtcttgtttcgaacaccgactatataatttacaatgtggttgtcgcttcaagcctgctcttgtggctgattattgttggttgagcaaagttttaaattgggataaaaaaaaaaaaaaaaaaaaaa

SEQ ID NO: 5142 - DNA, 1547 bp, Triticum aestivum
  Clone ID: PAT_TA_5142
cgtccgcccacgcgtccgcccaccccacgcgtccgctctttctcccctctcccatggagtcggcatagccagtagccggttctgcccgttgagagcgctcatataccctccacacctccagatctgtggcctgttgtagtctctgcctcctcagaacaacaagcccccgcagccgcgcccggatcggatggacaccgccatgcaccccgccggcgccgacgacggcggcctcgccgacccgctcaccggcaacgcgggcacaggcaccgagggcattatttgtggtatgccagacttcaagatgggtggaaagaggggcgatgaatctgcccctactgatgctggtgatgaagacggcgaagatgatgacggggatgaggatggtgacttcgcggagggcgaagaggaaatctcggaaggagaggagtatgacaaccccaaggccagtgacgccaagaagaaacaaataggcgagggtgaggagaatggcgaggatgatgaggaagaacaagaggagcaggagggtggaggaggtgacgacgatgatgatgacgacgacaacgacgatgacaatgaggacgacgacgatgatgacgatgatgtcgctgctgaagacgatggagatggagtagaagaggaggatgatgacgatgaggaggaggaggacgatgaggacttgctccagcccccgaagaagaggaagaagtgaagcccttcgacgcggctgctttagtcaccatgcgacgagatgtgcctgtccttcactgtgttctggaaactttccttagagttaaaaatgcccccacacgatcacaatgtgtgggcttgtaggagcgattagagggaactttgttgtcaccgttgctttgcttctgtggagttgatcgaacagatgtttcgctaacataattgtacctgagtggcgaaagcctcaagatttgaatatgtcagtcaactctttttatctcccccaatcctgggcctgctttctcctcgtcgtcctctgcttctgctgcgtgtccgacctcatctgccgtaggaatggggagcgagcgattgtttaaccgcagtcccagaagggctcggccatcgtccgcggacgcgtgggcgcctaccacttccagccccccaagaactggatcaacgatccaaatgggccaatgtactacaacggcatctaccacgagttctaccagtataaccccaatggctccgtatggggtaacatagtttggggccattcggtttcgacagacctcatcaactggatcccacttgaaacagcaatagagcgggacaccccgagcgacataaatggttgctggaccggctcagccacaattctgcccggtaaccgactggtcatcatatacaccggtgccgacccggagaagcgtcaggtccaaaacattgtggttccaaaaaacctgtctgacccgtacctgagagaatggaccaaagccggaaataacccggtgatccaaccggtcggtccgggcttgaactcgggccagttcaaggacccgacaaccggttggatcggacct

SEQ ID NO: 5143 - DNA, 1178 bp, Triticum aestivum
  Clone ID: PAT_TA_5143
ggagaatttacgcgcctgccctccgcgcacacatcactgcccacctgccctgctgcccgaacctcgcgtcctccctctctctccagcatcctctttctctcctccctcccatggccatggagtcggcctagccagttgtgcccgttgagagcgctcatataccctcagagacgcacctccagatctgtggctctgttgtagtctctctgcctcctcaaaacaagcccctgcagccgcgcccggatcggatggtcacaccgccatgcaccccgccggcggcctcgccgacctgcttaccgacaacgccggcaccggccccggcaccgagggcattatctgtggcatgccagacttcaagatgggtggaaagaggggcgatgaatctgcccctactgatgctggtgatgaagatggcgaagatgatgacggggatgaggatggtgacttcgcggagggcgaagaggaaatctcggaaggagaggagtatgacaaccccaaggccagtgacgccaagaagaaacaaataggcgagggtgaggagaatggcgaggatgatgaggaagaacaagaggagcaggagggtggaggaggtgacgacgatgatgatgatgacgacgatgatgacaatgaggacgacgacgatgatgacgacgatgtcgctgctgaagacgatgaggatggagtagaagaggaggatgacgaccaggacaacgacgatgatgaggaggacgatgacgaggactcgctccagcccccgaagaagaagaagaagtgaagcccttcgacgcggctgctttagtcaccatgcaatgagatgtgcctgttcttcactgtgttctggaaactttccttagagttaaaaatgccccacacgatcacaatgtgtgggcttgtaggagcgattagagggaactttgttgtcaccgttgctttgcttctgtggagttgatcgaacagatgtttcgctaacataattgtacctgagtggcgaaagcctcaatgatttgaatatgtcagtcaactcctttagtctcaaaagtttgaatatgtcagtcaactcctttttatctccttccggcatcgttctgtgcaatcttgttcagaacacattgtgttggtagctccttaaataaggccaaatcacattgttgatagctcctgggagggggggcccggta

SEQ ID NO: 5144 - DNA, 566 bp, Triticum aestivum
  Clone ID: PAT_TA_5144
ttttttttttccgtattcatggatttctttttggcagttcacagtatgtacaaacaatcagtggcgtagttatgcgtcgccgctgcacacaatcacagcacaccgcatcacatcatttcgatctattttctacaagttcttcactaaacgcccacagcctcttggccagctctgcatctcttgcgacggacgtcggcgtcgcctcgttgcaaccggcgaagtatttgccggacacacgtttggtatcaggatgcaatgccacataacaggtagttgcagccccttggggaacagcatgcaaagccacataacaggtagttgcagctcactggggtatatccttcaccaaaaggcttgaccagcgagaaaatcgaggccagcacactgtttgtcgtgatgtagcgaacgatgttggttccgatgattccagggtgcagcgaagttgcagtcagatcacatccttcttcctggaaacgcctggatagctcatttgcatggagaatatttgctaatttggagtgtgcgtatgcactaaatgcattgtacctgcccgggcggccgctcga

SEQ ID NO: 5145 - DNA, 876 bp, Triticum aestivum
  Clone ID: PAT_TA_5145
cttgatgggaggctcaaggagtccacaggggcgctctctttcttgccttgggcgttcttcctgttgtctcggcgcgccctctttgcagctcgatttgctttcttctgtgccgcctcctgctggcggttcttatcctcaagaagctgcgctgccttctcggcggcatgcactcggtcatggttttgaaccaccgagaggataaacagtcctttcaggtcatgcttcgagcaatttatagggtgtaccgccatctgaacctgtcaattcaattgtagtgattaatataatataaaaaatgaacatgacagtttatttgggtattgtggtatgaacataattttttttctgcctcagatctgtcttatgattcctagattgaactgggcaagaacaagaaggtggtggtccatgaagattggactcaaagaaatgtaggtgaccaacatgtaatggagagccgtggagggagttaaaagtgaagaatttgggagttgccccagggatgcagaaaaacagaggatggcttctactggcggctgctcattaaaattgccacaagtttctttgatgaaagaggaggatgggaactaatgacatgcagaattggaactggaattgtgaactaatgctcgttggagtaactaatctgctgaatgttgccaggctgcattatatttggatctactgttttggtagatgtgatttcgttgtgtgttgcatgccacatgttgctggggactcatgttggatgaccctggggtatagattttttggcacaggtgccgctgttcagtgttctgttctctttttttttttttttttgctttcggaacctcttatatgtgtcctgagcaattgtcttgtcgtttttgttct

SEQ ID NO: 5146 - DNA, 627 bp, Triticum aestivum
  unsure (1)..(627): unsure at all n locations
  Clone ID: PAT_TA_5146
gattcggcacgagcctaaatccatctttatttgggctcgctggggcagcaatggaggagcccctgccgctgcggtctcccccgtcgccgcctccctcgccgccatctccgccgccacggcggctgccgccttcggccgcactgggcccatatgtggctgagccagtggtggttgtggagccaattgtggatatcaagcaagaggaggaggatatgcgagatgaagatgtttgcttccaggaagccgataagtacgacgtcgctgaactagaagactccaacttgccagataatgataccccgatgcctccttgtttcctcccctcgccctcggatgccattggtacagatggcagcagcaccagttgtggcacagtcagcagtgcatccaattccattgcgccagcaacgacgactagcacatttgcggggctgtttgcatcagccacaacaagcaccactccccagagtagatcgctgcgtgatcttataggtgttgatcccaccttcctttgcctgcaatcggtacaccatcatctctgttcccacagacagatgcaagcaaccccggcacctttgtccaccaccagcaccgcacatatctgcgactggcactctgcagaaggcn

SEQ ID NO: 5147 - DNA, 1045 bp, Triticum aestivum
  Clone ID: PAT_TA_5147
caactccccacgaggccccgcggtagtccctccccccccagtgcccggctcccccccggccccaacgaggccccccctcaccggccagcgtccccttcggccggcgactcggacctccgcgcggggctgcagcggtcatcccccaggactcccaagccatgcgcgtcgccgccgactccgccgacgacgccgtcgccacctccacctgcgcgcactgttaccgagagactccgtctccgagcatcacgctgcattctgcacactgtgctccgcaaccttcatgtgaaatgctgcagcattgtcggaatatatgggtcccaatggaaccacatggattacgcactacgacgctcacccatgccccggcgaactgcccacgctggcgaactaactggtgggagcctcaacggtgcgcatgcttcagtaaacccttaatatccccactaagggatgctggccgtgccaagtattgcaagtttggaactacccgcgggtgatatttttgcgcatcaagatgtcacgtgggaagcgaacaaaatattgtcaaccttgcaacaaggacatcagacttcgcgaatggattggacacgagctcctactccattcaaaaacaaatgccgctgcagaatcctcaagcggccgatccatgctggaaaaagaagagggcggtcgtcacaagcaagtacgcccggcttttggtttgaatcacaagcaactgctcctcacaattgcaataaccggacttgctgtactgattggatccattctgttccaaagaaggattggaagttccgaagccctgtgaagttgtaatggtgttcaccgcaagaatgcagatcagttttttttgtgcctttaaatctcaatgcacaagttcttccataatcagtagcagagcttattccttgagtaatgttcagaacacaaaccatgtagaatactcctatgtcctatcagaaatcacctgattgataaatgtactgtgcctcacaatgtatgccaatatgatacttcctgatggcaataaagtattacagattacctt

SEQ ID NO: 5148 - DNA, 668 bp, Triticum aestivum
  Clone ID: PAT_TA_5148
ggatccccccatcccctccgccgcaatcctccctactcaccttcatccagatccacagggcgagagacaagggacgccggatcaacagatcaagaaggcagcgttcagccggatctcactcaccatggtggtcgcgctcggtccgggcaggttctacggcggcggcctgccgcgcccgcgcgtcttccccggcgaccgcgtcgacccgccggcgcccgtcaccgacgcgctgctctgctgggcgcgcgaagcgcactggtccatgggcgggctcggcgccaagcgcctccgcctgcagggccgcatcgagggcaacctcgtcaagctccgccgcaccgcgcgccgcgcgacgccagggcctccgccaagtcgcccgccaaggcctccaaggccaaggtccccgccccggggcacgggcccgcgcctgccaccctcgacgaggcgctcggctcgaacgacgagagctcccgggacgagagaggggtcgcggccgcgaggtggtggatgcggcgcgggactccgagtgcggtgagtcactcggcgtccgggtgccgctcgtcaccatcgccgccgccgcaagaggatgcgcgtcaggaagctctccgacgagttcgaccgcatcgccgccgcgcagtggagggcggcgcgaagaagaagccgtgaggacg

SEQ ID NO: 5149 - DNA, 758 bp, Triticum aestivum
  Clone ID: PAT_TA_5149
agcagaaaagcttcttgcaaaccttgttgatcatgaaccaagctgctgctgttgcgtgtaatgtgtttcttccaacaaaaaatgtctcagaatgcctaacatacaaaattgagataacactgaaacgaactattgtacaagtgtagtgcacaacggtgtacattatagaaggggagaacgacgcgtcgacgcccccctgcttcctagtacccactgaattcaaccagtgaggaatacgacgtgttctcatcagttgaagcagcatttcgaacatcgggagctcttgctccctgtcgattctcggacttctgcgaggtggcgacgccaaaaccagccatcgcattcagttccgacctcttgtgcctcgcttcctcgacgtctccttcccagcatgtctccgcgagcacttcctgggctttatccatatcttccgccgagatcagactgtcattttgcagcagcacaaggtacacctgatcagccgcagccttccggatcttggggtatctatggcctaggaacactagaagttgagagaacgccctggtgccagtcccgtccaattgtgaagaaatatatcccaggattgagaggcccgcacataacttcgtgaagtcctttgatcccttcagttcagggcctagtaaatttaccaattcactgtagaagtcgccgtgcccctccttgttcaagaagacctgtttactgagcagagtctcgatagtcttcaatgtgggtgtaattacacggtcgcactt

SEQ ID NO: 5150 - DNA, 685 bp, Triticum aestivum
  unsure (1)..(685): unsure at all n locations
  Clone ID: PAT_TA_5150
gaattcggcacgagccccgactcgctctcgccgcgccgcgccacctagccgctctccttcgtttatgtgcgacggcggcggctgattgatgtgggacgtggcggttgcgtccacggcctctgccccgcctttcaggacgcaggcttctggcccaacctccccgtcgtcctcgcggccgggagccagaatagatcggcgccagggcgtgaggaccatgccgtcatcacggcgagcccaagccagcatcctattgggctttctgacgcggttcagcatcatggtggcgcggagtaaggccttctttgactccaggtcggccgcaaacacgacatccagatgaagcccggctgttcaggcatctggatcggccgctgctccctcgctgactacgacgacgggctcatcaacatcacacaccagagcaccgtcatcatcgtatctagtatttggctgcagatcatcgatactacctcgtcgaagtcacacgggacccagtgcttcacactacctccaaagcattcgaagcaggtgtccgcgtacatggtataattgtcccctgcacatatatcaccatacattcaaatgaagaacgaaagcgtctaaaagattctgaagcttcattctggaattacatgaatctggngctgactgagggagatcaaaatggtactagatggtaacatta

SEQ ID NO: 5151 - DNA, 724 bp, Triticum aestivum
  Clone ID: PAT_TA_5151
gttcgcgccacgcgctcaccccgacctgacccacccacccctcgccggcccaccgccacaggtcgccgcattggcgtacaacccttcgcgcgcgcgcctctcgccgccagctcccgcggccccgcgccccaggaagcgcggacgctccccctctgctcccggcgcggcggtgtggcgcgcgtccgcatacgtcgctcctttcgaccaccgccgccgctggcaggatcccgcaggcgcgtctggccgcgtctggcaggggtaccacgcgccgcatgctccggtgccctaccggcggtggatcttcgcggacgaggcagcgacctcgggctcagatgcatgcacaatcatgtcatacaacatcttggcggataacaatgcacggaaccatcctgacctttacttggacgtcccttgggatgctttgaggtgggattcgaggagaaggcttattatccatgaaattaggcactgggactctgacttagtgtgtcttcaggaggtggatagattccgggaaatcgctgcagaaatgaagaacaaaggctatgaatgtagctttaaggggcgcactggggatgctaaagatggatgtgctaccttttggaagtcagaacggttacgtctgcttgaggaagatagtattgactttagtgaattcaatctacgaaataatgttgctcaagtattagtttttgagcttaacggaacccaaaaatttgtactc

SEQ ID NO: 5152 - DNA, 686 bp, Triticum aestivum
  Clone ID: PAT_TA_5152
gaattcggcacgagcgaagaacaggagtggagcagagttgttgaacaacaaacctgaatgaaggtggcttttcaggtggtacagagtgaggcctttcatggccatcagcccgagcactgccttgggcgtcgcctctgttgttgcagttaattaagctcatccatgcccaaggaagcaaaggcagctgcctgagagtgagctgatggatcaggccatgatcgccggcgttgcactgtggcgtgacgagcaggggaacaaaggagcaaatgaagaggactcactgtcggggccgccgagcctggcgacggcgtgcacgaagcgtgttggataatctgcgcgcgcacacacacacgcacacacttacagtttcaggttttagtttctctgaataaaactggccgtcagcgtgcggctgtgcacgtacgagcttcagttagtttttcccttcagttttcagttaggttgttagcacatcttctgctcgccgcaggaatcgccatgggatggcatggatcacgaattcctcgccgcgggcacgtagggctctgcacgtccgggcgtcatgggatggcacgacctgtaagctcggcgggcatgaccgcttcctttgcttgttttcaggaactcgttgatgagttcagataaataagatcagcaacagaaaagctgcataagttaggcagcac

SEQ ID NO: 5153 - DNA, 861 bp, Triticum aestivum
  unsure (1)..(861): unsure at all n locations
  Clone ID: PAT_TA_5153
tagctctctctctctctctctctctctctctctctctctctctctctctttcagacagaacgagtacactacagtcgcaatggacagactgcacgctaaatcataacaatagcgtgtcaatattctgcgcaaaataggagaatagatacactgagtaccaaatgctaaactgacaaagatttgtataccttgcggagaacactcgagcgctagcgcataaccgtggcatcggagacatcatctccacacacccgagtctgatccggatcagcagcctgcagccgcgggcctggaatccacctacagggttcntggctaaacgcccttgcacattcactcacagcgtgtttggcaaggatatgacatagccttacgatagataagataatttctgcatctgaatcctgactggtatggtcacccccgcgcatactctgatgtgctgtgcgctgtgccctccgagtcggttatcctaaacctttcctaccaattgaataactaacttgcatcagcctaactgtcactgtctgaggagaaatatatgtgttttgacgtgcttgcttctcctgcagattcgtcttggtcggattcatcttcttgctcggatgcatctctggtctgttccgagaagatgaattcagcaacaatgggcagatgatcactgcccatctccctggttggaagacccctcgttctcctcaaagcgtccacaggtagtgtgtccaaaactctggagcattctcgcccgccggtttccccccgagaatcaacagtcccaagaaacctcttgtgatatgacgttgctagaggttcaccatgatgacccctattgcttgaatttccctttaacatggcataaga

SEQ ID NO: 5154 - DNA, 1555 bp, Triticum aestivum
  Clone ID: PAT_TA_5154
gcccgccccggccttcccgggtcgccccacgcgtcctcccaaacctactacactccactgtagcaggaggaggaggatggtggtgaagagcggaggaggaggcggcgcggaggagggggccgcgggcgcggcggtgcggcggtgggtggaggccggcggcgggaggctggtactggacggcgggctggccacggagctcgaggcccacggcgccgacctcaacgacccactctggagcgccaagtgcatcctctcctccccgcacctcatccgcaaggtccacttagactacatagaagcaggtgcaaacattataattactgcatcttatcaggctaccattcaagggtttgagtccaagggattttcgaaagaacaaggtgaaaatttactaacaaagagtgttgagattgcacatgaagcacgtgagatgtttctgaagcaacatccagatcaatccactgccttgcgtcctattctggttgctgcttccataggaagttatggggcttatcttgctgatggctctgagtacagtggggattacggtgaagctgggacactagaattcctgaaagattttcatcggcggagacttcaggttcttgcagaagcacgtcctgatttgattgcttttgaaacaatccctaacaaattggaagctcaggcatatgttgaacttcttgaggaatgcaacataaatatcccttcatggttttccttcaactcaaaagatggagttaatgttgtgagtggagactcattaatcgaatgtgctaaaattgctaatgaatgtgcaaaggttggtgcagttggcataaactgcacacctccaagatttattcatagcttgatactctccattcggaaggtcacagacaagccaattctgatataccccaacagtggagaaagatacgatgctgagaaaaaggagtgggtggaatccactggtgtgtcagacggcgatttcgtttcttatgtaggtgagtggtgcaaagatggggctgcccttattggggggtgctgcaggacaaatccaaaccccatcagggcaataattagatcccttaaccaatactacccggcggcatagaagttgttctcatgcagagggcttggtgttgcggttacgtttgtcaacatgtcttggagatttagtaagatgttttacgatgttatacaaaatgacatacctgtgcacttacatttgtgaaatggtggtgtattttttagtcggcctactcgcctacatggaggtacaaccagtcaaggattagcaagcagtaatagtgaagttgtactgaggagcgagcgaaacgatcgaaggttcacgaccccttattagctattaagagagtttgaggcaatgtatgtgatacagattcagagttgttatggagatattaacctgcaataagctgctatgctgtaggcaaatagtgatcccttatgtatcccctgttacctgtagtgcactgtaggttttatctcaaccactatgtatgtattcccctctgaaaatgatgaattctcctgaggggtgctctcatca

SEQ ID NO: 5155 - DNA, 2302 bp, Triticum aestivum
  unsure (1)..(2302): unsure at all n locations
  Clone ID: PAT_TA_5155
gcgttccctcgttcaccttggctcttccggcttctgccgcacgcgggtcctcggttactccagccgggggcgctgtgttcttgccgcaggcccgtgtccagccagaggtttgaccggccccactcgttggaaatatttatacaatggttgatgttcttctgcatcatatccagcttgagcttcaacgggggcatctagtgcaggatttactttccaaagcaatcacgaatcttgcattctttgtctggacacatgagttagttccactggacattgtgctgctagctcttattgacagggatgatgatccttatgctttacgtcttgtgataagtctgcttgaaagacctgaacttcagcacagaattaaagcattctgcagttctcgttctcctgagcattggctaaaaaatcaacctccaaaaagagctgagctccagaaagctcttggtaaccatctttcatggaaggaccgctatcctcccttttttgatgacattgctgcccgcttgcttccagtcatcccactgataatttataggcttattgagaatgatgctacagatatcgcagacagggttctcgcattttattctacctttctcgctttccacccactgagatttacatttgtgcgggatattcttgcatacttctatggtcatcttccaagcaagttaattgtccggatcctcaacgtgctgggtgttagcaccaagactcctttctcagaatcctttgctcaatatttagggtcttcaaattcttctatttgcccaccaccagaatattttgccaaccttttgctaggccttgttaataatgtcatacctcctttgagtagcaagtccaaatcaaacccagcagatgcttctggcggacgcacaaatttcagcaagcctcatgcatctacgcaagctggtggaaatagtaacgctgatgctcagagggcattttatcaaaatcaggatcctgggtcatacacacagcttgtcttggaaacagcagctattgagattctctcactccctgtgccagcttctcaaatagtgtcctctctagttcaattaatagctcatgtacaagcaatgcttatacagtcaaatactggtcaaggaatgtctggtggtttgggccaaaactctgggctgccaacttctccttcaggtgccggtgctgagtcggcaggtgccagccgaggaaacacttcagcaagtggaatcagcgcgaactttgtttctagaagtggctactcttgtcagcagttgtctgttttgatgattcaagcatgtggcttcttgctggcacaactcccacccgaattccacatgcaactttactcagaagcagctcgaatcataaaagattgtcgttggctttctgacagttcgagacctgtgaaagagcttaactcagctgttggttacgcacttctggacccaacatgggcttctcaagacagtacatcgacagccatcggtaacattgtggcccttctacactcattttttagcaatcttcctcaagagtggctggaatcttcacatactgtcatcaaacatctccggccagtgacttcagttgccatgttgagaattgccttccgcatattgggccccttattgcctcgtctagcctttgctcgacctctattcatgaagacactggctttgctgttcaatgtgttgggggatgtgtttgggaagaactctcaggcctcacctcatgtgccggcatcagaaattggagacatcatcgacttcgtgcatcatgccgtcatgtatgaaggtcaaggcggcccggttcagagtaccagcaaacctaaagtggagatactgacattgtgcgggaaagtggtggacatgcttcggcccgacgtgcagcatctcctgtcccacctcaagaccgatccaacctcgtcgatttacgcggcgacccatccaaagctagcgcaacaacacccatcctaagctacagcacaacatggatgatgtagaatagtgtacacctggactgctgcggctcggctgatttcgctgtacaggcctgagcgccaagcggctttaaccagttaactcgctgccagaccggaacctggagtttgtctcaacggttaggggcagattgtccgctggatcttgtgttgtaacccatatatatgtagcagtggtgtagattgcgacgtttatcatctaaaaatttaatttgtctgtctaaagtcaaaacatatttaccgtcggcgccacccaagcgcntttgganncgtttaanaaaaccnttccnggggnaaaaaanngttttt

SEQ ID NO: 5156 - DNA, 1207 bp, Triticum aestivum
  Clone ID: PAT_TA_5156
gaattcggcacgagggcaactccactccacacaggtaagaagaagaagagatggtgcacaaggagcttcagcaggcatggtggttcgacagccacaacctcgccaggacgtccccatggctaggcagcaccctttcagaactggatgacaagaccaagcaaatgctcaagctgatcgaccaagacgcggactcgttcgctcaacgtgctgaaatgtattacaagaagcgccccgtcctggtggacatgctcggcgacctgtaccgcacgcaccgctcgcttgccgagcagtatgacctgctgaagcatggcagcggcacatgccggtccaagttcaatccatctccctgcaccaagagctggtctccggggtccatggatggcaaggcaaccaagagctggtcttcaggttccatggatggcaagacaacaagaagctcttcctccaactcactgtgctcagactcctatgactcggagtctgaagtcgatgaccctgaagaagagcatgatgagaaggtgtctgacgccgaagcagaggcagagaagcacgaggctgaccaagaagcagagctcatgcgcgcggagatcaacaggctcagcgagcagaatgctgagctgcagaaggtgatcgaggagaacaaggcggctcacgaggcggagctcgccgcgaaggacggggagaagaggggggtcctcaggcagctggcgtcgtccatcgacctggtgaagccgggggactaccccctgcgggagcccctcaagggccccaaaccccaagccccacacccgccgccgcggcccagccccgcggcttcggtctcaggaagctccccttggacctgttcttcggcgaagctgttcacgggacagcgcaagcattctggtcccatggtcgctctgtgaaggagtgagttttggtgatgaagagaagaaatagcatgatgcagtctctccgtcttgacatccagatccatgagaatttcttgtagctcatgtgcatataggatgggtttcttttggaccgtgcctggtcccatccttgttcagggttagctagtagagagaaattttaactatgttgctgttatactcatgttttatgtgtagtaagtagtagtagtatagccatatgaatgtttgtatattattatttttgcttaactatatagtaaaaatatatttttatttttgtcaaaaaaaaaaaa

SEQ ID NO: 5157 - DNA, 1016 bp, Triticum aestivum
  Clone ID: PAT_TA_5157
gaattcggcacgaggcgccgccgaggtgatagatctctccagcgacgacgacgaggagtccctcccctttcccagcaccagcgccgtcaccatcgccccctcctccccccgcgatgtcaagccgtacgagctcgccgatgtgaagcccctgctttacccgatccagcccccaggctgctacgcgctcgtgcccgtcaaggacgaggaacccgtgcccttgccactcgccgccgaagcccccagggtcctccccccgccgcgcctctgccgccaattctggaagtccggcgagtatgttgtagcccgccgcaaccctgacgccgatgcccctggtgggcggaatcggctgaggatcaatccaaagttcctgcactcaaatgctacttctcacaagtgggcatttggcgccattgctgagcttcttgataacgctattgatgaggtgaataatggggcaacatttgttcgtgttaataaattcacaaacccacgggatggtagtccctcattgttggttcaagatgatggaggggggatggatccagatgcactgcgatgttgcatgagctttggattttcagataagcagtctgatgctttcatcgggcaatgtcgccgtcgtgtcgtatcgggctccttgcggcctcgtgccggtgggattctggctgcgctgatgtattggtgccaacagtagactaccaatacgatcttacaactgcttcatatactcagctgttacgtcataatcagaaactcttctcttctaatttggcgatcctttcgaaatggtccccttttgctagtgaagctgagttgcttaaacaatttgatgatatcggagagcatgggacgaagataattgtattcaacctctggttcaatgatgatggggacatggagcttgatttcaactccgataagaaggatatcctcattactggggcacagaagaaggtcaaaaccaacaaacatgagaagcttatgactcaggactacattgcaaatcgacttcgtta

SEQ ID NO: 5158 - DNA, 754 bp, Triticum aestivum
  Clone ID: PAT_TA_5158
gaaataaattcaagaataaatgtgagcaccaggacttaaccctgatgggctggggataccacagtccctttaaccatccaaccacaggttggttcgcaacaagatttctatttgaggggaacattgtagccaatgttcagcacgtaggggtatgctctttattgccacctaggatctggcctgaattaatcatgtatatacagagtgtggcgaggctaagatctacttcacaaatttctgtacttcgctggtgtcaacaaactcatttactccacttgtcaacaaaaacctttcaaatagatccactgccatggatctgcaaccaccgggaacacaagactgcaagttgagtgctatattggggttatgaacactttggcgaatgtgaacccacccgagcggtctctgagactcgtcatagaactttgctctgtacatgtaggcgtcaacgtcgattggatggtcgttgttgtccacaaggcatccctcatcaaccgagcagtcgccacaatcatccagcacccagccgctaagtttcccttcctcgatgtatgtcttgaaagcctcgacggcttcgatgccccgctgtttcgcgctcttgggctcgcccacgatgtccatcctcagcagcacggactcggcgggctcctcgaggtcccggatgaggcccccgaccccgccctccagcccggccagcctcatccggaccatctcgatgatgatcttcaccaccatgtacgcgccgtcgtcgagg

SEQ ID NO: 5159 - DNA, 900 bp, Triticum aestivum
  Clone ID: PAT_TA_5159
cttgcagtataaatccttttttttagcttatatgccatgtgccagcacaagagttttcatggtcactgagtacaacataacactgtctaaacctttggtgctgctgctagaatcacaatggtttcatggttcttgagtactacaacacaacaccatctatagcaatttctccgccggtcttctggaccgtcacgaaacaggttcaaatttacagatgcagtcgtatatgtttccgttgaaaagcttctctgccaacctctggttcttcaccatcgcaagcttcagagcgtcacacttgaaacgggcattcaggttggtgtgcagtgaccgccccatgccctctaagatcaacagatcagcatccttggcagcagctgcaagctccgagctaacctgccggaagtcaatgcatggactgccacatccattctccacgaccattagtggcaccgacgccggttcatccttggtatcaccttggatgccagccatagcatcgactatcagtccgcccgcttctgcagctttccgaaggataccacagtgctttgcagcttcagctacaatttctggaagttcattagccgtaatatcgttcaaagccggcaacgaatttgcaaccagaactacttcaactccacggcgtagaaattctcgtgctaaaggaagcattccaaggaccacatcagcacccgcattatcaaccgaaataagtgctcttttgtatggcatgatccttcttaagcattctgcttttgaacgtatcaaagtcatcaatccgccaaggacgttgcatcttcttgcggctcatgccataaatttctattatagtgccttggttgtaaaggtccacgcaagctttagacccccaatcaaatatggttagcagcaagaacacct

SEQ ID NO: 5160 - DNA, 833 bp, Triticum aestivum
  unsure (1)..(833): unsure at all n locations
  Clone ID: PAT_TA_5160
gaattcggcacgaggagaggccggccctcctagctagctagctaactaatcagcataagaacagaagggagagatcgaaccagctcgatccatcggcagcagctagctagccctgcccgcgccagccatgatccatctgaagcagccgctggtgctctccgcgcagagcagcaatgttgcctcgccaccgctcttcgccacggcggcggccgcgagcggccagcagaggcgggcgtccggcgccgggaggagccgctctgggcgccggctcacggcgcgcaggataagctgcgcgtcgaccgaggaggccgtcggcgtctcgacgtccatgacgaccaaggagaggtcgctgacggtgacggccgtcgtgaccgcgcaggcgccgacctccgtgtacgtcgcccggggcctcgacgacatccaggacctcttcggcaagacgctgctgctcgagctcgtcagctccgagctcgaccccaagacgggaagggagagggagaaagtgaaggggttcgcgcacatgacgctcaaggaggggacgtacgaggccaagatgtcggtgccggcgtcgttcgggccggtgggcgcggtgctggtggagaacgagcaccacagggagatgttcatcaaggacatcaagctcatcaccggcggcgacgagagcaccgccatcaccttcgacgtcgcctctgggtgcacttcaagttcgacnccccgacccgggcgtnttnttaccgtaagtcatacctgccgtcgaaaccccgccggaatcnagccttgagaaaaagacttgaaaactgcnngggacggcacannagcncagttcacaacgc

SEQ ID NO: 5161 - DNA, 656 bp, Triticum aestivum
  Clone ID: PAT_TA_5161
gaattcggcacgaggaacaattctccgctggcttgtcagcgaacagcaccacaatccaccgggtggaaccgtgtaaagtgctgctcgttcttgtccgtggaaacggctgaacaagtgtagctgcgtaccacgcggcgggaatggaggagaaattccatctactttcccctccggtgctggtgcagtgcacaccggtcagcatcatgtcgatcgctttcgctttagcaccgccctaacaccggtcctgctaggtaggcgtacacgaaacacccatccgccatcagcccgagaaaaagaagatacgcgcgatatatactaagctattggtgtagaaatggacgtccatcatcttggcgtgcgtcgaccagttgccctgcagtatgggtaatctatcggtctaagctagctcgatccatctcgggtggttgcattgcattggtgggatgtgtcgacatcgatggctagcgagctggcttttctggcctgaaaattgttgctgattttattaccctacttggcccgaacaacgctagtgaggccgagtgatggtttgttaattctatctctttttgttcacttcaagaaagaaatttatgctaggccctggtgcaccttcacatggtgggttgtgtcgacatcgatggcttgctttcacg

SEQ ID NO: 5162 - DNA, 872 bp, Triticum aestivum
  Clone ID: PAT_TA_5162
tgttgtttgtctcgttgtgtccccttctttttggcaagcggggtcttgcgtttgccaccttctgctggagcaaactggcgttccgtctataacatttacaacttgccaccggtagcaaactggagttacttctgttggctccaatttagttgagcattacatattcacattaggtgtcccatgaatctttctatctttcgggttgaccaaactgatggactcaacagaatggttgattgattctagggcttgaatacaacgaatctcctatgactgatttgttatggcgggggcaggagcaggagcgggcctgaagagcctccggaacacccactggagaggtctcagcagctgcgatctcttcttgcgccagaaccaaattgcggcgctgtactgctcgttccgaatcttcctcgtcgccgccttccagccgaatttctccatctccttcctggcggccttccccattgtctctctcaactcttcacaggagagcaggagttcaaccttcccaacacagtcatccacatcacccggtatgtacagagggctgccccctcctcccgcagcgaccaccgggactccggatgacattgcctccaacacaacaaaacccagcgtctcggactcagaaggcatcacaaacacatccccactggcataggcctgtgacagttcttccccttgcaatgtccctgtgaacactgcaggcattcctgaaaacatctcttcaagttcaggcctgaatgggccatctccaatgaatgcaattcttgatcctggaagtcggtccatgactcgcttatgaaaatccaagcttttctcaactcctaagcgtccaacatagattatcagtggcttgtctggttcac

SEQ ID NO: 5163 - DNA, 744 bp, Triticum aestivum
  Clone ID: PAT_TA_5163
gaattcggcacgagctcatctgccggccttcgggcttgcatggtttctacatcaggactcggagaaatcaactggttgggcatcaatgagaggcacaatcggctatgccgctccagagtacggactgggcaacgaagtttcaatccatggtgatgtctacagctacggcattctgttgctggagatgttcactgggaaaaggccaacggacagcggattcggagaatcctttggccttcacaagtatgtgcaaatggcattgccagacagggcagcagaggtcatagaccgagacttactagcagagacagaagatggcgaagaaagcacctcaaactctggcagcaccatggatctcagaattgcttgcatcacctccgctttgcacgttggaatttcgtgttcacaggagacaccgacaaatcgcatcgaaatcggggaagctctgaaagagttgcagataataagaggcagatttgacaaggggttgcgcgcggaaatagaacccataaactaaagcatacaaagccattcaatcaatgcgactagccagggtcggtcataaggattaaggggagcaagctgccatttcaacaggctccagcttgttccaaacaaaaaaatgcagttgtgtcttgcgaatctttgttgtattgccataatggtatatttgtgctggtgaattgtacctatatatggtgttgtataaaccataagttctagaataagtccagggtgtagcgc

SEQ ID NO: 5164 - DNA, 1218 bp, Triticum aestivum
  Clone ID: PAT_TA_5164
gaattcggcacgagcagagcttagagcgccatgtctgctactccttgtgtttcttctctactcatctctgcgattgcagctgtcgcaagggctcaaacaaagacgggtatacatcgtctaccttggggagaggcaacatgaagatgtcagtctcgtcacctctttgcaccatgacttgctcacttccgttctcggaagcaaggaggcggctctcgaatcgattgtccacagctacagatatggtttctcgggcttttctgcaatgcttactgaatcacaagcgagaaagatccagacactgcctggagtggtgagtgtgaaagagaacacaatggtacgcatgcatactactcggagctgggatttccttgggctgtccatgggcgtggacatcaagcaggagcagcagccaaatgagctccttgcagcagcaaaccatggagatgggatgattatcggtgtcatcgactcaggtgtttggcctgagtcacagagcttcgctgatgatggctatggacctcctccttcaaaatggaagggaacttgccaagcgggtgccaacttcagtgcccacgattgcaatcgaaagctcatcggtgcgcggtggtatgctggccctgacatcgacaggagatttctccaaggtgacttcctgtctgccagggattctcatggccacggcacccacacagcctccacagccggtggcaacgtcgtccacaacaccagcttcttcggactggctgctggaacggctcgtggtggcgcacctcgcgcccggatagcagtgtacaaggcttgctggggttcttgctctaccgcgagcgttctgaaaggcatcgatcatgctatccatgacggtgttgacgtcctatcgctctctctcggaagcacggacgaaatggcagcactaggaacgctgggtgcggtggcaagaggcatcccggtcatcatggcagccggaaatgatggacctacagagcaaacggtgcagaactcttcaccatggctactcacggttgctgcaaccacggttgatcgatcattcctcacggttatcaccctcgggaataaccgacagtttgtggcacaatccatgtatgtggcagataaaggtggtgatgagttctctcaacttctgtattactttaatgataggtgtgacccggactacataaacagcactgacatacacgggaaggtggtattctgctacac

SEQ ID NO: 5165 - DNA, 1209 bp, Triticum aestivum
  unsure (1)..(1209): unsure at all n locations
  Clone ID: PAT_TA_5165
gccgttgcttgcggcgcggcacaaaatcttgctaggtgcgggtggatttccttattccggtaccatacaaacttatgtcaagttttcatactgacataaatgttcacataccataggaacgggcaccaatccccactgacgtcgtgggtgcttggcactgacctcagtgtccgcgcccctcggcatcggtctcttaccgccgtaccccttgtggcggccccgcttaagaggcctctgagtcgggccctgtcgtcttttattttacagtcgaactgcatgtaacgtccccacttaagaggcatctgagtagagctcttcaatcaccacacgaactgcaatcgggatccgaaccaggtgggcgcctccatcatgccatgccaagctaccgaaggtgtagctgccctggatccttcgggtcgccctgaaagtcacgttgaaactctgcaccctccttgcattgctgaacaccagcactgctggctccacagccatcttgacgccacgtggaggctccaagaatgccttgtacaccgcattcggctggccaacattggtaacagtgcgcacaaccgtcacagatgtcttgaggccaggaatggcaatcgatgggaggttcaagtcaggtggtgtgcaattgttatttgaaccaaatccttgtggacagttgaaaaactcgaggtaatctgacgcactgatgtcatatatcaggcctggatcagctgccttggttggattaacagaccctgctccgtaatcaaacgggtcggcgatctttgcacgatttccatttgcttctattggaaccccatgactgtccatggtatgtgcggttgtcattagtgctgattttagggcggcaggggaccagtcaggatgcacggatttgagtagagcgactatcccagatatatgtgggcaggccatggatgttccagaatcgaagacgtaggaaacacctagacttttgtaagcaccagtttgtgctgcagcggctaaaatgtacaccccaggtgcagcaatatcaggcttgagaaccccatgatagataggactaggcccccttgatgagaaagctgctantcttggggcaacaacttnacttccgctggttgttcgggttgttgatatctttatttttgggatgccaatgcgattgcagtacacngcaatctgatagctagtcttgaagtcgagaggaacgcaaggaag

SEQ ID NO: 5166 - DNA, 500 bp, Triticum aestivum
  Clone ID: PAT_TA_5166
gtgggaaaatcgagttgcctccgaacttgaagatggttatgcctggtgacaacgtaaccgcaatctttgagttgatgttgcctgttccgctcgaaccaggtctaagattcgcgctgagggaaggagggaggaccgtcggcgccggagttgtcgccaaagtcatgagctaataacaataatatgttccagacctttctctttttttttggcgtagtgaattttagcgaacaaatgaatgttgatatgaaggatttgtccgaccggaaacacgagataaacgagagtcgagagcaaggggactggcatggatgcatcttgtgtggatgcattcagccaaccaacttcctacggataatggtttgttaccattccgaagaattgctattttttcttctcatgttgggtagtttgctgtatcataccgcagcttgttacctagacacgcttctctggcatatattagctcggacgcgcaataagaccgtctcgtttcctgatgc

SEQ ID NO: 5167 - DNA, 1056 bp, Triticum aestivum
  Clone ID: PAT_TA_5167
gaacacaatttctcaaaccagggtcgtggtactgttgtgactggacgtattgaacagggggtaattaaaactggtgacgatgttgaagtcatatgtttgactgagagtggtcctgtgaagactacagttactggtgttgagatgttcataaagatgatggatcatggagatgctggtgacaatgttggtcttcttctccgtggtcttaagcgtggtgatgttgagcgtggccaggtggtgtgcaaacctggcaccgtaaagacctacaagaagtttgaggccgaaatttacgtcctcaccaaggatgaaggtggtcgccacactgccttcttctcgaattatagcccacagttctacttcaggacagctgatatctgtgggaaaatcgagttgcctccggatgtgaagatggttatgcctggtgacaatgtaaccgcaatctttgagttgatgttgcctgttccactcgaaccaggtctaagattcgcgctgagggaaggagggaggaccgtcggtgccggagtcgtcgccaaagtcatgagctaataacaatgatatgttccagaccttttttttggcgtagtgaaatttagtaaacaagttaatgttgatatgaaggatttatgcgaccggaaacacgagataaacgagagtctgagagcaaggggaccggcatgcatgcatcttgtgtggatgcattcggccgaccaacttcctgcggataatggtttgttaccattccgaagaattgctattttttcttctcatcatgttgggtaggttgctgtgatacggctgcgagaagacgacagaagtcgagggcaaggggactggcatggatgcatcctgtgtggatgcattcagccaaccaacttcctacggataatggtttgttaccattcccaagaattgctattttttcttctcatgttgggtagtttgctgtatcataccgcagcttgttacctagacacgcttctctggcatatattagctcggtgattcaataagaccgtctcgtttccgaaaaaaaaaaaagaacagtggagaaagaaa

SEQ ID NO: 5168 - DNA, 698 bp, Triticum aestivum
  Clone ID: PAT_TA_5168
cggacgcgtggggtaaggtgtactgctgggcttggactatgtgtttctgtttccagcagcttgccgagtcgttttactcaatacttgtggactgaaatttaagtcgttaagtttgtacaacatgtcgtgattacactttttatttgtagatgttgctattgccttgcttcttccgcagttttcttgagggcaaggcggggcgccgtctgtgcaggcgatggcagcaggagcggcggagcgccacgatacccgagcacaaccttggtcggaccgccccgcgacaccccacgcggagcgcggcggcggcgagcggtccgggagcccaaggaggcccttttgccagccagcgtgactggaggagagtgcccgagctaccagtgcctgaactaccacgccgaggtggcagcccgctctccacgcaggtcacagccagacgagccggaggctcctggcgcacgatcggccggccggcggccacgtcgcgcgcatccgaggaaggggctaccatggggaggcgctccggcaccaaggacgccggcggcgagtcgccctccggggcgcaggagctgcaggcggagtccatctcctttctaatatcctttgaagcataaagcaatcgaagtttgatgttccatcacgtgtatttattatagcgtgctcaatcgatccccgggtggcggtggactccgccctcgtgc

SEQ ID NO: 5169 - DNA, 779 bp, Triticum aestivum
  Clone ID: PAT_TA_5169
aacaagagaaaaatagttgttgctatcactagtaaaaaaaatacagaagttttgttttagaaatctgcaatgatacaaaggcttagcgacaaaaaacaaaattatccctaaattagatgtgatcaatgcgaaccaacccaaagtccagcaccagccgtgcatttcaagtgcaggtttgacacaaggccaccaaccagttcacaggtgtgccctcgcctggcaaggtgtcgaccaccggacggcaaaaagaaatccgacggcagagaatcaccgaagctggcaaagcggccacacgacaaatctgaacccggcgacaaccgtgaccttcgccccgcaacctcaagcggcccctccgcacatgtcgctctccaccacagccggaccgggaccggacgagccggccattgtcgtccaatcaaggcgcgcgcacacgagcagcttgccgaggccggggcctttcccaacgtcctcttcacgtgaactcactcagccaatggtccagtgcaaagtcaaggccgccatcaccacgtatcagcgtcaggaaaaggagaagtgcgtatcgtcctgtgactcggcgagttgctcaacaaacgggacgaaggtggcgtcctctcccttcctgatatttgggacacctacactgttggtagcattgccatcttccaaggaacctgagcattcatcttgagcccaggctgcaagaatggcttgtgctgtagatcccagcagcaacaagaacagcttgctgatgcttcctgagagagtgaagaagatcacca

SEQ ID NO: 5170 - DNA, 497 bp, Triticum aestivum
  Clone ID: PAT_TA_5170
gccgcaccgtacgaatcgtgccggtgcccgccatggccactttcttgggcagctccccggccttcctcgcccgccccgccgccaagccgcacgtctcgtgcgcgccgccctcgcgcccgcccagcgcccagccgccgtccgaccagcccccaccgccgccacagcagcaagagcccatgcaggcgcaggcggcaccggcgagggcgccggcgccgaagcgcgcggcgacgtcggccgactcgacggactgggtcgcgtcgtcgctgacgcggcggttcggcatcggcgccgggctggcgtgggtcgggttcctggccttcggcgtcgtgtcggagcagctcaagacccgcttcgaggtcgcgcagcagcaggccaacaccaaggacgtgggggaggagaaggaggtcgtcctgcccaaatgggaatccggtacacgggggtgcgggtgggcggcggcgacgtgccgcggccgggcgacctggtggtgatcgacctgc

SEQ ID NO: 5171 - DNA, 766 bp, Triticum aestivum
  Clone ID: PAT_TA_5171
ttttgttttcatttgctcgttaagtctctagtgccattattaaaactttcatggaaaatgcatatggtacactccaacaacgacgaagacaatttacttggaatgtcgtttatagcaggtatagtggatggaggacatcttctatggtaaaaagagcaatatctccataacacgcaagatcattagtagtaatacttactccctaggataggatacaatgcattgaatggttgagatgcacctaggccgccgatcggatcgggttttaggtcatcaatatacgtccgccgccgccgcaacggtgggtgagctcgtcgacgaagtcgtcgaagctcctctgcgacgacccgccgggcgccgcggcggccttgagcttggccgtcaccttcctgagcgcctggcggagctgctggccctcttgaccggatatgacgccctggatcctggcgctcacctcgtcggggaacaccttcccgcggtccccgctgggcacccccccccgccactcgcgcacgacgagccgccggttggtgaactggtcggtgagcagggggaagcagagcatgggcacgccggcccacacgctctcgaggacggagttccagccgcagtgcgtgaggaagccggcgagcgcggcgtgggcgagcacctccacctggcagcaccagggcacgacgaggccgcggccggcggaggcggccgcgaagccctcgggcagcgggtccgggtcgtcggagctgacgatgtccggccgcatcgcccacag

SEQ ID NO: 5172 - DNA, 1295 bp, Triticum aestivum
  Clone ID: PAT_TA_5172
tcggcacgaggcacgacgagcccggaccgcctccccgcctccccgcgcggcgacctcccccctcccctcggcgcaaccaacaccaacccgagcaatggagctccgcaccctcggcggcacgggcctccgcgtcagccccgtcggcttcggcgcctccccgctcggcaacgtcttcggcgacgtcccccgcgacgtcgcccgcgccaccgtccgccgcgccctcgacctcggcatcaacttcttcgacacatccccgtactacggcggcacggtgtcggagtcggtgctcggggactgcctccgcttctcgggcgtcccgcgcgacagcttcgtggtcgccaccaagtgcggccgctacaaggagggcttcgacttcagcgccccccgtgtcacgcgcagcatcgacgagagcctcgcgcgcctcggtctcgactacgtcgacatccttcactgccatgacatcgagttcaccatcctcgaccagatcgtgaacgagacgattcctgcgctgcaaaagatcaaggagagtgggaaggcgcggttcattggaattactggattgccgttgagcatcttcacctacgtgcttgaccgggtgcctcccggctccgtagatttggctctgtcgtactgccactacggaatcaatcaccccgcaccgggggattctcaagctggccatacaggcacagcagcagatcactgtagaaagaaggggaaacatattacaaagctagccaggtagtatagcttgatgaacaatgactgctccacaggtcctcttggctggcacgctccagaacaggtggaggagaatgttgctgctgcagtggaattgtcgacttcaggcatagatgaagaacttttgcacgaagtcgaagcaattctagagcctgttaaaaacttgacctggcccagtggtattcagcaagcgtaatgtcggagtcgtacattagcttcgtcagatgagatccattgggatgaatatatgtgatctattagtctgttataaatatgagtcatatctgttcatctgcagccttgcatgtgtctgagtcttgcaattgaaatcggattatccaactatccttggcaaccaaatggaagaccgtcatttggaatttgtgggtattgttgttgtctccagtaatttataggtcgaagcctgggagccgacactaacaataaagggggccggctgttggaatttgtgggtaatgttgttgtctctagtaatttatgtgcctgagagcctacactaacaataaaaggggtgtggtgttccgtcggggtat

SEQ ID NO: 5173 - DNA, 692 bp, Triticum aestivum
  Clone ID: PAT_TA_5173
ccccccctcctgctgtctttctttacttcttatacactcatctacgataagcaacaccgccccatccgcttcccttgggctactcaacggctcccggctgtccatgcccagctccccaagcagttcggttgggcttgtctactgctaccatctacacggcctacaacctcggtcctcagaacagcgtcagggaccgaggtttcgagaaaatgttgagcttcctctggaaaaaaccagatgacttcgacgctggccgcctgtgaatcgggctctcggtgggaggatcctctatcacgtcggctgcggccgccacttccgggctccccgtgggggggtcctcgctctcccccgcggcccccgccacttcctggggcctcgacgtgctgcgctccccttcccccatccccctcaccggctgctccacctgggccgggctgccccccgcctcctccaccccggtccccgcctcctccccgcgggcgcggattgccccctccttcatcaccgcggggcctccctcctcgcggcggcctctgtccgcctgctcggctatcgctccaaggcctcggtctgttcggcttcccggctccaggtactctgcaatggaaccaagacatcggtctgttctggtaataagcaccatagcttcttccatgtcgcataagttccgcaaaatctccaaacagcactcg

SEQ ID NO: 5174 - DNA, 725 bp, Triticum aestivum
  unsure (1)..(725): unsure at all n locations
  Clone ID: PAT_TA_5174
ccttgggaacgagcagcgccaatacttatcccctcgcggttaccttcccgccacaggctgccgcggcaactcaacccacacacacgcgcacactgacacccaggcagcagcggcggcggcggcggaactgggcttcggctcgggagcggcagccgcggcggcggcggcggcgcgcaccgtgtccccgcggctccacgcgccgacgtccctcaccgggcggcgcggcgcggggcggccgtcgacggtgtcggtgcgcgcggccggcggcggcgggctgatggacttcgtgggcggcgacctggtgaagccggacctggggcggtggctggccgacgtggaggagcacaaggcgctggccatctacccgccgcacgagggcggctacgagggccgctacctcaaccgcctccgctaccagggctactacttcctcgacctctccgcgcgcggcctcggcgaccccgagtccaccctcaccaagatccaccccgtctgcccgcctagcctcgggaggcagcccggtggcgaggtggtacttcccgccggaggttggactacaggctcagcctgctgcacccggacgccaaaagggctcatcgtctggggtctacgaaggccaaaggttctgtccaaggccccgctgctggcantttcctggtcaatgntncccccgaccttccgcccccaaaangtcaaagggtgaatncccgggaatnccggnaaaa

SEQ ID NO: 5175 - DNA, 887 bp, Triticum aestivum
  Clone ID: PAT_TA_5175
gacccactgcgtccgcacacaaaaattaaacaatattacccatcttttgaaaggagtagctttttttttaatgatcaggagcaaagtaggaacacaatggcattgatataggaggacacatattttgagaaaatgtgaacagactgaaaagacatctatgttttgaacgggagtgaaattatttggatttgtcagatacggactgtaccttcaaatttgtcatgaataattgtttcacatttttctttttagttactatatatgcacacaaaaattaaacgatttacattgctctagactgcaaaatctgaaacttcatctattttggaacgtagggagtaaaccaattgaggggatgatttgcatctgatatttagagcctgttcggaagctctcccgactctcaactccgctccgcgcgaggagccgggttcgagccgctccgcgcgattgtgctggcgctccctccgctccgggagctgcagttagggagcggaggggatccgaacaggccttagtaaccagaagtgctttaggaccaccgcggtgttctttcattgcaaaacatagaactactaatcttaatgtatttacatagcttgcctgctgtattgaccatcaccaatattgttcaggggtttaggttgtaaattatgctgttttttcttgagctgaaatagaaataacacattagggaattcaactcattcggtgcatgttgcttgttggtgtgtctatgtacacattcagatatttctatgggcagatccattgacgttaggtttgttgctagattttcttttttcaacctctactttccaccggtatgctacactcttctactcagtacagtaaggccaccttgtgactgcgtacttctctatttt

SEQ ID NO: 5176 - DNA, 811 bp, Triticum aestivum
  Clone ID: PAT_TA_5176
tttttgttgttcttccttctggcgctattatgtttgcattactcactttggttgtaagtgttattgcagtatgtgttacacacacatatataatatagtttggctaaggtcctccttttcgtcacaggcacgaccacacctaaacctaagagcagtgaagcgacatatcatcgtcatcagtttcagttcttcgcaagcagtcgacgacgaaactccccaagagcccaaatggggtataagttgcgatagttgccgtaattaaagtatatggagcagttgaagcatccaacgtgttcttgctggggaaactctcctgtctctagttgcatattgatcaactcttttgcagcatgatatagtggagtaggatctcgttcaacctgcccagcataaattaaagccaacattgcccaagcagtgttcactgcatgaggactagtggcctccacataagcctcagtttcactagaaagataagactctccccatccacctgtacttagttgctttgacaacagaaaattgcatgctttccttatggaagaactattttcgtaagttcttccagaagcaatcaatccttttacaccaaagaacgtcccataagtgaaacatataccccaagtgccaaaccatgagccatcctttcgttgcttgtcctcaatgaacttggaagcatttttgacacattttcctatctcttctttgcggtacccagggtaaagctctttgaacataattagggcctgaagcacagatgatgtacattcgacagaggatagtcgacaataatgttcagaaaaccctcgtg

SEQ ID NO: 5177 - DNA, 481 bp, Triticum aestivum
  Clone ID: PAT_TA_5177
ttcgagcggccgcccgggcaggtacttgctgtgggaggacgcgaagaagatgcggttgatagtgaacgcggagttccaccaagaaatgcgggagttcctgcgcaggcaaagatgatccaagggaagtgaccatcttggagagaagaaaagaagcaacttgtctgaaccacacgctccttcatgtgaggaaggcctgaatccacccaccaaccagacaagtctttacaacatccatcggcaggaggcaccgaggcagagtggttgtctgtagatgttgaaatcatttgaactcgatggtcgtaaatcgagtgtaatcatatgtttgataggttcagtctgcagtttgcgtcatgctaagtgtaggtcacagaaggtagtggattatccagttagtcaaatcaaaatcggatgaactgtacatgctccacttctccagttcagttttgcatggaagttgcgtacctcggccgcgacctcgcta

SEQ ID NO: 5178 - DNA, 704 bp, Triticum aestivum
  Clone ID: PAT_TA_5178
aacgggtaatcgaagaaaacattaatttgattgatctcacccattcaccatctaggaatttacatctgagtaaatgggaccatatggcccgataaaaagttccatggcacaagtcacagtaagtacggctaccaaacctgtactttgctccgagactgcaggcatcgtccttcctggccgcgggatgctgctctcacctgttgctgcaggtgaagaatcctccaaaagcttgtcgggtcaagaaggttcagcagagatcagcttggcactagcttgtttcatgccctggcctgcggtctcaagctcgattccagtactactctgcgtctcgactgttgctgctgtagacacagaattacttcctccagcaatttgtaaggtcggagatgcagctcttggcgcagcatagacaacgttatgcgttccacttgcctccgaggctggggttagtgttgcttgcgccaggtcttcaagcttgttctctagtgcagccaatatattattaagcacatctatctcattgtccagcgacaactcttctgagccaacttcagcagcaggtgcattctcacctttaacagccagcaaatcttcgagagcctttctcagcttccgcacacgtgacttgtacaatgacataacctttacagcatatgggagcgtgtctccaatctttgatgccgacgtgaaagccaggaatatgt

SEQ ID NO: 5179 - DNA, 353 bp, Triticum aestivum
  Clone ID: PAT_TA_5179
atagtaaatagccctctcaaatctttttagcaatttccttgtcgaatacatccatttcccgcttacatgtgattgtacatatgaacgtatgcatccaatcacgcttatttttatataagatcagatagactccttcttgtctgtgtgctcgatcgagaccgcttcaatggctgcctagttttagctcgatcatgggcagaagatgacctggtagttggtgccgccggggcaggtgtaggtgctggtggcgtcgtccttggggtagctgtaggcgtcggagccggacgcgtgggcggacgcgtgggcggacgcgtgggcggacgcgtgggcggacgcgtgggcggacgcgtggg

SEQ ID NO: 5180 - DNA, 1100 bp, Triticum aestivum
  Clone ID: PAT_TA_5180
aaagaaaaattgtatctttattattaataaatcatcttagctaagagaagataaaccttttctttttttgtttctctctttccaactcaatttttatagtccatggtattgctataatagcattattatcatgtgtgtctcgctccaagagcagtttattcttgcacaactcacctattcccacgcttttacaataggatcgtgcatgtgatgtcatgctcgatgttcacatgtcgtatcgccaagtaacattacacagatggtaacttactatttctcagtatatatatcatatgggattgctaaatctcagtcgactgagacttaaccaagtctcagtccggatatataaggttggtcgtgatcatgggcagaagacgacctggtagttggtgccgccggggcaagtgaagatgctggtggcatcatccttggggtagctgtaggcgtccgggcactggcccttgaagaacctcgagtagtcggtcggcccgcagttgtccgccgccgtgccggtgcagcagtactcgtccttcttgaacaccgtgcacgcgttgttgcacccgccgggtgcccggagctcggacgggcactgtgacgtgatgtccgcgtcgcaccgcggcccgcccttggcgcacccggctgtgccgtcggccggcagaaagtccatgggcacgttaaagccgtcgatgacagagatgtcgatgaagtcttggcccatgtacttattcagcccgaactcggccagcgtgttgggcgcctgcccgtaccccgtgcactgcagcacgccgccgcagtcccccgtctggcactgcccgttgccgctcccgtcgaagttgcaccccgtgcgcgcccacacgcgcccgcccgtcgtgcccgccggcacctcgatgctccatggctgcgcccccgggtccagctgcttgccaccgccggacggcacggccgccgcccacacggtgaactggcacttgttggtgatggtgaacgtggcggcgtgggtgccggcagcgaggagaaaaagagggaggatgtgcagcacgacacgggaagcggctgctagggatgccattgttgtgtgttagtgatgccaccggagt

SEQ ID NO: 5181 - DNA, 886 bp, Triticum aestivum
  Clone ID: PAT_TA_5181
atcccttgtttactggaatttgatgtatattcggttggacttggaaaatatagtaaatagccctctcaaatctttttagcaatttccttgtcgaatacatccatttcccgcttacatgtgattgtacatatgaacgggggcatccaatcacgcttatttttatataagatcagatagactccttcttgtctgtgtgctcgatcgagaccgcttcaatggctgcctagttttagctcgatcatgggcagaagatgacctggtagttggtgccgccggggcaggtgtaggtgctggtggcgtcgtccttggggtagctgtaggcgtcggagcactggcccttgaagaacctcgagtagtcggtcggcccgcagttgttggccgccgacccggtgcagcagtaccggtcctccttgaacaccgtgcacgcgttgttgcaccctccggcggcccgcagctcgttggggcactgcggcgtgatcaccctggggcactgaggcccgcccttggggcacccgggggagccgggggccggcaggaacgacatgggcacgttgtacccgtcgatgagggagatgtcgaagaagtcgaggttcatgtacttgttgagcccgaactcggccagcgtgttgggcgcctgcccgtactgcgtgcactgcagcttgccgccgcagtcgcccgtctggcaccgcccgttgccggcgccgtcgaagctgcaccccgtgcgcgcccacacccgcccgcccgtcgtgccggccgcccacaccgtgtactggcacttgttgatgacggtgaaggtcgccgcgtcggtcgcagcagcgacgaggatgaggatgaggacagggaggaggacggaagaagaggggagggacgccatcgtgttctctcc

SEQ ID NO: 5182 - DNA, 1096 bp, Triticum aestivum
  unsure (1)..(1096): unsure at all n locations
  Clone ID: PAT_TA_5182
nnnnnnnnnnnnnnnnnnnnnnnnnnnnnnnnnnnnnnnnnnnntaaaaccccccccgccccccccccggggcctttttttttttttttttatttttttttttttttttagccctctcaaatctttttagcaatttccttgtcgaatacatccatttcccgcttacatgtgattgtacatatgaacgtatgcatccaatcacgcttatttttatataagatcagatagactccttcttgtctgtgtgctcgatcgagaccgcttcaatggctgcctagttttagctcgatcatgggcagaagatgacctggtagttggtgccgccggggcaggtgtaggtgctggtggcgtcgtccttggggtagctgtaggcgtcggagcactggcccttgaagaacctcgagtagtcggtcggcccgcagttgttggccgccgacccggtgcagcagtaccggtcctccttgaacaccgtgcacgcgttgttgcaccctccggcggcccgcagctcgttggggcactgcggcgtgatcaccctggggcactgaggcccgcccttggggcacccgggggagccgggggccggcaggaacgacatgggcacgttgtacccgtcgatgagggagatgtcgaagaagtcgaggttcatgtacttgttgagcccgaactcggccagcgtgttgggcgcctgcccgtactgcgtgcactgcagcttgccgccgcagtcgcccgtctggcaccgcccgttgccggcgccgtcgaagctgcaccccgtgcgcgcccacacccgcccgcccgtcgtgccggccggcacgttgatgctccacgtctgccccgcgtccagctgcctgcccccgccggccggcaccgccgccgcccacaccgtgtactggcacttgttgatgacggtgaaggtcgccgcgtcggtcgcagcagcgacgaggatgaggatgaggacagggaggaggacggaagaagaggggagggacgccatcgtgttctctcctctccccttagtagagcttaagtgttgttgggtcgaggaccggccggcttcgagcgctcgaaatttatgcagcccgccgcctgagcgccccag

SEQ ID NO: 5183 - DNA, 503 bp, Triticum aestivum
  Clone ID: PAT_TA_5183
gccggccgggccgggactaccccccactccctaccacaagaccgccgccgccgcaggaggaggaggagaagcagcaggcgcgagaaggagatcacgcgagcaggcgaccgaccatgagggccaagtggaagaagaagcgcatgaggaggctgaagaggaagcgccgaaagatgaggcagcgatccaagtaggctgatggcggtggtgatggcgtgctgtagcttgctatgtgtgtctttggctgcggctgactgcgggcgtacttgcttggcatggtggcgccattcttctcatctgtcaactcgcttattccagaaacctgcactttagtaggcctgttatcgttgcttttagttgtaccaggagttttgctatcatgaccaatctatcgaaccgtatgaactctgttttggagctttatttgctgctaatattcggccatcaagtactttatgcttttgctggtatcagcattattgtctaaatgctcttatatcttgagc

SEQ ID NO: 5184 - DNA, 1386 bp, Triticum aestivum
  Clone ID: PAT_TA_5184
gcagtggacctgcgtgcggataaacacacccctaatctataaaatttatgtgacctgtcgcgccgccgccgccggcaggagaggaggagaagcagccaggggctgagaaggagatctccgcgtagcacaagaccgccgccgccgcaggaggaggaggagaagcagcaggcgcgagaaggagatcacgcgagcaggcgaccgaccatgagggccaagtggaagaagaagcgcatgaggaggctgatagaggaagcgccgaaagatgaggcagcgatccaagtaggctgatggctggtgggtgatggcagagctgtagcttgctatgtgtgtctttggctgcggctgactgcggatggacttgcttgggcatggcggcgccattcatctcatcgatcaactcgtttattccagaaacctgcactatagaaggcctcttatggtggcttttatggggtaccatggagttgtgcgatcatgaccgctctaccgaaccgtatggtcttctgttttcgcggagtttgttgggccgcataccttgtgcagcagttccggtcctccttgaacaccgtgcacgcgttgttgcaccctttccggcggcccgcagctcgctggggcactgcggcgtgatcaccctcgggcaccgcggcccgcccttggggcacccggaggtgccgggtgctggcacgaacgacatgggcacgttgaacccgtcgatgagggagatgtcgaagaagtcctggcccatgtacttgttcagcccgaactccgccagcgtgttgggcgcctgcccgtactgcgtgcactgcagcttcccgccgcagtcccccgtctggcaccgcccgttgccggcgccgtcgaagctgcaccccgtgcgcgcccacacccgcccgctcgtcgtgcccgccggcacgtctatgctccacgtctgccccgcgtccagcttcctgcccccgccggccggcaccgccgccgcccacaccgtgtactggcacttgttgatcaccgtgaaggtcgccgcctccgcgccggcgacggccaccaggaggagcacagggaggaggactgatgaagtggccatcgtgttctctcctctcccttgttgtagtggagcttaagtgtgcgccggacgccccgcgcgcggctgcttttagttgtaccaggagttctgctatcatgaccgatctaccgaaccgtatgaactctgttttggagctttatttgctgctaatattcggccatcaaatattttatgctttaaatggtatcagcattattgtctggatgctcttatatgttgattactgctccgtgtggagcttgaaaaactagataacagtgaaagttcaagcacttttactagagggcgcccgctttaaagatccaagt

SEQ ID NO: 5185 - DNA, 1036 bp, Triticum aestivum
  Clone ID: PAT_TA_5185
gggcatggccatggtgaagcccgtgttcatacccaaggcgcagcgggacaccatcgccgagcgcgagcggctggaggaggaggagcggcaggtggaggagaccatcaggaagaggctcgaggctaggaagatcgagaccaggcagattgtggtggaggagattaggaaggacgagcacattcagaaggcgcttaacgaggatgctagcattgaggatgtcgacacggatgatgagcagaacgaagccgaggagtatgagtcatggaagaaccgtgagatggcgcggattaagagggacagggaggaaaggtatgcacggttgaaggagaaggaagagattgacaaggtgaggaatatgactgaggaggagcgccgggaatgggagaagaagaaccccaaaccttctctccagaagtccaaacagaagtggaactttatgcagaagtactaccacaagggtgccttcttccaggaaggcggtgatgacgtgagccagtcagctggtagagatgctatatacacccgtgatttctctgcgcccaccggtgaagataagatggacaagagcatcttgcccaaggtcatgcaagtcaagcatttcgggcggagtggcagaacaaagtggacacatcttgttaacgaggacactaccgactgggatgcaccatgggctacaaacgggccgctgcgaacaaaatataatgcaaaaatggcgggcatgaatgcacctattgctaaaccaaagggaagtaagaagatgaaggattgggatacaaaacgagatgattaaatgtttgttgctggctgtgtgacctggtacactgctgaacatggtgattatgcagatgtttttcttctttatgttggtcgcatatgacacatgtgccatcatttggtaatgtacctatgctgtcaaaattcttcgtctttagccttttactgtcttgcaaaatgctttgtcagagaaatatttcatacatatatgtttctgtgcttctcgtgacaggagcatgttctataaaaaaaaaaaaaaaaa

SEQ ID NO: 5186 - DNA, 781 bp, Triticum aestivum
  Clone ID: PAT_TA_5186
gttttctcttgtgtttagcgtggtcgcggccgaggtctcgagttttttttttttttttttgaaggtcaatatatacgtgtctccttgcattgccccttccaggagtaaccaaagattgccaatcacacaggggagtttgcccctttcgacatatatcacagccccccccactaagatatcaccctcccccattaggatcccctctacactctcattttcgatcacacctaccttttctacctacactgcctaagctctttatagcgtatatagccttgcagtttctagaggtttagatttacatagctattatcactcccacgaagacgcctccctgtacgcccctcggctgagactctccagctctgtgtcccgccatttcgcgtccggatgaaactcggaccgctcggagttcgccgcgcccctgcccgccgtcaactgaccgtgatagctgatgccagttcattatccggtgtgaactgtaggatgcctatccaaataactccctacaagaaacatcagcttcactccgctccaataagttccggaagggcctgatgctgcagggaggggaccaaacggggacaacgccaccacctctcccggtccacctactcgacgacttaaagctagatagacagatggcgcttctctttcgctcctgcggtgccggggtggctgtgtgttgttgtgatggtgaatgccattagttcctgctgcattgcccgtgctttgaatcatttcctccctctcagtccgtggctcaaaatgcatgcggaac

SEQ ID NO: 5187 - DNA, 673 bp, Triticum aestivum
  Clone ID: PAT_TA_5187
atgaactcaacttacactatagcatccgagctacagatcgactcccagaatatttacaacctcaaccaaggatgaggcacatcatgcattgctccacataaccaagcagcaaaagctcagccaacacaggccaaaccagagtccaattttgccacaatgtgccaacacaggccaaccagactgccaacttacaacaaaatgtcgaattatgagacctccaagcaatcaagtattaaatgctagcagtggtccaattttgccacaatgtgccaacacaggccaaccacactcccaacttacaacaaaatgtcgaattacgagagttccaagcaatccacagccatgcttcagcaaagtgtgcttgtgtgccttgacaccactcattcaaggagatttcttgccaatccaatgcagcgggcaactttctgttctcgttgtgacagacacaaaagatggattcagtggaagacaggccgaagatagaattccaatagctccatcaatatttggtgacttcctcgggatccaacaagcaccttccatgccccaccgcttaccctttgaattcagtaataaccagtcagcttcgttatatccaatgagcagcattgactgatttgtctttccatggtcttctgggactttgatagtgccagttgaataattagcaaac

SEQ ID NO: 5188 - DNA, 2873 bp, Triticum aestivum
  Clone ID: PAT_TA_5188
ggagaatagccacatccctggtttggagagaccatcgcagcaacaaccattaccaccacaacaaacattatcgcaccaacaaccacaacaacccatccagtccagcccactgccaccgcgctactctccactcccactgccaccacctccgcctgcgccgcgctctgggcggaccaacccgcgaaccgtaccatctcccgccccgatccatgtcgtcggcggtcgcgtccgccgcatccttcctcgcgctcgcgtcagcctcccccgggagatcacgcaggcgggcgagggtgagcgcgcagccaccccacgccggggccggcaggttgcactggccgccgtggccgccgcagcgcacggctcgcgacggagctgtggcggcgctcgccgccgggaagaaggacgcggggatcgacgacgccgccgcgtccgtgaggcagccccgcgcactccgcggtggcgccgccaccaaggtcgcggagcgaagggatcccgtcaagacgctcgaccgcgacgccgcggaaggcggcgggccgtccccgccggcagcgaggcaggacgccgcccgtccgccgagtatgaacggcatgccggtgaacggcgagaacaaatctaccggcggcggcggcgcgactaaagacagcgggctgcccacgcccgcacgcgcgccccatccgtcgacccagaacagagcaccggtgaacggtgaaaacaaagctaacgtcgcctcgccgccgacgagcatagccgaggccgcggcttcggattccgcagctaccatttccatcagcgacaaggcgccggagtccgttgtcccagctgaggagacgccgccgtcgtccggctcaaatttcgagtcctcggcctctgctcccgggtctgacactgtcagcgacgtggaacaagaactgaagaagggtgcggtcgttgtcgaagaagctccaaagccaaaggctctttcgccgcctgcagcccccgctgtacaagaagacctttgggatttcaagaaatacattggtttcgaggagcccgtggaggccaaggatgatggccgggctgtcgcagatgatgcgggctcctttgaacaccaccagaatcacgactccggacctttggcaggggagaatgtcatgaacgtggtcgtcgtggctgctgagtgttctccctggtgcaaaacaggtggtctgggagatgttgcgggtgctctgcccaaggctttggcaaagagaggacatcgtgttatggttgtggtaccaaggtatggggactatgaagaagcctacgatgtcggagtccgaaaatactacaaggctgctggacaggatatggaagtgaattatttccatgcttatatcgatggagttgattttgtgttcattgacgctcctctcttccgacaccgtcaggaagacatttatgggggcagcagacaggaaattatgaagcgcatgattttgttctgcaaggccgctgttgaggttccatggcacgttccatgcggcggtgtcccttatggggatggaaatctggtgtttattgcaaatgattggcacacggcactcctgcctgtctatctgaaagcatattacagggaccatggtttgatgcagtacactcggtccattatggtgatacataacatcgctcaccagggccgtggccctgtagatgaattcccgttcaccgagttgcctgagcactacctggaacacttcagactgtacgaccccgtgggtggtgaacacgccaactacttcgccgccggcctgaagatggcggaccaggttgtcgtggtgagccccgggtacctgtgggagctgaagacggtggagggcggctgggggcttcacgacatcatacggcagaacgactggaagacccgcggcatcgtcaacggcatcgacaacatggagtggaaccccgaggtggacgcccacctcaagtcggacggctacaccaacttctccctgaggacgctggactccggcaagcggcagtgcaaggaggccctgcagcgcgagctgggcctgcaggtccgcgccgacgtgccgctgctcggcttcatcggccgcctggacgggcagaagggcgtggagatcatcgcggacgccatgccctggatcgtgagccaggacgtgcagctggtgatgctgggcaccgggcgccacgacctggagagcatgctgcagcacttcgagcgggagcaccacgacaaggtgcgcgggtgggtggggttctccgtgcgcctggcgcaccggatcacggcgggggcggacgcgctcctcatgccctcccggttcgagccgtgcgggctgaaccagctctacgccatggcctacggcaccgtccccgtcgtgcacgccgtcggcggcctcagggacaccgtgccgccgttcgaccccttcaaccactccgggctcgggtggacgttcgaccgcgccgaggcgcacaagctgatcgaggcgctcgggcactgcctccgcacctaccgagacttcaaggagagctggagggccctccaggagcgcggcatgtcgcaggacttcagctgggagcacgccgccaagctctacgaggacgtcctcgtcaaggccaagtaccagtggtgaacgctagctgctagccgctccagccccgcatgcgtgcatgacaggatggaactgcattgcgcacgcaggaaagtgccatggagcgccggcatccgcgaagtacagtgacatgaggtgtgtgtggttgagacgctgattccaatccggcccgtagcagagtagagcggaggtatatgggaatcttaacttggtattgtaatttgttatgttgtgtgcattattacaatgttgttacttattcttgttaaaaaaaaaaaaaaaaaa

SEQ ID NO: 5189 - DNA, 2937 bp, Triticum aestivum
  Clone ID: PAT_TA_5189
cggacgcgtgggttaccccacacagagcgcactccagtccagtccagcccactgccgcgctactccccactcccactgccaccacctccgcctgcgccgcgctctgggcggaggaccaacccgcgcatcgtaccatcacccaccccgatcccggccgccgccatgtcgtcggcggtcgcgtccgccgcgtccttcctcgcgctcgcctccgcctcccccgggagatcacgcaggagggcgagggtgagcgcgccgccaccccacgccggggccggcaggctgcactggccgccgtggccgccgcagcgcacggctcgcgacggaggtgtggccgcgcgcgccgccgggaagaaggacgcgagggtcgacgacgacgccgcgtccgcgaggcagccccgcgcacgccgcggtggcgccgccaccaaggtcgcggagcggagggatcccgtcaagacgctcgatcgcgacgccgcggaaggtggcgcgccggcaccgccggcaccgaggcaggacgccgcccgtccaccgagtatgaacggcacgccggtgaacggtgagaacaaatctaccggcggcggcggcgcgaccaaagacagcgggctgcccgcacccgcacgcgcgccccatccgtcgacccagaacagagtaccagtgaacggtgaaaacaaagctaacgtcgcctcgccgccgacgagcatagccgaggtcgtggctccggattccgcagctaccatttccatcagtgacaaggcgccggagtccgttgtcccagccgagaagccgccgccgtcgtccggctcaaatttcgtggtctcggcttctgctcccaggctggacattgacagcgatgttgaacctgaactgaagaagggtgcggtcatcgtcgaagaagctccaaacccaaaggctctttcgccgcctgcagcccccgctgtacaagaagacctttgggacttcaagaaatacattggcttcgaggagcccgtggaggccaaggatgatggctgggctgttgcagatgatgcgggctcctttgaacatcaccagaaccatgattccggacctttggcaggggagaacgtcatgaacgtggtcgtcgtggctgctgaatgttctccctggtgcaaaacaggtggtcttggagatgttgccggtgctttgcccaaggctttggcgaagagaggacatcgtgttatggttgtggtaccaaggtatggggactatgaggaagcctacgatgtcggagtccgaaaatactacaaggctgctggacaggatatggaagtgaattatttccatgcttatatcgatggagttgattttgtgttcattgacgctcctctcttccgacaccgccaggaagacatttatgggggcagcagacaggaaattatgaagcgcatgattttgttctgcaaggccgctgtcgaggttccttggcacgttccatgcggcggtgtcccttatggggatggaaatctggtgtttattgcaaatgattggcacacggcactcctgcctgtctatctgaaagcatattacagggaccatggtttgatgcagtacactcggtccattatggtgatacataacatcgcgcaccagggccgtggcccagtagatgaattcccgttcaccgagttgcctgagcactacctggaacacttcagactgtacgaccccgtgggtggtgagcacgccaactacttcgccgccggcctgaagatggcggaccaggttgtcgtggtgagccccgggtacctgtgggagctcaagacggtggagggcggctgggggcttcacgacatcatacggcagaacgactggaagacccgcggcatcgtcaacggcatcgacaacatggagtggaaccccgaggtggacgtccacctcaagtcggacggctacaccaacttctccctgagcacgctggactccggcaagcggcagtgcaaggaggccctgcagcgcgagctgggcctgcaggtccgcgccgacgtgccgctgctcggcttcatcggccgcctggacgggcagaagggcgtggagatcatcgcggacgccatgccctggatcgtgagccaggacgtgcagctggtcatgctgggcaccggccgccacgacctggagagcatgctgcggcacttcgagcgggagcaccacgacaaggtgcgcgggtgggtggggttctccgtgcgcctggcgcaccggatcacggcgggcgccgacgcgctcctcatgccctcccggttcgagccgtgcgggctgaaccagctctacgccatggcctacggcaccgtccccgtcgtgcacgccgtcggcgggctgagggacaccgtgccgccgttcgaccccttcaaccactccggcctcgggtggacgttcgaccgcgccgaggcgcacaagctgatcgaggcgctcgggcactgcctccgcacctaccgggactacaaggagagctggaggggcctccaggagcgcggcatgtcgcaggacttcagctgggagcatgccgccaagctctacgaggacgtcctcctcaaggccaagtaccagtggtgaacgctagctgctagccgctccagccccgcatgcgtgcatgcatgagagggtggaactgcgcattgcgcccgcaggaacgtgccatccttctcgatgggagcgccggcatccgcgaggtgcagtgacatgagaggtgtgtgtggttgagacgctgattccgatctcgatctggtccgtagcagagtagagcggacgtagggaagcgctccttgttgcaggtatatgggaatgttgtcaacttggtattgtagtttgctatgttgtatgcgttattacaatgttgttacttattcttgttaagtaggagaaaaagggagaaagctagctcacatgaaaaaaaaaaaaaaaaaaaaatcgagactagtgttctctctc

SEQ ID NO: 5190 - DNA, 994 bp, Triticum aestivum
  unsure (1)..(994): unsure at all n locations
  Clone ID: PAT_TA_5190
ggcacgagctttctcattcatactcaaggcttcggcccctgttctcttcatctggttgagagcatccgccccgtgctgcctccctgccacctccaaccccgccgggagaggagctcctctgccccgagcctcctccagcaggacagccagttacccggagtcaaacaacaaccgcagccaccctgccttggagctcgccgcctcctaccacctctccgtcggactcgttcttctccgcctcaaatccgtctgccgccaccggatccacgccagagcagccggatccgccgcctcctgacccgcctgccgttgggagcaggacgaccgagaggttcacccgttcgtttgtcgcgtgggccacgcagctgcctcggcccagcttgcccgcgaagtcgtcgccgtccatctcctccccctctctgctcctctctattttccctttttttgtttccttccttgctgttcgtcagctcccgagttgggcatatcacgcatgccgcttattttggatcttcctttatttctcatggccaaagatgacccatatatctcatcctcttttggttgatgtcctgacttaggcaggtgcgccggcagggatggcggtagcggcacgcagcgacgttggggtggtccggcggtgcgcagtgaggcaggcggggcgtggcaggaggtggggacgcgctggaggtgaagatcgagccggggcgtgcgggtggctgggttatgttttttcttttctttcttttctctcccagtacgcgttcaggttgatttatcacaaggattacgggttgaatattccaaaatcataggggcttttttgcaaaaaggcccgcgacgtacgaccagaagcgctcgctgggttanttagtaaaaaatctgggcccggggggtccctgtctgtatgtatgtatctgtatgtatttatatgcggagaggctcggccgttctaggtttgatcctgattggcaagattccagctttccatcct

SEQ ID NO: 5191 - DNA, 647 bp, Triticum aestivum
  Clone ID: PAT_TA_5191
ctcgtgcttcattcacaaagctctagccactgattaacaaagctcgtgctactactttagaacgatcggccgtgggaagcatcggaaccaccaacggcaccggcatcgggcacggcagtgccgcggtggcgcggcggcaccacgccgaggcccccgcgcccatcctcggcatccccacggccaaccccaccggcgtcgcggcgccccacgaacaccttcgccggccaacctcctccgcgtcaccaagagcgaccacctctctcaagctccagcaagaagctcacccacaatctgcgagaaggacgggcatcgacaagcgcaactgccacctgacggcggagaccctggtggcccacccggaactgtacgaccgcgatgcgcagtccctgggacaaccccctcgccatgaccgtccacgccgtgccgaacctgccgcaatgcgcggccgccaaggccatctcccagtggggcctcccggcgagcgagatcacccactccgcctaccgccacgcgtccgcctccggagcccctaccgcacccgcttcgccccggcagcccccagccaactcccgcggctggccgcgcgccggcccccccccccccctcaaaacccccccctccccgccccccacggctgctacggcggc

SEQ ID NO: 5192 - DNA, 1016 bp, Triticum aestivum
  unsure (1)..(1016): unsure at all n locations
  Clone ID: PAT_TA_5192
gaattcactaagtgattagcgtggtcgcggccgaggttttttttttttttacaatttattagtagaatccaagtagtttcttttggtgaatcatattacacccagcaggcactacatatataattactagctatagctagtcgtatgggacatgaactgaaagctcagtgggacgtggccgtttgcggccttaatttgatttgagtgtacgtgtccatttagtttgacacacgtacgtgcacacacaaatacgtacgaacctacgtataatggtataattaaggaggcttgagctttgagaaggatgactggaggccatcgatgcacctagcgtggacagcggagcaccatggtctcaattgtgaccccgggcccgaaggccagcatggcgccccactccggcagcaggctccggcgccggcgcagctcgtcgagcacgaagacgatggtcgcgccgctcatgttgccgtactcgcggagcagcgtgccggctgccgcccagcttctccggctccagctggagcaccttgtctatgttgtccaggatcgggcggccgcccgggtgcaccgcccagaagaggccgttccacttcccgttcccggataacggagacggaggacgagcaccatggccagcctcctctcctccgcggaacgcgtcgaggaggcagcgctccacgttctgcccgatgagcgtgggcacctggatggcgaggtggaagtcgacgccgctgccggagacctgcatgccgagcgcgtgctcggtcttgggcaccgtggtctgcgtggcgtggaccatctcgaagatggggctctgctcgcngtngcggaagggcccggcgccgacgatgaccgcnccggcnccgtccccgaagatggcgtggcngacgaggttgccgccgtcgggcccgccgaagcagacgagngtgatctcggcgcaggccacgaggacgcgcgcgccgcggttgttctcggcgagctccctggngaggcccagcgcccgncctccgccgtan

SEQ ID NO: 5193 - DNA, 1368 bp, Triticum aestivum
  Clone ID: PAT_TA_5193
ttcttctcttcggtccagaatggcgcacgcttggttttacagggcatgttaactcatgttcatacttccgactgtaaataaacggaattacatgtttttcccttttcaccggaagaaaaagaataactactgctatcttatggtttactcctatttattagaacagctcctcctttcgcatatacagtggatatattttccttcctcgtactcgctaggctatagcatagacggcgcgtcgggtttccttgacgctgtcgccccgaccatctcctagaaatcgtcctgacaagcggcatgcaggatttcagttcacgcgggcccgggcgcacgcgcaggtcgtatctcatcttcagacagaccataattggtccatccgcccgtcgatcctctcgagcctctcctgctccttcttctccagggccgcccgggcagtcccgccttggctcctggggaggcactgcaggttctggagcgccaggtcgcccttctccggcccccgcccccgcgcccgccggatcccgccgctcctgtgcaccagctccatggccgccgacagcgagcccgtgtcgcagaactccgagtcgatgatctccctcagctccggcgactcctgcagcgcgaagatgaccggggccgtcaggttccccttggccaggtcgctccccgccggcttgcccagctgctccgccgactgcgtgaagtcgaggatgtcgtccaccacctggaacgacagccccaggttcctgccgtactcgtacatctgctcgcatacggcggtgctcaccccgctgaatatggccgcagacctcgtgcttgaagcgagcagggaggcagtcttgtagtagctcttgagcaggtagtcgtccagggtgacgtcgcagtcgaaaagggtcgactgctgtttaatctcaccactagcaaagtccttgatcacctggctgatgagctttataacctcaatgttttccaagtttgccagaaaccaagaagattgtgcaaacataaaatcaccagcaagcaccgctatccgtgttccatatagctgatgaatggtttctttccctctgcgcatcccactatcatctatgacatcatcatgtattaaactcgcagtgtgaatcatttctatgatctctgccaagcgtttatgttctctagttagctccgacaagccagctacttctgctgttgctctggacaccaggaaaaccaatgctggtcttaatctctttccaccagcaccaaaaatttgttctgcggcagatactaaaactgggttttctgcaccaataagcgatttgaggttgttgttgagcttgagcaggtcatccgagacgacatccaagagcgaagcgatggacacgc

SEQ ID NO: 5194 - DNA, 689 bp, Triticum aestivum
  Clone ID: PAT_TA_5194
ccccgcgtccacgcagccacaatcccattccactccacggtgaggttgagcgatctgacgagcccttcagcagcagcgacgacggcggcaggtttgctctctgaacttctctggtctttttagcggcagccagcaggaacacacaagaaaccgatcgaggtcccgttcaaggggtccttcttctgggattattagatcggaagaagcgccctcctcttgctcgggattctcttgatttcttgctaacctcaccactctcctaggaggaacagagagatccagagaaccttttttctctcctggattcttgcccttttcagccttgttttgctccggtacggccggaaagggttcttttgcaatacccttctagttcgtccgatttattcttttcttcccctcgtttctctaattttattgaggaacagggccttttttctctctctttctgcttgcaccagaaagctccttttttttcatttcggttttggttcggccttctctacatcaccttcttctacctctgcccaagccctcatggccgctgccatagacatgtacaagtacaacaccagcacgcaccagatcggctccgccgcctctgccctcgatcaagagctcatgaaagcactcgaaccttttatcacgatagcttcctcctcttctcttactacccctacactactact

SEQ ID NO: 5195 - DNA, 1028 bp, Triticum aestivum
  Clone ID: PAT_TA_5195
gctctactcctcgcatatgccgcttcgggcatgaacgatcctggggctggcccagctcggcccggcccagatccagcagatccaggcccagttcttcgtccagcagcagcagcagcagaggggcctggctggtggctcgttccttgggccgcgcgcgcagccgatgaagcagtccgggtcgccgccgcgcgcgtccgccgcggcgctggcgctggccggagtggcgcccgcgcagtccaagctgtaccgcggcgtgcggcagcgccactggggcaagtgggtggcggagatccgcctccccaagaaccgcacgaggctgtggctcggcaccttcgacaccgccgaggacgccgcgctcgcctacgacaaggccgccttccgcctccgcggcgacctcgcccgcctcaacttcccgtcgctccgccgcggcggcgcccacctggccggcccgctccacgcctccgtcgacgccaagctcaccgccatctgcgagtccctcgccgcgccctcgtccaagaactcggagccggagtcccccaagtgctcggcgtcgacggagggcgaggactcggcgtccgccgggtccccgccgccgcccacgccgccggtcccggagatggagaagctggacttcacggaggcgccgtgggacgagtcggagaccttccacctgcgcaagtacccgtccgtggagatcgactgggactccatcctgtcgtgaacagcaagcagctgctactactagtacagtcttcgttaagctatgatgtaatttctctttcgctcggatcggcggctgctctggcccgacggcattttagacgtcggccatggctgctgcgagtagcagtaattaactagtagcagtaagtaagtagccagtggtgtttagtaagatcgttgctactactacgtggtgtaattgatctcctggtcgacctgccggcagttttttcacggcaaaggcggccagtcgagagatgtaatcttgtttacccgttgaaagaattgcactagcttatgtaacc

SEQ ID NO: 5196 - DNA, 814 bp, Triticum aestivum
  Clone ID: PAT_TA_5196
gccggccccccgcgtccggcccactccgaccttcgtccacacacattccaccagccaccacccgccgaaaaagccccaatcccagcaaaccacaaacactcacgtgagttcgagcgaggtaagcatagatccgagcgagttcttgcgtcgccaaggtaaggttctccgagtctcaagccctcttcctcccgccccctattcgtctccttgttcacccggcaggcagcgaggtctccaggacgttttagatcccggggctccagatctgttcttttttcttctcttttagttgtagtaatcggccaggcgaggttctttttccacacctccttgctcgttgtgtctagatctaccaccaacgccatctctttttgccgtggctgttgaccttgttgattttctctgcctgttctaggttttggtttggaaaccaggcagatttctttcttgttcatctttctaagaaaacaaaaatccccaaaaaaaaagatcgtcctagttccttagatggctgcagctatagatctgtccggggaggatctggtgagagcactcgagccttttatccgagaagcctctgccccccttccactccactcccatcttagtcccacctcgccattctccttcccccacgccgcctacagtgggtacccgtacggggtgcaggcacaggcccagaccgagctcagcccggcccagatgcactacatccaggcacgcctccacctccagcgccagactggccagccgggccagctcggaccgcggtcccagcccatgaagcccgcttcggtggcagcggcgaccccgc

SEQ ID NO: 5197 - DNA, 2038 bp, Triticum aestivum
  Clone ID: PAT_TA_5197
gcacgaggcccgctccccccctccccccctcgcccacccacacacccgccaacacacccagccaccgcaacagccccagtcccagacaaccacaaaccacccacgtgagggaaggcggggtaaggttagatccgagcgtgtctctgctttgctaaggtaacgtcctttgaaatccaatccatctccctcccgcccctgcgcgtcgccttctgctctcgggacggtgaggacttcaggcgcgctcgtttccggggtcctcctgctctgtttctttttttttaccctctttttttgtgtaggaatgggcagaggcgaggttctttttcttcacccctctgctgcttgtgtcttgttctacctccaactccatcggtttttgctgttggccgtgtgtagcttttcccttttatgttgtacgctgtttgttttggtttttggtttggtcattcttaatattacttcgttttttctaattctattgaaaaaaaactccaaaaaaaaattcttccctatttgcccttagatgggcggtactctagatctctcttcggaggatctgctgtgagcactctcgcctcttatcccagagacctctcccccccctccactccccacccccctctgagccccgccgccactctcctgcccccacaccgcctacagtgggtagcacgcccacgacctcgctacgcttgctccctccgcgccctcccactacccctaccactacttccccgcacgccccaacacccaacactcgtccagccacacgccccagctcggcccgcggccccagcccatgaagcccgcttcggtggcagcggcgaccccgccgcggccgcagaagctctaccgtggcgtgcggcagcgccactggggcaagtgggtggcggagatccgtctcccccgcaacccccgcccccgcctcctcggcaccttcgacaccgccgaggaggcggccctcgcctacgaccaggccgcctaccgcctccgcggcgacgcagcgcgcctcaacttccccgacaacgccgcctcccgcggcccgctccatgcctccgttgatgccaagctccagaccctctgccagaacatcaccgcctccaagaacggcaagaagtccgcctccgtctccgcgtccaccgccgcagccacgtcgtccacccccaccagcaactgctcctcgccgtcctccgacgaggcgtcgtcctcgctggagtccgcggagtcgtcaccgtcacccgccaccaccaccgcagcagaggttccagagatgcagcagctcgacttcagcgaggcgccatgggacgaggcagcctgcttcgccctcaccaagtacccgtcgtacgagatcgactgggactcgcttctcgccaccaattagcacccagtttgtgttcgtcagctactactactaccgtctttagcgtttcatgatgctaggttaatgggtcgccgcgatgcagatggcattttagacattctgcacgggcttttagcggattagctctaagtctctaatccttgttcattgtgtagatctattatttgttctctttgtgggtagggtttggttagtccgtcccggatgactataagccggcgtttttgtgcccggcgtctccggtggtcggtcactggtcagtgactccggccggtaaagtctttgtgtccatggttttagctaggtgctgttccttccgctgctctgcagattgtaacagtgggagtcttgtcatgtaaaattagctcgtcaaaaatcctgtaatgtggaatattattttttgctactactacgtggtgtaattgatctcctggtcgacctgccggcagtttttttcacggcaaggcggccagtcgagaggtgtaatcatgtttacccgttgaaagaattgcactagcttatgtaacaaaaaaaacgggcttcacatccgtacgttttcctcctatattagtacgcatagtcggccggacatactttactactcccacgatgagcgctcctaaaacactgaagaggcaccaacgccatctttttttg

SEQ ID NO: 5198 - DNA, 662 bp, Triticum aestivum
  unsure (1)..(662): unsure at all n locations
  Clone ID: PAT_TA_5198
ctcgtccccacgtcggcccggcgtgcgtgcgtgcgtgcatggaggaagctggtgggtgtgcgaggatgggtctgagaggggtgctgctcgctctggccttgctgctctcggtgtgcgtgcgagcaagccatggactcacggacagccaggacacttctgttctccgagcgctaatggatcagtggcagaactcgccgccgacatggggacagtctgatgatccctgcggtgtttcgccatgggatggggtgacatgcagcaacaacagggtgatctccataaaagtgtcaaccatgggcatcaaaggacttctagctgctgacatcgggcagctgaccgagctgcaatccctggacctgtcattcaacaaagaccttggaggtgtgctcactccgaccatcggtaatttgaagcagcttgcaaccttgattctggcaggttgcaagctttcacggcaacatccctgatgagctagggaagtcttcccaacctatcttacatggctctgaactccgaatcagttctctggaaaaataccagcatctctgggcaatctctccagcctctattggtttgatgtcgccgacaatcagctgactagcccattgccaatctcatcaaacggnggaatgggtctagacaagcttacaaaaaccaaacac

SEQ ID NO: 5199 - DNA, 511 bp, Triticum aestivum
  Clone ID: PAT_TA_5199
cgggtcgacccacgcgtccgcatcgcttcccccccgaccacggacggtcagccagggataaggcatacattgccgtcctctccttcgccttcctcttcctgctccactacattctgggcaagaagagcaatggcagcaagggcgccgcgcacctcccgccgagccccccggccgtcccgttcctcggccacctccacctcgtggagaagccgctgcacgccgcgctgtgccgcctcggggcgcgctacggctcggtcttctcgctgcggctcggcgcgcgcaacgccgggggggtctcctcgccggcgtgcgccagggagtgcttcacggaccacgacgtggccttcgccaaccggccccggggcccctcgcagatgctcgtctcctacggcggcacctcgctcgtcagctccagctacggcccgcactggcgcaacctccgccgcgtcgccgccgtgcggctgctctccgcgcaccgcgtcgccggcatgtcgggcgtcatcgccgccga

SEQ ID NO: 5200 - DNA, 825 bp, Triticum aestivum
  Clone ID: PAT_TA_5200
ccgggtcttcccagcgtccttttatcctcttgttccaccgtgagtgagtctgtcagcgctgcatccatccatggcgtccatgctctgctcctactccgtctccatgcccgccgccgccagggctccgctcctccggtccagcgctagctcctacgccacctcggtcgggttcgccacctcgcagctcgccgggctgagcctcagcctcggcctcacctccacggccgcggtctccctccccgccaagaacaccatcgtcgcgcgccggatctgccccttcttggagaagaagacgaaccgggccaacaaggtgtccttctccaaccacaagaccaagaagcagcagtttgtgaacctgcagtacaagaagctgtggtgggaggccggcaagcgctacgtcaagctccgcctctccaccaaggccctcaagaccatcgagaagcacggcctcgacgccgtcgccaagaaggcagggatcgacctcaacaagaaatgaaatgatcgatgagccatagttaaggcctcctagcaacaacatcttcttgatttcctcacatcaaccatttcaatgtaatgtagtatgcaaaatggatttatgtccagttttccttttctccccttttgtgtcggttccttccttcctagtgcgatttgtgcaagtaaccttataaatgcccattttccttgatgagttagttgatgttaagcatcataccggatcatcgtcatcatcatgtatatgtacttgtgcagttggtttgtgcctttcagctgcaaaccaacctgatgttttatgattgatcagggaaggatgttttatgattc

SEQ ID NO: 5201 - DNA, 792 bp, Triticum aestivum
  Clone ID: PAT_TA_5201
gggagtgagtctagtttggcatccatccatccatccatggcgtccatgctgtgctcctactccgtctccatgcccgccgccgccagggctccgctcctccggtccaactccctcgggttcgccacctcgcagctcgccggcctcagcctcggcctcacctccacggccgcggtctccctccccaccaagaacaccatcgtcgcgcgccggatctgccccttcttggagaagaagacgaaccgggccaacaaggtgtccttctccaaccacaagaccaagaagcagcagtttgtcaacctgcagtaacaagaagctgttggatgggacggccggcaagcgctacgtcaagctcaggctctccacccaaggccctcgaagaccaacgagaagcacggcctcgacgccgtcgccaacaaggacggggtcgacctcaacaagaaatgaaatggtccatacaattcaagcttgagaccaggctcctcccctagctacatggtctccttcaaccatgttggttttctcacatgatgcatataccctctcagtcgtaatgtagtatgcaaaaaatatctgcccctcgttttgttatttattatctttattgatgtaatcatgtaaatgcccattttccttgatgagttagttgatgttaagcatcataccggatcatcgtcatcatcatgtatatgtaagttgtgcagttggtttgtgcctttcagctgcaaaccaaactgatgttttatgattgatcagggaaggatgtttcatgattcttggttcaaaaaaaaaaaa

SEQ ID NO: 5202 - DNA, 602 bp, Triticum aestivum
  Clone ID: PAT_TA_5202
gaattcggcacgagcttcatgccatcgggcgtttcttttgctgaagtagtttcttctggcaactgagaaatattccaccagagtcaaatattgacctataccatcattacccaaagagaattacgatggatctctcatttgaaagatactgaaaactcttatttttgtctgagcattcggaaggcagcaacagtgctccttcagtgttacagatctgaaattcttcaatccaagctactctgaaaaaatcgatgtgttttgtttccacttcaaatcagatgtcgacaattccgtgtggagtgcagaagattgcagggagttttgcgagatccgaaactaatacaagacggatgtgttagcaaaaagatacatggcagactgattcttttctactccgtacaattttgatagactgagtagaatgctttcctcaaaaaattgggctgaattttggtcgtatggaacttaggttctagaaatttagaaattggtttgctcactgcatcgtaataatctcttgcgtcttttgtgagagaaactgatgttattcttttgatgagaatagtaacaagagtatctccaaaaaaaaaaaaaaaaaaaaa

SEQ ID NO: 5203 - DNA, 701 bp, Triticum aestivum
  Clone ID: PAT_TA_5203
acacgtgccactgttgggcttatttttttcttgaactcaccttaacaaatattctcaaaagaaaaatcgcgttcacaaataatactggttttacatgtacaacagatcaattaaattacatccacaaataaaaatgattacatgacacatcttcctcctcgaacgtatattgaacagctgaactcagtagacgtacagaagtaacactgggactagtttattaaggctccgcattattctggattttcgatgcatggttaaaaaaagttaggcggtgcagataacgtggcagcaccacatcaggtgcagcccatgggttgttcatccgtagtaacccaagatcaatcgtcacatgatggagcaggcatccgatgggtcctcctccagtgaaaccatggtgggcggcatgaagcagggttgctgcggcggccaggtgggcggccggcaagcagttagcaggcggcttgccgcagccacaggccaccgtgagaaggggtcgtgcgcgggcgacgcccttacaggggcgccggccttcggggcggtccccgcccccggtgcggggaacgccactcgatagggcacgcttccgactccggcgacgcccgcaccaggcccgtgcggtccggcgcgtgcccacggatcacccgatcgcccagctcggcccgcgtcagccttttatctaataaatgcgcccctcccag

SEQ ID NO: 5204 - DNA, 986 bp, Triticum aestivum
  Clone ID: PAT_TA_5204
ctcgagcggccgcccgggcagggcttttgacttatggtagcaggcagcctatcgatcattttcttcagtgcatggaggaactgaccctagatgacattacagcgtttgctaagatgttgttatcttcccaacctacaatggctagctatggagatgtcgataaagttccgccgtatgaatttgtcagccagcggttccaaccgttccgatagcgccctaacgccatgatccctggtgatgacgaactcagagctctgttccagttctccctaatttttgtcgcggacgcggggagtcagcttttgacttatggtagcaggaagcctatcgatcattttcttcagtgcatggaggaactgaccctagatgacattacagcgtttgctaagatgttgttatcttcccaacctacaatggctagctatggagatgtcgataaagttccgccgtatgagtttgttagcaagcggttccaacggttccgatagcgccctaacaccatgatccctggtgaagacgaagacacagagctctgttccagttctccctaatacttggcgttgtgcccggaaattttctttgttttacttgtgcgtgaacgaggttagttttgtattggcttagttcaaacagcgcatgctgatgaaatgtctcgggtagacaggaaaactattttcttgaagcttgtatggaaattttgccctgccaatctatgtggtcccgttgccactgttcaatgttcactaccccggcggcgaccacactgagctctcttccagttctccctaatacttggcgttgtgctcggaatttttctttgttttactcgtgcgtgaacgaggttagttttgtattggcgtagttcaaacagcgcatgctgatgaaatgtcttgggtagacaggaaaacaattttcttgaagcttgtatggaaattttgccctgccaatctatatggtctcgttgccatgtaaaattttcagtacgt

SEQ ID NO: 5205 - DNA, 1129 bp, Triticum aestivum
  Clone ID: PAT_TA_5205
ggcacgagtctctgctctgtcttttccatctttacacccgcgtcgccatccacggcacgaccggccatgtccccatgccacctcggttctcttcactccttgcatggacactggacgaggggatgaggagagggccccacgttatcccagcccggggacgcggccgcgccacgtcggacaccacacatcacccctcgacgcgatacgaggccaccagcagccgccgcgggggctggagagcaggcggctccgggtgacggccagggagtaactggagcggcggagagctacaacggttcgatcgacatggaggccaaggccgccgccgtgtccctctcggcgccgctgccccggtgccgcgtcgccggcggcaacggcccgctcgcgtgctctgcctcggcgcggaggtcgcgcaggtgcgggtatcaccatggcgcgcccctcagatcactcgctcgcccctcctcctctgctcgctccttccccgccggccgcgtctacgcgatggccgcggccgcaacgacgccggtgaaggagcaggacctcgtcttcgtcgccggcgccaccgggaaggtcggctcccggaccgtaagggagctcatcaagctgggcttccgcgtccgcgcggccgtccggagcaaggagagagcgtcgcccctcgtgcagagcgtggagcggctggagctcggcgaagggagcgccgcggactcgaggctggagctggtcgagtgcgacctggagaagcagggcgaggcgggcatcaaggcggccatcggcgacgcggcgctcgtggtgtgctccatcggcgccagcgagaaggagatcctcgacgtcacgggcccctaccgcatcgactacgtggccaccgccaacctcgtgcgcgccgcggccaaggccggcgtcgagcacttcgtcctggtcacctccctcggcaccaccagattcggcttcccggccgccctcctcaacttgttctggggcgttctgtgctggaagaagattgcggaggaggcgctggtggccagcggcgtcccgtacacgatcgtgcggccggggggcatggagaggccgacggacgcgtacaacgagacgcacaacctggtggtgtcgccgcgggacacgtacgtcg

SEQ ID NO: 5206 - DNA, 378 bp, Triticum aestivum
  Clone ID: PAT_TA_5206
gccggccgggtccggaactcggtccccaagaggcaggccatagaagaaggccgccaagtccaagacaacctagagcatctctctctgccaagatagctgtggccgtaggggctttgcgggaaagacggtcttatttaacaaagctaccgtacctgttcttctcttatgtgtaatggatccgtttttgaagggggcgtaggccttacaaggtgtgggtggcggtttaggcgactagattgtgtatcattattatgtgctacttccgatttgattgttgtagggctaaagattgttatcccatttgtttattctgcaaccaatattgttactgatgcaaaggagattagattaccaaaaaaaaaaaaaaaaaggccccta

SEQ ID NO: 5207 - DNA, 829 bp, Triticum aestivum
  Clone ID: PAT_TA_5207
gattccgagagctcccaagtcgcgccgcggctcctaccccgcctcccccaccgtatcccgccggtcgctcgcctcgccccgccgccgccgccgcaggttgacatggggttcgtgtccttcgccgggagggtcctcttcgcctccgtcttcctcctctccgcctaccaggagttcactgaatttggaactgatggcgggccagctgcaaagaatcttgcgcctaagtttaacagtttcaccaaaaatatttctgtacacctcggagttgtggtgcctcatgtagagttgaagcatgtggttgctgctaccattggtctgaagggtctgggtggtctcctgtttatcgtcagcagttcatttggtgcttatctcctggctctctaccttgctttcatcacgcccgtcgtctatgacttctacaactacgacatggagaaggctgaatttgtgcagatcttcatgaagttcacacagaacctggcgctgtttggagcccttctcttcttcctgggcatgaagaactcggtccccaagaggcaggccaagaagaaggcccccaagtccaagacaacttagatagttgcggagaagactcttatttaacaaagaagctaccgtacctggttctcttatgtgtaatcggatccgtttttgaaggggggtgcaggccttacgaggtgtgggtggcggtttaggcgactagattgtgtatcattattattatgtgctacttccgatttgattgttgtagggctaaagattgttatcccatttgtttattttgcaaccaatattgttactgatggaaaggatgttaccaaggtcaaaa

SEQ ID NO: 5208 - DNA, 1406 bp, Triticum aestivum
  Clone ID: PAT_TA_5208
tacatatgcgccactcgctcatgcccgtccagccgtcagtcaacaccgtcaaatcttgctctatttctgcatatttatcggacaagaggtattaccatcattgatccttaccgctatcccaacagaacctgtttcatcttaaggcgatcatatggccaattctttactatatatgcaagaagccgcatcacccaccgcctgaggatttgtcagtgtacacgggagattctcttccccatctccatccaggtctcccaaggtcgcgccgcgattccgagagctcccaaggtcgcgccgcggctcccccctcccccaccgtatcccgccggtcgctcgcctcgcctcaccgccgccgccggtcgacatggggttcgtgtccttcgccgggagggtcctcttcgcctccgtcttcctcctctccgcctaccaggaattcactgaatttggaactgatggcgggccagctgcaaagaatcttgagcctaagtttaacagcttcaccaaaaatatatctgtacacctcggagttgtggtgcctcatgtagagttgaagcatgtgattgctgctaccattggtctgaagggtctgggaggtctgctgtttatcttgagcagttcatttggtgcttatctcctggccctctaccttgctttcatcacaccggtttgtctacgacttctacaactacgacatggagaaggctgaatttgtgcagatcttcatgaagttcacacagaacctggcgctgtttggagcccttctcttcttccggggtttgaagaactcggtccccaggattcagacccataagaatgcccccaagtcatagacagacctaggtcatctctctctgccaggtaaagttgtatccgtaggggctttgcgggaaacacggtgtttctctacatagctaccgtaccggttctcgtcttatatgtgcaataagaacggtttttgaaaggggcgcatgccgtacatgttcatgggtttcacggttaaggcgacgatgtttgtggatcattattacttgctaggtccggttggattgttgtacggttaaggatggttaacccatttatttatttagcaacaagattacttagatatgttgcggaaaagactcttatttaacaaagaagctaccgtacctggttctcttatgtgtaatcggatccgtttttgaaggggggtgcaggccttacgaggtgtgggtggcggtttaggcgactagattgtgtatcattattattatgtgctacttccgatttgattgttgtagggctaaagattgttatcccatttgtttattttgcaaccaatattgttactgatggaaaggatgtacccaaggtcaaaaaaaaaaaaaaaaaaaaaaaaaaaaaaaaaaaaaaaaaaaaaaaactcg

SEQ ID NO: 5209 - DNA, 620 bp, Triticum aestivum
  unsure (1)..(620): unsure at all n locations
  Clone ID: PAT_TA_5209
gaattcggcacgagctctgccgccgctgctgctgctagtgctaccaccagcagcaagaagacgatgctgcgcgtcctcatcttccccttcttcgccaccagccacatcgagcccttcactgacctcgccgtccgcctcgtcgccgctggacctgcagtggaggccaccgtcgccgtcacgccggccaacgtcccggtcgtccagtccttgctccggagacgtgggcaagcccgagcatgtcaagatagccacctaccccgttcccggccgtggacggactcccggagggcgtggagaacctcagcagggccaacgggaggcccgaacgcgtnggcgcatccgacgccgctgccctgaagcgagcatctgacgcgcccggcgcaggaggctctcgccagggccccgtctccggacgcggtcgtcaccgacgtgcacttcgcctggaacgtccgcgtcgccggcgagctcggcgtgccgtgcgtcgccttcagcgccatcggcgccttcccgacgctcgccctgcaccacctcgagcgggaggacgtcgacaatggtgatgtggacgtcgccacggtcccccagtttccgggccctagtatccgggtacccagggccgagct

SEQ ID NO: 5210 - DNA, 561 bp, Triticum aestivum
  Clone ID: PAT_TA_5210
cggacgcgtgggggaacgactataactacgccttcttaagggcaagaccctggacgacgccaagtcctacgtccccaccgtctcctccgccatcatcgacgcaaccgagaggctgatcaagggcggcgcgatgcacctggtggtgccggggaacctgccgatgggctgctcgtcggcgtacctgaccctgcaccccggcaggagcaggggcgactacgacgccgtcggctgcctgaaaacgtacaacgacttcgcgcagcgccacaacgccatggtccagcagaagctgcaggtgctccggctcaagtaccccgaggcccggatcatgtacgccgactactacggcgcggccatggccttcgccaagaaccccaagcagttcgggttcaagcaggggccgctgaagacgtgctgcggcggcggggggccgtacaacttcaaccccaaggcgagctgcggcgtgcggggatccagcgtgtgcgccgacccgttcgcgtacgccaactgggacggcgttcacctgacggaggccggctaccacgccatcggcgacaggattct

SEQ ID NO: 5211 - DNA, 1244 bp, Triticum aestivum
  Clone ID: PAT_TA_5211
ggccgccccgcgcctccgcgcggggattccgcggaacgactacaaccacgccttcttcaagggcaagaccctggacgacgcgacacgctccggtctctccgtcccctcccccacccgccccgcaaccgagcgtctaatcaaggccgggacggagtggccgtcggtggggggagccagccagtgagtgagtgtgtgcggtgcgccactgctttgcggcgctgcggctctcgcgcggttccatggcgatctcccggctctccgtgctcgtcgccgccctggcctgctgctgcctcgtgcggctcgcccaatgcggcggcggcgggcagaactacacctccatgttcagcttcggcgactccctgaccgacaccggcaacctgctcgtgtccagcccgctctccttcaacatcgtcggccacttcccctacggcatgacctacttccaccgccccacgggacgctgctccgacggccgcctcgtcgtcgacttcctcgcgcaagcgttcgggctgccgctgctgcagccgtacctgtcgcgcgggaaggacgtccggcagggcgtcaacttcgccgtgggcggcgccacggccatggatccgcccttcttcgaggggatcggggcgtcggacaagctctggaccaacctgtccctcagcgtgcagctcgactggttcgagaagctcaagccttcactctgcagctcacccaaaaattgcaagaagtatttcagcaggtcgctcttcctcgtgggggagatgggggggaacgactacaactacgccttcttcaagggcgacaaaaagcacaaccagttgtcctacgtcccggggctctcctccgcgatcatcgacgccggggagacgttgatcaaggacggcgcgatgcacttggtcgtgcgggggaacagcgtgatggcctgctcgtcggcgtacgtgaacctggacggcgtccgcctgacggaggccgccgacgccgccattgccgacagcacgcacaacgacttcgcgccgcgccccaacgccatcttccacccgaagctgctggtgctccggcttaagtaccccatggctcggatcatgtacgccgactacttgtgtacgggctagtcctgcgccaagctccacaagcagttcggcgaggtggaagggctgctgccgctgtccttagttggccggggcttgctcttgcttgaccccaaggcgagctgcggcgtgccgaggtccaacgtgtgcgccgacccgtcg

SEQ ID NO: 5212 - DNA, 555 bp, Triticum aestivum
  Clone ID: PAT_TA_5212
gctgcttgctactacaaactggttatcagattcagagcagtactgtacaaaaaacaccggattggcttcgattagttcgggcacatgatggcacttgctctgagtgctgggcgattagagtctacagacagaaccctagctaagctaagcactggctaactttaggagggagggagcaacaaactaacaactggtctacagtagtaggaaacggaacacgtcggtcggattagaacacagcaaaatggtccgcggttgcatgcagcaacgcggatgctaccctgcttgcttgcttgcttgctaggtgagtgagctaatactaactagctatgtagctagctaactcctagctggagacgaggcggcgcaaggctgcgacggcggcgccacggacaggctcaggtcgtcgttctcgagcgccagccgggccttcgtggcagggggcgtggacggcagctcctcctcgggggaaggcggtctcttgctccccgcgccgaccggggcgctcctgaggtgcacgccgaacagcttcgtgggcgccgacagagccgcgct

SEQ ID NO: 5213 - DNA, 935 bp, Triticum aestivum
  Clone ID: PAT_TA_5213
ggtgatgctgaagaaagaagctgaatactttggagatattgtcattttgccatttatagatcgttatgaactggtagttcttaagacaatcgctatttgcgagtatggggtccagaacttgacagcggcccatgtcatgaaatgtgacgacgatacatttgtgagggtagatgtggttctcagacatatcaagatgaactcccttggcaaaccattatacatggggaaccttaacctcttgcatagaccactgagaactgggaaatgggcagttacagaggaggagtggcctgaagatatctatccgccttatgctaatggacccggttatgtaatttctggtagcatagcaaaattcgttgtgtctcagcatgccaatcagagtttaaggctattcaagatggaggatgtaagtatggggctatgggttgaaaaattcaattataccatgcctgtcaggtattctcatagctggaagttctgccagtatggttgcctcgagaactactacactgcgcactatcagtcgccaaggcaaatgctatgcttgtgggacaagttggttcgtggtcgcccatcctgctgcaattatagatagtgaaatgcgatctttcattcactcgcagtcagcattccttctatcccagcgggtgagtttggctggctggtgttctcttttttgacatgaatcacctagcttagaggctgctgctccattggcttgattgagcttacattgctgaggttgaagcttgaagattaggtagaaagctacaaccatctggtttcatacattagccctgatttgcgtttctcatctacttagcatccacatgtgcccttggtattgatgccaagttttcttccaagggagattaatcccaattttggatgtagaccatggatcaaaatgttcagatgtatgcctcttctta

SEQ ID NO: 5214 - DNA, 1671 bp, Triticum aestivum
  Clone ID: PAT_TA_5214
gaattccccccgtcctctcctgtcctcggcagcctcgagcagcaccgtgccgtgcgcgcggcgagatggcgtgcgcggccccacccagccccctccccgtggtctccctgcccgcgcgccgccgcagcgcgactgccgccgcgcccgcctcctaccacgccccctctacccggctctcgaggcgttcgtggctctcctctggaaactcgccccgctctcggctgcgggcccaggcctccaaggccgagccggccgaggagggccttcccgccgcgccgggcccgtctgccccgtcggagcccctgccccagccgcgtaccagcacatggaattggaagggctacaacattcgctatcagtgcgccggaacttctggccctgcactggttctaattcatggtttcggggcaaacagtgaccattggcggaaaaatattcctgttcttgccatggcaaatagagtttatgcaattgatctaattggctatgggtattctgataaacctaatccacgtgagttcgaagagagcttttatacttttgagacttggggagaacagttgaatacattttgtgctgaagttgtcaagagtgatgctttcttcatatgcaattcaattggagggcttgttggtctgcaggcagctgttatggaaccccaaacatgcaaaggtattgttttattggatatttcattaaggatgcttcatatcaataagcagccatggtttggaaggcctttcatcagatcatttcaaaatctcctaaggtaccctcttgctccgtcgctcttctttaatgctgttgcaacaccagaatccgtgaaaaatattctttgtcagtgttaccatgacacgtccgctgtcacagatgaattggttcagatgatcttgcagccagggcttgatcccggtgctgtggatgtattccttgagttcatctgctattctggaggtcctctacctgaagacttacttcccttggtgaagtgtccagttttggtagcttggggagagaaggacccatgggagcctgtggaacttggaagagcctacgggtcttttgatgctgtcgaagattttgttgtcctcccgaacgttggacactgccctcaggatgaagcacctgagcttgtaaatccacttgttgaatcatttgttaagctccatagttagtacgtacatgggtagattgtttcctctttacatgggtacatggtcaactcgagcgaagagttgctggaatatggggatgccaattttacttgaggatcacaaacgggccgttcttttgtaggccgtgaacttccatttgagcactggcgggaaacacatttatagttgaggtatgagacatgaggaggaactatctgatttcatcttattacagcagaagaacccgtctcctcagaacggaggtcagtacgagccgcacaggtgttttatcctggtccgaactgttgggaggttcatccaaaagtgaacgcaagttctcatgtgtggtttggatttggtgttgccctggcgtcctttcgtccttgtctccatcgcctcagtgaccgtcctttgcgcctggggttgctttgcattcagaagaagagatttgaagtgatctacagtatcttaagtaaaaagtttttctccctaggaatgcttaccaaaaaaaaaaaaa

SEQ ID NO: 5215 - DNA, 1875 bp, Triticum aestivum
  unsure (1)..(1875): unsure at all n locations
  Clone ID: PAT_TA_5215
gccggacgcgtgcgcgcgaccggcccaacaaaacaagaaaaaaaagtactataagcaatagaaaattggttgtccctcgttaagaaaataagaaaaagatttcctatttcttcttgagctccctccaacctctcctccggccggccgagttgtcccgctccggctgcgtcttctccggcgagaggtgtagctaggtttcctgctcttcctttgagcggtctcctcccggcagggctgaggagatctctcgggacctcgggaactggggcgtgtatgatggggatttcggcttattgccgatgaagacgcccacgcggcttctgtggagcaccagcttcttccgccacaagctcgccgccatgatcgcctcctcgtcctgcttcttataagagcccctccgccgcgcagcagctgtatatatacgtctttttcatttgatttcgccccccgttcgatcgacaaccaaccaaggcaacttcttgaagctttctctgcgatggagcccggccggctcatcttcaacacgtcgggctccggcaacggacagatgctcttcatggactgcggcgcgggcggcatcgccggcgcggccggcatgttccatcgaggggtgagaccggtcctcggcggcatggaagaagggcgcggcgtgaagcggcccttcttcacctcgccggatgacatgctcgaggaggagtactacgacgagcagctcccggagaagaagcggcgcctcaccccggagcaggtccacctgctggagaggagcttcgaggaggagaataagctggagccggagaggaagacggagctggcccgcaagctcgggctgcagccacgccaggtggccgtctggttccagaaccgccgcgcccggtggaagacaaagacgctggagcgcgacttcgaccgcctcaaggcgtccttcgacgccctccgcgccgaccacgacgcgctcctccaggacaaccaccggctccggtcacaggtggtaacgttgaccgagaagatgcaagataaggaggcgccggaaggcagcttcggtgcagccgtcgacgccttggagccggagcaggcggcggcggaggcgaaggcttccttggccaacgccgaggaacatgccgcggcagcggaggcgttcgaggtggtgcagcagcagctgcatgtgaaggacgaggagaggctgagcccggggagcggcgggagcgcggtgctggacgcgagggacgcgctgctcgggagcggatgcggtctcgccggcgtggtggacagcagcgtggactcgtactgcttcccggggggcgccggcggcgacgagtaccacgagtgcgtgatgggccccgtggcgggcggcatccagtcggaggaggacgacggcgcgggcagcgacgagggctgcagctactaccccgacgacgccgccgtctttttcgccgccgcgcaagggcacggccaccatcacacggacgacgacgatcagcaggacgacggccagatcagctactggatgtggaactaggctcgcgcacgcatcaagaagcgtgcgtgcgtgcgccgtggaatcgatcaatttcggagtatatcagtaaaagaaatcgtggcgttttgttttctctccttgtatgcttcccgctgtaatcttgggtcactacgatcgaccaagttgtatgcatatgcattgtactacgagttagggtaatacatcggtggtaaaatctgtcgtgatgtacgggaaataagtgaacggagtcagagcctcattcttatggcacagtacatcatgtcaaatgagatttttaatcatctactgctaatgtcgtgtgagttttgcaagatcggggggcccggtacccaattcgccctatagtgngtcta

SEQ ID NO: 5216 - DNA, 729 bp, Triticum aestivum
  Clone ID: PAT_TA_5216
gtatgtaccaatcttgcccttggctgtgctgctccgggggggctgtgctcatgccccccgtcctgccctttgccggatcgcacatcttcgggccggattccggcttttcttgcggttgagagcggggatttagacatattttagttctagatgcttccctgtttatctatgttgatgacaagtattttcggacggagggagtacaaatcaaaagacaatcaaccccagcaacgactactgagcaatgttcacatggcactttgcttttgtatctccacgagccacgaccgatgaaaagtcaagtcgtacgatctttgcatcgcaggctcagagcaatctgtaggcgaagccggatggatccagcatgcatgcatgcaccagagcgtgctagctactgtcggtccggtccgaatcaatgtttgtacccggccgtctcaagaagaagagctggaggagtcgaacgtcgagaccctccggcgtttgctggccaggagcgagtccctcggcgagaactcgaaggcggcggcggcgctggcgaccctgtcgagcaccgagtcgagcgcccggcggaccgaggccgccgtcacggcgccctcgcgcaacatggcgacggtgatccggacgcgcccgcccagcgtggtgacctccgagccgacgaccctcggcgcgagcggctgcagcgcgcgcctcacgtcggcgaagaggtccgcgcagccgtcgccgcagctg

SEQ ID NO: 5217 - DNA, 656 bp, Triticum aestivum
  Clone ID: PAT_TA_5217
gcacgcggcccaagccggggtggcccgagaaccccacccacacgaggccagctgacctttcccctctcctccccacggtctccgtccccacgcagctcagccacgccgattgattctcccatcgttccatccccacgcagctccttgggcgatcgatgaagtccatcggcagccgggacaagctgcaggcggcggcggcggcgacgggtccccggcgggtgctgctgctggtcttcgcctcctgcttcgccttcgccacgctcctcaccttcctctacacctcctccggcttcgcctccgccgcgtcctccggctcgcgcctgggttcgtcgtcctcgtctaacgcggcggccggctccggggcggcgctgccgctgccggtgttcgacgcgctggtccactacgcctccttctccaacgccacgcaccggatgacggacacggacatccgggccatctccgccatcctgcgcgcgcgggcgccctgcaacctgctcgtcttcgccctcggcgccgagtcgccgctctggctcgcgctcaaccacggcggccgcacggtgtacctggacctcaacgagttctacgtcaagtacctggagccgcgccacccggggctggacgacttcgacgtctcgtacccgccgccgcgccacccg

SEQ ID NO: 5218 - DNA, 808 bp, Triticum aestivum
  Clone ID: PAT_TA_5218
gaccgcccattcatcgccgccacccatcgcgtcgcccgcccgcgaccttgaattcggcacgagccgcgacggcgtcccgtccacctcgagatgtacggcgacggcgtcccgatggagaaccctggccgcagctggtcgccggcgctcctccgctgcgcgccccaggtgacccccacggatccgcggcgccgagggcggcgcacacggtccgcgacctggcggaggaggggaagaagcgggccgtgttgctcctcgtcttcgccttcggcctcgccttcctcatgtccatgacaagctcttcagtctggattaacttcccattcgccatatctttgatagttctgtttcgctacctatcacttgactatgatttccgtagaaagagcacaacaaccacagatcgtgatgccagtcgcccacttgccaaaacaaaaaagtattgaattaagcaaaccttcacttacccagaagaatggaaattccagttggaggagcaaggtgaactcacctccagttgaagcagcatttgaacagttcacaaggcatcttgtcaccgagtgggtaacaaatctttggtactcccgtataacacctgataaggacggaccggaggaactcatcagcatagttaattctgtccttggagagatttctaactggggaagaagcattaacatcatcactctgttaaccagggacctggtctcatatgcaataatttggagctttatcattcctgtgaagctaagattggaaaagagaagtttgttagactcccgacggagcgtcgtgatgctgaactgaaact

SEQ ID NO: 5219 - DNA, 673 bp, Triticum aestivum
  Clone ID: PAT_TA_5219
aaatacaaaaaagggggaaaaaaaaaaaaaaattgattagcccaggctgagcctgtctatagtcgtccatccaaagagaatggttgcgacgaagtcgggcgagctgagggcgctgttcgcgtcgctcgacagggacgcggacggcaggatctccgcggcggagctgtgggggtgcatgcaggacacactgggcgaggatatgccggcggaggaggcctaggcgctggtggcatcggcagacgcggacggcgacgggctgctgtgcgaggccgagttcctcgagctggcgcagcaggcggcctgggcgggtacggacgaggagaacgatgagcttaggatccaggcgctgagggaggcggtcgggatgtacgagatggaggggcaggggcgcatcacgacggtcaggctgcgccggatgctcgcgcaggctgggtacctcatgtgtggccaccctgtgcctcgctggcacgccatgatctgccggatcgacgacgttccaggctacctcctcttcggcacccgccccgggcaatggaccaagtgcaagcaatgctcccccgacgactccggtctccgctgccaccaatgtgcgggccaccgggctttggcctcgctattttgcttgccgttgtcgcgctcatcgcttgagtgcatctctgtactttatgtatag

SEQ ID NO: 5220 - DNA, 649 bp, Triticum aestivum
  Clone ID: PAT_TA_5220
cgcaagcctttatacgaagcagaggatcgaggaatcccaggcaggatcaagatcaacgactaaagtcatcttaataagagcctctctatcgtcgaccatccggcgagaatggttgcgaggaagtcgggcgagctgagggcgctgttcttgtcattggaccgggacgcggacggccggatctcggcggcggagctgcgggagtgcatgcgggcgacgctcggcgaggacgtgccggcgggggaggccgaggcgcttgtggcgtccgcggacgctgacggcgacgggctgctgtgcgaggccgagttcctcgagctagcacagcaggcggcctgggcgggcgacgcggcggaggaggacgatgagctgaggatccgagcgctgagggaggcgttcgggatgtacgagatggaggggcaggggtgcatcacgccggccagccttgggcggatgctcggcaggctcggtgccgagcggggtgccggcgagtgccgcgccatgatctgccggttcgacctcgatggcgacggcgtgctcagcttcgacgagttcaagatcatgatgagctagctacctagcgcctggacccaagcatatattcctagtatcgtctggcacatagaagctccttcgctcgctcgttcgttcgttc

SEQ ID NO: 5221 - DNA, 733 bp, Triticum aestivum
  Clone ID: PAT_TA_5221
gccggccggttccggaactataaaaaaaaaaaaaaaaaaaaatggctgcagcgcaatctttatagcaatcagaggatctaggaagcccaggcagaatcaagatcaactagtactaaactcttactaagagcctccctagcgtcaaccatccggcgagaatggtggcgtcgtcgggcgagctgagggcgctgttcgcgtcgctcgacagggacgcggacggccggatctcggcggcggagcttccggggtgcatgcgggcgacgctgggcgaagacgtgccggcggaggaggccgatgccctggtggcgtcggcggatgcggacggcgacgggctgctgtgcgaggccgagttcctcgagctggcgcagcaggcgtcctgggcgggcgacgcgttggaggaggacgacgagctgaggatccgggcgctgagggaggcgttcgggatgtacgagatggaggggcaggggtgcatcacgccggccagcctggggcagatgctcggtaggctcggcgctgagcggggcgccggcgagtgccacgccatgacctgccggttcgacctggacggcgacagcgtgctgagcttcgacgagttcaagatcatgatgagctagggacctcgcgcctggaaccaatgatacatcagttccatcttgcatatagcttcttcgctcgttcgttcattcattcgattgttattgtcagccctaaaaaaaaaaaaaaaaagccccta

SEQ ID NO: 5222 - DNA, 775 bp, Triticum aestivum
  Clone ID: PAT_TA_5222
gccggccgggccggaagcaacacattctccgctcaaggaccaatacatcagcacctcccttgtaatctcctctgctaagctctccttgcagttcaagcctcaatggctgtcacacgaaccatttttctcgccatggctgtgatggccatcctgagcaccgcatcagcggcgatctacaacgttggcgagcccggtggagcgtgggacctcagcaccaactacggcacatgggcgtcctccaggaacttcaaagccgacgaccagatcgtcttcaagtactcccctcaagcgcgtgatgtcctcgaggtcagcaaggccgactacgactcctgcaacaccgccagccccatcaccaccctcaactctgggaatgatgtcgtcagcctcaccgcctccagcacccggtacttcatttgcggcttccctggccattgcgctggtggcatgaaggttaagatcgatagtatgtctggctcctcctcgtcacccgccccagccagcggaccaagtgcaagcaatgctcccccgccgacccctgtctccactgccaccaatgtggaggccatcgggtatggcctcgccgttttgcttgccattgctggcctcatggcttgagtgcatatctccagtcacaggcacatgtgtactttgtgtatagtcaagtaatcattactagcaactatatgtgtgtatagtcaagtagttatgtgtatgttggacatattcaggttttgcgttttgctgattcgttttggagattataaaaattcgtttg

SEQ ID NO: 5223 - DNA, 725 bp, Triticum aestivum
  Clone ID: PAT_TA_5223
cgggagctgcaacgcagaactctagcaaagcagaggatctaggaagcacaggcaggatcgaccaaagacaaagagcgtctagttcaccggttagttagcacgaccgatcgatcgatcgtccggcaagaatggttgcgacaaagtcgggcgagctgagggcgctattcgcgtcgctggaccagaacggcgacggccgggtctcggcggcagagctgcgggggtgcatgcgggcgacgctgggcgaggacgtgccggcggaggaggccgaggcactggtggcgtcggcggacgcggacggcgacgggctgctgtgcgaggccgagttcctcgagctggcgcagcaggcggcctgggcgggcgccgaggacgaggacaacgagcagaggacccgggcgctgagggaggcgttccggatgtatgagatggaagggcaggggtgcatcacgccggccagcctcgggcggatgctcggcaggctcggcaccgagcggggcgccggcgagtgccacgccatgatctgccggttcgaccttgacggcgacggcgtgctcagtttcgacgagttcaagatcatgatgagctagagctagctagccttaccccggaccgaagcatatagccccttcagtggttcattcattcattcatttgattgttagatggtagtactacaaaatttgtaatgatgacgcacagtaattgatctatgtgaatacctttggtct

SEQ ID NO: 5224 - DNA, 704 bp, Triticum aestivum
  Clone ID: PAT_TA_5224
gttccagcaaccttcagctctatagcaaagcagaggatctaggaagcacaggcagggtcaagatcaactactaaagcatccggcgagaatggttgccacaaagacgggcgagctgagggcgctgttcttgtcactggaccgggacgcggacggcaggatctccgccgcggagctgcgggggtgcatgcgggcgacgctgggcgaggacgtgccggtcgaggaggccgaggcgctggtggcgtccgcagacgcggacggcgacgggctgctgtgcgaggccgagttcctcgagctggcgcagcaggcggcctgggcgggcgacgcgggggaggaggacgacgagctgaggatccgggcgctgagggaggcgttcgggatgtacgagatggaggggcaggggtgcattacgccggccagcctggggcggatgctcggcaggctcggggccgagcggggcgccggcgagtgccgcgccatgatctgccggttcgacctcgatggcgacggcgtgctcagcttcgatgagttcaagatcatgatgagctagagctagctagcctgaccccagacccaagcgtatacccgttccgtcttgcaaatagccccttcgctcattcattcattcatttgattgttacatggtagtagtacaaaatttgtcatgatgaggtaattgatctatgtgaatacttttggtctcgagc

SEQ ID NO: 5225 - DNA, 773 bp, Triticum aestivum
  Clone ID: PAT_TA_5225
gccgcttcgagccggccgggccgggtactccaacctacagctctatagcaaagcagatgatctaggaaacacaggcaggatcaagatcaactaaagtcttatcaagtgcctctcgattgtcgaccatccggcgagaatggttgtgacgaagtcgggcgagctgagggcgctgttcttgtcactggaccgggacgcggacggcaggatctcggcggcggagctgcgtgggtgcatgcgggcgacgctgggcgaggacgtgccggtcgaggaggccgaagcgatggtggcgtcggtagacgcggacggcgacgggttgctgtgcgaggcggagttccttgagctggcgcagcaagcggcctgggcgggcgcggacgacgagaacgacgagctgaggatccgggcgctgagggaggcgttcgggatgtatgagatggaggggcaggggtgcatcacgccggccagccttgggcggatgctcggcaggcttggcgctgagcagggcgccggcgagtgccgcgccatgatctgccggttcgatcttgatggtgacggcgtgctcagcttcgacgagttcaagatcatgatgagctagaggcctgaccccggacccaagcatataccatctccgtcttgcatatagccccttcgctcgttcattcattcgattgttacatggtagtagactagtagtaccaaatttgtagtgatgatgcacagacagtaattgatctatgtgatacctttggtctcaatcgattgtcggtgcttttggc

SEQ ID NO: 5226 - DNA, 729 bp, Triticum aestivum
  unsure (1)..(729): unsure at all n locations
  Clone ID: PAT_TA_5226
nagcaaagcagaggatctaggaagcacaggcaggatcaagatcaactgctaaagtcttatcaagagcctctccagcgtcgaccatccggcgagaatggttgcgtcaaaatcgggcgagctgagggcgctgttcgcgtcactggaccaggatgcggacggcaggatctcggcggcagagctgcgggggtgcatgcgggccacgctaggcgaggacgtgccggcggaggaggccgatgcgctggtggcgtcggcggacgcggacggcgacgggctgctgtgcgaggccgagttcctcgagctggcgcagcaggcgtcctgggcgggcgtggaggagggggacgacgagctgaggacccgggcgccgagggaggcgttcgggatgtacgagatggaggggcagggatgcatcacgccgaccagtctgggccggatgcttggcaggcttggcgccgagcggggcgccggcgagtgccgcgccatgatctgccggttcgaccttgacggcgacggcgtgctcagcttcgacgagttcaagatcatgatgagctagcgacctcgcgcctggacccaagcatatgctcctagtttcgtcttgcatatagctcctgcactcgttcgttcgttcgttcgttcattcgttcattcattagattattatttggtactagtacaaagttgtaatggtgatgcacagacagtaactgatctatgtgaatacctttggtctgg

SEQ ID NO: 5227 - DNA, 800 bp, Triticum aestivum
  Clone ID: PAT_TA_5227
ccccctacctcccgcgcggacgcgtggcggccggaacagacaaaatctccgctcaaggatcaatacaccagcacctaccttataatctcctctgctagctctccttgcagttccaaccgcaatgactgccacgagaatcattcttctcgccgttgctgtgatggtcgtcctgagcaccgcgtcagcggcaatctacaacgtcggtgagcctggcggagcatgggacctcggcaccaactatggcacatgggcatcctccaggaactttcaaaccgatgaccaaatcatcttcaagtactcccctcaagcgcacgatgtcctcgaggtcagcaaggccgactatgactcctgcagcactgccagagccatcaccaccctcaactctgggaatgatgtcgtcaccctcagtgcctccggcacccggtacttcatttgcggcttccctggccattgcgcaggcggcatgaaggtcaagatagatgtcacgtctggctcctcctcgtcagccgccccagccagcggaccaagtgcaagcaatgctcccccgccaacccctgtctccgctgccaccaatgtggaggccaccgggtttggcctcgccgttttgcttgccgttgctggcctcctggcatgagtgcatctctgtagtcgcaggcacatgtgtactttgtgtatagtcaagtaattattactggcaactatctgtgtgtatagtcaagtagttatgtgtatgttggacatattctggttttgcgttttgctgattcattttggagattaataaaaaaattcttttgttc

SEQ ID NO: 5228 - DNA, 804 bp, Triticum aestivum
  Clone ID: PAT_TA_5228
agcaaacacattctccactcaaggatcgatacacacctgccttacaagttataatctcctttgctagctctctttacagttccaaccgcaatggctgccaagagaaccattcttctcgccatggctgcgatggccgtcctgagcaccgcgtcagcggcaacctacaacgtgggtgagccgggtggcgcatgggacctcagcaccaactacggcacttgggcgtcctctaggaacttccaaaccaacgatcagatcgtctttaagtactcccctcaggcacacgatgtccttgaagtcaacaaggcagactacgactcttgcagcacggccaaccccatcaacaccttcaactccgggaatgatgttgtcaccttcacagccaccggcacccggtacttcatctgtggtttccctggtcattgcgcgggcggcatgaaggttaagatcgatgtcatgccaggctcctcctctaagtcacccgtcccggccaacggcccaagtgcaagcaatgctcccccgccgagacctgtctctgctgccaccaatgtggaggccacagggtttggccttgccgttttgcttgccattgccggcctcatggcttgagtgcatctctggactcgcaggcacatgtgtattttatgtatattcaagtaattattactagcaactatctgtgtgtgtatgatcaagtagttatgtgtatgttggacatattcaggctttgtgtattgctgattcattttggaggatttattaataaatattctattggtctaaaaaaaaaaaaaaaaaagggcccta

SEQ ID NO: 5229 - DNA, 805 bp, Triticum aestivum
  Clone ID: PAT_TA_5229
gccggccgggtgccggcaaaaaaaaaaaaccattccccgctcaaggaccaatacatcagcacctcccttgtaatctcctctgctagctctccttgcagttcaaacctcaatggctgtcacgagaaccattctcgccgtggctgtaatggccatcctgagcaccgcgtcagcggcgatctacaacgttggcgagcccggcggagcgtgggacctcagcaccaactacggcacatgggcgtcctccaggaacttcaaagccgacgaccagatcgtcttcaagtactcccctcaagcgcatgatgtcctcgaggtcagcaaggccgactacgactcctgcagcaccgccagccccatcaccaccctcaactctgggaatgatgtcgtcaccctcaccgcctccggcacccggtacttcatttgcggcttccctggccattgcgcgggtggcatgaaggtcaagatcgatgtcatgtctggcttctcgtcacccgccccagccagcggaccaagtgcaagcaatgctcccccgccgacccctgcctccgctgccaccaatgtggaggccaccggttttggcctcgccgttttgcttgccgttgctggcctcatggcttgagtgcatctctgcagccgcaggcacatgtgtactttgtgtatagtcaagtaattattactagcaactatatgtgtgtatagtcaagtagttatgtgtatgttggacatattcaggttttgcgttttgctgattcattttggagattaataaaaattcgtttggtcttataaaaaaaaaaaaaggccccta

SEQ ID NO: 5230 - DNA, 762 bp, Triticum aestivum
  Clone ID: PAT_TA_5230
gccggccggtctcggaaaccattctccgctcaaggatcgataccacacctgccttacaagttataatctcctctgctagctctctttccagttccaaccgcaatggctgccaggagaaccattcttctcgccgtggcagcgatggccgtcctgagcaccgcgtcagcggcaatctacaacgtgggcgagccgggcggcgcatgggacctcagcaccaaatacgacacttgggcgtcctctaggaacttccaaaccagcgatcagatcgtcttcaagtactcccctcaggcacacgatgtccttgaagtcagcaaggcagactacgattcttgcagcactgccaatcccgtcaccaccttcaactccgggaatgatgttgtcaccctcacagccaccggcacccgctacttcatctgtggtttccctggtcattgcgcgggcggcatgaaggttaagatcgatgtcatgtcaggctcctcctctatgtcacccgccccggccagcggcccaagtgcaagcaacgctcccccaccgacacctgtctccgctgccaccaatgtggaggccacggggttcggccttgccgttttgcttgccattgccggcctcatggcttgagtgcatctctgtagtcgcaggcacatgtgtattttatgtatattcaagtaattattactagcaactatctgtgtgtatggtcaaaaaaaaataaataaaagaaaaatattcaaaaattggcccctgctgatcccttttgggaga

SEQ ID NO: 5231 - DNA, 811 bp, Triticum aestivum
  Clone ID: PAT_TA_5231
gttctagagctcaaacacattctctgctcaaggatcaatacagcacctgccttataatctcctctcctagctccccttccagttccaaccgcaatggctgccatgagaaccattcttctcgtcgtggctgcgatggcagtcctgagcaccgcgtcagcggcgatctacaacgtgggtgagccgggcggcgcatgggaccttagcaccaactacggcacttgggcgtcctctaggaacttccaaacgagcgatcagatcgtcttcaagtactctcctcaggcacacgacgtcctcgaggtcagcaaggcagactacgactcttgcagcaccgccaaccctgtcaccaccttcaactctgggaatgatgttgtcaccctcaccgccaccggcacccgctacttcatttgtggtttccctggtcattgcgcgggcggcatgaaggttaagatcgatgtcattccaggctcctcctcttcggcacccgccccggccaatggcccaagtgcaagcaatgcacccccgccgactccggtctctgctgccaccaatgtgcgggccaccgggtttggcctcgctattttgcttgccgttgtcggcctcatcgcttgagtgcatctctgtactttatgtatagttaagaaattattgctagcaattttgtgtgtgtatagtcaagtagttatgtgtatgttggacgtattttgggctttgcgttttggtgattcatttcataggatttgttaataaagattcttttggtctttaaaaaaaaaagaaaaaaaaccaaaaaaaaaaaaaaaggccctagggc

SEQ ID NO: 5232 - DNA, 785 bp, Triticum aestivum
  unsure (1)..(785): unsure at all n locations
  Clone ID: PAT_TA_5232
gccggccgggtcaagcaaccattctccgctcaaggaccaatacatcagcacctcccttgtaatctcctctgctaagctctccttgcagttcaagcctcaatggctgtcacacgaaccatttttctcgccatggctgtgatggccatcctgagcaccgcatcagcggcgatctacaacgttggcgagcccggcggagcgtgggacctcagcaccaactacggcacatgggcgtccttcaggaacttcaaagccgacgaccagatcgtcttcaagtactcccctcaagcgcatgatgtcctcgaggtcagcaaggccgactacgactcctgcagcaccgccagccccatcaccaccctcaactctgggaatgatgtcgtcaccctcaccgcctccggcacccggtacttcatttgtggcttccctggccactgcgcgggtggcatgaaggtcaagatcgatgtcatgtctggctcctcctcgtcacccgccccagccagcggaccaagtgcaagcaatgctcccccgccgacccctgtctccactgccaccaatgtggaggccatcgggtatggcctcgccgttttgcttgccgttgctggcctcatggcttgagtgcatatctgcagtcgcaggcacatgtgtactttgtgtatagtcaagtaattataactagcaactatatgtgtgtatagtcaagtagttatgtgtatgttggacatattcaggttttccgttttgctgattcgttttagagataataaaaattcgtttggtcttaanannaa

SEQ ID NO: 5233 - DNA, 809 bp, Triticum aestivum
  Clone ID: PAT_TA_5233
gccggccgggctgggcagcaccaaccttcagctctatagcaaagcagaggatctaggaagcacaggcagggtcaagaactcaagatctactactaaagcatccggcgagaatggttgccacaaacacgggcgagctgagggcgctcttcttatcactggaccgggacgcggacggcaggatctcggccgcggagctgcgggggtgcatgcgggcgacgctgggcgaggacatgcccgtcgaggaggctgaggcattggtggcgtcggcggacgcggacggcgacgggctcttgtgcgaggctgagttcctcgagctggcgcagcaggcggcctgggcgggcgacgcggggcaggaggacgacgagctaaggatccgggcgctgagggaggcattcgggatgtacgagatggaggggcaggggtgcattacgccggccagcctggggcggatgctcggcaggctcggggccgagcggggcgccggcgagtgccgcgccatgatctgccggtttgaccttgatggcgacggcgtgctcagcttcgacgagttcaagatcatgatgagctagagcgcctgaccctggacccaagcatatactccctggagtaccagttccgtcttgcatatagccccttcgctcattcattcattcaattgttacatggtagtagtagtacaaaatttgtaatgatgatgcatagacaattgaatagaggccctaaataaattttatgtaacttacgcatatctggtgcctaaataatatactagggacttttttggtaaaaaaaaaaaaaaaaagccccta

SEQ ID NO: 5234 - DNA, 817 bp, Triticum aestivum
  Clone ID: PAT_TA_5234
ccggcggggcgggaagcaattctccgctcaaggatcaatacagcacctgccttataatctcctctgcaagctctccttccggttccaactgcaatggctgcgaggagaaccattcttctcgccatggctgccatggccatcctaagcacggcgtctgcggcaatctacaacgtgggtgagccgggcggcgcatgggacctcagcaccaactacggcacttgggcgtcctctaggaacttccaaaccggcgaccagatcgtcttcaagtactcccctcaggcacacgacgtcctcgaggtcagcaaggccgactatgactcatgcagcaccgccagccctgtcaccaccttcaactccgggaatgattgttgttactctcaccaccaccggcacccgctactacatatgcggtttccctggtcattgcgcgggcggcatgaaggttaagatcgatgtcatgccaggctcctcctcatcacccgccccagccagcggcccaagtgcaagcaacgctcccccgccgacccctgtgtccgctgccaccaatgtggaggccacagggtttggcctcgccgttttgcttgccgttgccggcctcatggcttgagtgcatctctgcagtcgcaggcacatgtgtactttgcgtatgtaaagtaattattactagcaactatctgtgtgtatagtcaagtagttatgtgtatgttggacatattcaagttgtgtgttttgctgattcatttcggagattaataaaaaaaatcttttggtctaaaaaaaaaaaaaaaaagaaaaaaaaaaaaaaaaaaggccccta

SEQ ID NO: 5235 - DNA, 1212 bp, Triticum aestivum
  Clone ID: PAT_TA_5235
agaattcggcacgaggcagtacaagcgctcccgcttccatccgtcatccgattgacacgctgcaccagccaaaaagccactgacctcacagcctcgctccgcccgccatggccgctgccacggtgcggtcgacgttgccccgctgcctcctcctcctcctcctcctgtccacggcgcttgcctccgccgccacctcgccgcggctcgtgctcctggcgccgtccggctcgcacacgccgtgcctggacaacccgcccgacctgacggccgcggccgacgaggcgggcgagctcgtccgcgacctcggcagcctcccggcctacgtcaccggatcccgcagctccacgcgcgccatcgtcctcgcctccgactacttcggcttccaagcgccaaaactgaggaaaatcgcggatcaggttgcggatgatggatacttggtcgtggttcctgatttgctgcacggggacccgttcagggatgaggccaagatttcatttcaagattggctgaaaacccactctccggtggaggcagctgaaaagactaaagtgcttattgctgctctgaagaagcaaggggtgtctgaagctggggtcggaggttattgctggggtgcaaaggtagctgtggagctatcaaagtctgaagaaattcaagtggttgtcatttcgcacccttcactagtgactgtcgatgacatgaaggaggtcaagcatcccattgagattctcggaggagagcttgatcaagcttctccaccgccgatagtgcaccagtttgaacaggccttggatcagaacaacaagattgaccacttcgtgaagatcttcccgggagtagcccacggtttcgcttgcagatacaacgccagcgacgcgttcgccgtcaaaactgccgaaaaagctcgtgcagacatgctcagctggttcaacaagtatctgaagaagcaccaagagctttcgctccacgaatcttagaaactcgatcgctccaagctgttttgaacaagtcacccttttagttttgtataaatcgacgccttttcattagtttagaagtacagaattaaggagctcttgcctttctgaataaattgcacatcggtgctgaactttttaggcgtagcttggtcgtgtatgcaatgcaataataaaatagttcctctagtttgattcagctgtaaaaaaaaaaaaaaaaaaaaaaaaaaaaaaa

SEQ ID NO: 5236 - DNA, 413 bp, Triticum aestivum
  Clone ID: PAT_TA_5236
tcgacccacgcgtccggccagacacgcggccgccgcagccgagatggccgccggagatgccacccacgcgccgccggccgcggaggcgcagtctctggtggagtcgttctgcgccgtcacctcggcgacccccgacgaggcggccttcttcctcgagggccacaactgggccctcgaggccgccgttcgatccttctacgacaacacggaggtcgacgccgatggccccgatccggcaccccagcccccgccacccgtcccagccgctgtcgatggcgcggactccgaggacgaggactacgtgggcgtcggcgacaaggatgaggacgacgaggactacgtgggcggcggcgacgaggacgacgacgaggatgccgccctcgccgccgcgtctgcggcggcagatgagcgga

SEQ ID NO: 5237 - DNA, 1028 bp, Triticum aestivum
  Clone ID: PAT_TA_5237
cgagcccgcacgcccttcacacacactactcaggtccgaccgcggctgcccgtcaccctcccctcagtggcgccctcgcctcctcggcgccctctcctcctccgccgcccccgcccccccccctcccccgcctgctccgctcccgcggcgccgccgccggcgccgccccggccgccgctgccaccgcgcccccgctacccgctctcccccgccagccggacgcgggcggccgccccacgcgggccggcgcgccgcgcgcgccggcggtccgcccgctgcgccaccccccccgccgccccccccccggccgcgcccgcggcgggccccccctcctcccccgccccccccccccccccccccgcctccgccgcctctgcgccatcgccgtctccgcggcggccgccaacgcctccgccaccgcgtccgcgctcgccaacaccacctgggccgcctcgggcgccccagagccgggcagcgacgggcgcgcgcagcaggtgccggcgctcctgacgaggacctgcgccggcaagtacggcgaggcgcgggaggcgctgctggaggcccgggagtcggtgggcgaggaggcgtacgactacgcgttcgtgcacgtgggcgccgccgccgagtaccccgcggtgtgccggacgatgttccggaggaagcgggtgccctaccccgtggagctggcccggcgggaggaggcgctggagcacctctgcaccgtcgtcatcgacatcatcacgctcctcgcctagcctgtcacaagggcctccccccccattgatcccgcctgaacgtattctgtttggtcggtgtgattcatgtatggcacgcatcacaattttaaatttcccgttagacgaataatcgcatgcggtttggcatgcagattacgtactcctgtagcagctacttccactgtaataccactgtaatatcgagcgtaaaccggagtgtactggcactactactactgtaactttgaaagtgcatgttcgcacacagaatttgagttcagggtttcccgc

SEQ ID NO: 5238 - DNA, 1366 bp, Triticum aestivum
  Clone ID: PAT_TA_5238
aatacaaaggtcatgcatatatatataacactctatgatccatgatcacctacaacagcagcagtctagcactagggcaacaaaaaacaagggaaccatgccatgccataacatggaaggtaggcaggcacatcatcacaacaaaaagaagcaaggtattagacaggaaggagctttacatttgatgacagtaatggcttagcttggcttggttttggctgggcttactcatccatcagtcctctcagctggttcagaccgactgaacatcatcagctcatggcgccaatgccggtgccgcggctacctaccatggcttcaggtcgcccttggggccctgggtccagttcagcgccttctgccccggggtcaggtacacactcttgctgtgcgggagcttccgcgccagcccgttcaggatctggtggaaggcgtcaccgggctgcgcgggctgcgggaacagcatggcctgcttcatcgacgggttcgccagcagccgctgcttccggaggatcacctccatggggatggaggtcaggatggtgtcaagcttgggcacgtcgtcctccgcgacgaacacgccgatctcgtcccacgggatggcgtccgcaaagggcagcacaatgtcgtccgcgatgatcaccgggatgctcccgaacaccaccgcctccgcgatacgggggctcccgcgagcccagcctagagggctaaggcaaaagatggcgcgctgcatgtcctcgtagtaggtggccgggtggtccgtctagatgtcgaacagtgggttgttcttgaagttctcccacaccgacgctcgggcacctcttgcatagtaaccaccctcggggtcattcgccgtatcgtagtccaatccacgtgaatacacaaagatggaacgcggggtctccgggggtacaaggtgagttttcattttctggggaggagcatatggtgggatgttgattgagccctcctttaggcagacatgatccttctgcccgaatgtctggacaagtgtagcgcggcgaagcaatggaaggatccccctttcaatcgccttttcttcctgataatggaagcatgccccaaagtcatgcggcacgacaaagaaatgatcagcacccgccgtccggttccaataaggccagtgtgatgagatgaactgaaccgcactcctcatgatccgcggggacttgaagggcaagggatggccccacggagtaaggtcgcaggtcgtgtacaccggagtgtagaaccagtcggcctcctccgggttcatggtccggatcgcgctcgacagcaggaaccggtgcatgaatatctcggcggcaaacatgggctgaggcacctggagtcccggacgcgtggg

SEQ ID NO: 5239 - DNA, 1803 bp, Triticum aestivum
  Clone ID: PAT_TA_5239
ggatggcaccaatgctgatttgtggacatgtcacagccaaacagcactaatacttagtaggtataataaatcaagcgaaacctgtgtgtgatatgtactgacagaaccggacaccaattctgctctgttcctccactcttctctcggctaggcgctagaagaaataaacaaatataatctcggacgcgatatcaggggatatattagaagggttgtgctcgcgtcatatgaaatcctggtcctggtcatctcctcgccgggaggcgtcgccgtcgagcatcttcttcgtcatgttggccctctgcacgagccggaccaacgcctgcaccacctccgacatcggtggcctgaactccggctcagcctggacacacagggcgagcacgtcggcgaatcgggacagagacttggcagggtacaggcccttgagcgcaggatcaaccatcctgtccaaggcatcgatgtcgtggagctggggagacgcccaccgcacgagcgactgctccgacctaggcttggagctgtcaaatggtttgcgtccggtcaaaagctctagcatgacaaccccaaagctgtagacatcactcttcattgtgtactggccagtcatgtccacctctggggcagtgcacccggcactctgttctgctgtctggaactcggcatcaggaataaagcttgcaagtccagcatctgaaacgtgcgggttgtattctgagtcgagcagaatgttggatgacttgaaattcttatggacgacagacggagaacacacttcatgaagatactccagtgcgcgggcagagcctagtgcgatcttaatgcgggagttccagctaagtggcttgctgtattcgtctgaaagatgaagtagatcatgaagtgatccgttcctgtggaaatcatatacaagcaagtgttgtccatgttccatgcaatagcccacaagctcattgagattcggatggtgcagaatcgaaatgtttgagaccagttcaacaaagtcttcagatgattggaatggtattacagtacaatctagtttcttcacggccaaaacctttccatcgttgaactgtgacctgtagacacgtccaaaagtaccctctccaacaaggttatccatgctgaagctatctgttgctatttgtagatctgcaactgaataaacaactgcctttataggttttgtgttgcttttcctgcgacaggtttgcttgagaagtcatcatcatcatcgaatgacttgttgcgttcaatcttggcaggtggcttcagaccaactgaagcaggggaagccaaagagtccacatctattgtggttgactcttcaaaagggcttcatgtctttaacttcgtttgaagggaatgaagtgaatggctggtgctgttcaaagtgctcttcccttttagatatgcgtttctctcttatcacaaagaatgcaacaattgctccgacaaccagcaaagatatgataatgcccgctacagccccgccacttattccagactttccatcagaagatgatgaaccactgtcttttttagctgggctcttccgacggtttgaaggtggagctgtgaatggcggtggcggtggagctggtcccgaagtccaagaattaccatcagtctgtagactatttatcttcttaagctgactaggaatccaaccagtgaagcgattatttgcaacattcagatcagaaaggggaagatcagctaggacattgatagaaccggtcaactgattgttctgcaaatatagagtcttaacacttgacagtgaaccggacgcgtggg

SEQ ID NO: 5240 - DNA, 931 bp, Triticum aestivum
  Clone ID: PAT_TA_5240
ggtttccaagagaggctaggcgcgcgcgcagtgttacgtacgtgccaggccggcgtcgccgtcgtcgtcgtacgtcaccgacaacatgtctttcaccggcacgcaggacaagtgctcggcgtgcgaaaagacggtccatttcatcgacctcctcacggcggacggcgtcatctaccacaagacctgcttcaaatgcagccactgcaaagggatcctctcgatgtgcagctattcttccatggacggcgtcctctactgcaagacgcacttcgagcagctcttcaaggagacagggagcttctcaaagaagttcacacaaggtaacagatctggcgacaagaatgaactgtcaagggccccaagcaagctttcagctgccttctccggtactcaggataagtgtgcagcctgcacgaaaacagtgtatccactcgaaaaaatgactctggagggcgacgcataccacaagagctgcttcaagtgttcccacgggggctgcatcctaaccacctcctcctacgccgccctcaacggtgtcttgtactgcaagatccatttccagcaactgttcatggaggaaagaaagctacagccacatgaaagaagaagagcccctcgcaggaggtgttgcccgatttggtggcggcagccgaagagcaaccggcggcagaggcggcagaggcggcaccgccgcaagatgaagaatagagaggaaaattaggaaaacacgagacttatatacacagcacagcctggaattcatgcttgttatttttacacattggttctttatgccccaacccggtcccccttatttattcggttcctctgagcttggtttgtcaagctgtaagtaatgtactaataccttcctttcaaagaaaaaaaataaaaaaaaaaaaaaaaaaggcccctggaaatcgagcggccg

SEQ ID NO: 5241 - DNA, 2662 bp, Triticum aestivum
  Clone ID: PAT_TA_5241
ccggtctcttatttcttaggtggtgtcatgtgggcacttatctacgacaacatttccctcagatttagacgaacatgcatctgttttcgttataccgttgctgacactcggatcattattattctaatgtaggtcatcattcgccgaggcgtacgaagtttcagcaaagattttcgtagcgggtatggcgcaaactaaccacacaactgaatacatgatcgatgctggctacgcagtacacggcggaaagcctaatcacacacatccttattcaggtaacttttggttgtcgatatgtacgatacatacagaagactccagctcagctaaccgaacactgctagaagccatctaacgagcttcaacagtttggtttcccacctctgttttgataatcttgtcgacatactcctttctagctgggcaagatggtcatggggacggttgtatggcgtccagactagggctctcccacaaagagccgccattgcccttgatgtagttggtcactatccaatgtaaagcggtgatacattcctgcaggcaaaacaatcatgccacctttctgaactgctatacggatccactgttcgtcttggtccctcagcatcaaagtatccactgcccgtcaagacaatagcgtatctctttcatcagtatgcaagtgacttcttcaaaagaaattctccagcttggccctcataggttctggcaacttctcaggaacataccgtcgcagaatgtccagcataggagtatcccctggccctcatcggattttcttgagattctcgtctttctccccagttatcagcattcaggttccaccttacaacacctgattctgaaagtttggcaaagaggaatgaactctttgggctcacaggtggtgagggagcctctggtcctcttcactgtcatccactgtaccatgcttggatgagctgcctccttgccatcctggaactcgttctccatggcggcggcctgcttgcagtcctcaagcgaccctgctcctcctccgccttcctccctctccgtatcataccccgaatcgtagaacaaaaccacggtaaatacacaaagatgggagcgcggggtctccgggggtacaaggtgagttttcattttctggggaggagcatatggtgggatgttgattgagccctcctttaggcagacatgagtccttctgcccgattttgtcacaccattgctgacactggatcattattattcaatacaggcatcatcgccaggcgaagaagtttcagcaaagattttcgaacgggtatgttgcaaactaaccacacaagtgatacaggatcgatgctggtacgagcacacggcgaaagccaatcacacatcttattcagtaacttttggtgtgatatgtagatacatacagaagacacgctcgctgccgaacactagaagccgtcaacgagcttcgacggtttggttcccacctctgttgataatcttgtcgacgtactcctttctggctgggagatggtcatggggacgattgtatggcgtccagataggctctcccacaaagagccgcattgccttgatgtagttgtcactatccaatgtaaagcggtgatacattcctgcaggcaaaacaatcatgccacctttcttaactgctatacggatccactgttcgttttggtccctcacatcaaagtatccactgccctcgagacaatagcgtatctcttcatcagtatgcaagtgctcttcaaagaagttcttcagcttggcctcatagtttggcaacttctctggacatacgtcgcaaatgtccacataagagtatcccctggcctcacggattttcttgagattctcgtctttctcccagtcatcagcattcaggttccagcttacaacacccaattctgaaagtttggcaagaggaatgaactctttgggctcacggtgatgaggaagcctctggtcctcctcactgtcatccatgtaccatgcttggatgacctcctccttgccatcctggaactcgttctccatggcggcggccgcttgcagcctctcgcgccctgctctctctgcaccgccgttcacttgccagcctttgagctgcccacttccttccttcctcacgccggaaaacctcgaagctgttttttttttttttttttttttccttctgcccaaatgtctggacaagtgtagcgcggcgaagcaatggaaggatccccctttcaatcgccttctcttcctgataatggaagcacgccccaaagtcatgtggcacgacgaagaaatgatcagcacccgccgtccggttccagtagggccagtgcgaggagatgaactgaactgcactcctcatgatccgcggagacttgaagggcaagggatggccccacggagtaaggtcacaggtggtgtacaccggagtgtagaaccagtcggccccgacggggttcatggtccggatagcgctcgacagcaggaaccggtgcatgaatatctcggcggcaaacatgtggctgaggcatctggagtccttggccaccatcttcttgttgtacttggtgggcagctcgtagacgtacaccttcagcctcccgacgggatcatcctccagcacatcaccagcactcccttcgatcctctcagtgtcctggcc

SEQ ID NO: 5242 - DNA, 379 bp, Triticum aestivum
  Clone ID: PAT_TA_5242
tcccgggtcgacccacgcgtccgaaccctaatccgacaatggccttcgacatcgactcccttcctcccctcctcggccccgactccgactccgactccgactccgaccacctccccccggccccgcgccgtggccgccctcttcggcctccaccggcgccgcgggtggaaccctcgcctccggcgcctcgcaggtgcgaggctacccccgccccggagggcaccggtggagcggcccagcagagttggccagggttaccaaggggtgtggaatttaatcctagcgacagtgatcttctatggcatctggctgcagaaatggggaatggcctggctcatcgtcatccattcattagtgaatttattaaatctggggatga

SEQ ID NO: 5243 - DNA, 949 bp, Triticum aestivum
  unsure (1)..(949): unsure at all n locations
  Clone ID: PAT_TA_5243
gaattcggcacgagccggaaagagtcgctgtgcaggacctatgtgtcagcatttagtagagaaagtgctctatcagctatcaaattggagttgaagcgtggcggtcaagttttctatgttgttcctcgaataaaaggcgcttggtagacaccagttgagaacttgagatgagagatgaactggagagaatagttcgattgttcttgcttgactcaaaagcagatacatgatgtccttatataaagcatgctcagccatagacgatgtattgcaatttctcaaggactctcttccagatgtaccaatggctattgctcatggaaagaaagtgtcaaagaatatacaacttgctatggaaaagttttcttgtggggaaataaagattcttgtatgcacacatatcattgaaagtggaatagatattccaaatgccaacacaatgattgtccagtatgcagaactatttgggctcgcgcagctgtatcagttgcgaggaagagtaggaagatcaggcagagagggtttcacatacctcttctacactgacaagtctttgctttccagaattgccatggatagacttggagctattgaagagcattctgatctcggtcaaggtttccatgtcgcagagaaggatatgggtattaggggatttggaagcatgtttggtgagcaacaatctggagacgttgcaaatgttggcatcgatctgttctttgatatgctttttgatagcttgtccaaggtatcgtcattttagtcaaccgcaagttctgagaggtgtgcctcccattttaattaatactagatgatacccccgcgttgctgcaggaattagttgcaatatacttgaatgcgatttggttgtagaaagcatgaatattagaactaaagctgaaaaatatanatttattgtactnattattgnaagttataaaatatttat

SEQ ID NO: 5244 - DNA, 667 bp, Triticum aestivum
  Clone ID: PAT_TA_5244
acctagacatatgtggctacttgagccgcatgacactgtaatcatacctctggaatgagttaatcaataaagttttagttcccctaaaaaagagaaaccaaccctttgctgaatcaaagggaaagtaatcaatcacccaatctccccgcctaagacagcgcattctgattactaatcaatcactcaatctccccacctaatacagcgcactctgattacaaaactatacgttaccagtcatgaaccctatgcacctgttagtgacaatgctggattttctccatcagaaagcctcagaagaatcttggagatcttctctgcaacaagaatctgaaccagaattctttaacgccattgacgaacagcacttcaggatatcaattgtgcatcacaccagccactgctagctaaacaaaactgtcagtggatgcagaaatgtagttcacgcctttccgtttgggcatccagttaacgtatacgtataatctgtcacactacactttcacagattttcttaacaatgttgcatattattggtacacgtttgcctgaagtgacaataccaacacaccaatggctgattaaatgcctgaagtgacaacaccaacaaaagaagagaccgtcccatggccaattaactgaaaattgaccgattaattgaatatct

SEQ ID NO: 5245 - DNA, 1391 bp, Triticum aestivum
  Clone ID: PAT_TA_5245
ccacgcgtccgccacggcagctccatggcgagggacgaaccctccgccgccgccgtggacgtcgccgacggcgactcaccctcctccagcccaaccctcacgcgcctacgggaagcactcgccgccctctccaaggcgttcgagtccggcgacaccgcctcctccgacgcagccgctgccctggtcgccgagattctcagcccgtctgatgctgacgcgtccgccgcgctctccgaacagatgctccgcgaggtccacgcgttcctctcgcgcccgtcctcgaatcagatggccatagacgcgctgtctctggagcttcccaagcctgtggcgaagctgggtgctcggatggggaattgccgggacattgccaggactatcattgagttctttgtgtcaaattgcagcccaagggacatgctctgcatcctctgcgaggcattagatacaccagtggcattaaatggatcagcataccttgttattctactagatgggcttgccagcacgcttattttgattcagaggagacacattgagcaagtaaaggtcgtacttcctgccatccttcgagttatgcacgctaatttatcagaatgtgatggggaacatggaatgtctgctgttgatctgttcagtgcagccctcagaataggcaatgctatacaagaaatgtgcaaaacaatggtcaaccacaggaaggaagagctatgttctatacttggtctatacgcccttcaaaacatagctcttgtatcatcagaaagcaaacatcagaatattcagtctacttgtggttcagttgttcttcaatattcgaaacttcttatgttttgcggcttcacctatttgggtcttttaactggtaatgatgtgacctcagccaccactaagctttctaaagaagaggacgacaattttctcgactgcttttcttctgctatggacggtgcaagtcttgtagttgtgtggacctctatgcacgatgacatgtcaaaatatgctggagcagagtttgaatcagctctgaaagaagttcaagacaattgtattaggaaatgggaagcaattaacatgtttagatacgtcttgtcttcagttaattactcatgggcaatcaaatctcacagtctggacttattgttgactctagttgatgataagtgtagtgaggaaaccaacgatcatgtacatttcccgtattccactcaaatttttgccacactcaacgccattgaaagagtcatgatagctgccccagatacattgatgcggaagaaagccttttctgccctgaaaagggttatttcagcggtgccatccactcagagatttgatatcttacaggccctcatcgagaatagtatgttcccctccttgactgcaattct

SEQ ID NO: 5246 - DNA, 613 bp, Triticum aestivum
  Clone ID: PAT_TA_5246
acttcaggccgcacaaccattgatccgagatgaataaaactgcacgaggcccataaacagtgaatgggaacatttcattgaggatttacatatactcgcagcagaggacgtctatatggcacatgtaatggaggaaatggagtcagaatactgatgagtgaaatttcacatttcctggcgaaggcaacactgcgctaggcactgtacgagcattacaaacctttcatcttttcctccaccaactcaatgcagcggtgaagtacgagttgaacaggatttaacaagcacgccatctgattttcgtcgtcgtcaccgccgtctttctcgagttccgattgattccctgtaacaactgatcttagtgggagcagccactctgagtacacggctcgtattttttcgtcccgcaacatttttgctgatctggatcctcttgaatctattatcagaatcaatctgagcaagttcagagcagataacacctcttcactatgatcacgaagacaaggaggaccaccttctggaggcctcaagatcagctccactaactcaagcacctgagaagcccagggtggtgattccccaaaatctttgtgatcgatcagatccatta

SEQ ID NO: 5247 - DNA, 1278 bp, Triticum aestivum
  unsure (1)..(1278): unsure at all n locations
  Clone ID: PAT_TA_5247
ccnttngtgcattttgaggnacgnggcncttgcttancantggaagggntntccagngtanntggaaccaggtttccatcagagttaaagacccgtgcccggttccggttttttttgtgacccaaggagattcagaaacattgtataaacaacagtaatttacagttccatggataacacaagcaggaaagcaatgttatggggggcaaatggaatctgatctgtaccctccagagcgcctaataagtgaagatgccattaatatgcaaagaatggatacatactctaatcattgagatgttatggaagaccagacaaatgatatggaacaacaaccagtaaacttgtactattcatctgggggcaatatctgtatctgtacaggaacaagttccgttattcttttgtcacatagacatctatgaagcacgcctctgtcgctggcagacttcccagcgaagccctgcatcactaatcaccacgttagtgacaagatatgagtagccatggctgagcaagcatgataaaaatgcaagcagaagcctttggtcatgagaaaataacagatgatggttgcttgaagctagagctggaagcgcctgctttgtttggtgatgttatcatcttatcctttgagatggcattgccagctgccagctcagaagaattcggccgctggctgttttcactgtgttgtggcctggcccagattttgattagcccctcacggcatatggtgacgatcgattcactggtgaattctaggccagaaaggggatcagcatgtactctgtgtgcaacgaggggtgagagctttggtacgtctcgcatccgtgctcgcgcctgaagaacaccagtaggaggaggacatgcactgtcccagtgtgcagaagggcttccactgctaaatgttggggagccgctggaaggatgtcgaagtggcacagcaatctcatccattgccaaatcccagagaagaagttgggtatcctggccaacagaaccaaagcgatacatggcattttctcctgcgtcatcagaacttggaggggaccaatacgaatcaaaggcaactgagctaacccatgatgtatgcccctcgccccacgcaaccatctttctgtcatccatgctccatacttgcacaagatcatcttccccacctgataatatatattttccatccgcactccatgagcaacacaaaagagcaccatagtaacttttcccaccaaatattagtgttctttcgcgaagtaaaatactccctcgtgccga

SEQ ID NO: 5248 - DNA, 511 bp, Triticum aestivum
  Clone ID: PAT_TA_5248
gaattcggcacgaggccgataaggctccttcgtgttcccccgcgttgctgctgctccggctccagctccggcgagcgccggcgatggaggcggcgatggggaccctcggctcgcagtccccgctctcattctcctccagcctctggtaatccttctcccctcccccggcgcctcgcccaagccagattcgcgggttactagtttaagtttggaggggtttcctgtgcgaacccaatgttagttaaccaaccgggcttgtatgtttcattccagctcctgcctagcctgtggcacttatcagggtccaggatgttcaagtacttagtgagaccttcaatttcgtcaagcttgatgcttgtcagactgccatgtatttttgttaccgacccccctgttaaagggatgcatggaagtggataagtgtcacctcgtgatgagtcagacatgtcatgtatgataatggcataggcatttggcttgaaaaataaagaggacaatgcgctaaaaaaac

SEQ ID NO: 5249 - DNA, 665 bp, Triticum aestivum
  Clone ID: PAT_TA_5249
gaattcggcacgagcttctacgtacacgagcgggcgaacagggtctaatcgaacgtcgaaaaatggcgcgaactttggcgttcctgctcgtgctactgtgctccagtgcaagcctcgtcacaagtagcaccagcgcaggggctccgcatgaagctcacccacgtcgacgacaaggcgggctacactacggaggagcgcgtgcggcgcgccgtctccgtaagccgggaacgccgagcctccacgcagcagcagcagcagcgccgggcgttcggcgacgtgagcgcgccggtccacctggccacccggcagtacatcgccgagtacctcatcggcgacccgccccagcgctcggacgccctcatcgacaccggcagcaacctcatctggacccagtgcgcgacgacgtgcctcaaggcgtgcgccaagcaggacctgccctactacaacctgtcgagctcggcgagcttcgcgcccgtgccctgcgcggacagcgccaagctgtgcgcggccaacggcgtgcacctctgcggcctggacggcagctgcaccttcatcgccagctacggcgccggcagcatcatcgggtcgctcggcaccgaggccttcaccttccagttcggcgcggcgaggctcgccttcgggtgcgtgagcctgacgcagatcac

SEQ ID NO: 5250 - DNA, 746 bp, Triticum aestivum
  unsure (1)..(746): unsure at all n locations
  Clone ID: PAT_TA_5250
gtctgcggagaaatttcacgctctgcattagttaacagatgctgattttgatcttaacaattgcaggaaaacaggtaatatatatgattagtgtttgggtgaccgttgattcctacaccgagttgtcttgctgttcatatagtctcttttttttttgctaacaccctgcccattctattttcactgtaaacgagttaaacactcttctattttttcccttcggaggagtatttaacgcggtgtacaaagaccagacagtagagaggacacacaagcaaggtgaggggctcagagcctcagagcacgctgcagtctgcggtctggaacgaaagctcccccttgccgatgtcgtagagcaggtgcaagtcttgctgctggaagttgccgatgacgctctcgtaacctccttcctcgatgagcatgcacgccgtggacttgtccacgggcccccagtagctccccggcggcaccgccatgtccgcaccgccactgaagtggaagaccagcgccggtacgaccttgttaacgtcttgccgtgccacacacaggtccagtccggtgtctcctggcggctgcacgacgctatggttcagttgccgggtcacttcctcgctccgccccccgtacgcgccgccggcgtgcgctgggtcgcggccgccgggcccctggatcgaacttgcctccaagctatcccgcaaggagtataaactcttaggaaccttggcctcaaangangntttaggccc

SEQ ID NO: 5251 - DNA, 492 bp, Triticum aestivum
  Clone ID: PAT_TA_5251
ttttttttttttgccagtgaacggggggtttgccattagacttgcgctacctaagcagagttaggcactccacaactcatataatgtacaggaatttgcactttggtctatcacaatttacaagcatcctcactctcggagtacacagactatagcagaacctgcagccgactggccgtttcaagtgggtccccaacggatgtgattcccagagaaaagggcccggcaaaccgcggatgaccggcgggctctgcattatcaaccctacgcagacacagacagcggcaatggcgaccaaggatagcaccgcgggcctgttcgacaagaacctgtttgggcagggccggtaggcaatgtgctggagctggacacattgtctgcaccccggtgggcttttctcgacatcaaatacggtctgttcagttgatctcggccgaccgtcatctgtgtgcttttcggcgatgccagtggtggtcatggcaaccgacacat

SEQ ID NO: 5252 - DNA, 587 bp, Triticum aestivum
  Clone ID: PAT_TA_5252
gaattcggcacgagacacatcgattcataagggtaggtatattatcgatgcatctcagctgctctatcttatcgctcagctactgcactggttttagctgataataaattgttctctatttcaaagagcaacaacacgagattgcgcgctgtcttgctccaggtgcatgtcgttgccctcatttcccctctgattcggcttgctttaccttgcatgaagttgtatactttcaactttacaaaattatatcaagttcgctttcaactgtacttggctacacctgcaacatgatgcatttctcttccagtttattgaatatgtgaagttgtatgttcaactttatacagagttatatcaagtttgctctcaactatacttcgctacacacatgtaacatgatgtgttcctcttccagcttattgagcataactttaaggattgaatgttctatctggtcctgccctatcactcatttaattgtgtgttaatttgcttacaaacctccgactgtacagcatacaatgtgccaggttctactgcaacagtatgacatacaaagtgatggaggagaggtgttcagagaaaga

SEQ ID NO: 5253 - DNA, 1028 bp, Triticum aestivum
  unsure (1)..(1028): unsure at all n locations
  Clone ID: PAT_TA_5253
cgtccgcggacgcgtgggctagctagctcatccatcgagctacctcctaggtacgtacacggtacacactcactgcatgtcattcctcgtctagcttagcgcgagacatcgatcggtcgccagggagagggatcgagatcgtgagctggtcgggctcgaagaggaggctaaggcgccatggacgtcaacgacgtgctgctgctggcgtcggcggtggtgctggggctggtgtggtggcggcgctgctccaagacgggcggcgtggacggcctccccccgggcccgccggggtggccggtggtgggcaacctcttccaggtgatcctgcagcgccgccccttcatgtacgtcgtccgcgacctccgggagaagtacgggcccatcttcaccatgcgcatgggccagcgcaccctcgtcatcgtcaccgacgccgacctcatccacgacgcgctcgtcaagcagggccccatgttcgccagccgcccggccgacagccccatccgcctcctcttcagcgtcggcaagtgcaccgtcaactccgccccctacggcccgctctggcgcgcgctccgccggaacttcgtcgccgagatcgtgtcgccgcagcgggtcaagggcttctcgtggatccgggagtgggccatgggcaaccacctccgccggatacgcgccgagcacgccaagaccggcgccgtccgcatgatggccagctgccgcctcaccatctgcagcatcctcatctgcatctgcttcggcgccaagatccccgacgagctcatcgtggagatcgaggaggtgctcaaggacgtgatgatgatctccctgcccaagctcccggacttcctgccgctcctcacgccgctcttccggagggagctcgccgaggccaagaacctgcgccggcggcagctcgactgcctgctgccgctggtgcgcgcgcggcgggagttcctccggaccggcggcaacgcgtgcaaggcggccggggaggggaacagggtgatcggcggcnnnnnnnngatgnnnnn

SEQ ID NO: 5254 - DNA, 635 bp, Triticum aestivum
  unsure (1)..(635): unsure at all n locations
  Clone ID: PAT_TA_5254
gctcgacccgcccgaatcatgcttgaaccaccgagagattagagtttacagatacatgtattagctacactctacaagaatacaaatcccggtctatgatggacacatttgctacgacgagccggcggcgacggggacggcctcgtagagcttggcgaagtagaactgggtggagatgaagcccttgttcttgacgcgccagccggcggcgcggagcgcctcctcgatgtccttctccgagtggaggtaggcgcgcgtggcttggacgggccggggaacagctcgccgacgcgcttcaccacgtcgaagtagagcctcttgggcgcgaagctgatgacgagcccgtcgccggcggagggatgcgtggcgccgcctggcctcctgccctcctccccgcgggtaatggatganacttccaagcacacaacactcgtacgccctccaagtctccaancccgcactccnaaccgcggnatcgnaccccgngatacccgcgnnaaacngctccgctccctcngaacatgcggggaattcggagnaacacggagnccgcgaggcaggggnncccggtccaatccccaaatgatcnatagnccnacggcgngtttaactctaanggaaacctgggnnncact

SEQ ID NO: 5255 - DNA, 961 bp, Triticum aestivum
  unsure (1)..(961): unsure at all n locations
  Clone ID: PAT_TA_5255
gatcccggccccgcctcctgcccctgcgggcccccgcgccctcctccccccccacacggggatgcgcaggaggcatcgcttgtttctccttctctacgtttttgatgttttgatcaagacctggggattctgttgtaatggccgagtgctccttgacaacactgggaggccagtatcgtgggggatggacccaatccagcggcaagctctccccccgaatcttatccagcgggacggcggagaggctctgcattcacctctttccccttccatggctggccttactcgctggagcctcagggtggatgtgctgcccttctgcctctgatggcttccgtgggtggggtctcaccctggcgactcttgttggatgttatttctttcagtcaatgatgggttcagagagtgtgatctcatccaaatctaatgttgctttctgatgaagcccttctgactatcagcgtagttcttgcgtatttggctggggttgcaccctctcgacctacaataccccgcacccaaaatcccagcgccaatcaacatctcacagcatcaatctcctctgattctggtaggaatggaaaacgtttgcttgacaagagtacagcgtctgaccccaatgatacatggaatgaagtgagggctaagctttctgaaccctagagcaaatggtcaagatgccagttctgatagcaagagacaaagaactaaaaaatgatagaaaaaactatcctttgagtatgcttgcaattcaatgggaggtcccaagttgcggcttcctctgatcacatttcaacttccttgaaatgggaggcaagaaatattccgggaagttttgaactccaagatgggataaggtggtccggaagtgtcagttatgttgatagatagcttgantgaaccagcattatgaaatgggttnaagaagacaagcctggaaaatggcaagatnatgaaaann

SEQ ID NO: 5256 - DNA, 549 bp, Triticum aestivum
  unsure (1)..(549): unsure at all n locations
  Clone ID: PAT_TA_5256
attttgaaaaggcattgcacattattgcaagtacgaaaatagacctgttgtgcttttttttttttttttctcatttcaacaagttgttatttgcatataaaggcctactttgtcctcccataatttatgtagtacaatctcacagcaggagtgtaaatacatactatggttgaactataatttcataacataaaaatcagcgagtgggctagtagtaaattacgttgactctatacggcaagcaatttttgtgcactaccactatccagacgcccaactggtcagcgctggtggttcttgttccacatgtagttcccttctgccatcttcatgagcatagatctttttcttgtactatgtttttgcaacaaatatacaaaccatggaagaaacatagcattagcttgaagaccatatgtaacataacaccagcttctctgaactcctccaggcatccagtctcccatgtgtaaagcagtcacttggaaacagtctggatgattaaccatggagctttagaaacataacctgaagaagcatgtcagnnac

SEQ ID NO: 5257 - DNA, 792 bp, Triticum aestivum
  Clone ID: PAT_TA_5257
gaattcggcacgagagcccctgcccctcgggctttccctttcttcccaataaaattcgctcgcgcaaattccttccgtccgccccggatttcccgacgggacacgcacgcgcgcgccaggagtgcgcccgtccgacggaaggcaccgcgccgatttgcgcctgcttgcttgcttgcttgatcgatcctccatccgtccgtggttgcgtcgtcgtccgggacaaggaggaggagcaagggggtgtgagggattcctggtatcttcttgattggttggcttccttgccgcggcgggcgggcgggcgggcagcagcacgacgacggcgtgctgcaagaagatgcgggcgctggaggacgacctcttcccgtcgacccccggcaaggtgaagatcgagcgggcgggcggcacgatgaaccgccagctgcaccgctgcttcgcttcgactagtaccatgttcctctgggcgctcgtccgcgtcgccatgaccgcctcctacctcagcttccagtccttcgtcgacacctcctccaagtacttcgccgcctcctggggcggcctgcactgggagcgccagatccgcgcctccgccgcgccgcgcaggccgccgggctccgcggccggggccgggatgtcggtgctcgtcacgggcgcctccgggttcgtcggcgcgcactgctcgctcgcgctgcgcaagcgcggggacggcgtcgtcggcatcgacaacttcaacgcctactacgacccctcgctcaagaaggcccgcaaggcgctgctgacctcccacggcgtctt

SEQ ID NO: 5258 - DNA, 1077 bp, Triticum aestivum
  Clone ID: PAT_TA_5258
atgggggtcagtttcatccagtccatttatttgagaagcattaatcattgacactctcaatgctatcgactgtgactcacacaatgataaccgctttaacaggaaaataaattatttttctggcaagtgcgaaatgtaaataaggtgtgcctacaacctaccgcggtacacgcagagatgaaacgaactcgtgttcttggctgaactgacgtgagccatgctgaccgactaccgagtcgaccccgccatgtccgtcgtctcccgcaggtccggcctccccttcccgcctcccccgccgtccttcgcggtcccctccggggagctgcagcctcggcgccacccctttcccggttggcctcgccgcccccctcagcctcacgcgcgcctccgccacctgtgccccgcacagggccccttcatctcttccaccccccaggatctgcgcgcccaccgtttcctcgaggagcctctccctcatggcatacgagaagtagtttgacaagttctgcttcttgccatgctcgttctggatgatgggcttcctcctcatcagcagctcaacaagtatcactccaaaactgtaaacatcgctcttgtcgttgagttggcccatgtagtaatactccggatccaggtacccaaacgtaccctgaacggcggtgacccaggtgcgtttgatcgatggggatcagcctcgatgcgccaaaatccgagacctttgcggtgtagctgtcattcaggagcacgttcatggacttgacatctctatggaggaccgacacggaagccgaagagtgcaggtacgtgagcgcgcccgcgatctcggtggcgatcctcaggcgctcctcccaggacaatggcatcaataagttgctactgttttgctcggaggggcggtgcagaaggtcgtagagcgtgccgttggagatgaactcatagacaagcagagggacctcggattcgaggcaacatccatggagcttcactacatttcggtggttgatctgcgacaagatggacacctcgttgatgaactcttcgatctcgctgatcaccgagagcgttgatttcttgatg

SEQ ID NO: 5259 - DNA, 560 bp, Triticum aestivum
  unsure (1)..(560): unsure at all n locations
  Clone ID: PAT_TA_5259
gggctcttcaccttnggcatcgccgcgccgccggggctcttcctccccatcatcctcatgggcgccgcctacggccgcatcgtggcgctcgtgctccagagcacgggggcggcgagcatcgaccacgggctctacgccgtgctcggcgcggcggcgctcatgtcgggctccatgaggatgaccgtctcgctctgcgtcatcttcctggagctcaccaacaacctcctcctcctccccatgaccatgttcgtgctgctcatcgccaagaccgtcggcgacgccttcaaccccagcatctacgagatcatcctggacctcaaggggctgcccttcctagaacccaagccggagccgtggatgaaggacctcaccgtgggcgagctcgccgccgccaagccgcgcaccatcagcctccaggtcgtcgagaaggtgtccaccgtcctcgaggtgctgcggaacaccggccacaacgggttccccgtggtggaccggccgcggcccggcctgtcggagctgcacgggctggtcctccggtcgcacctcgtggccgtgctgaggaa

SEQ ID NO: 5260 - DNA, 686 bp, Triticum aestivum
  unsure (1)..(686): unsure at all n locations
  Clone ID: PAT_TA_5260
catgcctggcatatccgcgaggtacgcccgggcgactgtgtgcggcacttttttttttcagagcggttcaaatgctactataggtagctttaaatccaggcaaatgtgagatacatccaggcaaatgtaagggatacatacgcgcttaagcgagcatgccactaaaataaaatatataagagcgcgttaggagcaagccactgaaataaaatatgttttgcaccacatctgtgcataaggtcagaaacaggcccttctgtagctccgtagatcgaaagccacactggctaagatagcatgcaagcaagtaataagcagacttgaaaatgatttgagatagaaagtaacttctcttctgaggaactctcaactcatgcatgctttaaaagtttgaaggccgtcaatgtagcagtacagaacagccttctgggattgataactacttgttaattgcggaactcctcccagcaaaccaggatttttagttggcactgaagaggatcttccggctgctggatttatccacattccccgacgccctctcatgcttttaggttcatcaangggactangggagatgccttgcntcaactgggtgatgatacacgattccanaagggataactcccttgcagtcgacatcacctcaggtgttctctggagctacagcgtgcaaccagttgtng

SEQ ID NO: 5261 - DNA, 2071 bp, Triticum aestivum
  unsure (1)..(2071): unsure at all n locations
  Clone ID: PAT_TA_5261
ccccccccctcgccctctgtgcgggcgccgtcccccctgcctccccccgcttccgcttcccccgtccactcgccccctgcgtccatgcacaactcaattgctgccaaatcttagcgctgcacccaccgcctccgtttggttccctggattcttctccgcgcccgcgagaaatctgggtgatgagatgatgaggacggcggcggtgctgttcctctgctttttcgccttcaccggcagcggctggggcggagcgcgggccgcggccgtatgggcggagggggtcaggcagacggcggcggcggtggtggaccctgcctggcgcttccctagcccgcggctgcgggacgcgtacgtcgcgctgcagacttggaagcagcaggccatcttctccgaccccaagaacctcaccggcaactgggtgggtcccgcggtctgcggctacaccggcgccttctgcgcgcctcttccgtcgccgcgcctgcccgccgtccccggcttcgtcctcagccacggcgtcggcccgcgcggcctcccgtcgctcctcgccctcctctgcgacctcgcgctcctctacctctacgccacccgctcctgcggcctcgtgcccgacaccttccgccgcctcgtcctcctccacgagctcgacctcagcaacacncgcttcgtgggcgcgttcccgaccgtcgtgctcgacctcccgtccctcaggttcctcgacctccgcttcaacgacttcngagggcggcgtgccgtcggagctcttcgaccgcccgttcgacgccatcttcctcaaccacaatcgcctccgcttccagctccccgacaacttcggcaattcgcccgtgtccgtcatcgtcctcgccaacaaccacnttcggcggctgcctcccggcgagcctcggcaacatgtccgacacgctcaacgagatcctcctcatcaacaacggcctcacctcgtgcctcccgccggaggtcgggatgctccgggaggtgacggtgttcgacgtcagcttcaacgccctcgcaggcccgctgccgccggaggtggccaggatgcaaaaggtggagcagctcgacatcgcgcacaacctgctgtcggggaccgtgccggaggccgtgtgcgacctcccacggctcaagaacttcaccttctcctacaacttcttcaccggcgagccgccgtcctgcgcgcgcgtcctgcctgccgacggcgaccgccggaactgcctccccaaccgccccgcccagcgcatgccgcagcagtgcgccgctttctatgcccgcccgcccgtcgactgcgcagctttccagtgcaagccgtttgtcccacctcggccacccccaccgccagcataccccggcccgttgccgccagtgtaccccatgccatacgcgtcgccgccgccgcctccacgttaccgatgattctttgacaacagaagcattgccagtttcactttcccttgccgcaccccttgccgccggtgtggaagagccagcggagctcgccgtcacaaaagtacgtggtcattgttgttcgtggattaccagttcttgattgatagctaccggcgtaaagaagaacgtggtgcatatatccttttcttgtttttttgcattggttggtgtctgttttccgcatcgtcgtcttcgatcatccgtttgcgcggtggcgatggcgaaaaggattggagcatggtgatagggaaatttgaaaggtgggaacaaattgggcttggattgatggctaattgggttgtgaataataaactggctgagagagacaggttaagctgagattgagaaatccatggaaaagttgtgatgcgggatgtatagaatgatacttttagttcggtaaagctctagttgagggtcagagataagtttctacatcaagagatttgtcctactgaattcctcttgtgtcacagctgcttactgttattcgattattattattaagatgtttagttgggcttcttggagaatgttgtctcctaactgttactctgctcttacaaattttgtacctcggccgcgacaacctaaccatactgtcctatacgct

SEQ ID NO: 5262 - DNA, 638 bp, Triticum aestivum
  Clone ID: PAT_TA_5262
agagagacggactagactagaccagatctcgtagcggggtctccggccgcctccccctcccggggccagcacgccctgccgtccgccggcggcctgctcggtcgtcggtgagtccgtgcagcggcccgaagaggcgcgtgctcgctccaagggcgaagggggacgcgccggatctcgcggggcaagtgcgccagcgacctgaggtaccttggtatggaatgaagtgaagagcgcagagtatcttggtcttactaatcaatgcatcatattatgtgcgcaataagattttgctatgctttcaccgtcgatgcccactggttggatcatgcttctgtttatgagctcattgaagtaactctcttgtagctcaaatgggccaattcctcatttgcgtggcacacaaaaccttcagctatccatctccatatcagttggtctctcttaattttgtaatcttctggaaatatgcttaagtataataaatgatgtgaaggtagatcatagaacatcaacacaattcttgatctaaaagaaggtctagttttgtgatttaacacaaatagagggcacccatgcaccaaaaccatgaaaagcagcaaagaaaatgagtaaagaggcacttgacttgtagattatac

SEQ ID NO: 5263 - DNA, 1369 bp, Triticum aestivum
  Clone ID: PAT_TA_5263
agctcattcgatatgtaaggtggatagtttgaggttttgtttatcatgaaaaacaagggattagcaagtttgagctcggtggtggaatggacgaacatggtgtatggacgggggctcttttcggctggacgtctaaggggaaaaccaccttgcgggccgggttggccttgctggttgacggggtcaatgggagcgtgaatagaagcatggttcaaccaattgacatcaatgttgataaaggcatgtgaaaatcttatcgtatacatgatatggtgattgatttcatatgcggaagaaaaacacttatgtggcatggagtgaaggcggtctattctaaaggcaagatgtgcaaattatccttctgaatgagcatgaatgttaggatcgatgttacaattcggtttcttgctattgtagattcattgttgctttgatcgaattttacaaagttctacgtgcgttggattagactattgtgcgcgcatgtggctattcttccctatcacaatgcttctcaaatattgtgtttgtcttattgttgtgttttgtattggttaatgacatgaatcacccattgtatttgtacttattgagtgcttaattatagtcgtgaatacttctgggtgtatttgtacccaccatttcctttttttttgataagtatttgttcccacatatgctgaaatatatagtcacttagtagaaaatcatataaaattaaacacgagtctcttagtgtctttgtacccactgatgctgaattatagttcgagtcaagaactgtcaaaattctgtgtcggctcctgcaggtgaaatttctgattgccatcagtaggaggattggcacaactgaggccttgcaatatccttgctgaagctacttgtgttcagcgtttgaggatattgatcggaggctgagagtccagaaaactgcatttgccttggtgtttgattgtcattcttctgtaacagagaactgagaactgagattaaacgttgggatttttccatctactcgttgaatgaaattatggcagtaatgctttgattttgacatgattcttttttcggaaaaatggaggcattccatttatttatattaataaaggagccagaagagagccggtaaagacggaacagaagctcgtgacatgatatcccccgattaatttctgatgtccctagaaattctagtgttcctcttatccaaagccaattccgctgtgaaaactctattttacacgattttatggtgctagaaagtactgctccagttttgaattatgagatgttttaattttttgaatcgaatggtacataaacctgttttaagtgtgattgtttatttatttcagtccgtatgtagtct

SEQ ID NO: 5264 - DNA, 1348 bp, Triticum aestivum
  Clone ID: PAT_TA_5264
tcgaccccgcgtccgttgagacttcttcttgagcagaagttgagagaattgacttctggggtgaggtcaacctattctaagccagccaatggtgttcgaatatacgccccttcaccaggtttggatgacacggcatcagcctgtgacacatccagcattgcatctactgattatgatagggactccatacagtcttcaaaggatggaaaagacaaattcccccggacagatcttgtattaaaagatgatcagtcatctcaatctgtgaagtatgataatggcttcattgatcaagtggagttagagcatcttcacctaagcccccattctacatgggaagcttctctttcaacagaaacctgcagctctgcagagagccgaacaaatgcaaatgaatcaaggttatttagttcaacagaaggagcagcaacatctggttcgacacactatggtagggtcctagaagtggaggctttatcagaatattctgatacagcctcatcaatcacagcgactttagccgaaacaacacatccatcagaaagcagcagctcatgtcgtatggagataaagttcttaagagaaatactgaatgctatttctgtcagagataatgcttgctcttacttcgagcgatttgatagctcaaatatcctggatccacatctgtttgaagaactaaatggcaattttaggctgccagtgggtgaagaagagggaaaatctttcggaatgattcggaggctgctctttgactgtgtgaatgaagtattaagcgtgaaatgcacatactacttcaatgctggttacagctcatggtttacggggatggcagttctgcagaagctctcgccggaagaaatctaccaagagatgaccagtctgaaggttgccgaggagtggatggtggatgaactcgtgtacaaagaaatgagtggccctctcgggagctgggtcgacttcaagacggagtcacatgaagctgcaaaagacataacagcagagttgctagaatccttgatcgatgaaatggttgctgaccttctatattggtagtttggtcatgcaattattgtgcattttgtttgtcgagaactacaacaggggccctaacctgcccaccatttgatgatagatcagcggctgtcagagccattgtctaccttttttggggaccgtttcggttgtcatgatgcagaaaatagcgaggcattgtaatttttttctttccttactatggcccattgttaatgaaaatagctggtactgtatgttgtacaatgtggcattttagctgtatgaatggtggtctgttctttgcaaactatactgcggtaattatttgtcg

SEQ ID NO: 5265 - DNA, 466 bp, Triticum aestivum
  unsure (1)..(466): unsure at all n locations
  Clone ID: PAT_TA_5265
cccacgcgtccgcccacgcgtccgctaccaagaacacctccaatcccacaccagtccgccacaaatctgatccgccccctccattcccacgaacccactccccgcccccctcgtcttggcacgagcgcgtcggcaccatcgccccggatcggagcaggggcggctccggcgctgatctccgctcagattcggatttagggtttttgggcgtggtcgcggtggtgggttcgctcggccggtttggaaatgtcggcggccgtggcgtgcgcagagagggcgacgagcgacatgctgatcgggcccgactgggccgtcaacatcgagctctgcgacatcatcaacatggatcccggacaagcaaaggatgcgcttaagctcctaaagaagcgccttgggaataagaattcaaaagtgcaaattctggncccttatgtgctagagactctaagcaaaaattgcggggata

SEQ ID NO: 5266 - DNA, 2429 bp, Triticum aestivum
  Clone ID: PAT_TA_5266
ccaggaccccccccatcccacaccagtcccctccaaatctgatccgcccccaccattcccacgaaccaactccccgttcccctcgtcttggcacgaggcgcgtcggccccatcgccccggatcggaggagaggcggctccggtgctgcctggcgccgacccccccgctcagattcggattggggtttttggacgtggtcgtcgtcttgggttcgcgccgctggtttgaaactgtccgcggccgtatctggcgcagagacggcgacgagcgacatgctgatcggccccgactgggccgtcaacatcgagctctgcgacatcatcaacatggctcccggacaagcaaaggatgcacttaagctcctaatgaagcgacttgggaataagaactcgaaagtgcaaattctggcccattatgtgttagagactcttagcaaaaattgcggggatattgtttaccaacagatcattgcagcgtgatatactaagatgaaatggttaagatagtaaaggaaaagccagaattaaaagttcgggagaaaatattgcgtctgattgacacatggctagtggactttgggaggtccttccgggggatatcctcagtaccacactgcgtaccaagaactcagggcaagctggtgtcgatttcccgcctcgctgaggcagaatacagttccactgtttccacctcctcacaatcaaccttggtacgaagccacatcgatgcccaccaggaccctcctgtttaaagatatgaacattcagaactgcaagtccgcttcaatgtcgccagcctcccgccaccccccacgtgtcgaagcgatcttcagagtgcttgtggatttgggcatgtggtgtctaacttctcaatcgaatccagccaacagccccaggaggcgctgagggaggagggcatcagtgaggttgctcacagaatggagttgccaagctgctggtgtgatggatctttttagcgatacaggtgatgagagctaagagggtccggtcggagtgttaattattgagttgggaattgtttttcatgcgcatgaggccataggaaaaggagtcctcagaaatataccagtgcctgttgctggtaacataaaccaagggacagcccctcctcggcctgctggggcttcatttgccccccttcttaatgtacaccatgaggacgatgaaccagaagatgagttctccgtgctttcccgcaggtctgcaagggatggcgcagcagcacagggcaacatgtcttctgttccaagaaatgaaaggccatacccaagcccacttcttcctccaccaccatcgacaaaaaggcctgtttacacagaggcaagcagtgtcgactatctaagtggggactcctataagtctgaaaaagtaccagatgattttgtcaacccaacggccccagccaatatgtctgcaccatctcattcaaaaacagaaacagatcaagtgccaaattatgatagcaggtcagaaaatgtgcctgatgacttcataaacccaactgcagcacccagtttttccatgccttctcgtcctacgagtgagccatctgtgaataagcttgagagccttcctgacgatgactttataaaccccactgcacttcctggtttttcttcgtcttcaactagtgaagatcttccaaaagctccatgggaagcgcaggctccagtttccctaccgcctcctcctgcaaggtatggccaaagacagcagttctttgagacaacagcatggctttcctggtgagaacaatgaaggtggctacgatgagatgctgacgccggacaggaagcctttctcttaatcaaaggaacactgagaatgggaagagcgcatcagtgtcgaccgcatcccgccagcccaaacctgaggatgcccttttcaaggatcttgttgattttgccaagaagaatccatcttctccatctaaaccagccaacagccgcaggactcgctgagtgatgagtgtttcagtcatgtaacacacataattgagttgccaggctgctggttttgctacaggtcggcgaattagatatatcatcaaataagagggttcggtcggtctgttctttattgcctcagggaattatttggtttgcgcattggacaattagagtcacaggtgtcagatacgtagtcatgatactgggtgtggtgtgtagcgagttgcatttctcacctttttcttgtgtggtattggttatcgattctggctttattttacttagctgtatatatttctccatttgacagcagtattctactatattgagtttgcaatttgatcttgtaagacttgctccctctgtaccaatatctaagacggtttttgcagttcactttgaactgcgaagcgttttaaattttggacgtagtatttcataggtccttttcaacgtggag

SEQ ID NO: 5267 - DNA, 614 bp, Triticum aestivum
  Clone ID: PAT_TA_5267
accgtcacgagccacgagagagagagaggggaggagcgggcaacggccatggccaccggagctgcctgctactaccaccccgccgcaggaagggggagcccctcctcgctatctccgggcctcgggtcatcgcagagcaaggtgttctttatcagcagcggcggccgcagcagcagccggtggtggatgaggaggaggagaggggaggggaaggcgagccggcgcggcatcaatagcagcagcagggcaagggcgaggcctgccttgttctcccctgccatggagtggcaggagtgcagcactgaaattgaagttgatgttccatgttcagtggccttcgagcggccgcccgggcaggtgactattcctgaatggatgccattcatatcaactgtcaaggtccttgaagataaaccagaactttcacgttggactttgaagtatgcgatacttggtcgggatgtagaattttcttggcttgcccgaaacatgacgccgactaaaaatcagaagattcattggcgttctcttgaaggtcttcctaacaggggcgctgtccgattcttccctaagagttcatcctcttgtagagtacctcggccgcgaccacgcta

SEQ ID NO: 5268 - DNA, 655 bp, Triticum aestivum
  Clone ID: PAT_TA_5268
gaattcggcacgagctcacttcctcctcctgcccacctccctcttttggcttagcctccactcttcccatcccccgatctctccggggctgcggcggcggctgcggcggcggcggcgaagatggtgggcaacgacaactggatcaacagctacctggacgccatcctcgacgccggcaagtcggccgtcggcggcgaccgcccctccttgctcctccgcgagcgtggccacttctccccggcccgctacttcgtcgaggaggtcatcaccggctacgacgagaccgacctctacaagacatggctccgggcgaacgcgatgcggagcccgcaggagaggaacacgcggctggagaacatgacatggaggatctggaacctcgcgaggaagaagaaggagttagagaaagaagaagcctgtcgtttgttgaaaaggcatccagaaaccgagaaaacacgaattgatgctacagcggatatgtctgaagatctctttgaaggtgaaaagggagaagatgctggtgacccatctgttgcctatggtgatagcaccacaggggtctcacccaagacaagttcagttgacaagctgtacattgtattgatcagtctccatggtcttgtccgtggtgagaatatggagctaggccgagatt

SEQ ID NO: 5269 - DNA, 934 bp, Triticum aestivum
  Clone ID: PAT_TA_5269
gtcgaaagggggatgaggttaacctctccggtccaatttccaaatcatgtgcaattgggtgatactgtagtacaaacacatcttcttcaggtaaccggttggcggtgacttatacgtacaagctaagcaaaatgttgtcaaaacgatatacgtacaagctagaatgattttagtacgacaaatcatgtgcaattgagcgtaacatacacgatgctgcagggtgccgtggcgcgtcgacagactttcatgtccaaagggaaatgctgtgcaggtgcttgtacgacgtagtacgatcactctttggagctgcctggcttggtctgctgctggcttagcttctggcacatggccatcatcctgctgtacgcctccatgccgttcggttgagcttgctgctgcgcgttctgctgcgccgcttggcaggcgaggaaggcggagtaggcgtccggcacggcggcggcggcgggctgcttctgccggtcggcgccggcgccggcgttccagggctgcatggtgacgaacggggtggacgtgtgcatcatgggctgggtgaggcccgggtaggcgggctgcgcgagtggcccggccatgttcatcattcccaggcccatctgcgccatctgggccatctgggccatgttggccatgacggacatctgggctagctgcggcatggccatgggcatcatcatgctgctcatccggttcatcatctgcaccgttgcctgcagctgcttcaagtggtcgatcacctcgtccagcatcgatgccttgtcggtcttgcttgagttggggacgagcttttgcaatgtctgcatcttctggttgatcctgtcccttcttttacgctcagattcgttatggatggcagcagcccggctcctcttagtggaaatggacgacctcattggagcttcccccttgatcacgacgt

SEQ ID NO: 5270 - DNA, 646 bp, Triticum aestivum
  Clone ID: PAT_TA_5270
gctcctacaacctccgatctccccggcgtgcaaagctcctctccaacctcggcgcgaaatggccaccaccgtcggcgccgcgccgacggcattggacgagaaggcccggcgcacgcgcgatctcctggccagtttctacaacaccgaccccgcggccgccggcgcggccgccgcgtccccggcgcggccctcccccaccgccgccaccgcgtcgccgctcgagtccatctactccacctccttcaaccccgagggctacatggacgtcctggtgcaacaatcaaatctggaagcccttctacagaggcatgtgaagatggctgccgagatcaagaacctggacacagacttacagatgctactatatgagaattataacaaatttataagtgcaactgacactataaaaaggatgaagactaacattgctggtatggagacaaacatggaacaactactttcaaagataacatcagtgcagtcaagaagtgacacagtgaacacgtctcttttcaacaaaagagaaaacatagagaaattacaccgaacacgcaatctcctccggaaagttcaattcatatacgatctgccaactcggctcaacaaatgcatcaaggcagaagcatatgcggacgcagtcagattt

SEQ ID NO: 5271 - DNA, 862 bp, Triticum aestivum
  unsure (1)..(862): unsure at all n locations
  Clone ID: PAT_TA_5271
gtccccaatattgccactttncaagcgacgtntaantnacctctgtgtgntgtccagatcttgattnaaattcgttcngagacgtntttntgcaattacaactcacatntgttcggtatacntttccctgtccctcgccctgcttctcggttcttgctggtgctggtctcgcgcttttgatnatccttncctttggaattgcatcttccacttcttgatgtgcctgagaaatagctcctgcagcttcaataagggcagctgcgcaagcctctgcggattcacgccttagtgaactgtcaatgtcctccatagatagatttttagcatctgaatcgatgtcatatgctttgcttgcttctaagatgctcccattatcatctgcccatgtcacagactgacttctgttcttagaccctacagccttcagtgaagattttagtgcagcactaactttctcgtcacttgtctcatttttttcaaggtccactgctttactgaattctttgtgtagttgttcagtgtaagtatgcattgaatctcttactgtgtattgagatgatgagggctgattatctatgaggatggaacttgcaaagtcatattgacccaaagccccttgatccatctttaccgaagcaggatcccccataatgattgtactagtaaagcctacttcatggccattacttccagcaggttttcttgcaggcttactcttgcatgcccttgatgatgctctagttgatttctttttcttcttgtcacttctctcttccaaaattacatgctctagttgcttcgcaatggaatcagttatgcaaggcaataacatatctgtatcttcatcctgttggaaaatctt

SEQ ID NO: 5272 - DNA, 850 bp, Triticum aestivum
  Clone ID: PAT_TA_5272
ccccccctttttgctctttctcactgcaaaatatttttgattttattgggtactaaatttgcttgagattatcgaaatattctcaaaaccggcctccaccgtaaaagaagggattcagaaaaaaaaaacttaaagcaggtacactacccagagcggctaggagcaagcacgtcgtgaatcaacgcatcaaagttgcggtgagacgagccgccgggcttggtcgccctcaccgctttctccctccactcctgtgccttcttcttcatcacctttccattctcccccccccggcgcgccgggcgttggtctgcgtcgccgtcccgccgcccctcgcggtccaccgccacccccactccccctgccgggcaccggtgccggccctgcggctgcccggcacgccgccgcacaaagctctcgaccagggcggcgttccatgccgctgtgcgtcacgaaaggcggccacggcggggcgggtccaccaccctcgctgctgcgggcagcaccacgccctgcgcccgccaggaggccacgagcccacgctccaccgtctcggccgagaactccggggggagcactgcggtgtcgcccttgacgaggtcgggacggatgatccctgcgccagcccccacgcgaactccaccatctgcgcgctggtcatgacggtgatgctgccgaagttgacgtacacgacggagccgggctccctgccttccagccactgcaggcactcctcctgctccttccacaggctgaggttgatggcagagcgcggcgtgggcggctcctcgcgcgccagcagcgggagagggccgagcgtgtacaccttggccaggccgagcgccttcatggc

SEQ ID NO: 5273 - DNA, 537 bp, Triticum aestivum
  Clone ID: PAT_TA_5273
cgtccgcggacgcgtgggcggacgcgtgggcactactagtacttgtcattagtgcgatgctgctgactttaaatttcttgtatcctggaaatgctttctaagtacatatcaatatcaatattcaaaccttaatttgtgtggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggccgttttaaaggaccaaagtttacttccccgtgcttgcaaagtaaaagtttttttttggggccccctaaaaaaaattcacgggccggggtttaaaaacgtcgggacgggaaaaacccggggtttcccaaaaaaaatcgctttgaaaaaaatccccttttggcaagggggggaaaaaaaaaaaaggccccccccaatcccccttccaaaaatttgccaaccctaaatggcaaagggaccccccccttaaacggccaataaaaggggggggggggggg

SEQ ID NO: 5274 - DNA, 1822 bp, Triticum aestivum
  Clone ID: PAT_TA_5274
gagccgcctggcctccgccgtgcgcgcgagtccgaagtcaaggcgaaaaccctcgaggcgaagcgagagtcagatagggataaccgcgagagacgagagtcgagtgagagggtggaagggaaggcgcgatgaagctcaacgtgaagaccctcaagggcacaagcttcgagatcgaggcgacccccgagtcctcggtgggtgaggtcaagagaatcatcgagagtgctcaggggcagaatgtgtaccctgcggatcagctgatgatcatatatcaaggaaaaattctcaaggatgataccactctggaagctaacaaggttgcagagaacagcttccttgttataatgctgtctaagcctaaggcgtcatcatatagtgtttacttctactgcactcaaaggcacctgctagtcagtctcaacctgctactccacctggcccctggtgccccagctgcaggatcaccaccgtcataggcacgtgttcctgcttctgaacaggcccctccctgtgcccagctttcagccgtttccgatactccaggccccgcagtcactggatccaacatcgccaatttctacggtcagtctggatcaatccgtgtctgtggcgccgccttggaaaatgaaacacctgagattggtgctggcggaaatgtactaggcgcactcgcagctgatgtgccacaggcacttcaagttactaaaagaagaacgggaggccatccagcggctcgaggcgatggggttcaaccgtgagcttgtgttggaggtcttctttgcatgcaacagggatgaagaactggctgccaactatcttttggatcatggccacgagtttgaggaacaacaatagatgttagattggtgttaccgtcgaaagacagaagagtcagtgacataagcagtacagtttggtgtcgttcttatatcttgctgctgaatatcactactagtacttgtcattagtgcgatgctgctgactttaaatttcttgtatcctggaaattctttctaagtacatatcaatatcaatattcaaaccttggtgccggtgtgggtgccggtgctggtgcccttgatgcattgcgacagcttccacagttccaagcactgcttgcattggtccaggctaatccccaaatcctgcagccaatgcttcaagagctggggaaacaaaatccacagatcctgcggttgattcaggaaaatcaggctgagtttctccgcctggtaaatgaaacacctgagagtggtgctggcgggaatatactaggcgcgctagcagctcaaatgccacaggcagttcaagttactccagaagaacgggaggccatccagcggctcgaggggatggggttcaaccgtgagcttgtgttggaggtcttctttgcatgcaacagggatgaagaactggctgccaattatcttttggatcatggccatgagtttgaggaacaacaatagatgttagattggtcttgctgttgaaagacagaagagtcagtgacagaagcatttcagtttggtgtcgttcttatatcttgctgctgaatatcactgctacttgccattagtgccttgttgctgactttcaatttcttgtatcctggaaatgctttctaagtacataatatcatatgcaaaccttaaataaaaaaaaaaaaaaaaaaaaaaaaaaaaaaaaaaaaaaaaaaaaaaaaacaaaaaaaaaaataaaaaataaataaaaaataaaaaaaaaaaataaaaaatcacaaaaatataattaaaaaggccgtcattataaaaaaatcatgtcagggaaaaagccaggggtaaac

SEQ ID NO: 5275 - DNA, 1159 bp, Triticum aestivum
  unsure (1)..(1159): unsure at all n locations
  Clone ID: PAT_TA_5275
ctgcaggnaattcggcacgaggaggacatcggccctcgaaatccccaaccgcacggcggctgacgaacggactgcccggacggcgatgaagacggtgagcctcggcgccccgcgatcctccactgtgaagttccgcatgccgacgagggacaacctggtgccgatacgcgtcgacatcgaggtggacggccagcgctacagggatgccttcacctggaacccccgagatcccgactcggaggtcatcaccttcgccaagaggacggccaaggagctcaagcttccggccaccttcgtcccacagatgctccagtccatccaggggcaattggcagagttccgttcctacgaggggcaggagatgcaggtcaaggagaagattatgcccctcaagattgacctccgagtgaacaatacgacaattagagatcagttcttgtgggatataggcaaccttgaaagtgatcctgaggaatttgcaaggacgttatgtgatgatttgaacattacagatcctgaagttgggcctgcaatagctgtttgcatccgtgagcaactttatgagattgctagccagactgtttctgctatgagagaagctaaaatgtcaaagaaaaggcgagcaccagaatttgcttctaatagtaaagccatgaacaacgcagtggacatgttcaagtattttgggagcaaaggaagtgtcattcggaaaaggaaggagtggtacctgtacgagcctgttgtagatgtcgtgcctaaagaggaagctgcggttgtggatgcaaaggagcagctgaaataaactctagacaaaccaattcccttcagtctgtgttccccaagcgtcgggcgcaggcgttggtgcgaaccctgaagcgaggaccaagattgccgagcagcagctgccaaccttcccttccttcctgcctgtcaacgagttgtatgtaggatccccttcgttgtacacagcttgagcagcgtgagtgctgaggtagaatgggcttgctcggtaaatacttgccctgctttcctccaccccgtcaccgaggatcatatcatgtgctgctgatgttgactggaaacgagaccgcaccgtgcctgttgggaacattctgttgtgctaatagtttcagctgtcaatgtcaatcaggaaacaata

SEQ ID NO: 5276 - DNA, 900 bp, Triticum aestivum
  Clone ID: PAT_TA_5276
cactggatcactaccactactcctagccttcttctagtggcagggctctgcttctctgtccagatctggttctgtctccttgtctctggaggaggaagagggccaagaggaggaaacaaggagccggaggaggagaaggagaagaagcgggatggtgatggtggatggcagcttggacgcagagaagatcgcagggtatttcaagggcaagaccatcctcatcaccggcgccactggcttcctcggaaagattcttgtggagaagatactccgggtgcagccagacgtgaggaggatctacctgctcgtgcgagccatggacgcccactccgccaagcaacgcgtcgaggcagaggtgacagacactgagctcttctgcctcctgaaagagaagcatggcaagggaggattcgagctgtttgtggaggagaaggttgtccctttggccggtgacgtcgtcttcgagaacatggggctagatgctcccaggttggaggagctggccaacgaggtcgacatcatcgtcaatggagctgcaacaaccaacttctacgaaagatatgacgttgcgttggatgtgaatgtgatgggggtgaagtacctgtgccagttcgccaagaagtgtgccaatctcaagatgctcctccatgtttccaccgcatttgcagccggcgacagggaagggctgatcatggagaggccgttcaagaagggggagaccctgagggaaggcacctacctggacatcgacgccgagctgcggctgggcggcgacgtgaagaatgagctagagcggcaggacggcggcgacatgacgaagagggagcggaaaggcatgaaggagctggggctggagcgctcccgccacttcgggtggtccaacacgtacgtgttcaccaa

SEQ ID NO: 5277 - DNA, 681 bp, Triticum aestivum
  Clone ID: PAT_TA_5277
ttgaattcggcacgagactcaatgtggtgctgggatgtgtgttggagtaacatatctgtaattgcatgacactgaatgtgtggagtaacatcttttacatctctgctttggtcaaaactgaatgttgattgcttgcatcatctactctgaatgattctatactgacaacttcagcatctatagactttgtgttgcggcagcagctaaaaaccctacatcttgtctctctgttcactgaattttcagtgcactcatggaagcatgcattctctaatcaattaacagcgacaactgattcctttggtctgtccttcaaaattatcaaatgcattgtttggaatccagttttgtgatttggggaactataaatattctgattatcaactttatgcgtcaagtttgacatcaacttgactgaatatcaacttgacagatcaaaagctgacaaaaattgacaggttttgagcatcaagagatctgaatgcagttaacttgtgttgaaaagttaactgaatttttttatcaacattgcaccatttcagcatgacaactcaactcaactaacctcaactcaattcagcaatcatcttgtaggttcaggaattatctttgcaggttctccagacacaacaataatcttcagactcacaccactagttgaacagcagcagcagcagaagc

SEQ ID NO: 5278 - DNA, 581 bp, Triticum aestivum
  Clone ID: PAT_TA_5278
cttgcgggggtgctacataaaaccggttggataccacttgactattaaactatcaattcactgaggtgacattctctgtaatttcacattagtttataattccaatccacaaatgcagccaatgtgtcttcctcctttaactgctttgtatcatttcaggttgttcacctttggttactccagaaatatttttgtcctactccctccgtccaagaaaagttgtcctcagcacagggtatttacttttttgcaaaaagaccctcagagttttaaacccgtcacgaataactccatcttcttccttcgtgctccccagtcgcccgcgcctcgcagccatcctcggcttcccacctgcgccgccgcccgcctggacctgcgccgcgacgaacaccagcgccgcccagcgcgcgaccaacaccagtgccgccgcctgcagcccgcctggacgtgcgccgacgcttccacctgcggcgcccgctgcgaaggcaacctgcgccggcgcccgcctcgagctgcgccgccagcgccgttgaatctcgctgcaacggtcgcccacctgcgctgcccgcggtatcccacct

SEQ ID NO: 5279 - DNA, 1120 bp, Triticum aestivum
  Clone ID: PAT_TA_5279
ttggaatgaatatccttgttgttttttttttctttcttccttttcttttccttgactttaaaacatcaccacttaattggtattatcaaaaagtagagcaatctctgcaactaatgtagctaactctactctcataaactcacggactacatacacatagcgtaaaccaaaacttacaatcatcacttacatggaagaaatcttacaccgtgcgcactggagttcatgtctaagccgtgccgttgctggactttggaggtaagaaggcctcccaccatccagactcgtatttggggtatggagctgtccatttgtcaggcttatcgaatttcaactctgcagggttagaagccaatgcttcttcaggtgtctctgcatcgaattgctccgctaagaccctgtccagccttagtttcatgaatctgatccagttgcggtcggtggagacgagcgcgacggcggggcgcttgagccgcttggcgacgttggggaacctgtctagaaacttgggctcgatcacaagccagaagtcctgctccttgctgcgctcctcgtagagccgcagcttctcctggagctgctcctggaagtgttcttcgtcgtccagcatgaacttggcgttcgccaccaggaagtagtaggtccgcgacttcccctcctgtttctcggaaggctccgcggagccttgccggtcggatacggcggtggcggcgcggcggaggctctcgaagcgcgtcggcgggcaggagacggagagggctggacgactagcgggggcgaacccggcgtgggcgtgggcgcgggggagcgcggccctggacggcgcgagggtcgcgcaggggcggagggacagcgtcgccggagccaccattggctcggtggggtctaactgaactgaatcgtagaggatagaggaacggaagaagatggtacggagcagagagccttatctggacccccgcgcggggaacgcctctacttcgcgctttgccagtgaacttcaggggtgaaatatgggccggagtacggcgatgtgggcttgtcgactaggatcttcggcatgtactacttcttttcctggctgactgagttccggatctcacagtcccctgtcactcgg

SEQ ID NO: 5280 - DNA, 469 bp, Triticum aestivum
  Clone ID: PAT_TA_5280
gattcggcacgagagagaatctaatctttggccctcaacaaaaagagcaaagtgacggtcctttccctccggttcctcgtttttgtagtattccgccattcaagtctccgccttcccgaggggctaccataactcactcagagacaacaaaagagaagacatactccttcgggaggcagctgcgtctgcgtgcaggccgaacgtcaccaaggcatgggggacgccgcctccaaccatcccgttcttgcacagtcgagctcggacgccggccacgccgccgggaccggtgggttcatcgccctcgacgtggccgccctctcgtcgctcgccggcgacggcccggaaacgacgccggcagcgccgccggcctcgaccccgaggacacctagggtggtgaggtcgctctcgcggaaggggtcagaaaggaagcaggccgacggcgacgccgccactggcaccacaggaggcg

SEQ ID NO: 5281 - DNA, 1197 bp, Triticum aestivum
  Clone ID: PAT_TA_5281
cgttcgtcgcctcgtgcgcatcaccagtccaccgcaatccccatttcccaaagctcgaccaaagccccccgcctccccctcctcgccgcgcaccaaaccctagctatccccgccgatcccaatggccacccaccaccggcccctccacgccctcctcggcggcggcgcagtcgccgacctgctcctctggaggcggaggaacgcctccgcggcggccgtggccggcgcctcggtcgtctggttcctcttcgagcgcgccgggtacagcctcgcgtcggtcctctccaacgccctcctcctcctcgtcgtcatcctcttcttctgggccaagtccgcctcgctgctcaacagacctcttccaccacgtgcctaatctagaggtctcagatgtggttgttgagaaagctgtagttcgggcctcttgtatgggtaaacaaggtgttggctgttgcccatgacattgccatcaatgagcggacaatactgtttttatacaggttataatggctctatgggtggtttcatgtattgggatgctcttcaacttctttacgctcgttcactgaggaatactactcgctctgttgtgtccgcctgtacaaggtgttggctgttgcccatgtcattgccatgaagagagaccgtacagtttacttacaggtcatttgagtaccatgggtggtttcacagggcggccacctaaacaaatgaagtccgcttagaaaaattattttggcccatttggaagttctccccccggcctagcgcaggcacccgggtcctatgggtgtataggccggtttcccacccaccgttcagtctaggcacgggtatcccggcgtttgctagtcagggcaaccacctatgcatttggatgctacgttcttcaagtcttgtgaaacggattgatttgtatattatttccatgaacatgaaacttgccgaggtttacatgttgcggataatgacatataccttgtctcgctctggatatccagggcataatgtttaactgctgatacgtgggtttagatgcacgctcttcagtctgagaaatggaatgatctgtatattgtttccatgaacatgaaacttgtcgaggtttacatcttgtggataatgacgtataccttttctcgcaacatccttctctatgactacgtgtgatgtcgtgtcttgcataaaaaaaaggggggg

SEQ ID NO: 5282 - DNA, 377 bp, Triticum aestivum
  Clone ID: PAT_TA_5282
gaattcggcacgagtacttgacattttttcagatcccagatttggcagttccaggtgcatcagttgcacacatttttttggtgtatatgtgtttctgtgaattttgtaattgccattagcccaaccccagttagcagttctaggtacaatagttgcacgcattttgggatctctgttctgtggtttttatatttgccattggaccagttcccagttggcagatctaggttcaatttgcacacaactgggatctgtgttccctgcattttctatttggcatcacccatatcccagttggcagatcaagggtccagttgccacaggatcttcgaatcgtcctagcggaggggccctgcgttttctatgcattgcttatc

SEQ ID NO: 5283 - DNA, 560 bp, Triticum aestivum
  Clone ID: PAT_TA_5283
gctgaaatctgagatgggctctaggcccatattgcaatttctgaaaaatctctaagggcccatgtgggttatatggcactaggtgtgtgggaagtttagtcccaccttggaagtggaaggagagttggagtggtttataagggactctctccctcatgctattggagcttgagaagagatgaggccctcgcgcactcctcctcctccgctcgcctcgccacgccacgcctcgtcacgacgcgccgcgccgcgggttgcgggattgagccgagccgagctcactcctatgcgcttctttttgccggtcaggaacggagagtctttgacaggtggggccacgatctgagacgtcggatcgtgggctaccgacttggacgtgggttcagcccacgtctctccacgcgcggccgcacatatatatgtggggcgctgccaaccctagccgtcacgaaacagaacgcatctccgcctccacgcccacgtcgttcctctgctgctgctgccgccggcgactccgtcccgttcaccgcgtacacggttgacgggagagcaggcctccg

SEQ ID NO: 5284 - DNA, 529 bp, Triticum aestivum
  Clone ID: PAT_TA_5284
tttttttttttttttttttgggcgttgcttatcaagccaactcttaattaataagccagcaagaacaaaatgacgctgtatgtgaacaatcaaatacacgtagaggcagtactgctacaaatagtgccaactgaatgcaaacttttattgtactagttcttaaaagactgaatgaataaaggaaaggaggtgctgcgtttctgaaagcacatgcaggagaagtaaatagctgatcatgaacaatcatgcggaagcctccatctaacaaagggcagaatctgaacatacgttggagagaataagccttcgtttattgggagttccggaggtacaatgaattgttggtgattgcgacggcacagtgaattgtttgttgcctatcgaaatgttggaacagcatccacggcaactgatggaagtacagtacctgactccaggatcttgttcaagcccttactagcggcaaaggcatgtcagcactcaacagtcaaggatgtcaatggtgggaagttttggatgggcttgtgct

SEQ ID NO: 5285 - DNA, 1175 bp, Triticum aestivum
  unsure (1)..(1175): unsure at all n locations
  Clone ID: PAT_TA_5285
gaattcggcacgagacgaggtcttgcatctgatggccggcgaggagccgaccacattcgcggaggccgagcaagaggattgctggcgccacgcgatgctggacgagctggcgtcgatcaacgacaataccacttggacactcaccacgctgcctgctgggcaccgagccatcgggctcaaatgggtcttcaaggtgaagaaggacgagcacggcaccattgtcaagcacaaggcgcgcctcgtcgcaaagggctacgtgcagcatgagggagtggacttcgaggaagtattcgcttcggtggcaaggctggagtcggtgcggctcatccttgccgtggccgctcactgtgggtgggaggtacaccacatggacgtcaagtcggcgtttctcaacggcgaccttaacgaggaggtgtacatctcccagccacccgggttcgttgccaagggccacgagcacggcgtgtatcgactacacaaggccctctatggtctccggcaagccccaagggcgtggaacgccaagctcgatgcaagccttgcatcccttgggttctcacgcagcgcttctgagcacggtgtgtactcgcgtggcaccgcgaacacgctgctcatcgtcggcatctacgtcgatgacctggtcatcgcccgggcagagcctgaagaggttcaacgcttcaagggagagatgcatcgtctcttcagcatgagcgacctcgggctgctccggtactacctcgggctggaggtgaaccaggagggtggtcgcatcacgatcacgcagacggcctacgccaccaagatgctcgagcgagcaggcatgaaggactgctatgctgtgcatgctccaatggaggcacggctgaagctcagcaaggatagctccgnagaaggcggtggatgctacgctctaccgcagcatcatccggagcctcaaggtatctcctgcacaacccgacctgacatcacgttcgcggccggggtcccgggttgcttcatgggagccccggcagccgttctccccgcggccgccctgcccctactccggtactcccccggttcactctcctgtggctgcctgtctcgccgtgggcatcgccagcgctgactcccgccgcagcgctcgccnaggtcctccggaantcatcactgaatctagnaaagnttccnattnt

SEQ ID NO: 5286 - DNA, 700 bp, Triticum aestivum
  Clone ID: PAT_TA_5286
gaggaattcggcacgaggctcgcactcgtcgccgcgcctctccgtcgcccgcgttgccggcgcctctccctcacgcgtcgtcgccgccactccattggccctctcgtcctcaccccttcaggaccccatttttactttccgacaggtggatccgaagcgcggcggctcgacctgcaacgccggcagctgcgggctttaatctggagctccatggcgtcgcacaagtgtggcggccagatggagcggattcattgctcctgcgtgcaccgggcgctccgcggcctcatgttcagcagcagcaacaaggccagcaacggctggagggaggtgcagggcaacttcatccccttctgctgttgcccaatgtcgaggacggtccaggagccgccgctcgtcctggcggtggacgacagcctcgtcgactgcgtggtcatctcctggatcctccgcagctccaaatacagagggggtcacgtggccgcagccctggggccctccgaatggtctcaagcatactccctaaaacatttggagtacatttgttggttgaagtaccaagatattggtggaacttcattcaaggagtaaaacatttccagtaccaagattgcagtaaattttgtggaacttcactgcttgagaccatgttaatgatgatgcttgtgcagtaccaagattcagtatcagtagcccgagtgtt

SEQ ID NO: 5287 - DNA, 1298 bp, Triticum aestivum
  Clone ID: PAT_TA_5287
ccgcgcgcgtgggttccggcgaaaaaaaaaaaaaaaaagcgaagtcttcttcccccatgtccatggtccggcgagcacctatcttatctcgtgagggcggtcgcgatgatgaccatggatctgattggaggatacgggagggcggacgagcaggtggccatccaggaggcggcggcggcggggctgcgcgggatggagcacctcatcctgcagctctcccggacaggcaccagcgagagctcgccggttgggtcgtcggaggcgccggagcagcaggtggactgccgggagatcactgatatgacagtgtccaagttcaagaaggtgatttctatcctcaaccaccgcactggccacgccaggttccggcgcgggcctgtggtggcgcagtcccagggccccgccgtgtccgagccggcgccggtgagggcgtcttcgtcgaggtccgtgaccttggacttcaccaaggcgtcttctgggtacggaaacgacgctggcttcagcgtctcggccgcgagctcatccttcatgtcgtcggtgaccggtgacgggagcgtgtccaacggacgcgggggcgggtcctcgctgatgctcccgccactaccttcggccagctgcgggaaaccgccgctggcgtcctccgcggcatccaccggcgcgggtgccgggcagaaacgcaagtgccacgaccacgcgcactccgagaacgtcgccggcggaaagtacggcgcctccggtggccgctgccactgctccaagcgcaggaagtcccgggttcggcggatgactcgcgtgccggcgatcagctcgaaggcggcggagatccccgcggacgacttctcgtggcgcaagtacgggcagaagcctatcaagggctccccctacccacgaggttactacaagtgcagcacggtgcgcgggtgcccggcgcggaagcacgtggagcgcgaccccagcgacccctccatgctcatcgtgacctacgagggcgagcaccggcacacccccgcggaccaggagccgctcgccccgctaccggagctctgaaatctctttgccattaccgtcgtcctcacatgttaattcaacttagcttatcaccatgttcccttcgttactgctagctaccatatattactactaataagcaagtagaatttctttttcttttggccgcatcggtttagtcgcactaagcatgttgtaaaagaacatgtgtagttggaagctttgagctttgaagaagaaaaggtgcgtggtagacaagaaggaaaaaaaaaaactcgagactagttctc

SEQ ID NO: 5288 - DNA, 931 bp, Triticum aestivum
  Clone ID: PAT_TA_5288
agcggttggtacccccagctgaaatggccggcattcattttctgttgcgctcacagatccaaaatcatcatgcttgtggtctaacaaagcattcaacccaagccaaatccataatgttgcagtttatatggaactacagtctgtagtactgatctagctattaatctgtagtactgatctagccgaataatccttcagtatacatgtctgctccgtgtatgcacactagtgatcataagtaaacacgatgtacaacatggccaaacctggaagaaattcaacaactatttttacactagaatacaacatgtcaaggcaattctgcattgaccgactacttggctagctgccaggagctgcccttgatctgaaatcacccaactcagcagcttcgtcgacttcatggaatgtattgacgtacaggtcaggttgcctcgctttattggaagcctcaagaaccaattgataggcgagttggcttctctaaggtggatgaccaatatcttgctgctcgttgatgggtgtggagaccaccattgatttttgacgctcacgctgtgcttctagccaattgctcaaatctctgagtaataacttgctggtttccacttgtatatacattgagcaaggacactacagcagaagataacataactttctgtgacacatttgggctgaaaccatcctcgtcatttatggtctcgcttgccagaggctggtcctcggcactattgaatgctgagcataaacccttcagccagtcttccagaaaggatgctttcttgataagaaaatctttcaggctttggtcatccttcggtgaaacaaaaccaagcaaatgcagagcagtaaacgtaagctgtttctcaaggttgtcccggtgtttgaaatttgaaggcgatgatgaactgttcgacggacgcgtgggtcg

SEQ ID NO: 5289 - DNA, 689 bp, Triticum aestivum
  Clone ID: PAT_TA_5289
tgccgcatcacttgctcagcagaagtcaagtgtcgtagttattcttcttcattgtatagaagaggaaatgcatttcagtgttaggtgtggagctctccaggtgttgagatcagtggttcataattacccaagctgtgcaaacatcatttgggaaaaagttcgagatatcgttcttgatttattgcacacggagagctttgaagaccaaaaatgtgatgctaactttggcccccctaaagaagaattatctactaaaggaagatgtcttgtagctggtattaaggtaattgatgagtgtctgcgtgtttcatctggattcaagggtgcggatgatctcaaagagtgtagattgctggatattcagcaattttcagactgcactgtaaataaaagtattaaatctgcgcctcactttgaaattgaaacccctggaccatcacaaaactgctctttggacattacacttggaaccaaccgttggactgaggtgttagaaactcatctccctcggggattatcacatgcctctgctatggtcaggacagcatcactcacatgtttcgcgggcatgacctctgatgttttcttctccctaccagtaaacaagagagattatgtgacctcctcatctgttcatgcagcattgagtgatgcagttgctacagtgaggtcggctgcatgtcgagcca

SEQ ID NO: 5290 - DNA, 743 bp, Triticum aestivum
  unsure (1)..(743): unsure at all n locations
  Clone ID: PAT_TA_5290
gccgttattccttccttatagagacagcgtgtaggcgccgggcgagcaggccaccaccgcaaccctagccagcccaactaccggcgtcggctggagaggactagctgctgctcgagagagagagagagagagagatgtcatcgggacggtacatggcctactcgccctccccgtccaccacgccgcactccccgcgcatctccggcctccgcgcctnctncgccggcgtcgacgaccaggagaagtaccttgcggagctgctcgcggagcgccacaagctcaacccgttcgtcccagtgctcccccatagcatacggcctggggaatcgtcggagctgaccatgtgatcaaccaggagacggaaactgagtatgcctatgggtttgccttcgtggctaatggcgcaaaaaaggtctggtctcgcaccgctagcgtcggagcagcccgtacttgataatacatatgcctggagtcgtgttcgctgctactggagaggtttggttatggcaagactgggtgtctattgtcgagctatatatcgggttgtgcaagaagtggtttgtgtattgctatgagctatgactggggttttgatttaaggttcttgtgcttgtatttgaacttttgaagaatgttatctgattatgttatttgggattgaaatgatgttgtaatttgttacagttattgtattgcttaataatagatcgatattgtaatatataggtgctggtatttgcatt

SEQ ID NO: 5291 - DNA, 1557 bp, Triticum aestivum
  Clone ID: PAT_TA_5291
cacctgccgcatccgcgccccgccccccccgccgccgtccccgccccccgccgccgccgccgtcccttccttgtagagacagcgtgtaggcgccgggcgagcaggccaccgccgcaaccctagccagctagcgagcctaacaaacaccgccggttggagaggactagctgctgctcgagagagagagatgtcgtccggacggtacatggcctactcgccctccccgtccaccacgccgcactccccgcgcatctccggcctccgcgcctcctccgccgccgtcgccgaccaggagaagtaccttgcggagctgctcgcggagcgccacaagctgaacccgttcgtcccggtgctccctcatagcatacggctgctgaatcaagaaattttacgtgtttccacactattggagaacgcctcccttttaaaccaaagtggctttgaacatggtagtccactaacattgggaggattatattcaaatggagcagcaactgatatgaatggatggacatcagcatttcaatcagaaagttcatcagcttatagttggcttggaggttctcaaggcagctcatctggactaattgtcaagaaaacaatgagggttgatattccagtagacaaatatccaacatacaacttcgttggtcgcatccttggtcccagaggaaattccttgaagcgagtggaggcaactactgactgccgtgtgcttataagaggccggggtagcattaaagatccagctcgggaggaaatgatgcgtggaaagccaggatatgaacatctgaatgaacccctacatatattggttgaggcagagctgcctgttgaaattattgatgctcgtctgatgcaagcccgcgagatccttgaggatctgttaaggccaatggacgagtctcaggacttcttcaagaagcagcagctccgggagcttgcaatgctcaacggcaccctccgcgaggaagggatgcaaagatctggttccgcatcccctttccacaacagccttggaatgaagagggccaagacaagggggtaaaaggccatgagtaccatgggagaagcaatcatctgtcctgagacggaaactgagtatgcctatgggtttgccttcgtggctaatggcgcaaaaatggtctggtctcagcaccgatagcgtcggagcagcccgtacttgataatacatatgcctggagtcgtgttcgctgctactggagaggtttggttatggcaagactgggtgtctgactgtcgagctatatatcgggttgtgcaagaagtggtttgtgtattgctatgagctatgactggggctttgatttaaggttcttgtgcttgtatttgaacttttgaagaatgttatctggttatgttatttgggattgaaatgatgttgtaatttgttgcagttatagtattgcttaataatagatggatattgtaatatataggttcggggtattttcgggtatttgcattattccgtgcaacatcctttgtgacgttgtgaaggtttggacgtattaatctatagtttaactcttaagt

SEQ ID NO: 5292 - DNA, 1393 bp, Triticum aestivum
  Clone ID: PAT_TA_5292
gaattcggcacgccccatccttctcctccggccccgtccgtcaccgcccacaacccccgaaatccctccaccgcactcccggagctgagcctgccgccggcgtcggcgctgctcgccacccacaaagaccttgcaacaccacggcggccgtcttgccctctcctacgcagaagcgagccaccacgggcgtacgtgcggtagccagccatggccgccgcctgccgtttcgccgcgccgctgggcctggccccgctgccccgcggccgcaacgtcgccaagggcatcgctttctcggcaggctccgccaaggccgctccacggggcgtcgcgacgaaggcggcaagcgggacgtccggcggcgaggagacgccggaggtcgtcggccccctctactgcactggcattatgaagagagcagaggaggttctcctttcaacacaagtagaagaaacttccggtcccccttctgacaaggatctaaagagaaatatgaacttgctgcagcaacttggtatacttccttgtggtgctacggcatggttgagtttcgcacagtcagcacagtctagtgaaggagtaaagttaaatatggtttacgaggttggggagctgtttgagctgggaattcagctttcgtatctgctcatactacttggtctgcttggaactggtacattttttgtcatccgccaggttcttgtccgcagagagcttgatctttctgcgaaagacttgcaggaacaagtgagaagtggtgagggaagcgctactgaactttttgagcttggagcagtcatgctccggagaaagttttaccctgcagctttcaaatatctacagcaagcaatccaaaaatgggatagagatgagcaagatcttgcacaggtgtacaatgccctgggggtgagctacaagcgggagaacaaactggacaaggcaatcaagcaattcgagaaggccgtggagctccaaccaggctatgtgacggcgtggaacaacctcggcgacgcatatgagcagcagaaggacctcgcgtcagcgctcagggcgttcgaggaggtattgctctttgatccgaacaacaaggtggcaaggccgcgccgagacgacctcaagtcgcgtgtgggcatgtacaagggggtgccggtgaagacgacggacaagcgatagccgccacaagggggtggacggattcgtgcctcagttttgaacagtagcatctgtaaacatgatgagaagtttgtatgtagcatattggtgtctgtcatacgtctgcgctgccggttgtagaatgtttggatgttagcacaaaaagtaagatttgcttccgagtgaggtccgctccaagcccataacagctattttttgcgcttgctaacaaataaattatttc

SEQ ID NO: 5293 - DNA, 596 bp, Triticum aestivum
  Clone ID: PAT_TA_5293
gaatcgccgcgccacagaacggtgatggggggagcggagcacgcaatggattctgtggccgtcgtggcggtgccgttcccggcgcaggggcacctcaaccagctgctgcacctgtcgctgcagctggcgtcgcgcggcgtggacgtgcactacgccgcggccgcgcagcacatccggcaggcgcgcacgcgcgtgcacggctggggcgaggaggcgctccggtcgatccagttccacgacctcggcatctccagctacgtctcgccgcctccagaccccaccgccgactcgcccttcccctcccacctcatgcccctgttcgaggcctacaccgccagcgcgcgcgccccgctcgcggctcttctcgaggacctatccggttcctgccgacgcgtggtcgtagtgcacgaccgcatcaacgccttcaccgccgaggaggccgcgcggctgcccaacggcaaggcgttcgggctgaactgcgtggccgtgtcgatgctcgtcggaagaatcgacaccaaccaccggctactgcgtgagaacggagttatactcagctacgtggagcgctatgcgacctatgagttcatagagtgacg

SEQ ID NO: 5294 - DNA, 641 bp, Triticum aestivum
  Clone ID: PAT_TA_5294
gagaaaccccacagaccgctccagacccccccccccccccccccccccaaccccgccgcccacgccccccccccaaagccccccgcccccccccccgccgccgccggtcgccatggagaggaagcaggccgactacagcaacctggacgagaggtacaccatccagggggagaggtaccagggccagcagtacagccacatctactacacccgcctccaccacatgcgcaccctcctccacgccctcgtcccctcccggaagccgcacctccccgtcactacgagtgcttggactcgaagaaggcaaaagattgtgtgcttgttgggactttatacaagcacatgaaactgaagccttctattctcgatgaatactcaaagcgagaggtcggcaatccctcttgttaagccacacaagttcatgcattctgacgataatcttattctgggagattgaagtgggagattgactctccccggagccggaccgccaacagcttctggcccctgagtttgtggagctctgcatgggagcgggtcttccgctcgcacctggctggcccacgttgttgtggacgcgggtcttcctccgcggtcggtgttgctgtttggacccgacattcattatgttgtttttgtgt

SEQ ID NO: 5295 - DNA, 943 bp, Triticum aestivum
  Clone ID: PAT_TA_5295
cgagtcggctcgtggcttgtcttttgttttcgtgaaaccgcgcacgctcccccatcataaaccaaatttgctattccataacatctggctcatcataaccatacacaggttctgcacaaccagtaaaaagtccacagcagcagcacaatgattacatgatgaaactcttgtcgtgcagcgcattcatcccaagttttcgctgagcgagaggccgtgcaggactcccagtgctacggcaaggcctcttctacctctggaacggtatcggtgcacgtcctggccatgtctcgatcttctcgaagtacttgacggggacaacgccgtcgaagccctccgtcagtatcaccttgttgtctgagatgtatagcttcatcccgtcttgcagtgcctttctgacattcaaatatatcaatatgtttgcgccactccgcataccactaataactcctccatctgatggtaaaccacttgagaaatgtacatgtagccttgccatacgtttaagcccatgtttcaatattgaatcaacatttttcctgtaagttccatggacacagactgagacttcatcagccgatagaattggtttcaacaagctctctgatgtaacagttgtcacagtgtgcccctggttagctcgaatcagcagctcgccgccctcctccaacagaccaaacctctgcttgttgtctcgcctgaccgcctccctgatttcatccaccgtgtgggagttgagcggaaccttggcgaaggtctccaggttgaggcggagcaggtcgcggacccgcacatacccgtcgctcctcatgttcagcctcagctccggcgccatgtgccgcaagaccctcgtcaggaggcggccgagggcgtcgatgcggtttccgccgtcgccaccgccatcgccacgtccacccggtcgcctgccaccgccacggccctcgtc

SEQ ID NO: 5296 - DNA, 906 bp, Triticum aestivum
  Clone ID: PAT_TA_5296
taggttatgacatgaggtggtttaggacacgatacacattgtatacaaagcacgcaattcctgccagacttccccgcccggcttacagaacaccacatgcaagtttatgtacctcttctctacatatcctctcctcggctggaccagccttgcctgatccattaaccccgcgctcctaccatcacgtactgtgctgactgaaccccactgtcttaacctgacgccttccgtgcaagtgcctaccagaatttgtatccgtgatcatctacattggctcactggtcatctgaagtaaccggctttgacaaaaatgaattccaattaggctttctcaccttagtgcacaatgcgcttcctctttgacctcttgcccttctttccagagtaagtagggagcttcttgtcgttgccggtagcgaatgtttcctctacaggtcccccctcctctgtaagtatcaatcatctgtactgctttcatccgtcttgatgtagttgaaccatttgaatctcctgcaccaagtgctttcacacgcttttctcctgttctcctcttcttttagctgcttaaacctttctcccaccctggccctgattgagcacctgaacgttttgctcgtccaagcagttataaattccgcttgctccctcattcatagcacgctttgctccccccaagtttccgcaaccccatatctggctggggctgtactgacggacattggtttgtaaacaaataaatggacaaccccgatggcaccggacaaagagaagtaaccgttcataaatggaagaaatttcaaaataagttgtgtattcttctgcgatggatcagtactctggggtggtttcatgatctccatggagacaaacacctcggccgcgaccacgctaatcactagtgaattc

SEQ ID NO: 5297 - DNA, 682 bp, Triticum aestivum
  Clone ID: PAT_TA_5297
caacttttgaggtttcttgaggtgattgatcatgccgctttgctagatgagatcaagcacacccatctcttttccaaccccacactcaaatcacaatcttcctttccccctcctgcattacttggaaaggctaatcttttccgttttgctttgatccatccctctgctctgctctgttcggtgccactgccagctttggcaaagccccattattgccctctgccgccctcgcctactcgtcagtactcacctcgcctgggtagtacttgctggctagcccgccgtcaatgcccgccccgtgaatctctcggctcgccatcactgggaatctcccatcgcggtcgagcctaggtggggttcgccagggcttcatttattgtttcccccgcaaaagattcaagctccagctcgtgggtggagctctggtagctcggggattcgagcgccttcttcttgagttcttggagcctctggcgcctgcgcctcccctctctttccggtgagggtttcagctccgagcttcgatttcagtgtcttctgggacgttcccggcaagatcccctcttgtattgcctcgccggattggttcatccaagatctgagcccggagcaagcgaggagcccaagatttcatctggagctgctgctgttggggtcatctgctctctgtccatgggttctc

SEQ ID NO: 5298 - DNA, 801 bp, Triticum aestivum
  unsure (1)..(801): unsure at all n locations
  Clone ID: PAT_TA_5298
cggacgcgtgggcggacgcgtgggcggacgcgtggggcgcccatgtccatgcaacaacaacagcaacaaccggcgcttgccaaccttctcggcgcaatgcctgcggcctccatgatcagcctcgccttcacggccgccgtggctaccgcggccttattcgtggccgtcgctgtggcgaggtacaaccgcaagtaccgggggctgaggctcccacccggcccgcccgggtggcccatcgtcgggaacctcttccaggtcgccttctccgggaagctcttcatccactacatccgcgacctgcggcgtgagtacgggcccatcctgacgctgcggatgggggtgcgcacgctcgtcgtcatcagcagcgccgagctcgtgcacgaggcgctcgtcgagaagggcgccgagttcgccagccgccccgccgagaacaccacgcgcaacatcttctcctccaacaagttcaccgtcaactccgcggtgtacggccccgagtggcggtcgttgcgtcggaacatggtgtccgggatgctgagcacgtcgcgtctccgggagttccgcccggcgaggcttcgagccatggaccggttcgtggcacgcatgcgcgccgaggccgcggcgtccgccgacggggcctccgtgtgggtgctccgcaacgcgcgcttcgcggtgttctgcatcctgctcgatatgaccttcgggctgctcgacctggaggaggagcacatcgtgcacatcgacgccgtcttgaagcgcgtgctgctcgccgtnnnngtgcgcatggatgactaccnnncgttc

SEQ ID NO: 5299 - DNA, 586 bp, Triticum aestivum
  Clone ID: PAT_TA_5299
gttctttatcttgatcatacacatttacatgtatgattagtgtacggtcaaatcggggcgtcgcgtctccgaggcacaggtcgatttttttttttcggtcttgatccttatcgatctcgtcttctgctgtctttcccatctggtatggcgcccgcctgctctatcccttccagagtccggactccctggttttgcaagattggccgctgctgggctgctacctggctggatcggtcccctgctggctcgcttctcccagatcgccactgacgcccctgctgccgcgcgcatcgcttgcctgctgtcccgccgctaggactccggttgaaggctgcgcctgcgtctccgccgcttctgcctgcccgtcgcctcttctgcgcaacacaccttggctgtgtccgctcctcagcgctgctctggtattcaggagctctgcgtgctacatcaagtacttcacaatcaggagaagcaagtacttccaatcaatcgcagaacgaccaataattgcaatggccaaacaatcaggatctctcagcacctcagccttttatttcacatggtcctgtcagctcaacaacaagcaaca

SEQ ID NO: 5300 - DNA, 1460 bp, Triticum aestivum
  Clone ID: PAT_TA_5300
gtcggcgcgtgaaaaacgcatgggagggcgcggctggagatgagcaggcggaaaggggtggttcagttgcgttcgctcgattgatccaaaaaaaaagttgcgttcgctcgatcgagcagcggggaaacacgccatggagagctcgccgcccacaatcaccgtccaggtgaagttcgccggccgaaccattccggtggaactcccgacatccgcctccaccgcggagctgaagctcctcctacagccgctaaccaacgttctcccccgcggccagaaactcatctgcaaaggaaaagttcttgccgacgccgcgagtctgagctcgatgcaggtgggggacggatccaaggtcatgctcatcgcttcgcagggtcttcatcaaggggaaggccccatcactaagaatagcagtggtcttgcaccaagtgcaaaaagaacctcaaatgttaaggataatcaaacactaaaaccggagattatcagcaaaagccgagcggagcgttggaaaataacaggtgtcattgctttatctggttccagcttgaaggctgtgcctgaggaagtctgggactgtggctcctccatacgagtactagatgtctgtaacaactcaattgaagcaattccacagaaaattgctgcagttaaatcattaaataaattgttgctaaccgccaatgacatatctgatgggggcatcagctgggaaggtctatcatgtgttgatacattaacagttttatctttaagccaaaatcgattggtcactttacctccgagtttgggcacattgacttttctacgtgaacttcgcattgcaaataacatgcttggcagcctacctgttgaaataggtttgctgaagcagctagagattcttatagcaaataataataggataacttcgctgccttcctctataggcgactgtgaatctctctttgaggtggacttatcatcaaatcttttagccgaactaccaaaggcttgcggaaaccttcacaatctgaaggctctgcatctaaggaacaatggtcttaattccctaccgccgactttattcaagaagtgctggcggcttactacacttgatctccatggcactggaattacaaatgacattcttcgacagatggagggctgggaggagtttgatgaacgtaggcggcagaagtatcaaaagcagctggattttcgtgtaggatcatcaggtgttttcgacgagggtgcggatgatgataaccggcatgcataattgtctttcttattacagacagggttttgcgcttccaatattgtcccagaattattctagaattgaacttgaacagacatggagctgatattattcctcacatttgggtcgtgtatttgtttattcctctcatttcattacattttaataccaagtgatgaaaagtggtggctacctgttaaacattaaaaaaaaaaaaaaaaaa

SEQ ID NO: 5301 - DNA, 574 bp, Triticum aestivum
  Clone ID: PAT_TA_5301
gcagtagcagtatgtatgtagtatgtaccaccagctttgctgcgaaatttgtacttacacccggcaaaaaagcatgccactgaaactctgaaagtgtgctgtgtgtttctctgcttcagttctaggatgtcagtggggttctagcttcttaggctacatacatacatacatacatgtgtgttcccttgtgtatgaacaatcgaaccgagagaaaatgaggcgctgcctagccagccgttcggggtcagcaggtccaagtagacgtcgaacccctgcgtggacacgctccgcttcagcttgtccagcgcccggttctggagctgccggatccgctccttggacaggccgtacatgtccccgatcacgtggagcgtcttgggctcgccgtcgtagatcccgaagcggtgctcgatgatctccttctccctcgtgctcaggatgcccaggaactcccgcacctgctgcctcatcattatcctgtccaccaccaggtccggtgggtcgatgttcgggtcctccgtgatctcctggaaggtgactgcgtcgttggaccagacttgatcctgcattgatc

SEQ ID NO: 5302 - DNA, 692 bp, Triticum aestivum
  unsure (1)..(692): unsure at all n locations
  Clone ID: PAT_TA_5302
gaattcggcacgagattttgttgacttcgtgccggagttggagatgcgtgatttgtgtgtcttcccgagcacctgttctgtagttggagatgcataatagatgcatgattttatggttgactccctgctggaggtggaggtgcgtgatttgtgcacctccccgcggcgctgatgcagttgcagatgcggtggttgcttcctgtctcctgtccacgggttgttgtagtttgggggattatgtagatgtgaccccccctgtaggtgcgtgattccctgaatttttgtgttctggtctattatgtcctgatgcttgctgcggtatgcagctgtgtagcttgcttttgtgcctaagatgtttgtatgatgttttgagttcaagcaggcatgtgtttttgagtttaatttcagtgtaatttgtgccagcgcattcagcgtaattttctgaaggaagttgggggattatgtacatgccccccttcatgtatagaacttttcagtgtattctagccaacttttatagtgtaatcctagggtaatttgtaccaagtttacagtgtaatttgtcctgcacttacagtgtaatgtacccaatgtttacagtgtaatttgtcccaaatttacagtgtaatttgtcctacacttacagtgtaatgtatccaatttttacagtgtaatttgtcccacaccttanc

SEQ ID NO: 5303 - DNA, 647 bp, Triticum aestivum
  Clone ID: PAT_TA_5303
gatcggagtgtcgttcggtcgactataatgcgatccaatcgcccggcccccccgccacgtatagcgcgagccagggcaagtacatatacaaattgatggattgttttgatacaaaataattagatgcgattactcaacgccctgattgcagatttgtcacagctttcttctcaatgctgaaatattgatcactgacaatcgtcgagtggaccattgccgagggttcctcaagtaagctttccatttcttcaggattctgttgcacccatggatggtgcatcaccttcctcagcctatcgagcttctctgcaacttccttcattgatggcctgttctcaccagacatctccaaacaatgctttgccagctccgcgatctcttcaagaatctccatattgtcctcgtccttgatcccatcatccaacataacctcaagcctattctccttcatcgcagacataaacatcattgataggctcttctcctgcccaagggcatcgagattaaatggcttcttgcatgtgagcagctccagaagaacaacaccgaagctgtactccgctcgccggtctggcacctggcgggtgcgcatgttgtccgggtccacggaccccccactgccgtgcaccggggtgacaaactgcaag

SEQ ID NO: 5304 - DNA, 650 bp, Triticum aestivum
  unsure (1)..(650): unsure at all n locations
  Clone ID: PAT_TA_5304
tgcctccacacnnctcccatggcccgcccccagtgtcctggggnncctccccgnnttccacgaaagganagcttagcgctaccaagccctccgtcggctgctttcttggtccgtcccggtcgtcaatcttcgtcgagcggagaggggaaggaggtcgtcagatttgcgcgagatccatggggaagtacgtggagctgctggacatgggggtgcgtatcgccgcgcggttccactcccactgcccgcagacggcccggatgtactatcaccctcccgcctccgcctcggccgcccccggcgccgtcgacggcggcgggatggtgcccggagaaggcgccgtggccatggccatgatgaagaggcagcggcgggccgccatcgacgccacggagattattctctacaccgtcgtctaggccggttgcttctgcgctcgtccggatttatcgtgccattgaagagagaggagaggtgttatcttcttttattgtacttctgttttacttccgaatcgagagagggaaatgaaagatgggagacaatgtttgattgattgaatgaacggattgaagaatttgcaagttaaattcgtttggtttctgatgtgattttgccattccactcaaaaaaaaaaaaaaaaaaggccccta

SEQ ID NO: 5305 - DNA, 817 bp, Triticum aestivum
  Clone ID: PAT_TA_5305
tgccagttcgggaaaagatatttcttttgttagatgcgacccaaacatcccttggtggagctaaaggaaagttcccccagtactatgaggcatattatgaattagtgtctgctggtgtgaagtttatgaatcgtccaaatgttgtcattacacaagtacacaatcctgtgccagaagcaataatagaaccgaataaggacaatctatctagcagatcgaatggtgttcaacaggaagctaacgtgcagcctgtttctgacacgagtataattcggaaagcatctagtgtcatggaagttctaagggatgtactaaattccatggatcctagacatcctgagggagcaacagatgagtttgtgttggatcttgtagagcaatgtacttttcaaaagcaacgaataatgcatctggttatgacatcaagggatgaagcggtggtatcgcaatgtatagaattgaatgaggagctgcagaaggttcttgtacggcacgatacactactttcagttcacccaactacgacgacagtgccatctaatctcaaggaggacgaggaggaagaagatgctgaaagtctataccggagactgcggaaggggaaggctttatcgcaagaccacatagacgagtccgtgccatcgtttcgatctatacccgaggagaagatgcgccgcgcgctcaccattcagccgcctctccctgacaggaaacccactgcactgaacatccgctcaccagaccacccggaggcgaggcctgaccctgctgtcttgattccaccgccacccgccaagcacgctgagagggagaggtt

SEQ ID NO: 5306 - DNA, 1159 bp, Triticum aestivum
  unsure (1)..(1159): unsure at all n locations
  Clone ID: PAT_TA_5306
gtccgcccggccgctctccccggatgagctcctctcccccgctctcctccacccctcccatggccgcccccagctcctgggcctccccgttccacgaaaagagagcttagcgctgccgagccctccgtcctctccacttctcggctgctttctccgtccgtccggtcgtcaatcttcgtcgagcagagagagggagagaggaggtcgtcagattcgcgcgagatccatggggaagtacgtggagctgctggacatgggggtgcgcatcgccgcgcggttccactcccactgcccgcagacggcccggatgtactaccacccccccgcctcctcctcggccgcccccggcgccggcgacggcggccggatggtgcccggagaaggcgccgtggccatggccatgatgaagaggcagcagcgggccgccatcgacgccacggagattattctctacaccgtcgtctaggccggccggttgctgctgcgctcatccggatttatcgtaccattgaagggagagagagatgctatcttattttattgttacctttgttttattttcgaatcgaggagagggaaatgaaagacgggagagaatgttcgattgattgaatgaatggattgaagaatttgcgagttaaattagaaaaaaaaaaaggaaccgaataaggacaatctatctagcagatcgaatgcagacctgctgggcgcgatcgtgctgctcctgtctctcgcgtgtcctctgcggactgcctctggtgtcgtcgatgtgccgggggtgggctgtcagtcagtcacttatcagtattatagttaatctgttttaggcgagagattgagggggcaggcagtgattggtatatacagttcatttttttgctctttattaatatggatgatcctcttgatgcttgcctggcgggagagatacaatgatctgttcggagagggggaggccgccttggcctcggccttcctagttcctactgacacccctgtacacagacttggttggcttgataattcttttccagttttcatgaataactgtggagagcctatccacaagcaggtcattgataatgggcttcttccgatacttgtcaaaatagtgaagaaaaagaaatttctttncccgaagtggcaattcctncttttc

SEQ ID NO: 5307 - DNA, 1653 bp, Triticum aestivum
  Clone ID: PAT_TA_5307
cccacgcgtccgcggacgcgtggggccgctcgtcccgtcccgtctcgtctcccccaaccaggcgaaaagccgcatcgcgaacggcaccagaccaaacccccgaatccgagccaaggagcaagggcaaaaccccatctgcggcggcggcggcggcgatggagtcggtggaggcgctcgtggcgcacatccagggcctctccgggagcccatggaagctggcgcagctccacggcctcctcaagcaggccgacggcgacgccctgcgcggccactccgccggcctcctgcccttcctctcccacctccaccccggctcccactccctcggctacctctacctcctggattctttcgtgtcgtcgtctgctaatctgagggcgcacgccggcggggaccttcttgtgaccgttgccgatttcctcacctcttgcccggcggccgcggggaccttgttgccaccgtggccgattaacgcgtgtagggctcggcagaccagatacgcgtggccgcccgacaaatttatgaatgtgtgtagggtgctcaagaacgaggtcatgcagctcaatgcgccgatcagagggattgctccgctgcgggctgccgtccgcaagatccagacatcgtcagagcagcttaccccactccacgcggaatacctgatgctgtgcctgctggccaagcagtacaaggctggcctgagcgtcctggaagacgatatatttgaagttgatcagcccaaggacttgttcctttactgctactacggggcgatgatatacattgggctgaagaagttccgtaattactgtcggggcttacaagaagtatgtcctagtttcgcttcttcagagtggacaggttccgtcattccccacgtacacatcttcgactgctcaaaggaatctgaaaaatcacactcagatttacgtcgatctgtctacatgctatggtactggtagctactctgatttggagacattcatccagtcaaatgcagaggccttccaaactgataacaactttggactagtgaagcaagtgctctcttcaatgtacaagcgaaacatccagaggctgacccagacctacttaactctttcacttgaagacattgccagctctgttcaacttaacaccccgaaagaagctgagatgcatgtacttaggatgattgaagatggtgagatccatgcaacgataaaccagaaggatggcatggtcagctttaatgaagatcctgagcaatataaaagtagtgagatggtggagcacatagactcttctattcaaaggttgatggctttgtccaagaagctgacctcaattgatcagaacatctcgtgtgatcatgcatttttgatgaaggtgcagagtggaagggaacgtgcaagattcgactacgatgacttcgactcggttccgcacaaatatttttgagatgatcagcgccttaggtgtctcggaagtactaccatcaagctagccttgccctgaggttattattggttcgacccgtatattacagccatcgaagtttgaaccctgtaatttctggaattaaaggatgggagcttttgcttagggataatgatattcactcttagaatttgcacagcaagctttcattttgagtaaaaaaaaaaaaaaaaaaaa

SEQ ID NO: 5308 - DNA, 1087 bp, Triticum aestivum
  unsure (1)..(1087): unsure at all n locations
  Clone ID: PAT_TA_5308
gcctcagtatggttagtggacagaatgatgcagagctcgattttaacgcagtgcagcggggagatgctgagatggcacagaaattatatcgcgtgatcagggcatgtgcggaaatgggagagaagaatccaatcatcagcattcatgatcagggagctggaggaaactgcaatgtcgtgaaagaaataatctatcctaagggtgctgaaattgatatccgctcaattgttgttggtgatctcgcaccgtctgcggcgcaggtctggggtgctggataccaggaacaagatgcgttattggtgaagcctgagagcagaaacctgttgcagtcactttgtgatagagagagagtttcaatggctgtccttggtgaaattgatggtagtggaaagattgttttaattgacagtgctgctgtggagcatgcaatgttgagtggccttcctcctccaccgcctgctgttgatcttgagcttgaaaaggttttaggagatatgcctcagaagacctttgctttcaagcgagttcctcgatcgagtgagcccttagacatagcacccgagattacactaatggatgttcttaagcgagtactgaagcttccctcagtatgttcaaagcgtttcttgaccactaaggttgacagatgtgtgacaggtcttgtggcacaacagcagacggttggccctctgcaacttccacttgctgatgttgctgtagttgcacagacttacacagatctgactggtggtgcttgtgccattggagaacaaccgataaagggtttacttaatcctgaggccatggcaaggcttgctgttggggaggcattgaccaatctggtttgggctaaagttacatctcttgctgacgtcaaagcaagcggcaattggatgtacgctgcaaagattgatggagagggagcagatatgtatgatgctgctgtcgcaatggctgactgcatgattcaacttggtattgcaattgatggaggaaaggatantcctttctatggcaaccncaatngtgatgggcgaacctatccaaagccnccaaggaaaanccctggttacccantgcttaagtt

SEQ ID NO: 5309 - DNA, 1884 bp, Triticum aestivum
  unsure (1)..(1884): unsure at all n locations
  Clone ID: PAT_TA_5309
acccgccgcgacgctgtcgtccctgtgactttgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacggtcgttttcgcggggcgcgtccccgtgaccgccggcctggcggggcggcctgggaatgcctcacttatcaatttatccggtaaactccttggaggctcatgtagcccatgccggattaatcgtattctgggccggagcaatgaacctatttgaagtggcccatttcgtaccagaaaaagcccatgtatgaacaagggttgattttacttccacacttagctactctaggttggggagtagggccagggggggaagttctagatacttttccgtactttgtatctggcgtacttcacctaatttcctccgcagtcttaggcttcggtggcatttatcacgcgcttctgggacccgagactcttgaggaatcttttccattctttggttatgtctggaaagatagaaataaaatgactacaattttgggtattcacttaattttgttaggtctaggtgcttttcttctagtactcaaggctctttattttggcggtgtatatgatacctgggcccctggggggggagatgtaagaaaaattaccaatttgacccttagtcccagtgttatatttggttatttactaaaatctccttttggtggagaagggtggattgttagtgtagatgatttagaagatataattggtgggcatgtatggttgggttttatttgtgtatttggcggaatttggcatattttaaccaaacccttcgcatgggctcgccgtgcatttgtatggtctggagaagcttacttgtcttatagtttagctgctttatctgtctttggttttatcgcttgttgttttgtatggttcaataatacagcttatccgagtgagttttatggacccaccgggccagaagcttctcaagctcaagcatttacttttctagttagagaccagcgtcttggagctaatgtgggatccgctcaaggacccacaggtttaggtaaatatctaatgcgttccccaactggggaggttatctttggaggggaaactatgcgtttttgggaccttcgtgctccatggttagaacctctaaggggccccaacggtttggacttgagtaggttgaaaaaagacatacaaccttggcaagaacgacgctcagcagaatatatgacccacgctcctttaggctctttaaattccgtgggtggcgtagctaccgagatcaatgcagttaattatgtctctcctagaagttggttatcaacttctcattttgttctaggattcttcttttttgtgggccatttatggcatgcaggaagagcccgagctgctgcagcaggttttgaaaagggaatcgatcgtgatttggaacctgttctttacatgaaccctcttaactaagattttcttatttatacctgttctactttttttctgttctggctcggttattccatctagccgagccattcattcctttttatgaaagaaagataagggacagaaaaaaaaaaaaaaaaaaaaaaatgaaagaaacaaacgtattcaataagcaaaaggagagagagggattcgaaccctcgataagttcctagaactataccggttttcaagaccgggggctatcaaccactcaagccatctctccacaagcctaatccttattttactcctacaaatnagaacatagccatataaaaaataaaaagatttatta

SEQ ID NO: 5310 - DNA, 678 bp, Triticum aestivum
  Clone ID: PAT_TA_5310
ccaaaagtgccgtgcctacctctgataactagccggtccctgtgtctccttcccaatactgatagcctcgtgcgcaaagcgttccgcacgtattccccgcccgtaccactcacggcgcttgcatatctcctccgcgccccggcccgtccttctgcctcggtatccgctcacccttcttgttctcttcgcctggcttgtgtctgtccgggccgattggttgcgcccgcattatccccctcgccgcttccattggcgtctgggatatcttctccgtcctgttgtcaccatccctatattgaacgcggcggaggggatgtcttccacgcgtactcccatcatcgtgtgttgccatgtcctccgttggaagtggccccttccaagcccccggcgaagtccccttgccgctcgcctttgcttccgggctttctcctgccagttgtctgctcagctcccctccgtcttcgcttgttgccgggtcccgttgtccagtcctcgacgagtcaagatcctcagtctctctttttccgctattcatgacgacagtaatccagtgattattttgcttgtttagacgtgtgtttgcctttgctctttcgatctccgcctccccgctttcgctcacgcgtccggtgcctcgccgctctgcttcataatcattaccggcggtcttttttccgg

SEQ ID NO: 5311 - DNA, 911 bp, Triticum aestivum
  Clone ID: PAT_TA_5311
gccccccctccggcgatgctgatgcgtcgccgccgccagcgcccggtcctcccccgcctcctcctcgccaccctgctcatcgcgtcggccgtcgcattcctcccccgcgcggccggcgacgcggccgaggcgggcgacgagggccgcgtgggcgaggcggtcgcggcggtggagcgcgccgacgccgcggccgcggccctgggggccgccgaggccggcggggaggcggctcagggcaatgccacgaccaaggagcacagcctcgccgacatgatcgaccgcgcgctggagaaggagttccccgactcggagggcgaccagggcggcggagagacggaccccggcagcttcaacaacacggtcgcggagaagcagggagttctggaaactgtggccagaagagtaacgaagaagaatgagaccaaagacaataactcattcccattcaaggaggttttcttggatcggtcagagcaagaggatgttcccacgttgattgaccggaaggataatgtttttattatatcaaatcggaagtcaaagtaccctgtactgcagctggaccttacgttgatctcagatcttgttgtcgttattgtatctgctacatgtggtggaattacctttgcttgccttggacaaccagtcattacaggttatttgcttgcaggttctataattggccctggaggttttagctttgtcaacgaactggtgcaagttgagacagtagctcagtttggtgtgatatttctcctttttgctctaggacttgagttttctaccgcaaaactacgagctgtacgcgcagttgccgttcttggaggattgctgcaaattatacactttatgttcctttgtggtatttctgcgacgctatgtgggggtaaaacaaagggagggtgtttttg

SEQ ID NO: 5312 - DNA, 736 bp, Triticum aestivum
  Clone ID: PAT_TA_5312
agcgtcaaactcgccaaagcgacaccaggggtttcatgttttataatttttatttcaaaaggttcacagttcacgttttctaattttcatttcaaggggtttacaattgttcagaaggaacagcagctacaaccaacccagggaatttcaactcaacagtggtttcaggcagtacaatgacgatctcatgatcgctagccatctttcagagtcgtatatgtacacaattttgcactcagcaactataggcggccccagcatgataatctgcacaaaattttgcactcgcaggtgtagaatggtaattgctccagaagaatgacaggctgatgaacccaagatcacgcctgattgaactccaccatgtacacgctagctagctagccagccatcaaagcttcttcatgtagccgacaatttactggttcttaatatgtcatcgaaacgttataaaaggtagggcaccagacaaactagaaatatattgctcatcctttttcataaaatcttgccatgtcacaccttcaaagagagtgaacttctgcaagaccgcaatggagacaacaaactaatcaccatgtgggcactattatgccacatcaaggctccgtagcttgtcacagtgaggcgtagggtagtcattggcccatttacgccgatggagttccacacgacagtttcttcctagcatagtcttataatctctgaaaacgtgatcctcgagggtatctctaga

SEQ ID NO: 5313 - DNA, 642 bp, Triticum aestivum
  Clone ID: PAT_TA_5313
gctttcgccacttccccccgcgcgcgaacccaccccgccgcgccccgcccggcccgcggaccccggccccccgcggggacggggcttctcccccccccccccccgcccagtccagccgccaggcttccgtccccgcccccccccgcccccggcgccgcctgcccctccccgccccccccgccccgccggccgccggcgccccgctccccgccacctctcgccccgccgcgcgccgccgtgccgcgccccctcgcggcgccgcgcgccggcgccaccagctgcccggcgggcctcccgccggcccccccccgcgccagcccctccacccccaacccccccacccgccccagagccggcgacgccagccgctgctccccctcgctccccgccctcccgcccgaaccgtcctccctccccgactctgcacatggctccccttcgatggacgatgcgtcagcgaagcttaaagattttgatgatgatcctcaggggaacgactacccgtttgactttgatctccggcagatcgacgacctgctgcccgatgaagatgagcttttcgctgggatcacgaatgagatggagccatcttcgcaggcgaatcctgtagaggaactggaggagtttgatgtgtttggcagc

SEQ ID NO: 5314 - DNA, 655 bp, Triticum aestivum
  Clone ID: PAT_TA_5314
tttttttttttttttttttaactaatatgtatttatatattaaatataatatatgataacactgacctacaaagtagttctggtgccatattttttaaatatcgcgtacaaagcattttccttggtgtatgccatattcgaatgtcttctcgacaaccacatatatcaatttacttttcgagaatctcagattttccgcaagcctcaactctgctctgcatttgtcatcttacggcttgtcttgtctgtttcagcatccagcagaagacaacaacaatcttgactgtacagccttcgaatgcctcgggcaccagcttgttgcgtcgaggcatgttggaatggaaagctatggagaggcgatctcatgttatggcttgtaactatgttatgctagctatgtacctttgatgatctattatgagcctgaacaaccactgttgatgctaaagtacaaggtcttgcgactgaaggcgttcatggcgtagtcgacccggatttgacctatgtccatgttgaagtgaactaaatcccggtttcccttgccgaagagctgaaccaaaaacaaagcggccaccactgccgcggttacacatgtgtaggactgctggataagcttcgtacatgtgtcggataagcttcggacatttggcgggta

SEQ ID NO: 5315 - DNA, 798 bp, Triticum aestivum
  Clone ID: PAT_TA_5315
gattcggcacgagaggttctccatcctctggtcctccagttccgtcgtgttctacgtcgacggcacccccgtccgcgaggcgcagcgccgccgtagtcgccgtcgttttacggacgacggcatgggtcccgacggcgacgacagtgacatgggtgccgactacccgtccaagcccatggcggtgtacgtgaccatctgggacggctccacctgggccacggagaacggcaagcacacggtggactacgggcacgggccattcacagccgagttctcggggctcgtgctccgcggatgccccgccgacgccggcgcagacatccgccagctccacctcggcgcctccacgcagcggtgcgccacggcggagtgggagctgatgacggcggagtacgcggtcatgacggcacggaagcgcgcggacatgcggcggttcaggcggaggcagatggtgtacacggtgtgctacgacacggaccggtacccggcggcgctgccggagtgcgaggtgaacgcggcggagcggcagatgttcgagcggtggggaagagtccaaggcctccgttccgctcccggacgactgcgccggcgccgcttgtgtccatgatgcaggccgccgactgagttgatcgcctgattcggaaaggaccaccggcggccacgttgttgcctgtacagttgcttagcttagtggataagaaaatgattattaatgatgagcagttggttgatggagctgtttagttttggttcccgtatccttatatgtttaaaaaaagtaataccttaaaaaatacg

SEQ ID NO: 5316 - DNA, 1136 bp, Triticum aestivum
  Clone ID: PAT_TA_5316
gaattcggcacgagaccatccccgtcgggggctcctccatcgctccccttccttttcttttcctcctcccgtcctctccaaaaccccccattaaattcacttccaaactcgctcgccgcccctccctctcccacggcggccccccccccctcccccgggccccgcgccacccagagatccagctccgctcggccgaggatgcgggggccgggggcggtgaaggcggggagccggccgccgtggctggggctgagcgcggcggtgtgggtgcaggtggcggggggagccagctccaccttcgcgctctactcgcacgcgctcaagctcgcgctcggggtcgaccagcgccgcctcgcgctgctcgccgtcgcctgcgacgtcggggagaacctcggcctgctcccgggcgtcctctgcaaccgcctccacccggccctgctcctcctcatcggcgccgccgcctgcgtcctcggctacggcaccacctggctcaccgtctccggcgccgccccggcactgccctactggctggtatggttggcattgtgccttgctgcaaacagtggcgcgtggttggggactgccgttttggtgaccaacatgaggaacttcccactcagcagaggtgctgttgccggcatccttaaaggctacgccggtctaagcgctgccgtctacaccgaaatatacaccggcatacttcacgattcggccgcgagccttttgcttttgctcgctctcggggtaccttctgtgtgttttctgacaatgtactttgttcaaccctgtcaaccctctctggtgccgaattcttcagagcaagttcacttcctgttcacacaaatcgggagtattgttcttggggtttatcttgttggggccacagtattggatcatgtcgtaacacttagtgatgcagtgaactattctctggttgttattatggtccttctcctctttgcgccggttgcaatacccttgaaaatgacattgtttccaagtaaccgaagaaaaggcccgtcggactcttccggcgctgatagtgatcatacagaaccatttcttccaccttctgcctccggatcaaaccttaatgatctagacgatgaggattcctttgatattgatattctcta

SEQ ID NO: 5317 - DNA, 995 bp, Triticum aestivum
  Clone ID: PAT_TA_5317
cacgtcttgacatcggattactgagcacaatgcaggttttctcacattacgccagcacacagaaaatacaagaaggaagagcatgctagcttcaaaatggagtgcactggtgaagaaggatagtgttgacgacctgttcttgattaattcgtatgggttttatgcttatgatactgtctggatccttgcttatgcgctggatgcatatttcagtagaggtggaaacatttctttctcaaacgacaccaagctacatgaagttggggcagggggtctgcaattgaaagctatgactgtctttgatggggggaggctgttactagaaagaatccagcaagtgaatttcacgggtgcaactggccctgtaaaatttgatacagatggtaatcttatccgtcctgcgtacgacattgttaacatagtgggatccggcccgcggacagttggtcactgggccaactattctggcctgtccacctcgttgcctgagactctttacatgaaaccagcaaaacgtattaggggagatcagaaactccacactgtgatatggccaggtgagactacagtaaggccacgtggatgggtgtttcccaacaatggaattgagctgaaaattggagttcccaatagggcaagttatcgtcaatttgtgtcagttgacaataacagtggaacggtgcgtggtttctgtattgatgtgtttgttgctgcagccaacttgttacaatatccagttccatttaagtttgttccgtttggggatggtagtcagaatccaagctatccagaccttatcaacaatattctaacgaatgaattcgatgctgtggtaggtgatatagctattgtcacaaaccggacaagggttgttgacttcactcagccatatgttgagtcaggacttgtggtacttacctctgttaagaagcaaagctcgagtggatgggcctttttgcagccattcaccatcaaaatgtggtgcgtcacagggc

SEQ ID NO: 5318 - DNA, 737 bp, Triticum aestivum
  unsure (1)..(737): unsure at all n locations
  Clone ID: PAT_TA_5318
gtacgccgctngcacgttcggcctgagatggctcaaacatggacgttcggcaattattgatactgctatttataaagcagggcaaaaacctgtttagagagtgtgcgtcagttaattaggatccgattagatgagctaaattttgtagagactagctagatcttccagcgcatgcttgtgcataaatgatctaaatcttgtagagcagttacttccacggtccacagatagagatagcggttagcagatgttattggggtattagggagagtagaacacctaacagcattccagaggcatacacacgatcgtcgtctggttatgtacagtcagcaacatcgatggcgaagaattaccaggaacttcagagtcggtcaccactcgctatccaatatcaactctgcggcaacacccattgcctccggtccacccctgcaaaggatggccacggcaagctccttctctttccactgccggagcccaatgctaagcttcttgagcaccttgaggtcgacctcatgcaacaagcagggggcgcggtccactaccagccccaggaagcctgaaacgtaggctcgccacagggacatgttgcagcctagagagatctttccgtccaatgcgcttgctaggaactccaggtgcgaccgcataaccctctctcgacgccgggacactggtgtcgggtcgatgccccatgcgaacatcccagagtacactgcaaagtaggcaagtgc

SEQ ID NO: 5319 - DNA, 645 bp, Triticum aestivum
  unsure (1)..(645): unsure at all n locations
  Clone ID: PAT_TA_5319
gtcgcgcgcccccccgggctgctgcctcagtcttcccccatgctttttgctctcctttgtgtttgcccccaaatacatgctagtactcctatatatatatgcccacgaggctcaagcaatacaacaacggactattccaccaatccctctctcccttctaacaatcttgttgttgattcgcggactaccttacaatacactgatctccaaataactatcactaagcaatttattacggatctgtttcatttggttgccatttccccttcgcatgataaaaaactatccatggccgaaaaatattgccatgtccgcatgttttcttcatccttcttgctctccttttccccctcagctcggatgcaatgctgtccacggccagttgcactgtgccggggctccatgttttcccctgcctccacgcgctcctcggtatctctgccgccatgatctcccctccgttgtccgctgggctggtctccgacttttcccctccctcctctggctacctcttaactcctcccacaggaccattcttcctttgacggtttggaattgctcattcatttctccacgcagctgtatcaagctcttattccccgccttcacttgtccttctgagattaccncacaggagctgacttg

SEQ ID NO: 5320 - DNA, 1170 bp, Triticum aestivum
  Clone ID: PAT_TA_5320
cctcctctcgaaacacccgaacggccggatggaagggatggggcagaagaggcgcccgctggtggtgatggcctcctcgtcgactacggcggcgcagtcggcgtcgcggggcggggccaacccgctggccgagctgaccgaccgtttcaggtcgctggaggtcggggtgcgcgagtggatggcgaagcagcccacccacatcgaggccgccgtcaccacggcgtttggggctgtgcagggcggcgcgctcggcgggctcatgggcacctttgcgccggaaggaggggcggggctccccgtgccacagccgcctcccggtctcgaccccaaggccatggccaccttcaagcaagcgcaggctttggcaggtgggccactggtgcaagctcgaaattttgcagtcatgactggtgcaaacgcaggcatatcttgtgttatgagaagggtacgaggagtggaggatgtccagggcagcatggcagcagcgtttggttctggcgctctattctccattgtgagtggaatgggaaccccaaatccagttgttaatgcaattacaactggtatggcttttgcagtatttcaaggtggctttttcattgttggacagaaattctcgaagacaaagacacataatgaagatatgaactattctcgtgcaagaaatatgttgaaccaattaggcctccaaaactatgagaagaatttcaagaagggtcttctgactgatgaaacattgcctcttctcaatgaaagcgcactcagggatgtgaatatcccccctggtccaagacttgtcatacttgagcacattaagagagaacctgggttgacgaaatcaaactgaagtgattgccttggcaccagttttttctcaagttgcataaactatggtctgggaagtccgtccagtccagtccagctctttcaacgatgatgagctctttaggcagcagtatgattgtaaaagataactagtaaatgttttgtagtaattaggctgattaagttatatggattcatctgtattgaagtttcagtcgagctactatctgctgttgtcatggcagaaattttatttccagaacacttgagcttatttagagttatttttttgaaaagtattcaagagttatttgtgtaaagacaaaaaaaaaaaaaaaaaaaaac

SEQ ID NO: 5321 - DNA, 1528 bp, Triticum aestivum
  Clone ID: PAT_TA_5321
gcctcacttcgagactcgggactttcgctcgctgctcggtttcccaaaggaccacgcatgcggattcggcaagacagagaggtacaagtctcttggcaactcgttccaagttgatacggttgcttaccacctatcagtgctgagggacatgtttcccaatggtgttactgtgctgtccttgttcaccggaattggaggaggagaggtagctttgcacaggcttgggatccgcatgagggcagtggtttctgttgagataggcgaagctaataggaggatttttgaggggttggtgggatcagacccagacaggcacgctgattcagattgctgacgtgaaatctctcacgactgagataattgcatcattagttagtagatttggttgcttcgacttggtgattgggggcaggcccacgtaacaatcttgccggaagcatcccacacccccgttatggcttggagggcagtcagtcatctctgttctgtagcttcttcataatagtacatgtcgtcaaagtcagtctttggcgagcgtgtacgctgatccctgcagcttcatctacataaagatgtagtcaaaccatccttcttcacattatgtgttttactgcttatccctaggaaccgcagcttcagctatgtttaaacagtgaggcggcgtaaggtgcctgaatgggcccgatctgccctctctagctcaggcaatccaccacctgagagtgtacacaaatatgtcagggatgagtgctcaaaatggaaccttgtctgggttggcaaggacaaagctgctcctttggaaccgcatgaggtggagtacctgcttggtttcccaagggaccacacaaggggagtcggcaagacacagaggttcaagtctctcggcaactcgttccaagtcgataccgtcgcttaccacctgtcagtgctgaagggcatgtttcccaatggtgtgagggtgctgtccttattcacccgtattggaggaggagaggtagcactgcacaggcttgggatccacatgaggactgtagtttctgttgagataggcgaagttaataggaggattttgaggggttggtgggatcagactcaaactggcacattaattgagattgctgacgtgaaatctcttactgacgatagaattgcaacgtttgttagaagatttggcggctttgacttggtgattgggggcagcccatgtaacaaccttgccggcagcaacaggcaccaccgtgatggcttggagggcgagcaatctgctttgttctaccactacttcagaatcgtggatgctgtaaagtcggctatggggcgaatgtagcctaatcattttagttaatgttttatcatttcatgcttatctctaggatccacaacttcatctatgttaaacattgtgttgatgtgaaggatgtttgtttctgagaaacattgcattagtctttagctatatgatttcttgttgctaactaatttagagcctgctcgtctttatttgaaaaaggtttattgctgtccaaaa

SEQ ID NO: 5322 - DNA, 923 bp, Triticum aestivum
  Clone ID: PAT_TA_5322
acgggcaggaatcattaccacggcatcgacaaacaacgttgcaacaatctttccctccctccgttcctccttccccccctcctcttccgggcggcttcccccggcatcgacctgtgcccggacaagagaagcaaaccaagcctagagagatgcaccctagacccagggcgagtcgtagacgggggtgacgacggacttgacggcgaggaacttgtcaagcgcgtgcatgccgtcgtccttgccgaacccgctcatcttgcggcccccgaacgggcagtcgctgtccatggcgaagtagcagttcacccacaccaccccggcgcggatcgaccgcgccatcctgttggccacgttgatgtccttggtcaccacccccgccgccagcccgtacctcgtgtcgttggccctcgcgatcgcctcctccaccgacgtgaacttcataaggcacatgacgggtccgaagatctcctcctttgcaatgatcatgtcatccttaacatcggtgaaaaccgtgggctcgatgtagtaaccgctctggccacagggcttcccccctgtcaggacggtggccccttctctcttgccatggtcgatgtagccgagcaccctctcatattgagccttgtccacctgaggcccttgattgacgcgaggatcgaaagggtccccgacgacccaactctccatgcgctgcgccagcttcttcacgaacccgtcgtagatgccctcttgcaggtacacacggctcgccgcaacgcaagcttctcccttgttgaagaagttggcgccgatggcgagacccacggccatgtccacgtccccggcgtcgccggcccggtgccggcctgcgccgccctgctcgagggacaccggcttcaggttgctcctcgccgacgcctccattacgagtctcccaactgacc

SEQ ID NO: 5323 - DNA, 718 bp, Triticum aestivum
  Clone ID: PAT_TA_5323
ggacaaaaattttttaaagaaatattactgtcaaccgcatccatactggcatcagtgcacaggggtcgcgatgcatgtcctctcgtctccctcggcggtcctctgcctctccctcccctaccctatgttccgttggcggcctgagatgttcagagcagccagttacagcatgcacaaaattatgtattgcgtatcactcactcccagggcatcggattgcagtccctcactcccatatcaccttttttgcatccggccatggagcatcatactcactgccttcccgtattaatgccttgcaggagaattcttcgtatacttaaccaacaaaagctccccacctagcaagaatgatagatcaacctccgcagttggccttgtccggaagcacaaattcgctctgtggtgctcccgctccttatctatacatgcttcctttgcctccttgacaacatcttcataaggattaaagtagtcaacttgactcccatatctttctttggatttgatgaatagattcctttcctcatacaaagcaacgtataacctcattccagtttttgacatccccttccaatctctgaaaagtttagctaatggaggactaagggtcagcgcgtgcccacttgcaacagcatcaatgacccacttcctagccttggcaaatcgctgtgcttcaccaaacagaacgaagagagtgcaaactaatctctgacat

SEQ ID NO: 5324 - DNA, 507 bp, Triticum aestivum
  Clone ID: PAT_TA_5324
cggagggcgttttttttcctcgtgcccaaaaataaggctgctatttttgttgctctttgctcctaattctccactgcacaatacttccactccatacgagttgagtaaacaaattacatctggtacatcaattagcgaagtcaaacaaaggaggcctacatacagcttaggatcatccaacgcaccatgcccatacaacaatcagttaatgaaatatgcacttttgatattcacacatcaatggtactactgcaactgcattcctcagaaattactttcgccgccaaatgtagatggggggtggactgcggcatatgccggaaattcctgtggtgctgctgcacactgaggcacggaatggatatttgcatgcccctcaatctgacttgctgaaacaccagtaccaggatattcctggtagaagaaaggtctaccaatagatgagtttgttgcaatatcttctgttgcaaaatactgattttgatttggttggtcaacaaaactgac

SEQ ID NO: 5325 - DNA, 563 bp, Triticum aestivum
  Clone ID: PAT_TA_5325
aagagaattaagtggggaaaatgagagcggccagattggaattgacgggcgatatggatgtctacagtacacgtgcagtaatagttcgactgcagaggagccgaacctggaactatgacagtttcagttttcttttctgcatagctggaactatgacagtttcagttttcttttctgcatagcttggtaacgccatttccagtgcactcatcctggcagcacatgggggtcgttcatcatcaggtgcacgccccatacggattcttttagcccaaccaggagcttgagggttgtctttgcctgtagattgctcggacgccggtgcggacagagcaaccccctcgcaagtgcttatcaaatccatttgtaagtccagtgcgtgtctccggcatcaccaatgcttgattcagcaggcgcgcatactaaagcttggcttgcaccatggtccagcggcgcagatgcgccgcccagatccggcaggggaaatctgtcgactggatatgataagaactcgattccatcgcctccggtgcgtcggggtctccattgccctcgtgccgaat

SEQ ID NO: 5326 - DNA, 669 bp, Triticum aestivum
  Clone ID: PAT_TA_5326
ggccaagtgcaagtattaaatgataagatgctgaaacttgatggtgccgactgagcagttttgctccttgcagctgcaacctcatttgaagggccatttgtcaagccttctgaatctacacttgatccagtgacatcagcattcacaacattaaatatggctaggagcatgtcatatgcacagctaaaagcttatcacatggatgattaccaaagtcttttccagcgcgtgtccttgcaactttcacgaggctctaatggtgtacttggaggtagcactttggctcacttacctgagaatatctctcaggatactgcagtatctgattgcactgtgcagatggttgacagttcaaggttaaacgagcttaataattcagagaagcctaccgtagacagaattataagttttagacatgatgaagatccttctctggtagaacttctgtttcagtttgggcgctatctactcatttcttgttcgaggcctggaactcaggtttccaatctgcaaggaatatggaacaacgagactaaggcaccatggggtacagctccccatccaaatataaatctacaaatgaattactggccatcacttccttgcaaccttagtgaatgccaagacccactattcgacttcattggatccctttcggtcaatggggct

SEQ ID NO: 5327 - DNA, 621 bp, Triticum aestivum
  Clone ID: PAT_TA_5327
ctgtctctgcttcgttcgcgtctgtcctcgcctcgggctgcctcgcctccatgcggcaatttccaaaatggcatccacttcttccttcctccgttcgccggcctccttccagccggccaccggagcctgcggccacgtctgctgggcccagccgttggcaccccccaaaccgcaccgctcgccactcccgccgacggccacgcccggggtgccgcgcaggctcctcctgccggccgccgctggcatctgggacttcctctccggcggtgcggccggtgcggccggtgcagcggccgcgccccttgccgtccggcgcggtatggagctcttcaagcagggagatgtggctgggtcagtggcggagttcgatcgcgcgatcgagttggatccgcggcagaaagcgtatctctggcaaaggggactgtcactgtattacctcgacaggttcgaggacgccgcggagcagttcaggctggacgttgctgccaaccccaatgacaccgaggagtccatatggtgtttcctgtgtgaagctcagctgtatggggtggaggaagcaaggaatcgcttcttggaggtcggtttagatcgaagacccgtgatgcgcgaagcttacgcctt

SEQ ID NO: 5328 - DNA, 718 bp, Triticum aestivum
  unsure (1)..(718): unsure at all n locations
  Clone ID: PAT_TA_5328
ggcgtcgccgcccgcggcgacgcggtcgcggccccgtccgcgtcgcgggcgcccgggccccgcccctgtcccccccgccgccgcctcccgcctccgccaccccgccgcctccgccgaccgcgaccccgtcctcctgcgcccggcctccccgcccccggccccgctcccggccctctccctcccgccgctcccgggccccctctgccgcgtcggcttcgtcctcgccggcgtcctccccggccgcgtccggcccgcccccaagggcgaggcggcggtcggccccacccggcgcgccccccgccgcggctcggcgctggcgaccctctccgtctcgcggtcggccctcgcccggcgcccggcccccgtccgcggcgccgcgctacctcctggcccgccggcacgccgagcgcgacgccgacttccttgcgacctccatggacgatatcgacaagatgacgaggacgaggaggaggacgaccaggatctgcgttcccccctgagaaaatcgacgctagatatcctctgcttctgtctgattgacctctggcggcgtccggcgggagttcttgcgcggaggagggagcttgggttccgtccatctgttcgatcccgatgggggacgtgtccacgattcaacgcccatccgacattgtccccaagngtgatcaggttggggggctggtgtcggccgtatggaccaacgacaccnacaacatgt

SEQ ID NO: 5329 - DNA, 1181 bp, Triticum aestivum
  unsure (1)..(1181): unsure at all n locations
  Clone ID: PAT_TA_5329
cgtccgagtacatctccgctcgtctgttcggcgaacagataagcacagaatccgaagagagcggcgggtggttggcagatggctgcggcggagccgtcggggtcgagccagccgggtgctccaggaaggtggtctcttcacggcaagacggctctcgtcaccggcggcacccggcgggatcgggcgtgcggtggtggaggaacttgcggcgctgggggcggccgtgcacacctgctcccggaaggaggcggagctgggcgagcgcctcaaggagtgggaggccaggggcttccgcgtcacaacctccgtctgcgacctctccgtccgggagcagcgggagcgcctgattggcgacgtcgccgaacgcttcggcggcaagctcaacatcctcgtaaacaatgtggggacaaacataaggaagccaactactgaattttccgctgaagattactcttttttgatggccactaatcttgaatctgcatatcatctttgccaacttgcacatcctcttctaaaagcatctggtttgggcagcattgttttcatatcatctgtctgtggattagtagccgtatttagcggtactctatatgccatgactaaaggtgccatcaaccagttaaccaagaacctagcatgtggaatgggcaaaagatgtgcataagaacaaactctgttgctccatggtacataacgacttcgcttacagaaggacttttggctaacaaggaatttgaggcctccgttgtgagtcgaactccactggggcgtgtcggagaaccaggagaggtatcatcgctggttgcttttctttgcatgcctggttccacttacataacaggccagacgatctcagtggatggaggtatgactgtcaatgggctctatccagcttgaagactaccaaggaagaggccatatttcgctttgttgcccaggagtccagtcatatcttgtgttgttggcaaccaaaataaatattcctgtaaaactgaggtcatcttgaatctagactccatgagtattcgccattgttcagatcagccatgtgaagaaagttgtggtcagaattgtgtgattattttgcaacttggtgaactcttttcggattattaagtgccttgctgttggaaaaaaaaaatgggattgaaaaaaanaanangtgttgtnaaaaaaaa

SEQ ID NO: 5330 - DNA, 567 bp, Triticum aestivum
  Clone ID: PAT_TA_5330
tttttaagcctggaagaccagagaacatcctatttattgcactttaaatttacaaggattgcaattaccggtcgagccatgcctgtggatttttccttctcattttaaaagggggactattgaatgattcttctgggattcaaaagaaaatggcacccctgagtgtgttttcatgagcccgtggtagcacccctgagtgctagcaatgcagctccgtacgccgcctctgtctgctctgctttccgaacaggcaccccaagcactctctcccggatcgccgtccacttctcattctgcgcgcctccccctgccgtaaagacctcctccaccggcgtcgcgccgagctccttcagcagtttgtacccactggcctcgatccgcgccatagactccaatatgccatgcaagtaatccgcgtcgctgtcgggccgaggctccagcctcggctccatgtcggggtcagagacagggaatctctcacccttcttgggcagagggtagtagtcaagaggggaaggagacgatgggtcgatgtccctgctcagcgccacaagctggtcgtcgctg

SEQ ID NO: 5331 - DNA, 439 bp, Triticum aestivum
  Clone ID: PAT_TA_5331
cccacgcgttcgacagcggaagagcgcggagaagaaccagaagtccaaggggtcgcagctcgaggcccgcgccgtcggcctcaaggtcgtctgccccatctgcaagtctcaactggccaacgagaagcagttgattgatcactatggatcaaagcatcccaaggagaaacctccaggtccatcaaatgcagagtgactgatgcgaggcggaagcatgagctatactttgactgtttctgagggtttttcaatctgctccacactcggacgacttgagcctcagctttaccctatgtaatgcatgcatttccccttgttccaggcaagaaccttgatgagcatgtatttgccttatatgagtatcttgtcaaactgtcagcataccttcaaactgtatgtggtacaatctttggataagagaatgctaaactttccgatt

SEQ ID NO: 5332 - DNA, 856 bp, Triticum aestivum
  Clone ID: PAT_TA_5332
gcaagccgaagatcgtcgcgcaggcgtggaccgcggaggagcacctgaagtcctgtgggtcgccgcacgaggccagcgcagccggcctcgtgggtgtgtgcccccgcgccacgcggcaactccccagcgagcctcgtgccaatacgtgcggggggatcgatcggaggcggaagagaaggaggaggggcggcgggatgacgcgggggaagcagaagatcgacgcgcagcggaagagcgcggagaagaaccagaagtccaaggggtcgcagctcgaggcccgcgccgtcgggctcaaggtcgtctgccccatctgcaaggcgcaactggccaacgagaagcagttgattgatcactatggatcaaagcatcccaaggagaaacctccaggtccatcaaatgcagagtgactgatgcgaagtggaagcatgagctatactttgcctgtttctgagggtgttcaatctgctccacacttggacgacttgagcctcagctttaccctatgtaatgcatgcatttcctcttgttccaggcaagagcctttgatgaccatgtatttgccttctatgagtatctttgtccaactgtcaacataccttcaaactgtatgtggtgcaatctttggataagagaatgctaaacttttttcgattcatcaaaatccaggcaagaaccttgatgatgagcatgtatttgccttctgtgagcatcttgtcgaactgtcagcataccttcaaactgtatgtggtgcaatctttggataagagaatgctaaactctcaattatggcattctcctgttgcgcgatttgctgtctaaagagccgaaaaatgaatgttttttcctaaaaaaaaaa

SEQ ID NO: 5333 - DNA, 747 bp, Triticum aestivum
  Clone ID: PAT_TA_5333
cccttcggcgcctaatctgctgcactgcactgcggactacaccggcccatagaactcctgcaaacccatcagcatcacccgtgctctgcaaaggaatggcgagcccaatggtggcaaccccaatccgcctcagcagcctcagacgcccctccttccccagcacccagaggacgattcgtggcggcgagggtgaaggcgtcggcggaggcgatggcgacggagaagctcggcgtcagggtggagcgcaacccggccgagtcccgcctctccgagctcggcgtccgccagtggcccaagtgggggtgcgagaagagcaagttcccgtggacctactcggccaaggagacgtgctacctgctgcaggggaaggtgaaggtgtacccggacggcgaggaggggttcgtggagatcgcggcgggggacctggtggtgttccccaaggggatgagctgcacctgggacgtcgccgaggccgtcgacaagcactacaagttcgagtagcctgcacctacaccgctgcacggccggccgctgtgctgcctgctgccgctactagcactagactgaggtatttgtagccggattatgttgtgctcgagtggatctcttctcttgtggtggaataaaaacgccagattagtggattgtgcttgtccaaccttctctgtggaagcaaaccgtccgtattttgtttgcgttgcaacgggggcacatagacatgtggccaaaaaattcagtgagttcttt

SEQ ID NO: 5334 - DNA, 880 bp, Triticum aestivum
  Clone ID: PAT_TA_5334
tccgcgggttcctgggcccacgcgtggcattcgtgcgccttcaccatccggcccctcggctgacacgagcccctgcaaacccatcagcgtcacccgtgctctgcttcaaaggaatggcgagcccaatggtgggaaccccaatccgcctcagcagcctcagatacgcccctccttccccagcacccaggggacgattcgtggcggcgagggtgagggcgtcggcggaggcgatgccgacggcgacggagaagcagacggcgtcagggtggagcgcaacccggccgagtcccgcctctccgagcgcgtcggcgtgcccagtggcccaagtgggggtgcgagtaagagcaagttcccgtggacctactcggccaaggagacgtgctacctgctgcaggggaaggtgaaggtgtacccgaggcggcgaggaggggttcttggagatcgcggcggggggcctcgggtggtgttccccaaggggatgagctgcacctgggacgtcgccggggccctcgacaagcaccacaagtgcgtgtggcctgcctcgaacgtgctgcacggccggccgctgtcctgcctgcttccggtgctctgcctctactgaggtatttgtagcgggattgtgttgcccgctagtggttctctcctctggctgatgtatttataacggcgattaagttgtgcttcggagtgggtctcttctaatctgtgggggaataaaaacgccagattagtggatagtaagtgtccaacgtccgtgcgtgggtgcctgccgtccgtagataggtcgcctgtaaaacgggggctccttgtcatgtagccctgtgttcttgcttccttaacatcatacctggggggggaacataaaaggtcctttacatct

SEQ ID NO: 5335 - DNA, 559 bp, Triticum aestivum
  unsure (1)..(559): unsure at all n locations
  Clone ID: PAT_TA_5335
gccataccttgtctcaggtgcatctggtttcgcactgaacgcgataacaagagctatggaaaaggatcttaaggcttacattgagtccatgagaagcatattagcgagcgattcatggaatacaaagacaacaatatgttggggcttgagagatcgttggctcacttatgatggggtggaagatttttgtgatggcctaaaacacaacgttgtgcagctgccaatggcagggcaccatgctcaggaggatcgtggtgaagactagggaatataataaaacgtatactgagaggatgactacagtcatatggggcaggctctacaacatgccaaaaacaggggtcaaaatgtggcacaacaatagcaaatagggcatnactcttcttggttgaaaagagantngcgcccattgagccacccactccatgtcagacagcgctccagagtatttagtgcntgcacaacaacgcattccgcttttcatnnttgancgtttcagtttacttgtgtcatacttattctaacagtcatcgtgcagtntatctcnaaaaaaaaaaaa

SEQ ID NO: 5336 - DNA, 589 bp, Triticum aestivum
  unsure (1)..(589): unsure at all n locations
  Clone ID: PAT_TA_5336
cggacgcgtgggtacatgttctaaacattatacagtactttcgttgttaactccaaacaacttgggatcttctcttctgcatgcagcaactggcttaccagtacaccgccaagggggcatgccttgccctggtagcaaggagggagtggagcctgtggcaggtcgccgaccgcgccttcgagctcgatgcgcaggacgtgatcattctccccggggacgtcgcagaccccgacgactacaacagatttgttcaggccacaatcgaccagtacgaccaatgcaaaccatggaaggcatgctgatagttcaaattgtcattctgttagtccagtgtaatgaaggtcatggcctagtcaagtatggtcgcccattgagtcgtgcatatgtttaatatgattggagcaggggcccagtttgtgtcgattgtcacttcatatgtttaacagtgattctacttgtatatgtgttattacactagtagaatttgtacctgtgcgatgactggagcaggatcccaatatttgtagagattgtaacattgattgtcattgtatacagattgattctgnnttgctgttactttgaagta

SEQ ID NO: 5337 - DNA, 1346 bp, Triticum aestivum
  unsure (1)..(1346): unsure at all n locations
  Clone ID: PAT_TA_5337
gcggtcgagagagggcggccgagagagagacctgccggcccgccggcacacggtggatgtggtcagccacgtgcgccaccgtccggctgtgcgccgcgagaggaagagacctgccggccggagacggagacgatggatctggtgaacggcgcgctcaactgggcggcgatgcccgccatggtcgccgccctcctgctcttctacccgccatactacctcttcaagctctgctactccttcctctcctacctcttccccgacgacctcaagcgcaaggtcgtcctcatcaccggcgcctcctccggcatcggcgagcaactggcctaccagtacgccgccaagggggcatgcctcgccctggtcgccaggaaggaatggagcctccggcaggtcgccgaccgcgccttcgacctcggtgcgccggacgtcatcattctccccggcgacgtcgcagaccccgacgactgcaacagattcgttcaggccacagtcgaccactacggacgattggaccatcttgtgtgcaacgctggcattgcgagcgtgggcgcctttcaggagatccccgatgtcactaactacagctcgcagcttgatgtcaacttctggggcgcagttcagtccacttctgctgccctgccccatcttaaaaggacccgagggaaggatcgtggtcaccgcctccgcgaccggatggaaccccgttccgcgcatgattttctataatgccgccaatgccgcactgataaacttcttcgagacgctgcggtcggagcttggaagtgaagtttgcatcacaatagtgacgcccaggggtggatggagtccgagatatccaaaggcaagtttctcaaggagcaccgcggcgtggaggttgatcaagaatatcgagatgctcaaatcggtctcttcccggtggagtgcgcgatgaaccccgcgagggccatggtgcagccagctcgccaaggacacggtcgcctcaccgtgccgtcatgggtccgaagaatgtagcaaggggatgtgttagcgccgcacgccgccgagttctgctatcgcctcctgtacatgcaccgccatggtgctggcgaccagaccgatgcgccgagcaagacgatggccgagggttgcgggaagcctatgctgtacccctcctcgctgcgctctgcggacgtcaaaagcgactagaaactaagctttaggtgtggatgctaagctttagtagtttgtaatcccgaataagctgtgttgtgtgtttgtaatattagttctgtgtttgagactgcgtgtcgatcgactcgttggtgtcttgaataatgctttgcactggtcagttgcacncttcccat

SEQ ID NO: 5338 - DNA, 787 bp, Triticum aestivum
  unsure (1)..(787): unsure at all n locations
  Clone ID: PAT_TA_5338
aaggtantgganncggtttcccgtngatttaaagagcntgggggttaagaccnttngggattggacggcccccttttttagggattgtttnaggttattccccagaaaaattnntaccctttgacatcaattntgggcaaagcgttngcacccaccagacagaccagacacacacaacaacatccancgtgcggtgttatctagtncgttgtggtgttctcgggtgggacagacggtacacaagtgcagatgtttaccaatccacactctctttcgctgacatccttttggtgtatgcccaccttgatcttgttcaatatcgcaaccacatcgctcatcgtcaacctctcgtttggcggaatggctagaacagagcaaacccaactcaaatatcggtacaagaaaatcttcattcaagtcgcagatggaaggcaatgagccttgcagtagatggctatccacgacgtggacaagatttgcaggaaatgcctgacgaacccactctctaagggttagctctcccacaaacatagaatccataggcctccttcgagtgaaaacttcaagaagcatgattccgtagctgaatacatcactcttacgtcatgcttttcccataaacccatattctggtgccatgtaaccaaccgttccaggcatgctaccaacaatcatcgagttgccatcacctaatagcatctttgcaatgccaaagtccgccacatgcgccgccaagtccatgtcaaataacacattgctaggcttcaaatcacaatgcaaaaccacc

SEQ ID NO: 5339 - DNA, 756 bp, Triticum aestivum
  Clone ID: PAT_TA_5339
tcgacccacgcgtccgtccatatgcttctgctccagacaagagtctgacagttgttccagcagcccagaactggatccagcaccagggagatgtgttccatttcccaggaggcgggacaatgtttccaaatggagcaagctcttacattgatgaacttgcatcagtcattccacttgctgatggcaccattaggactgcacttgacactggatgtggggttgcaagctggggtgcttacctaatggatagaaatatattgaccatgtcatttgcacctcgagactcacacgaagctcaggttcaatttgctttggagcgaggtgttcctgctgtaattggagcggacgcgtgggtgaagctcccatacccatctagatcttttgatatggcccattgctcacgctgcttaatcccttggaaatcaaatgatggaatgtacatgatggaagtggatcgggttcttaggcctgggggttattggatattatctggcccgcccatcaattggaagaaatattacaaaacatggcaaagatccaaacaagattcagaggaagaacaaaatagaattgagaacattgctgaaatgctttgctggaataaaatatatgagaaggaagatactgttatttggcagaaaaaggtaaatttgaatgcatgccataataagaatggtcggaccagcaagatgtgcaacgttcaagatgcagatgacatctggtataagaaaatggaagcatgtataacacctatcc

SEQ ID NO: 5340 - DNA, 1149 bp, Triticum aestivum
  Clone ID: PAT_TA_5340
gaattcggcacgagctcttctcccagccgcccagcaacatcgactcccctcggcgaccccaactccggcggcggcgctgcaggtcgaagcgcggcaggaggcggcgcgtctgagcagccggcggccagcggaggaggaggggtccataaggcggcgtcgcggtaaccggtcgggcgagcggcgaacggacgaaggcggccggaagagggggcgccggagcgatgtcgaagcggttgatggagcggatgctggggatgttccggtcgcggacgcaggtgggcgtcgacagggccggcaaccactacttctcccgcgtcgaggaggtcgacggcgccatgaaagagaagcggtggattgagttcaagggcgaccgggacccgaccactgttccagttgagtggatttgctggttgaatggacaaaggaagaaggctccaacaccagaggaattagctgagctggaggcgaggcgtgaacgcgtgaagcaaaatgttgaacttcttaaaaacgaaagaagaagaggaaagaaggtctggtgtccgaccagtcaagacaattgggaaaacggattctccaaatctgagaagttttacacagcagttccctggtacatctgaagataaaaagaaagaacctgagaaggtgtctaagcccaatgatgtgactgatgcagaagatgcccagaacaagataatgacaggtcttcctgagccaacaagtactgggtgccagttttaaaccagggacttggctgccaccgtccttgaatgccaacctatacttgcagctgaccaagtgcctctgcttgacctttttttcgtggcctacctgctgtcagtcctgatagattattccaagattatgtcccttaaccattttgatacaagaaggggggttgtttgtgtggtgcgcatcgccatatgcctgccaattgataaagttcagtgaggtcgcacctcactaagcaacactggcactctctcttttggttttctttttctgaagtcttcggtgctagttttgatagcaaaaagtttggaagacaactaatcatgcttcttttatggagttagaggtctgctttttgtttgcatggtgtaacaactgaaattggtgcaatattactgtctaagatgcaaacccccatgt

SEQ ID NO: 5341 - DNA, 824 bp, Triticum aestivum
  unsure (1)..(824): unsure at all n locations
  Clone ID: PAT_TA_5341
aggccaggtacggtttgttcttgaacaagatttgatgttcttcgttgtacgccgccagcctcttcgccatctctgataacatcacatatttttttgtttatacgcacgatccaacaaatatttgctcagtaatctgtgacaaaaacacatcacttgtgctagctatttacagcagtgtctcatggaacaggtgaaatgactactttgccggtggctcgcccggtctcgaggtaggaaaacgcctccacgacctgggagaaggggaagggccccttggggtcgaccaccggcttcaccttcccggactcgaggtaagggttgagcttcgccaggacggacccgtcggaggtgaccacgaaccggaaccccggaggcgcgaccgcgcctgtgaggaccaccacgctgccgccttccttcaccaccttgaccgccttctcgccctggccgactgcgtcgaacacgacgtcgtacttctccggcatgtcctcgaagttctccttggtgtaatcaatggcgacgtcggctcccaggcttttcaggagctccagctttggggtgctggctgtggccgccactttcgatgcgccgtaaacttgctttgccagctggatgacaagggtcccgactccgccggcgccgccgaggacaaggatgctcnnngccggcggagaagcctgctctctcgaggccctcatgggcggtctcgatggcgagcggcagaccggcggcctggcgcgaagtcgatgctcttgggcttgagcgccaccagcttctcctccacggcggtgtactctgccagcgagccgaactgcttgggtccctcg

SEQ ID NO: 5342 - DNA, 384 bp, Triticum aestivum
  Clone ID: PAT_TA_5342
tcggcaccgagggccggtgcaacaacctcggggaatgggtgtggagcctgcacggcgaggcgcgcgtgctggacgccgtcgacccgcggctcggcggcgagtacgacgagggggagatgcgtagggtcctgctcgtcggtctcgcctgctcgagcccggagccggagcgccggccggggatgcgcgcggtggtgcagatgctgagcggggaggcggacccgccgttcgtgccggcggcgaggccgtccatgagcttcagcgccaaccaccagctgctgctgagcctgcaggacagcgtgtccgactacaacgcgctggggctgaacccgtcggacgactcctcgtccgactcgctgagctcgtcgtcgcgtaaaagcacgctgg

SEQ ID NO: 5343 - DNA, 575 bp, Triticum aestivum
  unsure (1)..(575): unsure at all n locations
  Clone ID: PAT_TA_5343
acatagaaagaaaattacttcacaaagataacctgttcttcatgaaagaggtgaggtcttcttctatttcaacacaaccatacaaaattggataattacaaaatgataagaatagacagtatattacagaggacaaaagtccacgaatatggcaagcacaatcttaagtactcccaatatggcaatcctcaaaaattagcatatacgattcccaatggtagagcagaagcctgcgccaaaactgaatggtccgattatgtattgaagcttctatcaccaagcgtctcccaacccggggaactatgtaccctctctccgtctnacttcagaatcgatcatccctgcgtacacatgngaggcccaagggaacttgttgcctgaagctttttgtaagcgccanggaggtgctgccaaccgctgaatacaacctttaaagttggtttgccttgtaactccacccgctcccaccaagccaagtccagcagccatggtcccgcctgggccccgccctggagccccagctagcgctcgagtcccccctgccacctcgtctgccccctcggtgagatatactg

SEQ ID NO: 5344 - DNA, 1081 bp, Triticum aestivum
  Clone ID: PAT_TA_5344
catgggctccgcccgcggcgacccccccgcgcgggcgggttcgcggggtctggcagcggcgtcccacgcgtcctcctcctcacctgtcctcctgcacgtcaatggcggcggcggcaggcaggcgcatctcctctcgcgcaaggccaccggcaacgccgcaggcttattaagcgggaggacgaggaggcgaggcctatccgccgtcgcgtcagcggcgacggccaatgtcaggccggcgtcgccccgcggcgtcagcgccagcgacgtcctctggccttccgccggcgccttcttggcgatggcggtgctgggaaggatggaccaaatgatggccttcaagggagtgtcattgacaattgcaccactgggggccgtctgcgccgtgctcttcaccgctccagactcaccacctgccaagagtgtcattgacaaagaaatataacatgttcatcgctcagattggttgtgcggccatcggtgtgctagccctttcgttgttcgggcccggatggctagcaaggggtgcagctctttctgcatccatagcattcatgaccatcacaggctcttcgcaccctccagctgcgagcttgcctctcctgtttattgatggtccgaagtttcaccacttacaactttggtatccactttgccctggggctgccggctgcgccatcctttgcgcgattcacgactgtggtgcgcgctcttccctggggctgccggctgcgccttcctttgcttgattcaagaagtggtggtttacctgaagaagaactgcaagttttgattcaagcgttggcatttcctgattcttgatggtttgattattatcaaacctgtggcatacataatttgacgaagaggcctctggatgaagttgataaatgtagatttagtcttcttggttcatttaccaaggaaaagtagtaggaaaagaagctgattctgcttcacaattgttattgatcatggttcacgccatgaaaatgtgaagtacctatacacccacccgcctggagtgtgatatttcgacacagaaataccctttttttctcaatagtattcttcatgccatacc

SEQ ID NO: 5345 - DNA, 948 bp, Triticum aestivum
  Clone ID: PAT_TA_5345
gaattcggcacgaggcgaaccctagcgctatgccttgcagccgcctcccaccgctgctccagatccagatccgcctccctctccgctcgctgccggtctgcaccctcccctcccctccctctcccttacctttgccgcccatcttcgccgccgcgcatccacaggagcaacacgagcggcgcgccatggggcggcaccaccgacttttctcatcaccggtcgccgtggaatggaaataaggggctgggttgtcgccgcgcgctgttcctgcaggttgtcgctgcgggggccggctgcaccctcctcccgctcgcggaggatgacgagggcgaggacgcggaggccgacaaggggggaggcggtggaggggtgcgcccggtggccatccggtgtgggcggcctcccactacgacctcacgcgccgggcgcgcgcgctggcacagccctgggtcacccgctgcggccgcagggagacgccctccatcctcaccttctaggcggggcgcaacgagacgatgctcgacctggccaagttcgtcaacaagggcgtccaggtcaagctcaccggcggcgagcaaggcacgccccgatgctccctcccctcgctctgggcacccgatgccaggcaggctgtggatgccccgaacctcaaggctggccgtgctactccagctgctcctgcctcggtcgtgctcaactttgctcctggtcagttgccgcaggatctaatgttgtttaggctgttgttgctgtgacggaagatcagaagaggcatggagatgcgcaacacagttttagttgatgttgcaccatgttttggtgcttgtgtatctgtttttgcttgtaagcacttgtatgtgcttgtgtatctgtttttgcttgtatctgctaagtttagttgatgttgggcatgcgaacatgtatgtgatgttgtgtgtaaaaaaaaaa

SEQ ID NO: 5346 - DNA, 682 bp, Triticum aestivum
  unsure (1)..(682): unsure at all n locations
  Clone ID: PAT_TA_5346
caaagccttgacgatggctgcctcccacccctcttcctcctcctcatctcatgccaccctcgcctagaacccctccgcctcccgatctccggtgcaatcttacgcctactccccgcgccccgatcgcctcctgaccctcgtcccatcggatcctccgccgaattgccggacgaatccatcgaattgcccccatcaataacgccgctgccctagaggaggcaggacgagacgagacccttgggggttggttgttgcgggggcgcggtttctggccgcgccgcggtgctctaagtgcgtgggatgggtgcgccgaagcagaggtggacgtcggaggaggaagccgcgctcaaggccggcgtggccaagcacgggccgggaaagtggcggaccatcctccgcgacacggacttcagcgccgtcctgcgcctccgatccaatgttgacctcaaggacaagtggcgcaacttgagtgttactgctggaggatatggctcaagagaaaaggcaagaatggcgttgaagcaaggcaagcgtgttcccaaggttaacactgaaccaatggacgttgatgcagataatctggacaatgttcatgtcacggtcattcctgcgaatcctttgaccaacaanntaatcntttaanaatcattcagnntgagatcnaaattgacntaaaacttag

SEQ ID NO: 5347 - DNA, 673 bp, Triticum aestivum
  Clone ID: PAT_TA_5347
ccacgcgtccgctctccaccacaaccagcgctccctggtcaggccgccccctccccttcgtcaccaccgccggcgctccctggtcaggctgccctccccttcgtcaccagcgtcgccgctccctagcaggccgcccctccccttcgaatcagatcacataagtggccgaggaggtcctcgagctcggcatgctcgcgccagtgctaggcgccgttggatgcggacgcggaggctcgggacttgcacgccctactctaccctgttccttccaatccggccccgaagtgctcgaggaggcgctcgaggtcggcatgctcaccggcgacgctgggtccctccatcctcctggttccctcgccatcgccaacatgagcctctccaccctctcccgcgcgatcgtccaggtccaggtaatctctctctccctgaccctgccgtatgctcctccccgtcaattcggttagtcgccaggtgcatcgcctcactgagatatcaccatgaatattccttttcaagactgtccatattttgttctgttaaagggctttgttagaaaatctgatttaactgagtattattctgctctaaattgcggccccttctggttgtgagtggatccaagagttcacatgatgcaatatctttttgaaagatgatacattatcttcataaa

SEQ ID NO: 5348 - DNA, 1628 bp, Triticum aestivum
  Clone ID: PAT_TA_5348
cctcccctctcctcagtctcggagcctggggcgatccgtcgacctcgcctctccgccctccttatctccttcttcccttctccgtttactaccgtgagctgagtgagatcgataaagagtggaggtcgccagttcagcctcaagagtgaggggagagtctcaggcttgggaaccttttcctttggacacatagcttgataaaagcaacacccgggtgtcgctgaagaagcatagatcggggagttttcttggcctgagaagtacaggagaggagagtagtgatagcatggcttcaaagcttgtggttcttggaatcccttgggatgtggatacagaaggattaaaagagtacatgagcaagtttggccccctggatgattgcattgttatgaaggatcgctcatctggtcgatctcgtggttttggatacgtcacgtttgcatcagtagaggatgcaaagaatgttgttaactctgagcatattcttggagaccgaactctggaagtgaagatagcgactcccaaggaagaaatgcgagctccaggaaacaagaaagctacccggctagttgctgccccgttgccaccgtctctgcatttaagcgacatgatagcatgaagatgctatgacattgtgagaacatgattttgaatgcccggatgtctcggttcaaggattctatgtggaattgggtttgtcactttccgaagtgcagaatgcgtggacaatgtcatgcaagaaaatcatgagattgatggttcaacagttgttgttgatcgtgcaactccgaaggatgaagaagtcaggcaccctccaaggagggggggaggagcacagggcgagggtggttatggctcgtataatgcatacattacagctgctaccagatatgcagctctgggcgtaccaacactgtatgatcatcctggaccagcttatggaagaggttacttgaatgagccccctgtatcaagcaaaaagatttttattggtagactcccacaagaagcaaatactgatgatttatgggattattttggccgatttggcagaattgtggatgcatacattccaaaggatcctaaaaagagcggccaccgtggttttggttttgttacttttgctgaggatggtgtagcagatcgtgtagcgcgaagaagtcatgaaattttgggacaggaggttgctgtagactcagctgcacctgttgagggtggccccagtcgaggcggttacatggaaccacctgcgccacatggagcttacagcccgatgatgtcttatggccagttctctggcagtcttggttatgattatggttatggtcccagtggaagtagcagcagatcaagagtacagccacggtacaaaccgtactgaggcattttcttggagcatctatgcgacgtgatagcgaaggagatgctagtatgaccatgatagtgaaaaaaaggatgttccgttgtcaggattctatggtaccgtgtatacttatgtttgtttttgtccaggatatgcgtaaccctttttgttcatgacgatttttctgtattcatgtgccaccggaaatttgatcatatggtgcggcagactctgaacatcaccgattatgctagctggcactggc

SEQ ID NO: 5349 - DNA, 710 bp, Triticum aestivum
  Clone ID: PAT_TA_5349
gaattcggcacgaggcgaccaccgtcaatcttgatcctccatggcgccgcggcggcgcacgccttctgccccccacttagttctttcagatcctcccccgcggtcccggtgcccacggagtcgctgggcgctgcgaccgattgcctgccgcagccgcttcgcccgccggccgcccccgtcgcgagcgtcggccgcgcgccgccgatccggcgctgcccccggtgcgccggcggtctcggacctgaggcgctgccgccgccgcgcggcgagcgcccgcctgcgcggggtccccaccagggtttgccggcccgagcgggcctggcccgccgccgtgcgacagtcctcggcccggctggccggcccgccccggccccgtcggcgctttcctgatatttaggtctttccaaggcgaaaatgattgagcatggggtggcatacagtgatgggcatgacccagacaggaaatcattttacattaccatacccaatctcgatgtccagactcccacatcgtttttcgcagtgtacaatggcagtgaagcttctgggaaattttgcacaacaaatattcaccaggagctccacaaacatcaagagtttgacactaacttgcgtcaggctttggaagacaccttgtacaggattgacaggcaaatgaaaattacctcagctgtgtatggctgtgagcacattgatgatccttcggttta

SEQ ID NO: 5350 - DNA, 683 bp, Triticum aestivum
  Clone ID: PAT_TA_5350
tttttttttttttttttttcttggaaggaaaactataagcccaaaacacatgcccgcaggccgcagcttttcttgcttgccgagctaaacagactccccaaggaacaaaaacagggaaacatcagtctccttatacacgggtcagccacacctattcttactcatatctaagaactacaactcatccacttttcagcatcttctcatcagcggtagcaccaaggctcctccgatcctacaaacagtcgctgtacaacctttcattctgttcaagaaatcatgtgctcgcgctgcgaccaagttctcattcccttggtttctgcagtccggctcaaacatcatcaatggagaatccatggataggtgatcggagaacggttccttctctcaggggacacagatctaacctcctcatgatgtcagccatttcacctcccagtcgaagaagagatctgattgagcaaatcttaagcttgatcttgttttcagtgtctgttggagctgcggcggatgatatccgtgcaatctcagcaacttcagctctcaaggcccgaacgcgtgcataaatttgcttctggaggtccaggaggggctgacggatcttttctttccacccttgagtttcttcagataagttctttttcgtagtcaacagagcaaatatcatttcagttgaaccaatc

SEQ ID NO: 5351 - DNA, 623 bp, Triticum aestivum
  Clone ID: PAT_TA_5351
gcggctttgcttttttttttttttcggcggcctccgccggccgcctcatgctccttcgcacgcccagtggtcctccgcggtgcgagaccaagtccgaggtacggccaatggcaatgcggagatccagtattatctctagcagtttatgtaaatctgtaactatggccgcggacactgcaaaacgggtttctttggatcaaaagaagttgaataaggaggcaagttttgctgcaaccaaggtcctatattctttttttttttgcggataaaggtcctatattcgctcttctaattttctatcagctctgaagcctggatcatttgtacagtggcactgggcttgagacttattgctgcttccgagctcgcctcctactcttcagaaagctttgcttatgtagatgagagagggccttcaagcaaagtcatgtgtgatgcaatacacaggctaccctttgaacctggagggttgcacttgcaccatgtgaagggggcatggaagtttctttacactgatgatccaatggcacctgcaaccgacctgccgggcggccgctcgaaatcactcagtgaattcgtcgcagtgtaaccctttgaagcaaagatgaacaacacccaattac

SEQ ID NO: 5352 - DNA, 805 bp, Triticum aestivum
  unsure (1)..(805): unsure at all n locations
  Clone ID: PAT_TA_5352
gcacgaggnnnaaacattacgttcgttggaggcagtatatccttagccgagaagacatgcaagtttaccagtctattgcaaatgcaataaatgacatcactaggcatcaaccttttcgagatatttgctttcgtaatacacatcagctgtatgatcttctggctgctgatgttggtgattcggagtttgctgcaatgcttgaaacacattgctccgacaagaatgtgaggcagctatttatgcctctccgtggccgtctttgtctgcgccccctggttgattgtaaaacgccagcagttattcaggtggatggttcggaacctggtgaggcaaaagagaatgagttaaaactcctctcggagaggcttgttcagtccctagataccctccaacctgcaaagttccattggcaatgggttgagttgaggcttcttttagatgaacaggctcttgcagagaaacttgacaaagctgaaaaaagtaagatacccatgccgatactgatgacacttgcagacgggcttcggaagctgtcccctaattccgagagctttacactatctgaaagcgagaaagggtttactgaaatcatcctgtcgagattagttgccagacctgatgctgctcctctctactctgaagttgtccaccttcttgggaagctacaggagtcacttgtcgtggatgtcaagtggatccttcaagggcatgatgctgttctgggacgcaagtccacatgacagcagcttcttactattgctacacgaagaggtgttccaataaaggcacatgtttggaaaccatg

SEQ ID NO: 5353 - DNA, 692 bp, Triticum aestivum
  Clone ID: PAT_TA_5353
cgtccgcggacgcgtgggcgacacaacgtcgtcacgcgaagaaaaacagacagtgctgcgtgctttgtcgagctcacctttcaaagactaccgtgtgtggtggtccctttcagattcaaaatatgcaggcacagctgtgtttatgaagaagaagtttgaaccaaagaaagtgtcattcaacttggatagaacatctactaagcatgatgcagacggtcgtgtcatcattgtggaatttgaatcattcttgttgctaaacacatatgctccaaacaacgggtggaaagaggaggaaaattcatttcaaagaagaagaaagtgggataaaagaatgtcggagtttgttcaacaagtagacaagcccttaatctggtgcggagacctgaacgttagtcatgacgaaatcgatgtcagccatcctgatttttttagcgatgctaagctcaatggatatatccctccaaataaagaggactgtggacagccaggattcacccttgcagagagacagcgctttggcaatatattgtcccagggaaagctggtagatgcttacagatacctgcacaaagaaaaagacatggagtgtggcttctcttggtctgggaatccagttgggaagtaccgaggaaagagaatgcggattgactattttgttatttcagaagggttgaaagacagaattgtttcat

SEQ ID NO: 5354 - DNA, 694 bp, Triticum aestivum
  Clone ID: PAT_TA_5354
gcgacctctgactgcgctgatggccccgcccccaccgcggccgacgccggcggggatggccctcccggcgaggagccacgcaggttcgttacctggaacgccaacagccttctgctccggatgaagagcgactggtccgcgttctgtcagttcgtcgcccgcgtcgaccccgacgtcatctgcgtccaggaagtgcggatgccagcagctggttccaaaggggcacctaaaaatcctagtgagctaaaagacgacacaacctcatcacgcgaagaaaaacagacagtgctgcgtgctttgtcgagttcacctttcaaagactaccgtgtctggtggtccctttcagattccaaatacgcaggcacagctgtgtttatgaagaagtttgaaccaaagaaagtgtcattcaacttggatagaacatcttctaagcatgatgcagatggccgtgtcatcattgtggaatttgaatcattcttgttactaaacacatatgctccaaacaacgggtggaaggaggaggaaaattcatttcaaagaagaagaaagtgggataaaagaaatgttggagtttgttcaacaagtagacaagcccttaatctggtgcggagatctgaacgttagtcatgacgaaatcgatgtcagccatcctaattttttaagcgatgctaagctcaatggatatatccctcca

SEQ ID NO: 5355 - DNA, 1728 bp, Triticum aestivum
  Clone ID: PAT_TA_5355
cgtccgcgttgcttcactttccggtgttccctcctctgctggcggctgccgagagcgcagccgcaccggccggccatgaagcgcttcttccagcccgtactcaaggacggctcccccgccaagaagaggcccgccggagttgcgacctctgactgcgctgatggccccgcccccaccgcggccgacgccggcggggatggccctcccggcgaggagccacgcaggttcgttacctggaacgccaacagccttctgctccggatgaagagcgactggtccgcgttctgtcagttcgtcgcccgcgtcgaccccgacgtcatctgcgtccaggaagtgcggatgccagcagctggttcccaaaggggcacctaaaaatcctagtgagctaaaagacgacacaacctcatcacgcgaagaaaaacagacagtgctgcgtgctttgtcgagttcacctttcaaagactaccgtgtctggtggtccctttcagattccaaatacgcaggcacagctgtgtttatgaagaagtttgaaccaaagaaagtgtcattcaacttggatagaacatatggccgtgtcatcattgtggaatttgaatcattcttgttactaaacacatatgctccaaacaacgggtggaaggaggaggaaaattcatttcaaagaagaagaaagtgggataaaagaatgttggagtttgttcaacaagtagacaagcccttaatctggtgcggagatctgaacgttagtcatgacgaaatcgatgtcagccatcctaatttttttagcgatgctaagctcaatggatatatccctccaaataaagaggactctggacagccaggattcacccttgcagagagacagcgttttggcaatatattgtcgcagggaaagctggtagatgcttacagatacctgcacaaagaaaaagacatggagtgtggcttctcttggtccgggaatccaattgggaagtaccgagggaagagaatgcggattgattattttgttgtttcagaagggttgaaggacagaattgtttcatgtgaaatgcatggtcatggaattgaactggaaggattttatggaagtgatcattgtcctgtttcacttgagctctccaaagaagcagcggaagcaccagaatcgaagagctccggctaactactatgtttttgtctgaaccggacatcgtggattattagattaggtcaggcgcttggcctatcatgagctatttaaacattttctatgacctgtaggccaatactgcgttgcaccctctagtctggatctggattggaattagagttcaacacttactgtgatcagctattggtgtccaagttcagatttctaagagttgttccatttatgactggcttttacaatttcggaagaaaccagatgcgagctctagggcaacattatggtccctctatttcttaacagtatatagatcatgttttgcaatgcaggcagccaaaaaaagaagcagcggaagcaccagaatcgaagagctccagctaacttctgtgtttttctcgaaccggacaccatggattattagattattattaggtcagttgaagcgcttggcctatcatgagctatttaaacattttttatgacctgtaggccactactgcggcgcaccctctagtccggatctggattggaattagagttcaactcttactgtgatcagctattggtatctaagttca

SEQ ID NO: 5356 - DNA, 824 bp, Triticum aestivum
  Clone ID: PAT_TA_5356
gaattcggcacgagggagtttctacatgatagctagatccgctcagtcgcctgtctgcgtctgctggaccacctaccggagttcattgacttggccaccattgtatcccggatggtcttggacccgctttgctcatactcaatctcctggatctggacccccaacggagaatatacggcgagttccgcctactcggcccagttcatcggatcctacggcacggcacattcgagacgaacacgatatggcgcacccacgcggaacaaaaatgcgggctcttttcttggctggtacttcataaccggatcctatcaaccgattgcctggtgctgcgaggctggctcacgaccccatctgctagcttggcttgagctccctggacacggccacccatttgtgcaaggactaccccttcaccgcggcggtccgtttcacggtgctctcttggcagggtgtccatttgagtccgagtctcgtcactaccatcccctccattgatgcctggtgggaaggtctcctaaggtcctccagcaaagacactaaaaggtttcacagcagccacatcatttacatcatgtggaatgtttggaaggaaaggaactggcgcatcttcaatggcataagcatgacgtatattgaggtggctcacctaaccatcgaggacattgcgtagagagatttagcatttagaccaagagttaaccacttgcatgagtaatttgcatgtggtgtgagtttcttggggtttccggcatgtcccctaaacatgccactctgtatatatttcccccttaatgaaaaggcagcgctcctgccgcgttgct

SEQ ID NO: 5357 - DNA, 915 bp, Triticum aestivum
  Clone ID: PAT_TA_5357
gaattcggcacgagatctcctctcctctctgctctggattccggaagctgcgggagcggcggcggacctgtaataactgaatccaaacacggatcgacctccgctggccgagcaaatcgttcgtgggggcatcgcagatttttgtacagcgccacgcctcgatccgcgatggccttgcgggtgttgctgaagaaatcctactcccagctggccggatctttctcggaaggcggtgttgcgtctctcagtaaatgctcttagtggaggtctccatcctagactggcgatccccaataacaatgggctccatggctttacagcaaggtacttgaacacctctccatgtcctcgtgagcttgttacaagaagctgctcaaggactggtgtgaactcaggtaaacataaatcacatcatgaagtcagcatctgtgcgtccagctacaggggctgggcgaactttctcttccaagacgaccaccagtgacgaaccttcaattgaatcacagatcaaagcgaattgagtcgcgtttcgaaggaaaataaggattacttccaatgcatttgttgctttcggcgttctgtattgtggcgcacttattcataaacatttagattaagattaaagacgctggtgccagggttgtggtggaagcgctgaaccctcgaactccagatagagcagagcgggatggagtcattataaaggacatcaaagtgtaaaatggtgctgggtgtgcttctgcattgtatatagagatgtctagtggagttgctcattagttggctcaaattgctagtaggagttgcattgttagttctttatgtctacacgattgtgttttcttttgagggcactcctctgttaaacagggggagtaccctttatagtgttaacgcgagttgttcataatgcgg

SEQ ID NO: 5358 - DNA, 598 bp, Triticum aestivum
  unsure (1)..(598): unsure at all n locations
  Clone ID: PAT_TA_5358
caagcaaacacgnnngaacttaacattcctcgcattttcagtatgtcggttacaggttacaaagcttgcatatgcatcaatacaagcatgactcggtaccaaatgtattgtattctacctgaatttaggtagggggggtgtctatttccatgtcacttctgtcttctcctatctacagcttttcgtaaactttagctattcactggcgatcaaccgaaataatttgtgatttcttttacgagcaagaagagctggttttctcctggcatgttttccaatctttcgaacaagatgccatccattctagcttggacaccatttaaggaggtgacatcctgtagcacccccttcacaaccctgtcaactccaagaattgaacccccgatgcctgataagatctccggtagcgtcggcgaggcctttgagatctcaactagccggaccttcttatcctgtggtatcttagctctctgttttgcaatagcaagcgcctgtgagaatccacctagcgaatcaaccaaccctcttgaagctgcatcttggccgctccaaactcgaccttgtgcaacagtctccatctggtcaatactcattgagc

SEQ ID NO: 5359 - DNA, 1604 bp, Triticum aestivum
  Clone ID: PAT_TA_5359
cggcaccccgcccaccccccctcctagccggtcggaccgccgggcgccgaccaaccgggggaggtggacccgctgcgccgcaggagggggggaagacgacccgcggtgggggagggaggggccaccacgccggcgggggggaaggcgaccagcagcagcagcagcggagcggagcgggccgagctcgttccggccgcccctgtgcccatggcggcgagcggcgaagggggtgggggcccgccggccgccgcgggccggcggcggtaaggatgtcagcaacacgcgggcggagtcccgacggtgtatgaggctgaggacctaaggccccacgaacaatcaaacggtgggggtggttatctgccagctaggaaggcaacagttgggattgtgagggtgtggtgcaaggctatggtcagtacacgagagcgcaaggccacgtcaattctatgggaccgggccaagacgaaagaggaggagaagataagcttataaccctcgatgaagtggaattaagcagaaaagaaatgtcttcgcatgtcaccacacaagcctagtctggcaggtctgtctgatgtctgtgtgtgcggaccgttcgtcaatcagtcacacttagatcacaagaaggggcctctggtggaggaaatggtggtgttgcctcaccataccgtattggagaaaaatcatggggaggaagtacttcctttccagcaaggaagaaaaaaaagagcacactagtgacacccaacaagaaatcacaacctggcaacacatttttacctcacaacctacgaagacgactccacgccttcttctgccattcctccagcacaggttgccccacctgttgcgagacttcttcacgctcctcttcttcactagctggaagaacttggacaaccgttggctttgctcataaatttagaagtgacgaccgtactttcgaaaggaaagaagaatcaggctgaaacaaagaaaaaggatgagcaagaaaaggctataaaacaacagagggaatccttggtaatcaaagcaaaacacacgccaaacatctaccaaaaaggcccccctccaaaggctgagctaaagaaggtgcctccaacccgtgccaagtcaccaaagtttacaaggagaaagagcaccggggatggcacaccggtcgaccctggaggcagtgaacaccagcgcggcatctcacagggcgcatcgtcacagcatggggaatcctaaagacgccaagaaagcgcagtgctcgccgaagagcggcgtaggcgccaaagccagagccgtcaaacccgtgagctgaatgaaggccctctgagaaggaggagcatggagcagccagccaagttcgaatgtcgctgtacaaaccctaactcaacgttgtctctgctgtcgttgtgtttcgcggttaagttgattcatgtaaggtggatgtcagtcagtcactcggtcgtttgatgatgccctcgacgaacaaatttgagagctgaacttgttgcattgccccgctggatgtttgcttgcctgggtctgggtggtttgctgatttgtcccatgttcctggcccccctccctggctggtgttgtgctcatgtttgtattat

SEQ ID NO: 5360 - DNA, 724 bp, Triticum aestivum
  Clone ID: PAT_TA_5360
gagcatttgtgttttttctgtatcgatacaagttattacatccgccacgggggctatagtacaactgtacaagagtatcatcgaatccgacatgaatgcagaattattcagctatacagcttatccgagaattctggaatcagatcattttggtacaatggtgccattttctacaatacatttacagtgtcaatttctccatgattcagggaagcatgcacgtagtttcaaggagcatggaggcaagcaaatatttacctatttttcttcaaatttacagagcagtgccttccccagacacccgaatcctcatgctccgatgctgaagatgaacatcaggcactcgtggagtgcgaaatcaggttttctcctccacggaattgaagtaatcctggagccacctgacatgcacctccagcccggcttcccggaggctgttgaggacgatcatgtacagccgcctgtccagcttggtgccctgcagcttcatgtccctcagcagctggatgaggtcgttgaaccggctggtcttgcagaacacccccaccatgagcccggccagggtcttgtccaccgtcccccccgtctccctgaactcctggtagtagtccatgcaccggtccagctcccccgaccggttgaacgcgccgacgatggccgtgtagctcacccggtcgggctgcaccttgcgccgcatcatctccttccagatcttctcggcctg

SEQ ID NO: 5361 - DNA, 890 bp, Triticum aestivum
  unsure (1)..(890): unsure at all n locations
  Clone ID: PAT_TA_5361
ggcgtccctgcggcgcctgtgtatggatgaggaggtcgagggcacgagcaaggatcatgccgaacaggggcgcaatggggtggccggggagcgcgcggtgtctggagagacaaagatgctcctaagcagaggacggcgcagcgctggcttctcctctccccccgctgcctgcacacctcgccgatgtctgctcgtcatccgagacaactagcgatgataataccttggatgcgagtgatgatggattctttacttctggaagttcgagtgatgaagaggcagatggcgagcttaccgataaaagtacagcgtatggttcatagctcttgcatctcaaataaatatgtgtaggttggcgatgaagcctgctggcctttttcttgaagcaattcttgcagggaagactctgaagtggcaataggggttggcggatgctccgagaccataaagagcctattcaatgatgagaaggatgacatggcgaaggaggattccgacaagttagcccccacaatcgggcagttggagagcttgcacgagcttgatccatggacatcgtcagagtgctcattttcttgcagtatattattttcagatctcatgtttctcaaggcttgctctcagcactcctctagacagggaaagccgatgactccatatagctcgttttgtaggcgtactttaggcaaaatttggtctacaaatatattgtttcagcaaaggacaaagggaaaatcgtcaaggtcaacgacccagtttttgttccgtaggattccctttttcaaatgaagctcctacctgaagaagggcatggtagtagatattgtatctgttttatgtgtcagaagagacgaccagcggtnattttgtgcgcacattctgtaatcaac

SEQ ID NO: 5362 - DNA, 568 bp, Triticum aestivum
  Clone ID: PAT_TA_5362
gaattcggcacgagcactggccggccatggctccaactccatgcttccaccttctgctggtcctatccgtcggcggtgcactctgcaccagcgcacttgtagactacgtccaccaacccccgatccggtgctctgctgacaactacaccgacggaagccagtaccacaagaacctctaccgcctgctgcagaccatcaccatggcagccccgcgaaaaggtggcttctacagtggcacctttggcgtgggtgccgacaagatcttcgccctcttcatgtgctacgccgaggtcgaatattccccggaggtgtgccaatattgccgttcctcacctgaaggagatatggaagaaatgcccgcagagcccggacggctaacgtctacattggggagctcccgcctcatccggtaccccgacaattctctcttcggcggcgtcgtcccccccctccaagcgaggcctctgcccgtggagcaccgcttgccccctgcaacacgagccgtcccggcggggccagcggcgcgctggtgcgccggcccacagcgagggccggcaaagacgcaatg

SEQ ID NO: 5363 - DNA, 646 bp, Triticum aestivum
  Clone ID: PAT_TA_5363
ggcggggctatggcctgagtggccacagtccttatactccagttccgttttcttattttaaacagcgctactagtacaaaataataattcttgaaacagttctgaagggcccagataagcgatgcagtagtaatctaatcaagtctgtgcagagctcgtggtggcctcaatgctgccggtgctgctgctggcatctgaagtaccaaaagaatcttcagctgatggctgtggcatgtaggttgcaaccggcattttcgccgggaggcttggcaacggcatctcgaaccgcagcacactgacagcctgcctgatggatggcctcaagctgcggtcagggtgcccgcaccagagcccgaccaccatgacatgctccatctcctgcccgtcaaactccccatccaaccgctcatcggccgcctcaaggatggttcctttgccatacgactcccagacccactgcagcaagtggacaacggagtcatcgtcatcttcttggactaccgccggccgtcggccacatgcaatctcgagcaggacgacgccgaagctatagacgtcggactccacgctggcagtggcagtgaagacgcactttgggtccatgtagccgagggtcccggccgctcctgtcgtgcacgagcccctg

SEQ ID NO: 5364 - DNA, 2057 bp, Triticum aestivum
  Clone ID: PAT_TA_5364
accttgcgtctgtcagccaggatctagttaaggtgtggtcagtatcatcaggagagtgcattcatgaggtcagctcaaatggaaataagttccattcttgtgtgttccacccaagttataccaatctcttggtgattggaggctaccagtccttggagctatggaacatggtaaagaaccaaagcatgacggtgccggctcacgatggtctgattgcgtcgttggcacaatcaccggtaaccggtatggtggcttctgcgagccacgacaactccgtcaagttgtggaagtaacaataataataataaagccgatgcgcctagatagttttttcttcttctccagataaattgatattccatcagtcgaggcatagaatgagttgttgtcgattgtgttgtacctccatcaaggcgaataaggaaagagtagcttggctggttgcccgccgcggccgagctgtttagggctggttgcggcgagcctgcggaaggaactgtatatgtatcttgattggtggttgtgtgtgtagcccaaaagacaggaaaggaagaaatgtaacattccagtgcttatttagaataagtgaggttcactgttggcgaacaagcaacagcaagatagtctgctgcaatttttcttctgacggcaagatcttggcaagtgctggacatgaaaaaaaggctgtactttggaatatggagactttccagacacagtatttaccagaagagcatagtctcattatcactgatgtccgtttcagacctaactctacacagctggcaacttcatcttttgacagaacagttaaactatggaacattgcagatcctgcattctcgcagcatacattcaccgggcataattatagtgttacgtcactagattttcatccaaagaagacggaacttttgtgctcttgtgatggcaatggtgaaatccgatactggaacgtgactcagcattcctgtattcgtgtcataaagggtggtactgctcaaattcgtttccaacctagcaccggacagtttctcgcagctgctagtgaaagtgttgtctccatatttgatgttgaaacacataccaaaaagtacaccctgcagggccataacacagacgtgcagtcagtgtgctgggacaacactggggagtaccttgcgtctgtcagccaggatctagttaaggtgtggtcagtatcatcaggagagtgcattcatgaggtcagctcaaatggaaataagttccattcttgtgtgttccacccaagttataccaatctcttggtgattggaggctaccagtccttggagctatggaacatggtaaagaaccaaagcatgacggtgccggctcacgatggtctgattgcgtcgttggcacaatcaccggtaaccggtatggtggcttctgcgagccatgacaactccgtcaagttgtggaagtaacaataataataataaagccgatgcgcctagatagtttttcttcttctccagataaattgatattccatcagtcgaggcatagaatgagttgttgtcgattgtgttgtacctccatcaaggcgaataaggaaagagtagcttggctggttgcccgccgcggtcgagctgtttagggctgattgcggcgagcctgcggaaggaactgtatgtatcttgataggtggtgtgtatgtagcgtaaagacaggaaagaagaaatgtaacattccggtgcttaactggaaggactcattgcaattagcctctgtcggttggttgtgaaatctgtgggtcttgcgagcaacagtatatggtaagttagttctgagttactgctgctgttcgtgtttgatcttctgcataaaattggcacgctgctgctagcaactattggtatgcatgctccagtttgtcaggttttgaagtgtgcaatccgtcaggttgagatgtcaagctgataatttaatcactaaaagggatagtgttatgttacagcttcagaaggcattatttataagtcggttttagcaatgaggaaatggactaatatttgtttcgcaatttggccttt

SEQ ID NO: 5365 - DNA, 632 bp, Triticum aestivum
  Clone ID: PAT_TA_5365
tttttttttttttttttaacaaaccaaaacggatttagctcatggagggtttggattcggcacggccttgctgtcttgcaatcatcgtcggtggttacagagaagttacaagagctgtcctaaaatttacacaaggacccctggaaactaaaaatgaaaagcaatcaagtcctccatctccgccactcgctgcttcaccgccggccccgccgcccctccttcgcctcgcccccctcgccgcgccgctccccccgccccgcccgccgcgccgccccgctcccccgcccgccccccccgccggccccgccccgggatccgcaccgccgcccggccgtgctcgctggatcctggagagagagagagggggccatcgtcgcgcgccagtacaacgtcaggccgctgcgcgccggagggacgaggccgccgcgcgcccgagggacgaggccgccgtgcgcctgtgctcaccacccgcgggtccgccatgctcgtgcgtcgaagggacgaggccgccgcgcgcccgtgctcgccacctgcgggtcagccatgctcgcgcgccgaagggacgaggcccctgcgcgcccgcgctcgccacccgcgggtcagccatgctcgctgcccgcgcggctgggggc

SEQ ID NO: 5366 - DNA, 593 bp, Triticum aestivum
  unsure (1)..(593): unsure at all n locations
  Clone ID: PAT_TA_5366
tttttttttttttttttaaactccggtcaataagaccaaaataacatttagaacagggaacatatcgttttccactnggaaagagtattttaaggtcattgtattccagattaaagagagcgcatgcatttcttatcatcattgccacgtaaatgacctatgcactaaaacaatccgatcaaacatatcctttgataggtgcaataacatgctgcggagaagataagcatcgtgtcttgcaagtaacagtgcatttgttagactgctccaatctaaattgccgagcgcatcaacaagcggaacacgccaagattgtcccggcatttccccaaaatgagagtccatgtcttccagtgccaccatcagctcagttgtcggtccattgtaaggaatcaaagatattctggcatgcttcgattttttttctggtctttgtcaagagtcaacacgaaccagtatgtctgccaaagtcttccttgttgcattggtcgccttgctcgaaagtgttcctgtacacgggaggttgtaggattcaatccatgttgggagcattacaggcacaaagaaagcagagctgtagctccgagatgtga

SEQ ID NO: 5367 - DNA, 890 bp, Triticum aestivum
  Clone ID: PAT_TA_5367
tctccatatccagtaacatgcagttctaacctcagccagtcggcctgcaggctagctaacagtagattcttacacaacgaataaaatgccgattcgagtatgactatataaaaccaatgccaagggatgtaaaacatgattatttttgtcgtttaaaaaaatcttgggtacatcttggattactctagtggaatcaacagcaacaaagtggacgatacacaagtctccatatacagtaacatgcagttctaacctcagccagtcggcctgcaggctagctaacagtagattcttacacaacgaataaaatgccgattcgagtatgactatataaaaccaatgccaagggatgtaaaacatgatgcctcttcatgggggccaagtgaagtgatttacaggaacacgtccttctcgagcagcttgaggacctcgtcctggttgttgagcttggcgacgtcgatgggcgtcttcccatccatgttttggagagtgacagcagcaccgtgcttcaacagaagatccacacactctttccggccccacgcagcagcggacgtgggcggacgcagtggggtgttcttgttcttatccatggcatctacagcagcgcccgcctcaaggaggatttccgcacacttgaactcaccatatccacatgcaaagtgcaaggcccttcttccctcagagtcttcttcatccttgtctgctccaccatctagagccttcttcagaccctcaccgtcaccaacactggcagtgtggtggacaatggactcgtcttcatcttcaccttcttcttcagtttcttcagtaccagaaggttcagcagtagagacagtgctaaatggcatcgtagttcccattgcctggccatcttttgaagagttcag

SEQ ID NO: 5368 - DNA, 984 bp, Triticum aestivum
  unsure (1)..(984): unsure at all n locations
  Clone ID: PAT_TA_5368
cgttcgcccacgcgtccgtccagcagtacacacacacaagctagccacagctcgaccagcacgtttcagctagctaggccaggacaatcaacagcgaagatggcctccctcaccgtctcgcagacgacaccggcggccggcaacgccaacaagcagcgcgagggcgcggagatcatcaccggcgctgaggcgtgctacgagcactccaaggagctcctcaaggggctggggttcccgggcggggtgatgccgctgcgcgggctggaagagtgcgggctggtgcgggagaccgggtacgtgtggatgcggcagggaaagccctacgagcaccacttccgcgccacgggcacccgggtgcgctacgacgccgaggtgacggcgtacgtggaggaagggcggatgaagcggatgaccggggtccggagcaagcagatgatgctctgggtgcccatcgtcgagatgagcctcgacggcgccgacaaggtctacttcaagtccaacgtcggcatcggccgctccttccccgccgccgccttcgccgacgaggacgccgctgctgacaacgcgccggcgccggccggcgccaccgaggccaacgacaagcattgatcgatcgacgtcgcagcgttcatatggtttgtgctggtgcctatagtacctgtgtgtgatacgactatacgagtgatctgcggtgcacgcattggcatgagtacgtacgtggtgcgtctcgtgcgtggagtatctttttattttgcgagtttgcttctattaatttttaccaacgatgtaatgctacgtgaatattcaataatcgatgaagtctttgttaccccnnnntnnttttttttttttttttttttttttttttnttttttttttttttttttttttttttttttataaaataaaaaaaaagggggggcattttttggggtttccgggtttacgtaccntttgcttgtggcggttttgtgtttttttttt

SEQ ID NO: 5369 - DNA, 1522 bp, Triticum aestivum
  unsure (1)..(1522): unsure at all n locations
  Clone ID: PAT_TA_5369
gaggtctccacgcgcgcacgccatcttggcaagcactctctcctcccccaccgcgccgccgagctccgcctccggccgacgcaagcagcccacctcggacgaattcttcttcccctactactcgtatctaccgggatggcgtcgggtggagatctgccatccggggtcgctgatgagagcaaaggtaaaaaaacagaaggatcatccaacgaacgtcaaggggttcctccagctgcgggtgcaggcttgtcgggtcctttgggtttttcttctatgcaaaggttgctcaatgggccatctatgaaggagatggcggacaagactgcaaggcaccccgcattcactccggtggctgaggaggtacagaaaggggcgcagacggcaggagaacagggcatgcctccattggatcctcatcaatacatggaaaaagtgcaaaggggtcatcgaaaaccctcagcttatgacaatggcagagggcctcgggactgcccttatgcaggatcctactatgtcccagtatgctggaatatttgactagtccaacacataaggaggagcttgaagagcccatgtctcggactaacgatgatccagcgtcgaagccaattcttgatgagttatagtattgtgtgcctgctgcaatgattaagttctggcatgaccctgaaactcttcaaaggattggccaggcaatgggaaatatgatgccgtttagcactgtctctactggtgtaccttcttggtactgaagaaactgaagaagaaggtgaagatgaagacgaatccattgtccaccacactgccagtgttggtgacggtgagggtctgaagaaggctctagatggtggagcagacaaggatgaagaagactctgagggaagaagggccttgcactttgcatgtggatatggtgagttcaagtgtgcggaaatcctccttgaggcgggtgctgctgtagatgccatggataagaacaagaacaccccactgcattacgctgctggctatggccggaaagagtgtgtggatcttctgttgaagcacggtgctgctgtcactctccaaaacatggatgggaagacgcccatcgacgtcgccaagctcaacaaccaggacgaggtcctcaagctgctcgagaaggacgtgttcctgtaaatcacttcacttggcccccatgaagagacatcatgttttacatcccttggcattggttttatatagtcatactcgaatcggcattttattcgttgtgtaagaatctactgttagctagcctgcaggccgactggctgaggttagaactgcatgttactgtatatggagacttgtgtatcgtccactttgtttctgttgattccactagagtaatccaagatgtacccaagattattttgatgggccgcttcccatccttgtcgtttgaggatgatagcagcaccgtactacatcgggagaaccacacagacttttggtctctcaaaaaaaaaannnnnnnnnnnnnnnnnnnnnnnnnnnnnnn

SEQ ID NO: 5370 - DNA, 1151 bp, Triticum aestivum
  Clone ID: PAT_TA_5370
ctcgggcaatgttcctctaaatgctgttcagcttctctgggttaatctcataatggacacactcggcgcacttgcattggctactgaaccaccaacggaccagcttatgaaaaggacacctgttggacggagagaacctcttgtgactaatattatgtggagaaacttgttcattcaggctgtctatcaagtggctgggcggccgcccccgatcttgagcggcccagatcttctgcatttgactcaagataccctcgaacactccagtaaagtgaaaaattcatttatattcaacacgtccgcggacgcgtgggtgtttaacgagttcaatgcacgtaaaccagaagagctgaacatatttgaaggagtttcaagaaaccacctctttttggccgttgtgagcgtaaccgtcgtgctgcaggtgataattattgagttccttgggaaatttacatcaacagtgagactcagttggcagctctggcttgtttctcttgctattgcttttatcagctggccgttggctcttgttggaaagttcattccagttccccagaccccattgaagaatttgatcctgaagtgttggccaaaaaagaagaagcaaggtgacgaaggagcagctcctccaccggtgtgacactgaacgtctctcccaagtggcagaaatcatcagctgccaaaattccagttctggtgcatatagatgcttggataaatttgaatgctgatttcctctaactacgctagctagcttttacctgactaaatactcgggaggttgaagccaacactaatgagacgcttcgtcctcgcttactcgtaagctgggggtctgaagccgacctgaactaaagaccattttagtagcctaacaaaggtcaggaactccgtcggctacacacctgtacaaatggtgcagcatgtctagaatgttcttgcagttgggaagatcgctagtaaacaaatttccttttggatacgattgatgtgtatatcgtttcgtctaggttccctcatttcctctaggattttgttctagcgaactagtgagtcctgtggagagaactctgggctttcttttgagtggtaatgtttgtgtggtcgaatcatgaacttgcataatgtgcattaaattggtactgccttcc

SEQ ID NO: 5371 - DNA, 665 bp, Triticum aestivum
  Clone ID: PAT_TA_5371
ttgttttctcgttcggcgttccttgctggcaggccacccccagccccgcgccctccaccttcctgtttctctctcggttctccggggcggtttcggctccgatgcggccggcccgccggcgcgcggcccggcccagccggtgtccccggccctgcgcttcaggacccacccctgcgcgtccccgggcccgcgcgcctcggctgcctcgccgccgcgcccgggcgcgccccccccggcgccgcttggcggctcccccggcgcctcgccgccgcggccccggccctgccggggccgccctgctcctccccggcggggccggctggcctccggggccccgccccatttctccagggcgcgagcaatgtcgtagcgccctgccctctcaaaagattttctacttggcatataagaagggtccatcccccagttcttctggaatctcctgatctcttcttccaagttctccagattatcccaataacctcttggtttccgatttttataagaaagggaaagattcattaaggtagcaatcttcctgaacccacccatccgtgttatagccttctcgatatcaactctcccatgtgtacgaagatgttttctcttaggcatgaaactcgtgccgaattcggcacgaggaaaaatcaagcccagtggctgca

SEQ ID NO: 5372 - DNA, 516 bp, Triticum aestivum
  Clone ID: PAT_TA_5372
ggacaatttgaacatatttccacaaatttataagtgacaatgttatcactcatctatttacaaatcttaacaacaaaggggggtttccagagctgatgtttgcagttcttcaattacagaaacatcttatatatgcaagatcatgcaactgagctaattacttgatcaagctacacggtcttggagcacttctggatgaaaacattctgcaactacctaaccaaagtgctacacagtattacaaccaaacctcatctacagtgaagcaacggttaaaacctgcccgggcggccgctcgaatcgctgccgcctctgatgtcactcagtaaagcaatttgatgcagaagttgcgctatcctcttatccttctcctgcgagagcatgacgaggaggtccctctccctcctgtctcgccgccgcacgtacaacagcgcgccaaccacaacggccgccgccgcggccgaccagacggccggcctcaccccgggacatccgcactctccatgcacgagcacg

SEQ ID NO: 5373 - DNA, 736 bp, Triticum aestivum
  unsure (1)..(736): unsure at all n locations
  Clone ID: PAT_TA_5373
cccggcaataatcaacagtttccctctctgctactcttgcccacgtatgtcttgcatgtcttgcgcatcgaaagaacaaataagacactggaacatcatttcctttacagtgcttttgcaaaactctttcaacaagagaaacaaaacatgctcttccccagtataaccctatgacatcctcacaaactaacctaacaacacagggggtttcgtgtgtgttttttctttctcctaaccgtaacactaaatattgacaatcttaatgaaactaatcggagaagaaagtttacatggatgccttgcaaagtgagacctaccaacataactccatctgaccattgaacccaatatgatacaaagtacaatttcagcaaaacttcatgggaaacataagttgattcttcctgccaacaaaaaatagctggtttctatggattcttctggcgatcgggcaacccactcactcatggatatcaagatccttggctggcaccgacgatttcctacctgattccacaggagtttagccttcatccgtttcagtgggatccgactttcccttgctcttttctagccatccaagccccctagaatgccagcccgcttgcgtgctgggtggtccgtgttctccttcgcgctttcgcgtcccggcgtctgcgtgcggtgccgccggctgganncttgtctcanaanttcgcanaagtcctccantgnaaccataaangntaattcctgg

SEQ ID NO: 5374 - DNA, 1169 bp, Triticum aestivum
  Clone ID: PAT_TA_5374
ctccgcagcagcagcagcagcagccacaacctccctcccctatccatctctctctctctttctcactcctcacctgcggccgccggatggagacctccctgcggctgcgcggcgccgacagcacctccgggcagcagctgggcctccgcatccacgccaagcagaagctgcccctcgcatacaacgcgctcctccaggctcacgcggagatcgacaccgccacccggaagcccagcctcctcgccatcctcgcaaggcacttcttcccacagctgtcggccaacgtcggggcgggggtgcagctggagaggggcaacatcttcaggtacaccctccgggccaagaaggccgtctcattcaccgacgacggcctcctcggcctcaacatcaagggacgcctcctcgcagacaagaacttcaagccgaggaggaagagcggcgccgtcgagctcgcctggaccatactcgacttcagaaggggccaggacgtcaggatcaaggccggatacgagctctaccgcaagatgccttatttccagctgagggagaacaactggaccctcaatggttacatggatggcaactgggacgtcagattcggcatctgctcggctagcaacccgattctggaggagagaattctctggcacgcagtgagcgcgctcgtagtcgagttgctccgctagaggccaccatttctcttgatgggataggattgctcccgcaagatgccattcacccggcagcgggagcaagttttgtggattaaaaggtcgaaggccgaggtagaaacttagacatttcattggtgaggggctgtctggaaggtcatcatttagcgccgtagttgtgtggtccctcctatagaggccactatttaacttcattccgttctatggcaacggcaggatgcaatacaacaaattgcgccagttctatggagaaagccgtatgtagaattagaaacctagacgtttctttgatggaattgaatcaggaaattcgtgggacggtagcgccctttggctgtgaattgccaaatagaaagatggtccaaggtgaagtgctggtaagaaaaaccccaggaaggttcccaaaggtgaagtgcatgtaagaaaaacacaagatgttcccaatgaccttcactccaaaaaaaaaaaaaaaaaaaa

SEQ ID NO: 5375 - DNA, 829 bp, Triticum aestivum
  unsure (1)..(829): unsure at all n locations
  Clone ID: PAT_TA_5375
ggcacgaggttttttttttttttttttgcagtccagaaagaatgctatcctccaaacaattataaacaatcaccatgtttatcctttcttccgaagacccctaggtagcttttccaatcgtttttgcatgtgcagtatcaacccctccagctaatccggtttgaaataacactacgagctagatggacgcataacgacgtacatacatagatcaatccaagggaacagcaccgacttgatgacatagcgtaaaggtccagagtacacaaagggaaagaatcgatgctgtcgttaatccgttggtaaggcgaggctgggcttgtcggcggagggggacggcaagctgaggctcctcgtcagctcgggctcgggctccgtcttccggttccggacgctgccttcgccgtcatcgtcgtcttcgccggacgcttgctgctcctcctctccgtcaggctcatcgaagagggatttgacgcttggtctcttcgccttctccttcttcttcagaccagccatttcaagaacttcatcatcattcacaagttcaaagttcttgtaaagtatagcccacgaaattcaggtcctttgatgaaagcatcttcctccaagggcctgtctttgatgaaagcttgagaatgatcggaagactcttcaaatttctcaaaattctgaggtgtccaactcatcccggtcttctttgaggtaagnnatgccgctttcgggtttnanaccaattttcttcccagntctaactttnaatnaaaaccangaaggggnctcncttnaaatnccctntngcaccctttttggtacccaaggggtttggncc

SEQ ID NO: 5376 - DNA, 1252 bp, Triticum aestivum
  unsure (1)..(1252): unsure at all n locations
  Clone ID: PAT_TA_5376
tcacatcactcaccccgcgtccggctactgtgcgaggccctgagctaataaaatttattagcagatgcaagaatctgcagcaattatgggtgatggacctaatcgaagaccatggtctagctgtcgtggcaggctcttgcagtaaactgcaagagctgcgggtcttcccgtctgacccttttggtgccgggcaagttttattgactgaaagaggccttgttgatgtttctgccagctgccccatgttggagtcagttctctacttctgcggccagatgacgaatgaggccctcattacaatcgcaaagaaccgtcccaacttcacttgcttccggttatgcatccttgggccccgtactccagattacgtcacacgggagtctcttgatgctggcttcagtgccattgtggaatcatgcaagggccttaggcgcctctctgtgtctggccttctcacagatctcgtgttcaaatcaatcggtgcaaatggtaattgtcttgagatgctgtcaatcgcctttgctgggaacagtgatcttggcctgcattatatcctctctggctgcaagagcctgaagaagctggagatcagggactgcccatttggaaataagccgttgctggcaaatgctgccaagctggagacaatgcgatccctttggatgtcgtcgtgctcattgaccctgggcgcatgccgacagcttgcagagaagatgccccgccttaccgtggagataatgaacgatcctggacgaacatgccctgtggagtcacttccggatgatagcccggtcgagacattgtatgtgtaccggacaattgccggtccaaggtccgacacaccagattacgtccagattgtttaagggtacagtggtgtattcattttcaacctggattggattggtaccttcaacaccttcctagcataacatagaatttttctgtcaagtagaaaggctggtggttggatgaagctgtcgtaaaatctcgactcggcaagtgtaggatgagactggaggccttttcaggtgttaataactgtaggaggctgtgggtggattacagaaactgctagatagcgttatgagaaaacgttggtttgttttctttagcgtgtttagttcttttatgtataaagatatggcaccattttaatcttgtattgtacctgcccgggcggccgcgataaactgtacctggagctgagtttttgtcatcccaaaaaaaatggccccnccttaaaaaaaaa

SEQ ID NO: 5377 - DNA, 821 bp, Triticum aestivum
  Clone ID: PAT_TA_5377
gtcttctaccattgcactgcagcagattttctctgggctgtttgcagatgatgttttctttatgcagttgtatatcgaagacaagctcataccctgcagtatcagaaaccagcaaagtttctatttccattcttacaaagcgatgtgaggttatactgggtcagtttttagctgatgaaaatgacctaggagaccgtccattgcctagtgtgaggattgaagaaacggtttgtgtccttcaagagcttgctaggctaatattagatattgaaacagctaatgctctcaacataccgcggtacctgaaagatgctttacgggaaaaccagtcccatgggagggcccatttgttgtcgttgcttcccactttctctgagcttgtcgtctcaagagaagccagggttcgggagcttgttcaggtccttctcagactcatctcctcagagctaggactgcaacgcctgacgtaaagatgaatgatgaactccgtttttattcttttgctggaccggaatgctatatcttcgttagtattccacctcttcatttacatccatgatcctgtatatccgccatgacgggcgagaggcgctcgaggaatcacatctataaatgaatagggttgtacatgtaacattttgttttctgtttctgtaaacattaggtatatagccaatatttttcatgtttgacgtagcagtagtcaacctctagttgtgacagtaacttgtattttgaactgtggattaaggctgtgatggtgttgatacaaaataatgaaccgtctacactgatgaatgatctgtaagcacattcgagcc

SEQ ID NO: 5378 - DNA, 702 bp, Triticum aestivum
  Clone ID: PAT_TA_5378
cccttctgttctgttcgagagaggcgacagaggaggcgtctcgggcccggcccgatcccggatcttcgccgccggcgacgccggtcggagaggagatgggggaggagctcggagcgccgctgtagatagtagatgtagcctagctgtttccttactggagtttggcctcgtgccggagtttggcgtcatgccgatggggaccttgccgccggcgcgcccgagccgcgtgcggtggttttcggaggggctcctgatggtgtggtgattggttcgctgctgctggtcggaatcaagccggagtcctcggaaataaagctcgtgggtgtcccagatctggagctcaagctccttcttccccacttcttctcgagctgccatggaggtggactggaagaagagggaggaaggggatttagttgctctattctttctgcgtgtccttggagcctaggttttgcagcaaatggtgggggatctcggtgcaaagagcatcaggaggttctcgccgctgcgccgctgcaccttctggtcgaaaggcgaccactcggagttccggcgacggcgtccagctcctctatttcctcctggccgtcgagccatatgggaggcagtttactaggttcttcgtctggtatttcaactgtctacctccggtcgtgcgctggtggtgttgtagccattcctccgcgccaagtggtttcg

SEQ ID NO: 5379 - DNA, 1164 bp, Triticum aestivum
  Clone ID: PAT_TA_5379
acgcgtccgcccacgcgtccgtattgctcaagggaatggccgccgcgcagtgggtaaaaacaattcgtttccaagtcggccacgcaaccgtcccagggcccgcctcgtctccgtcggctccgacggcctgggtcgccaggggggaggggcgtcggctctccttctccacccgtccctttgagagtcgctccaggcaccccggcccgatctcgagcctcgtccgtcggcgatgccgatcgacgatggcttgggagaggcacccgggagatgcttgtatatactggtttagttcagggtcggtcttgtggtttggcgctatgccgttggggttttctaccgccggtgctttgcgaggcaactgccggtggttgccgttcttgtcttcttcttcgtctccatggtggaggaagggaggaggggcgctggatctggcgaaatccctctcaataagctcgcgggtctctcagatctggagctcaagctccttcttccttacttctcctcgagctgccatggaggtggattggaaggaagaggaagaaaggggatttggctgctctatcctctctgcgtgtccttggagcccaagttcctgcagcaaatggttggggatcttggtgcagagagcaccaggagtttcttgccactgcgccgctgtatctgctggtcgaaaggcgaccactcggagttctggcgacgacgtccggctcctgtatttcctcctggccgccgagccatatgggaggcaggtttatctggttctttgtcctggtatttccatggtctacctccggttgtttgccggcggtgttgtagccattccttcaccccaagtggtttcgtccccggtggtggtgggatcgggccaggatcgaagacggcgaagaggactcgattgcttttcatttttgttgtctggggtcctatctgcaaaatgtccggcttgggttgtaattttttctttctgttgggcctttctgtaatatgttgcatgcttatctagtataagtctgggtccttcggggcccttcttgtgttcaaaaaaaataataaaaaatggatacttggtctacgctattatttgttgaacttaggtgtgaaattgttagcgtatggtccatgtctaatgccacaggtggcgtataaattgaaaagttttagagc

SEQ ID NO: 5380 - DNA, 466 bp, Triticum aestivum
  unsure (1)..(466): unsure at all n locations
  Clone ID: PAT_TA_5380
ctcgtgccgaactcggcaagacaccagtagtcacacaagagaaaagcaagagcagcaagcagcacagagctagagaaaagaggagcgtctcatcgggaggaggagaaagaaaaagcgagcgaggatgtgtggcggagcgatcctcgccgagctcatcccgggcgcgccggcgcggcgcgccacgtccggccatggccacgtctggccgggcaagggcgccaagcagaccaaggccgccgcggccgacgacttcgaggccgcgttccgggagttcaacgaggactctgatgtggaggacgactccctgatggtgatggagcggcgggaggaggtggccccaaaacaacccttccgtgttcgccccttgccgcccaaagaaancaacaatcaangagggangatgganggtggcccnccttccncccgcaaagaaagccgggngncaattaccgggggngtttccggg

SEQ ID NO: 5381 - DNA, 546 bp, Triticum aestivum
  Clone ID: PAT_TA_5381
gaaggcgccccggggcctggttctcttcgccgggccgcccccttccgctccccggtcgcgctccagcgtgccccttgttcctctggaggagcagccaccacttcccctcatggtttgccttttctacaacaatggaatggttcggttcagtggtgggtctcccgcactacaaacaatccaggcaaacacttttacaagtgcgagcacgggtgggtatgtcctaatatcttcataattttttagtactatcctgttcttctgcaaaatttgttcttcgtgttctctcctcatttttgtagtcgcgcaagtgcaccttctggaaatgggaggaaaactacataaacatcatacgtgccaagtggccaaagttgttcatcaccgcttcccgcgaagacaggaaattccaccgcatcatcatcgctcttctctcaatcaatctgatcgccctgctgttcgtatggtgcaaggtggcctgaagccgccagtaacttcaagacgcatgtctgtgcttcaagttccacccgcataataatgaagaattatgtt

SEQ ID NO: 5382 - DNA, 639 bp, Triticum aestivum
  unsure (1)..(639): unsure at all n locations
  Clone ID: PAT_TA_5382
gtaccgggccccccctcgagcggaagactcagaagaggattatgagaccctagaagacgaatacaggacccgagaggacgaatatgaatatgaaaccctagaagaatctaaatatggaatcctagaagacgaatacgaatatgaaaccctagaagacgaatatgggagcccagaaaacgaatatgggaacccagagaacgaatataggactttagagaaagactcagaagaggaatatgggagcccagagagcaaatataggacccaagaggacgaatatggaactatagaggaagactcagaagacgaatatggcagccccggggaaagcgcagaggaaaaatatggtactttagaggaagactcagaagaagattcagaggatgaatacgagagcccagaggaagattccatcttaaaaaaagagggtttgattgagcatcgaggaacaaaagaatttagtctaaaataccaaaaagaagtagatcggttttttttcacctcggccgcgaccacgctaatcactagtgaattcgtctgcatatatatgggtngtancatcccaaatcagaatcatnngggcngccatgananaaaaaacntcggatcaatntcgggaatnttcnaaggggtaaattt

SEQ ID NO: 5383 - DNA, 1705 bp, Triticum aestivum
  Clone ID: PAT_TA_5383
ggcgaagcttttcttcatgctctcggcctccttatccttccttccccttctccccccctacggctggatctagagtagccccgttaaagcccaaacaaaaaccccgctgcgagatctgcgcatctcgccacaccaccaccacgacggccatggcggcgccgcgcgtcctcctcctcctcgccgccgcggcccttctcgccgtcgcctccctcggggacgcttcgggcgagggcccccgcgggcgcaagctgctggtgctcgtcgacgatctggccgtccgctcatcccactcggccttcttcggctcgctccaggcccgcgggctagatctggagttccgcctcgccgacgaccccaagctctcgctccaccgctacggtcagtacctctacgacggcctcgtcctcttcgccccatcgaccccgcgtttcggcggatcggtggaccagaatgctgttctggagtttatcgatgccgggcacgatatgattctggcagcagatcattcggcttcagatctgatccgcggcatcgcgacggagtgtggggttgactttgatgaggacccggaagcaatggttattgaccacatcaattatgcctccagtgaggttgaaggtgaccacaccttgattgctggcgatgacctgattcagtcagatgtgatattggggtccaaaaagattgaggctcctgtgctgtttcgagggattgggcatgcggccaatccatccaacagcttggttttaaaggttctatctgcctcgccatcagcgtattcagcaaacccggaggctaagttggcatctgttccatctctcactgggtcggccatatcgctggtttctgttatgcaggctaggaataatgctcgtgtgttgatatctggatcactggatttgtttagcaacaggttcctaaagtctggtgtgcagaaggctggcagcaaaatgagccatgacaaagctggaaatgaacaatttgtgacagagacgagcaaatgggtcttccatgagaggggtcatctgaaggcagtgaatgtcaagcaccataaggttggggagacaaatgagcctagcatgtaccgcatcaatgatgacttggaatactcagttgagatatatgaatggtctggtacaagctggaagccatatgttgctgatgatgttcagattcagtttttcatgatgagcccttatgttctgaaaaatatgtcaactgacaaaactgctgtatattcagcatccttcaaagttccagatgtttatggagttttccagttcaaggttgagtaccaaaggcttggatacactggcctctctcttgcaaagcagattccagtgcgtccatacaggcatgacgagtatgagaggttcataacttcagcgtttccgtactatgctgcctcattttcaacaatgggagccttcttcatattctcagttgcgtacctgtatcacaaatagatagctcatcgagtagtggaagtaaatcaaggtggcgatggaattgtgatgtcataagcctggtgatcttaggtgcaattttatggaaccatatttttgtagcgccaatctgtagtacctttatttttaagaaatgggcttctccctgcccccaacttttattaacatttttgctaattttcagttgactgaaaaaaaaaaaaaaaaaaaaaaaaggccctaggcggcgagcgaggtcc

SEQ ID NO: 5384 - DNA, 735 bp, Triticum aestivum
  Clone ID: PAT_TA_5384
tttttttttttttttttttttttagtatgaatctgtcacatcttgatgcttgatcaacacaaaaaatctacagcaattctcgagaaattacatttggtatttccacaatgacacgacatcaatcaaagggacttatttccaaaataaaataaagtacacttagcaataatggggacatgcatggtttcttcaccggatcccaacagacccatctttcatgctcactgtagacctgatcgaagaccttgttcgcaattcagtttattccgttgagggtgtcaataattttttctatagtgggtctgcctttccgatcgatagtaacacattccagcccaattttgatgcatcgcttaacttgattgaggcaatctggggttaaacttgagtacttgaatgttatgtaatcctctgtccaattttttgtacattatcaataaaattccttgcggacggttggttggtttcaggacaattcttctctcctgtggtgatctcaattatgagtaggcctaaactatatatgtctgattgcgctgagatttcacccctgtatagattcccgagagccctatggccggcgggtccaaccaccgtctgtgtgcacaatcggggttgtgcttcgccgaagactctagagagtgcaaagcccgcagtccccgccaccggatcctcagccacctactcattccccggcgtcggatccatatggattatgggaatatctaatttgtg

SEQ ID NO: 5385 - DNA, 648 bp, Triticum aestivum
  unsure (1)..(648): unsure at all n locations
  Clone ID: PAT_TA_5385
gtagggatcaacaggctatcaaaagaaaacaggctacaatgtcagagcattcctgcatctcttcacaaactggacaatacatccctgcatgtcttgcagagtaggattacaggtcaaaaccaaaaaggctaattagaaatctctgaagctcatcttaggatcgtcgtgccttgagttcccccgccttcctctaccccggccgcctctccctcgtcccctgcccctacctctccccctgcctctccgcataaagaatgacttcccatgcttcatctcaacgagggaatgtaacagctcatcacacaagatacaaccctcatgcaaagtggctccatcttcaagaggggtggctttcttgttgaagtcgacttcaatgatagttgactcgcacgttgggcacttcttatctgtagtggtgattctgtgagcggcatgtgggagtagcacgacgcagttacacgtgttgcagagaagccgccattttggtgcgctaactggatcgagaatcagggtaccgctacactctggacaggcgcaaactccctgggtgatcattgattgcttgcaagtcgggtgcgggcaaaggaagcacggcatgccggcccctttcccaaccttgccggtgtcatcaagncttgagccccccgc

SEQ ID NO: 5386 - DNA, 880 bp, Triticum aestivum
  Clone ID: PAT_TA_5386
ttttttttttttttttttttagaacaagatggcaggacgacgaaataaatcaaaaatagaagatttcacaaccgtcaagtgtgaaataaatcaacagagcaaactcagataaaaatcaaaatggtttggtaacagcacgcgcaatatcaaccttacataaacatatgctaatgctatacttcattctaagctatcaaagcataaacataaacaaaaaggtgagatattttccaggtcctagagtgtatcctgctatcaggttggttagtagcactgccacaattttgccagtccagctgtaagattaacctcgccaacagtccagcttcagtttgtaagttgtaacggcgaactggtgcccatgggatccttggtagggcatcaatatttaccatagcgggttaaatgtgggataagaaaattgagaaaggggcctaaactggttcgcatgctgaagtccttatgatgcgaatggggatgattcttcaattgatttctggtctgtgggctttaactcccaattacgaaggctgccagttgtcgaatcggactttgaaatgtacaaaaccttgttgtggaacctgtgaagtgttttccggtgaccgacacttatatatgtaatccctgcagcttcaatctgactgtatagatgaacctcatttgtatcatctagtgcacttgtggactcgtccagtaggaccagagttggttttgcgagtaacaaccgagcgaatgcaagacgctgttgctcccctagggaaagaacactagcccaatcatggacagaatccatgccattgaaacgtggtaatatgtagcccagcctaacaacctcaagtactctgatcagttcatcagttgagggcatctcaggcttggc

SEQ ID NO: 5387 - DNA, 2133 bp, Triticum aestivum
  unsure (1)..(2133): unsure at all n locations
  Clone ID: PAT_TA_5387
cggacgcgtgggggggcganaaagtaaaagaagtccaaatntaaggttgatggggacggcattattttgttaagcctgccaacacggccgtagcagaggaagggacgctgccccctccccgcccccgcccccccaaacccctcggccgccgccggcgaagcgcgcggcgaggatggcgctctacctgctcttcgagtccgcgtccgggtacgcgctcttccacgcgcacggcatcgacgagattgggcagagcgtcgacgccgtccgctccaccgtgctggacctcaagcggttcagcaaggccgtcaagctcgccgggttcacccccttcctctccgccgtcgacgccctcaaccagtgcaacgccacttccgaagggatcatgactgacgagcttaggaacttcctggagctcaacctgcccaaggtgaaggaggggaagaaggccaagttcaccgtcggcgtcatggagcccaaggtcgggtcccacatcaccgaggccaccggaatcccttgccagtccaacgactatttccaggaactgcttcgtgcagtgcggctgcatttcgatcaattcattgagcaactcaagccatctgacctggagaaggcccagctaggtctgggacatagctatagcagggccaaggtgaagttcaatgtgaatcgtgtggataatatggtgattcaagctatctttctgttggatacacttgataaggatgtcaattccttctctatgagagtgagggagtggtatggatggcattttcctgagctggtcaagattgtgagtgacaaatacctctatgctaagcttgccaagtttgtggtaaacaaatctgacttgtcagagaaggacattccagctttagcggatctaattggagataaagccaagccaaaagaaatggttgaggcaccaaagccatctagggaccagaatctttcaccagttgatttgatcaatgtccaacaggttggcccaagggttatgaaactaacagagtatcgtaaaaatctctatgagtgtctggtgacaaagatgtatgttattgcacaaaacctgacgtcattgattgttgaaaaggttgtagctcggctaatctctcatgctgtgagtcttttaaatcttttaaaatgcgctgcgtctactctgcagatactgggtgtggtgaaggcgctcttttgagatctcttaaaacgctggaaacacaccaaagtatggcctcatattccactcatcttttattggtcgtgcatcaaccaagaacaagggaaggatggcccgataccttgcaaacaaatgttccattgcttcacgtattgactgctattcagatatgagtagctccattttcggcgagaagctgcgtgaacaagttgaggagaggctagacttctatgataagggtgttgcaccccgcaagaaccttgatgtgatgaaagctgctattgatggcttgacaaacacagaggataatgacggcaaagagaatggtgacgcatctgtgaagaaaagcaagaagaagaagtccaaagctgaggctaacggtgacgcgatggacgttgagaatgccacggcagaagctgaaactggaaccgagaagaaaaagaaaaagaagcacaagcttgaggagccgaaggacgaggagatgcaagccaatggcgatgatgagacccctaagaagaagaaaaagaagaaccgtgaagccgagtctgttgatcctaagacaggcacagaggggaaatccaagaaaaagaagaagaaatccaagactgacgacgacgagtagtagattagtaccttagtacctagcagcgaatgttgaagccgattgaggatgaaattttttgtaccgactgtttaagtgtgtactctttgagcctctttgagcccttgatgaggtctgtaatgtagcgtggcatggactgaagcggcgaatctgtattacatttgatgttgcagtatggcgtttattgggaatggcttaagctttactagttataaatcgcgaggcattgctggcaccggcaagtagctgaatgatcaatgatcacattagtagcggggaccaatgaatttgaaaccactgccttatatacatgttattggctaaaaaaaaaaaaaaa

SEQ ID NO: 5388 - DNA, 1144 bp, Triticum aestivum
  Clone ID: PAT_TA_5388
cgcttttttgtaaggatcaaacctttgggctccattaaccgggggacactgtagtggcgttgggccgctaactgaatttgcatgctgaattggtgtcacctgactttatggtggtgggggggggctcgcgacatcttagtggaaggcaccgccagtgcaatacaacgggctaatacggagaagccctaaccacgggctgagctggagatgtcttacccaagttgaaagcccggtttgtctaaacgataaagacctgaagtggaacatgatatagatccggcgaagaaaattgagtgcgagagaatgtggcacctgaagggctcttgactgttttttgtgctttcactctctgctgcatgcactctctcctgcccatttttgacctacgtccgtttggaatttccctgccgtcgattggaagaacccttctacgtcccgcccttgctccttttcatattccagtgcttgaagtatcatctcaaccttgtcaaaatctttaacaaccttcgcttccaaagtggcgttgttctcatactccatccaaagttcacgaatttcgtcggctcttgaacctccaccaagcaatgcgcacatatggtccaaagcttccttctctctacggctcttctcttccttgggcacaccatcagcaggggtgatatcgccaacaatagcttcggctatgtcatgcacaatcgccattttcacacacctatcgcggttgacgccgcccggaaggtcggcggcgacgagcgccatgactcccatccggtacatgtggtcggccaccgactcggggccccggcaccccgcgcctcacccaccccgccctcttcgtcgtcttgaggcggtagcagagcgtgaggaagtcgatggcggaggacgccgacgacgccgccggggccgcggggtcggacccaggggccggggcgggcgaggaggaggacgacatggcggcggcgaggcggggccggaggtggcgcgcgcggtggtggggggagaggaggggggaacctggtcgcggcggcggcggcggcgccgagggaggcggcgcagagggaggagagggaaagggctcggctcccacccatggctggggttaagtattgggtgaggtgaggtgaggccgggaggagcggtgcgg

SEQ ID NO: 5389 - DNA, 657 bp, Triticum aestivum
  Clone ID: PAT_TA_5389
tagaattcggcacgagacgatgatgataccagccatttgggcgtgcacacaaatgatgatgatgacgacgacgatgatgaatggcatgatggtatcagttgggggcagccaagctccagtgactctgaacccagcccaagtcctagtcccagggaggaccggcacaccgggatgctcaaggccatggacaagcagctaaagatgctcacaacccgattcctaacgtctgcaggcatatccttgccccacgaagatgacggcggcgaaagctggctcgacatcgtaaccgccctgtcctgggaggctgctctgctcatcaagcctgacggcaaagccggaaatgaaatggaccctgggtcttatatcaaggtcaagcgcgtcgcctccggcacccgccgacagtgtgaggtgatcaacgggttggtgttcaggaagtatgcagctcacaagcacatgcccaccaagtgccacaaccccaagctgctgctgctcggaggcaccctcggcgactccgatgtcggtctatcatcatttgattccatggggcaggaaaaggaccatttggaaaaggccatcagccaagtgatggagaaatgtgctccagatgtcatcctggtggagaaaacagtttcacgggacatacaggagcttctactg

SEQ ID NO: 5390 - DNA, 641 bp, Triticum aestivum
  Clone ID: PAT_TA_5390
ccacgcgtccggtcccactcccgcaccggccaggacccaaaccctagacccatttcccctcgatccccacagcctcttccgcctactccatcccttcttcgtgcctcggcacggcctccgccccagagcctcgccgccacctgctattcctcatcgcccatgcgagctcggtggcgggatgaatggacaggggaggtgggcgacgagggctactccacccaccagattcgcgccgcccctgcccaaatcctctccgcgtgcgttgcacccaatcccgtcctcgctcgtatcgtccgacggacaggtccccatcctcctgcggttcccctccctttgttccttctcctccctcacgacatgtcgcctgtctccatcccgcatcttgctgccgcaacagcctctccaggaggctcgccctccgtgctgcaaagtagcaggcccggacctggaggaggaagaggagatcagggggtccaggcggtggctcggtacagttccttttcgatatgctcttcatggcgccgatggcttccacggagcagaggaaagtatgcgtgccttctgctggaaagggctcggtggttgggagagtagcgccatgaatgatgaatgttggcgatctttttattgtgacacaacgc

SEQ ID NO: 5391 - DNA, 660 bp, Triticum aestivum
  Clone ID: PAT_TA_5391
ttttttttttttttttgtttttaattgaattatccattttatttcatgcagctaccaaatatagctcccaaaattatcatcacagcgacttcacaattaccattaatacactaaacttgtgatagtttcggcacgaacattggagagtaggctggcaaccatagacaagagcaatagtactgacgactgcatatatattttagcatacagcgtaattagcagttgatctttttcagcccatgtgcgaagtagaggaaagttgggtcagcagctccgtccttgtagtaggcgaacaccaggctgccatcatcatgcatgctctcgcccacaaagaactggaaatccgcgagcttgctaagaagaaactttgtggcagactcaatgtggtccttgaaacatccttgttcctcatcttcaagctgggccctgtgcttctggacctcgcgctgcgcgtaaccgctctcctcccgcctcccaaaaccgggtacccccgtcacgccctcgcctcccgcaccctcctcaccacctcccccacgctcgccgccctcgtcacaggggctcgctccgacggcctcctctccggcaccttgcacgacccgcggtccgccgacttcccggcgcacgccgttctccaactccctgtacaagaatgaatccgac

SEQ ID NO: 5392 - DNA, 1229 bp, Triticum aestivum
  Clone ID: PAT_TA_5392
gaattcggcacgagctcatccaacctcttgggcctgactatcctcatcatatagaaagtatgttgatattgcatccataccatgcttcctgcttttcatgattcgtacatataggattacaacgtcagtccttacagtttacttcatatttaccacgccaaggcttctacactaggccagtttgcttcatacatatcaatcttgtgcttctacattgtgtttagtttttctttggctctatgccctgcatgtacttgtaggctccatgttttttacttagtcgacagccaaatcatgcttcctaaaacgtatattatggacaagctgcatgtgccacccccttccttatcttaacacaaagttccttcctagctcgagctccacggtccctcctatctagaccgttggcttgctatgcgatttgtgcaggaaaggagcggcacgagcgcgcagcggttgcatgcagcgtcatttgcaggcgctgccgtgcgcagccgcccctcgtctcccatccgcatctcaccccggcgctgatggaatcctctgcctcggtggtgtctccacctatttaactgttgaaagaagctaggtcgctgagtttgagatccatagtgtatacgaggagatggaaaggaagacaaaagaggatgctagattataacatacctctgatccaggcagatggagacggacgtcattgcggatggatctggaggcgccgcaatcaaaatctgttcggccgctgccgctatcgccatgatgggctcctctgcctcgttggtgtctccacctcttttcctgttgaaagaagcgagctcgctgctctccagatccatggtgctgcaagcagatacaaaagaggagaaagaggatgccagagtaaaacagctatgcgttgcctgatagaaggaacgagattacacgcgtcgtacttgcacagaggagtcgtccagatctgttggttgtccgtcgttcagtggaacgcatagctgtttgatgggcctagtcacgtggggcccttcacgtcttgtctagtagcctactaggcccatcaaattcgaaccttttgcagcctcccgccagagtattagggcttgattcccgtggcagagctgctgttattcaaacactagatgacccgttgcaccaatggcgcaaaggccgaatgtaagctaatcgatgtgagagtatgctctagcatattattgttcaaaaagaatagcccatat

SEQ ID NO: 5393 - DNA, 1369 bp, Triticum aestivum
  unsure (1)..(1369): unsure at all n locations
  Clone ID: PAT_TA_5393
accacacccacaaacaaacagaagcaggaaaccagaagcgacccaccggccgggcagttgagccccctcgccgccccctcgcctcatcagcacccacctcgcgccactgaggagagatcttgttagttctgggcgactccccaggcagcggcggccaagtcaaatccaagtaagaatggcgccgggggagaagaaggggaggaggtggctgccggcggcgtgcctcccgcggcccgggtgcttcacggtgtccgccacggaagaggggccctcgggctccggctccggctccggcgccgatgaggggggcagcggccggccgcccgcgcccccgatcctgtccgccgctggcatcgtcggcagtgcagaaaattggggttacgccgccaaacgtttcatcagaaaacaccctgaggatgtggttgttcattgcagtggatgcaactcagcaactcgaactttcgatggtgttgatgtgatgggaaggagattagcggaggaggtgatttcagttgttaagtgtagaccagaacttcagaagatctcctttgttgcacactcattgggtgggttgattgcaagatacgccattgcactactatatgagcctactacacaaacagattgtcatgaggagtatgagaaggatgtcaatgatgctcgtagcaaccaaccgatgggtcaaggcaagattgctggtttggagcccatgaactttataacttttgcaacaccacaccttggcacaagatcacataaacagatgccccttctccgtggttcctatagattggaaaagatggcttttggtatgtcctggcttgctgggagaagtggaaaacatctttttctaaaggatgttgaagatgagaagccaccattacttcttcagatggttactgattacggggatctccatttcatatcagctcttcgttctttcaggcgttgtgttgcttactcaaatgtttgtggtgatttccgttgttgggctgggaagacacttcaaatacgcccgtccaacatgagcttcccaaagaaagaagatttggtgggatgatgttaagataccacatgttgtatatgtgggaaaaaccaaaggtccgggatgttgattttcccggatgaaatgatttatcaaggcaaaaactacaattgaaagggaagaagtaaggctgaaaaacctaaatagttccctgggaaaggtaaatgttaactccaagagaatttnacaaaggattttgcncatacacatcaagggaagactttcctcaacccgaaggggcgaagtggctccaatgatgacattcccnacaacatggncaaaactgggggggcccattctttcctcccaattgnacaattnttc

SEQ ID NO: 5394 - DNA, 853 bp, Triticum aestivum
  unsure (1)..(853): unsure at all n locations
  Clone ID: PAT_TA_5394
ccaatcctctttgtctgtatgggggagatacagtttctgcacgcaatcatcacagcttgatgctttcacagcaatttcaccatatcagcaaacttattctcatccttttctatctgccggtccgtggcaacgaacgattcttgatggaagagatgacaaagttgcctaacattaccatcttgggactggttgtattggcatgtggacattcctttggagccagctcattccatgttctcaagatgtctagcggtataagagagctcacgcttcaacttgttactcggagggactctaaggcattgtgccaaccaggttgcatttgtgctgagccatcaaattgggaaactgaggacctcgtgctaccttgcctcaaagaagtagcaatcaatggcctgagaggaactgaacatgaactcgctcttgtgaaaaggttattcaagtgggcgacaatgctagaaagggtgacagtaattttccatgactcgatctctgaaagcaacggcgaagagttccgccagttgttactaagcttctctaggccagcaatatgtatggaattctcgcattgcggaggaagtttatcatttgactaggccaccaactttgccgattttctatggttgtcagttcagtatggcgtacttttgtgagactgaacttctgtaacttgtttaagtccagcaacttgtttccagcatttctgagactaaactctggtaacatgtttaattctagaacttgttttcagtatctgtgagactgaactgctgtaacctcttgtaacttgttaactttgagacttggctttagtatttgtgaggctcaaaaaaaaaaaancnnnnnnnnnnna

SEQ ID NO: 5395 - DNA, 1340 bp, Triticum aestivum
  Clone ID: PAT_TA_5395
tttttttttttgtgagccccagtaatatacattttgatatattatttcttagatagcacaatagtatacatttatacgtgtcaaaactaaaataaacagaaggtgacatttcccgcacaattgcccgaggcacctggctagttaaccaaaccacataaacaataaccaaacacataagccacaaaacttattgcggtgaaaaaattgccacaaaactaatagaagaatcaggcaggcgtccctccactggggtagtaattcgatgtattcgaacacgtacaagactgggtgctcttttgtgatagatttggtcggtcacaacccgccggagaacgggatggacgtgccggcgagccagacgtcgccgtcgatgaaggaccccacggtgacgcggccggcctcggacgcgctaatgacgccgcggtaccccatccacgacacccggccggacgtgccggcgccgggccccgtgttctggtactcggcgtagtagagcgtgtcaagcgcgaaggtgccgtcccacgcgagccagccggcggggtcgacgacgctgtcgagctccgactgaatgaacacggtgcgcgagtactgcttccacggtcggcccaggtaggtcctgaagctggactgcacggcggcgaggtcggaggcggcggccaccttgcacttctggacggagatgccggtgttctggttggggtcggtccggccctgcgccgtgtagatgttgctctggttggggaggggccgacgggcgtagaggttgcagctctggagcacggcggcggagttgccgaagacgaagtcgatggtgccgtagatgtcgcactcgcggaagaactgtcggagggagtgcacgtagagggtgtcttggtagcccacgaagctgcaccggtagaaggccgagaggtcggcgccgacgcggagcgccaccgcctggtgcttggatgggcctgccgcgttctcgatggtcaggtcgcgggccaggaagttgttacccaccacagcgactgtggcggagcggaaggtggtggagccgtcgacgacgttgaggctggccttgatcaccgtcttgcccatgccgtcgccgatgaacatgaggttcttgtggctcttccccacctccacgttctccatgtacgccccggccttgatgtagatcacgtacctgctcttcgagttggtcggcgccgcggccaccgcggccgacaccgtcgtgaaccccccgctcccgtccttggccaccaccgcgttcgccgtgatgcccgacgccggcgcctgcagcagccgccggtccccgggcctcacccaccgcgggaagccccccttcaccacctgcc

SEQ ID NO: 5396 - DNA, 779 bp, Triticum aestivum
  Clone ID: PAT_TA_5396
gaattcggcacgagaaaacattcttctccatcgatgtcctcccatgccccgaccggcaacgaagcaccccgcatgagtggacgggttcccctgccctagaccgtcggtgaagcgaccccgcgccctgcttctccctccctggcatcatcctacaccctgtcgcgttgatccatcgccgggtcgatgcatcccgtggctgggaccttcggttcctgtttgatccagtcccttctcatccaacaacaacaacaaaaggaggaagcggctgctccggccaccccttacagattccaaccagcgacgaccccttctactctagcgtcccttggagatcccctacagttcaatccctagctgcacagtatacagaggattctcttgaagccttgcctctaattctttgtccacaaccatgcctgcaggggtcatgtggagggcgacgagaagcacggagcagtggatgcggtgcagtacctcactgtagagttccctcccgctcttcgtccacatgggcccgccagaatctctgccatggaggagtcgggaggaagaagaggagcgggaggagagaaagaggagtgggtcccccctgtaagccacacagggcctggccccgccagtgccacgtcgtttaagtggaggcgcaaaccccagagtgcgcttttcctttatggaaagcgtattactgagaatgtgttttctttttttctgtccaggccctgtctgagattattttctttgtggataggtccctggcagaaaacaccctgtatcttttt

SEQ ID NO: 5397 - DNA, 601 bp, Triticum aestivum
  Clone ID: PAT_TA_5397
gaattcggcacgtcgccccgtccgcgaaggccaaaccatccgcctccgccaccgccggctgcacactcgccgagcagccgctcaccgatcgagagcatgcagccgccgtgcctgggcgcgtgcgggggcagccccgccgtcctgggcgccagcgcccactgccagcgcccctccacctctaccagggttaccgtccggtgcgccgcccggggcgggagggcgtcgtccagggggaaggagaacgtctggagcgtagacaacgaacgcgccgccgagcagaagtctcggtcccaaaagagtcaccgcgggcggaggcgcccggccggccgcagcaggccgcccccgccgccgacgaggacgaaggagaatgacgcgggctcgagggttctggtctccggtgccatgctggtggaggtcgagaccgtgctccagacccaggaatctgtattaaggccttcctgggatacatttgcgagtagcttaagtggcgtatggaagggtgtcggagctgtgttctcaccaatcacagcagagatggaacctgttggactaggaagcaaacaggagtatctttatgattgctacaccctttctctcattg

SEQ ID NO: 5398 - DNA, 585 bp, Triticum aestivum
  Clone ID: PAT_TA_5398
ctgaggaaaccgaagcctgcgcattcaacagaggcaaagggttttacaactgatctatgatggagtacatcaactggagcactattttattggaactcacacatccatagacattattgctcctatactaatatccagaaacagatgttactacaaacagaaagcttaaagtggcgtagtgatttctttgaactatggtgggagtggttgattccacctgcgcttgatttcagtttttgtccgaacctccctgagcttcccatcggttccataatctctctccatcaccagattaatcccttcctccgagtaccaactaactccgatgcagagtataccgtctttatctacgtcaacataggcggggacgcctccaggcaaccaaagtatagtcacgtcttgcatatcgagcatctcctcctccccgaagaaaacagagctctctggcaagcttctcttcttcatggtctccatgcacaagtatacaaaggcggctccaccctctatttctttcactttctcgctgaaaattggtgttgcactgacttcatatactttccaggggcctgtcagttctgatggttt

SEQ ID NO: 5399 - DNA, 756 bp, Triticum aestivum
  unsure (1)..(756): unsure at all n locations
  Clone ID: PAT_TA_5399
tgtttttgttccgtctgcagtattagcgcctgctggcctttctcctgatcgcctcaccgttcttccgccggtcccctgcgcccgcccgcagcgccgcggcagccacccgcctgccggctgcctttcgatggcgtttttctaaaattgtcaattgctcttaattgctcgtattatgacagactctgaactgcctcagtccaaatgatacacaaaccaatgaatatgaatctgtgatacagtaacaggcaaaaaatatcttcagggatcttgagtgggtgttctccggtctcggtgcgttttagattatacttgtattattgcggcttcaggaactccctaatgttacaaagcatgcctttgtcgtatggtttgacaaacttgacttcaaaatctgactgaggctgttccttcatttggaattcaggatatttcttccagtttatctggataaatctcacctcttagctataagaaacagcaaacgagaagacgacctgcaattggtgaagaaagagtccaaagcatgggaaatttgacattacccactcatccgtcctgatgttgaagctgatgccgcccgcaggcctgctccgggtcacatcctgccttgtcccctggtggacggcgatcagcaacaacaaatccgtcagaagtgcataataacctangatttcngnctatcaatacaaatcaggcatggggncatacctcaacattgcttgaannttnaagcccacctntaaagntggtatccaa

SEQ ID NO: 5400 - DNA, 649 bp, Triticum aestivum
  unsure (1)..(649): unsure at all n locations
  Clone ID: PAT_TA_5400
gaattcggcacgtcgctcgagcggcgctcacgtcgctgcttgccggtatccgtatccgggcgggagtgcccgcgcggcgtgcgccactcggtgaccgacgcttctcgatcgcgcgccgcgatcgggactttctcgccgctccctcgcgacctgcagccaacgccggccactcgaccagtccgtcattcacccactcgctcgcactgatagccagcctgccaagcaccggccggcaatcaatccacccggtcacctcacgtcacccgcctaggcatccagtctaaaacacggtggaagcttagctagtgccagcgccatatccattgagcatgggggcgttggcggcgtcgatcgcgtcgcacgtgccgtcgggtatgctgagcgcggggctggcagcgctggccgcgctgccgaaccccggcgagctggtgcggaaggcggcgcggctggaggacgaagctgagggagctgctccggctgaacggccgtggcgccgaggcgagggcggagcagggggccggcaacagggcgcagcagacgcgggagcggttcctgcgcgcgtacgagcggctcaaggacgagctcctcaacgaccgcgccttccaggttcggtcccaccgtggctgacgtcggaggaacgacgggnttn

SEQ ID NO: 5401 - DNA, 453 bp, Triticum aestivum
  Clone ID: PAT_TA_5401
tcgacccacgcgtccggcacacacgccgcggccagaaatagcaatggagggacccacgcgtccgcccacgcgtccgcggacgcgtggggtgaagtcagagccagaggaaggagaggtgctgatgatgatgcaggacggaggcgaaggaggcggcgcgtcggtggcggcggagtccatggcgccggcgcagatcgacgtgaggatggacctgacgctgctccactgccagggctgcctcctccccctgaagccccccgtcttcaagtgcgaggccgccgggcacgtcgtgtgctaccactgccgcgccgtccacagcaccatctgcagccgcgccagcacgcactgcggcgagctggacgccgtggtgggcgccgccaaggtgccgtgcgcctacagggcgttcggctgcgagcggcacgtcgtgtaccacgaggccgcggaccaccagcgcgc

SEQ ID NO: 5402 - DNA, 691 bp, Triticum aestivum
  Clone ID: PAT_TA_5402
gaattcggcacgagcgcgagcccgcgcggcccccgcaccgcccgtcccggccccccgcgccccgctcgtcccgcgcctctccggcacgcgcgcgcctgggtcgggctgccccgagcggcgcggccgtgcgcccggtgcccccggcggtcgccgcggagcgcggcgccgccctcgcggacgcctgggactgcaagggccgccccgccgcccgcgcctccaccggcgggtggggatgcgccgccatgatcctaggcgcggagctgttcgagcggatgacgacgctgggcatcgcggtcaacctggtgccgtacatgaccggcaccatgcacctcggcagcgccgccgccgccaacaccgtcaccaacttcatcggcacctccttcatgctctgcctcctcggcggcttcgtcgccgacacctacctcggccgctacctcaccatcgccgtcttctccgccgtccaagccaccggtgtgatggtactgacgatctcgacggtggcgccggggctgcgcccggcggcgtgcggggacgcgacggggcagagccccgactgcgtgccggcgaacgggacgcagctcggggtgctgtacctggggctgtacatgacggcgctggggactggcgggctcaagtcgagcgtgtccggcttcgggtcggaccagttcgacgagtccgacgacggcgagcg

SEQ ID NO: 5403 - DNA, 256 bp, Triticum aestivum
  Clone ID: PAT_TA_5403
gccggccgggtctcgctctaaagtgacaatttcttttgtgtcggattggttttacggtttgctgttgttggtcggatattgtgtttaatcttttcttgttgggaataatccaccacccaaggggatcaaggtttgtagaatattgttgtttgttcaaaggctataataaaaagtgtttctctttttactactatcaaaaaaaaaaaaaaaaaaaaaaaaaaaaaaaaaagaaaaaaaaaaaaaaaaaaggccccta

SEQ ID NO: 5404 - DNA, 1396 bp, Triticum aestivum
  Clone ID: PAT_TA_5404
ggccaaagctgaccacctccacccgcacctccctccctccctccctcaattattacaagccccttagcatgttaatcacttcagaccgatccatccgaccatcagctgtattgtatttgttcggtggatgacagcggggagaggtgcgattctgacttcccgaggggcggctggattccaagaaaccatattcttgtgctgctagtgctagctagctaggggcgaccgagtttcagccagggacttgtaaaccggtggtctcgaggaggtacccgatcccatggccggcaaggaaatctaccacaagatgaaggacaaggtgaaagatgcttttagttcatcagggccagaaacagggaaaggcaagacaaaattgtcaggcaggcgtgtcaagcatggttaccatcttgtgaaggggaaatcaaatcatccaatggaggactacttggtggcggagtacaggcaagttggggagcatgatttgggtttgtttgcaatatttgatggccacctgggccacactgttccagactttctgcgtgcacatctctttgataacatcttgagcgagccagaattcttgagtgacacgaaaaatgctatcagaaaagcatatctacttaccgatgagaaaatattggaaaaagcagctgagttgggaagaggaggctccacggctgttaccgccatcttaataagcagtaacgatagtgtgaagctagtggtcgcgaatattggagattcacgagcagttattagcaagaatggtaaagcagagcagctttcagttgatcacgagcctagcatggagcgagaaattattgaggaaaaaggcggatttgtttcgaacctaccaggagatgtgccacgagttgatgggcagctggctgttgcaagagcattcggagaccggagcttgaaaaagcacctcagctctgagccacacgtggctgaggaagttatcgatgagagttcagattttctaattctagcaagtgatggcttatggaaggtgatgaccaaccaagaggctgttgatgagatcaaggacatcagggacgcacaggcagctgcaaagcatctgacggagcaggcggtgaacaggaagagcaaagacgacatctcctgcgtcgtcgtaaacttccactgctagcagagcttgaagctgctgctagcttctcaagtgtacaatttcttttgtgtcggattggttttacggtttgctgttgatggtcggatattgtgtttaatcttttcttgttgggaataatccaccacccaaggggatcaaggtttgtagcacccaggggtttcaacaaaggttgaatattgttgtttgttcaaaggctataataaaaagtgtttctctttttactaaaaaaaaaaaaaaaaaaaa

SEQ ID NO: 5405 - DNA, 857 bp, Triticum aestivum
  unsure (1)..(857): unsure at all n locations
  Clone ID: PAT_TA_5405
ggcacgaggtgtttgccttaattggccgcggcccctccatcccatccctccctcctcctcctgtcctgcgccgctccatacctcaccactgctcactgccagtattcagggggagcgttaatggctagctagcgcgcccggccccaggccagccacacatgcacactgcgccgggcattcacttccctccctcctcacgcacgcattcagcactgtgcagccgctgctcgtcccctacccctgccctgctgcatctgcaacacctagtagctgactcttcaaagggagacataggatccatggtgtggaagagctggggacggcggctcctgctcagcgccgccgtgctcctctgctcggccgcggcgggcggtgctgctgccggcgacgtctccctcagcctgaccagcgccccgccgcgcgtctcgacgtcgccgtcggcggtgttcgccttccgtgccgtgcagagcagcggctggacctgcggggactgcgccatcacctgcaagttggacggtgaacgaagatcggactgcgggggcaacggaaatgggacggaggtggtgacctttgccggactcaaggacggcaaccacacattcgcggcgtgcgcgaccccgagatcaggatcaggaaagcaagcgccggcccgaacctgcgccaccttacgcctngggatggttgacaccgttccccccccggcggcggtcgcggcggcggccgccttcacggccccgccccgcgccgcggcccccgtcgccctgcgcgggccgtgcccgggccccggcggcttcacccccgacccccccgcctgcggccgcggcgtgttcgcgccggcaaaaggccccaccttaatg

SEQ ID NO: 5406 - DNA, 743 bp, Triticum aestivum
  Clone ID: PAT_TA_5406
gtgcgcctcgtgacgtgggctgtttccgggcgccgcttcctcccgcccgccgcggcgcaccacgccgcagctgaatctttcgcctccgcggcgtcgtccctctgagcctcccgtcagcaccagtccgttcctctgcaccccaactgcaatccaatccaatccaatcttccgcctttcggcgtttctgcttccctggggactcgggatctcgtcgggggaggcggcggcggatttgagatttggggcacatggcgtggcggcgcgtcctctcccaggctgcaaggaaccaatcagcatatgcaatctataatgagttggcagcctcctctcctctgaggtcacttagaagtgacatcagtgcaggtggcgcactcaggaacttacatgagaggtatcattcgagctattttggtggcctttcacgcagcatgcgagacctgggctcccagagtgaagcttctatgctaaaagagatatacaggagtgacccagagcgtgtgataaaaatatttgaaagccagcctttgttgcattcgaaatccttcagcactctctgagtatgtaaaagctcttgtgaaggtcgacaggctggatgatagcaccttgctaaaaacattgcaaagaggtcttgctgcttcagaaaggtcagaaggaagccttggtagcgtgccggcattacagagtgctggtcaagtgacaaaagatggaattattggcactgcgaatgcccctattcacatggt

SEQ ID NO: 5407 - DNA, 441 bp, Triticum aestivum
  Clone ID: PAT_TA_5407
acgcgcccacgcgtccgggagttctcttaagaaagaaattttgatgaaaagtttactgtgtacatagtacatactaaatttcctatctgaagagtttctccaggtatgtaccaatcatcatactagtgaatgcttctattttgtagatgtcaatatgagtgctgaccaacatagtttcattttattaaatttcatacggcctatgaacatttttttgttataattagagccagttattgtgatttgtggatgtaaaaatgtttgtccccccattaacttagtttcaattcttgggcacatgcttggaagatgtgaaggtctcgtaatgatttggatgtaacacaacacccatgtaatgtgagcaatggctgagagatgtgaaccaaccgccacgcaagtggagggatgaattgtggggctggcttggttgtaaaaatatac

SEQ ID NO: 5408 - DNA, 1026 bp, Triticum aestivum
  Clone ID: PAT_TA_5408
gattcggcacgagggcaaccccgccccggcccccctcccgtggggaattctcgggcttaccatgaggggcgccgcgatccagggccacggcctcgcccgcgcgccgccggccgccgtcccgctgctgcacccgcggccgcgccgcgccgtcggggtggccccccgccaccgcctgaggagcgacctcctgccgctgctgctgcccgccgccgcgcccttccgggctcgctccccgccctcgtcttcctcctctaatgtgaaccccgggacaggggagggcgcggacgagctgctcgaggaattgctccagaagcacggcgaggtcgtgtacagctccggcggggccggcagcgcggctctggccagcgaggccgacgaggacgccgagtgcctgtcactggctgtttctctggctaaagttgcaagcgaggtcaaggccgccgacattcgtgtgctgttcgtgaagccgattgtctactggaccgagttcttcatcatcctcaccgccttctcgaatgcacagattgaggccatcagttccaaaatgagagacatcggggagcagcagttcagcagagttgcgtctggtgatacaaaacccaattcatggaccttgctggactttggcgatgtcgtcgtgcatatatttcttcccccgcagcgggagttctacaacctggaagagttctacggcaacgccactcccatcgaactccctttcgagacccactgcagtaactaccgctcgaatcttggattggagccaaacgaggacgtccactcaacgccctgcaaatagattggtcgcttggtcccacacctggacagggcatccccccggttacacaccgggcgtattcaaaattggccccgttatcagcatcttattcgtgtacacaactttacattccaaaacaatataacaactacgcaattcgaataacaaaacaaggggtaactgcaagaggaatagagttcagaaagattggcggtagattgttgaattcacagtgctggaaacccccc

SEQ ID NO: 5409 - DNA, 554 bp, Triticum aestivum
  Clone ID: PAT_TA_5409
cattgggggacttagaagtgctgattcatgctgtagatacaattgaaatgttgccacgaattcgaataagatgttgctaaaatacagagtaataatttgttcatatagcgtacacatgcataggaggtaatctcaccatttctacacaaagaggtgtgctcaaccaaatccatctctcaaaccaaacactgacaaagcacacgatcggaaccaacctgttccagcggcgtggaaccatgaccattctattacacttcgttccccaaccaaacacgaccccaagaatctcgcctcccggcgccatcggcagtcttacttgatagagcaacagaaccgctggcagcgacccatcataataatcactgcgagtgattatagtgatatggacagtttcaacagtcaacctcatcttttggatactaaataacccaaagtgcacagagcatacactgaagtgcttcagctactcattaagaccttgttgagataacaagtcttgcccaaatcttgcaaagacccaaagctcatgaagtgcttgttgacctcctcgtgcc

SEQ ID NO: 5410 - DNA, 597 bp, Triticum aestivum
  Clone ID: PAT_TA_5410
ggataattgtagtgtcccgtaacatagatttatgcaacaccaagatacagcaggaatttgggggatgagaggagggtacaggtgacggaggaagaaccgaggtgagtagaatacagataaaggatgagaagttgcatagactaatcaacactactctcctacacggcatgaccagcctatataccagacacacacccacacgcttacagatggtcccaggacccacccgccagctcacagagctctctcgcctggatcttctgagccaggcgactcgttgtccgccaacgcaggcgtagtgacacttgccgccgcttgagattgagcttcatcccacaatgaagaagacgggaaacgatgcttgaccacctcatagttctcccatgtggcggaatcatctggcagatcaccccattcgataagcacttgagttgtggccctgttgccatcacggaccatgcggcgttgcaggattgctgacggaagcttatcacagagcaccaggtccggcggcggaagctcgctgaaaaccggcgagtaatcggccgagaaaggctttagccgtgaaatgtggaagactggatgtacttgggcagc

SEQ ID NO: 5411 - DNA, 501 bp, Triticum aestivum
  Clone ID: PAT_TA_5411
ttcctccttgccccgttggccttgatttaattttgggtgcgggaggaaattgaatatctagaagggaagggggttcttcccccaaagatcgaggagcccaccccccccaaaaagttggtggtcattgacttccctgcatcgtggtgtggcccctcccccattagggctccaattttcgctgttctccccaaaaagttcccagctgctgttttcctcaaggtccattttaatgaattgaagtccattgttgaccaattcagggtggaggccatcccacccttcctgtttataaaggaaggagacttcaaggacagggttgtgggagctatcaaggaggaactgccgaccaaggttgggctacacccggcccagtaatcccctaccggtgtagtattggcctaaataaaattcccgctcaacaagtagtgcctctaatggccccttatatcctgtgtacttcttgttacttgttggtttatggataatgcgttgcttaatccc

SEQ ID NO: 5412 - DNA, 1132 bp, Triticum aestivum
  unsure (1)..(1132): unsure at all n locations
  Clone ID: PAT_TA_5412
ngaaattacaaaaaaaaaaaaaaaaaaaaaaaaaaaaaaaaaaaaaaaaaaaaaaaaaaaaaaaaaaaaatttattctttggggagaggggaccggagattgaacacagagcccgcaaggcaacaacaaagggcgcgcagtacgaaaagtggcgctgagaaatcaacaagcggtgcttgccgagaagagagagagagagatggcggcgtcggcggcgacggcaacggcggcggcggtgggggcgggggaggtgatctccgtccacaccctggagcagtggaccatgcagatcgaggaggccaacgccgccaagaagctggtggtggttgacttcactgcatcatggtgtggaccatgccgcatcatggctccagttttcgctgatctcgccaagaagttcccaaatgctgttttcctcaaggtcgatgtcgatgaactgaagcccattgcggagcaattcagcgttgaggccatgccaaccttcctgttcattaaggaaggagatgtcaaggacagggttgtgggagctatcaaggaggaactgacgaacaaggttgggctacacgcggcggcccagtaatcacctagcggagtagtattcgcctaaataaaattgtggctcaagaagcggtgcctctaatggcaccttatatcctgtgtactgcttgttacttgttggttggatgatggtgaatcaagtgtgactttattcggtaaatggttgatttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccccaaaaaaaaaaaaaaagggccccctgggcccgggcccccttaaaaaaaagggtcccccccgggttgaggaattccaattccattttttcgaaaccccccaccccaggggggggcccgggaccccatttcccctaaaggggggcccattaaggccccccccggggcggggttttaaaacggggggaatggaaaaaacctgggggaacccaatttaattgccttggaaggaatcccccttttccaaggcgggggaaaaaggaaaaggccccacccggtaccccttcccaaaaaatggccaacctaaaggggaa

SEQ ID NO: 5413 - DNA, 721 bp, Triticum aestivum
  unsure (1)..(721): unsure at all n locations
  Clone ID: PAT_TA_5413
ggccgctcgaggcnncggccgggccggggaaattggggaaaaaaaaaaaaaaaaaagacagagcccacaaggcaacaacaaagtgcgcgtgagaaataagcggtgcttgcccagtagagagagagagagagagagagagagagatggcggcgtcggcggcgacggcgacggcgacggcgacggcggcggcggtgggggcgggggaggtgatctccgtccacagcctggagcagtggaccatgcagatcgaggaggccaacgccgccaagaagctggtggtgattgacttcactgcatcatggtgcggaccatgccgcattatggctccaatttttgctgatctcgccaagaagttcccagctgctgttttcctcaaggtcgacgttgatgaactgaagcccattgctgagcaattcagcgtggaggccatgccaaccttcctgttcatgaaggaaggagatgtcaaggacagggttgtcggagctatcaaggaggaactgacgaccaaggttgggctacacgcggcccagtaatcacctagcggagtagtattcgcctaaataaaattgccgctcaacaagtagtgcctctaatggcaccttatatcctgtgtactgcttgttacttgttggtttatggataatggtgaatcaagtgtgactttattcggtaaatggttgattttcgtaaggagctgatcgaattcagttgttcggctttt

SEQ ID NO: 5414 - DNA, 881 bp, Triticum aestivum
  Clone ID: PAT_TA_5414
caaccacgcagccggcaacaacaaagtgcgcgtgagaaataagcggggcttgccaagcagaaagcaacaacaaagtgcgcgtgagaaataagcggtgcttgcccagtagagagagagagagagagagagagagatggcggcgtcggcggcgacggcgacggcgactggcggacggcggtaggggcgggggaggtgatctccgtccacagcctggagcagtggaccatgcagaccgaggaggccaaggccgccaagcaagctggtggtgattgacttcactgcattatggtgcggaccatgccgcattatggctccaaatttcgctgatctcgccaagaagttcccagcctgctgttttccccaaggtcgacgttgatcaactgaagcccattgctgagcaagtcatcgtggaggccatgctaacctaactgttcatgaaggaaggagatgtcaagtaccggggttagtcggagctgagaagtgaggaactgacgagctagggttgggctacacgcggcgcagtaatcacctagcggagtatgcattcgcctaaatgaaaacgaccgctcaacaatgtgattgccgctaatgggcacctaataagcttgctgtactgacattgttactttttgtgttggctcgtttaatgccttgtttaattgtgactttattgtgtaatttatggatttttgttttgagttaatctaatgctgaagtaagcgtatgcttaataaggaaaatgatatacctacagaataagatgagaaaatgctatgatactttgaatacatgatacatcttcgaagccttatacattgttactctcttgaatattgatttgtgccatagccaaaaaaaaaagaaccgcaaataccctcagg

SEQ ID NO: 5415 - DNA, 563 bp, Triticum aestivum
  unsure (1)..(563): unsure at all n locations
  Clone ID: PAT_TA_5415
ccacgcgcccgccgacgccgggcccagctcagcaatccccgccaatcgccatggacgcgctcgtcgccggacagcaggccaggcggcggatccggccgccggagcccctcgtgatggccgcctccccgaccacgcccgccgcgttcaagtgcccgatctcgctcgaggtgatgcgctcgccggtgagcctccccaccggcgccacctacgaccgggcgtccatacagcgctggctcgactccggccaccgcacctgcccggccacgcggctgccgctcgcgtccaccgacctggtgcccaacctgctcctttcgccgcctcatccacctgcacgccgccacgctgcccccctcgccctcgcccgaggaggcgctctcgcagctcgccgcctcgcacggtgagcccgccgccccggagaaggccgntgcgctccctggccgccaagtccccgccggaggaagggatcctcgccccccccgcgtccgccggcgccgctcttctcgatgcggccgtgccggcgctcctctccttcgccaaggggggcgccggcaccgacgcgcgcg

SEQ ID NO: 5416 - DNA, 744 bp, Triticum aestivum
  Clone ID: PAT_TA_5416
gtggatctactgccgccgccggcgtccttgaaggtctcctgcctcaccgcgacctacatgagctgcgcatcacgagataccctggagcgacgtcgccgagctggctgggcttgcagatggagaagctgacgagcctgtacatcaggaactgcaggaagctaaacgccctgcctgcccttggtgagctcccctgcctggagcttttggatgttaaggagctcccctgcgttaaaaggattgacggcggcttctgcggcgccggcgcgttcccaaagctgaagaaggtcgtgctcgacgacatgccgggtctgctggcgtggggtgacatgccgaaactggcgttccctctgctcacggaggtgagcatcgccgactgcccgctcctgtcctccttgtcgggcctcgagcgcacaggtcccctcggcctgcgagtgatgggatgccctcgcatcacaccggagaccctgccagcgattttcagtaccggcgtctctacctacagattccgctagcggtacgtgtcctcgcatgcaacatccatccgggtcaatattgccactatttatgcggcttttgccgatttgcgggtgatgctgatgctgaaagttgtaaatttgtgtggtacttacgtactatatatgtgaactcatgcactcaaatacttttcccgtaacttgtcgtgctaggcaatgtaactggaactgatccagcttactggataaatacacactccctctcaatgtt

SEQ ID NO: 5417 - DNA, 607 bp, Triticum aestivum
  Clone ID: PAT_TA_5417
gaatcccgcccgacgttagcttctgtgtggggccggggaggggcgcgcgccatgacgaccgccactgccatcgtcgccggccacggcatcgccttccgccggagcctccacctgcccaacccgccggggaagccctccttctccgtcgcgcggccccacgcgcactaccgcctcttagtcccggccacgccgtcgccgaggccctgccggtccatctcctcgcagagccccacggccgccgcggcggacaccgcggaggacgaggaggagccagccgaggagagtgaggggagtgaggaggagttggacccgctggcggaggtgcgctacctggacccggacgcggacgcggagggcatccggcagtgggaggtggacttctgctcgcggcccatcctggacgccaggggcaagaaggtgtgggagctggtggtgtgcgacgcgacgctgtcgctccagttcacccgtttcttccccaacacgtccatcaacagcgtgacgctccgggacgcgctcgcctccgtggcctcctccctcggcgtgccgctcccggaccgcgcccgcttcttccggtcgcagatgcagaccatcatctcccgcgcctgca

SEQ ID NO: 5418 - DNA, 725 bp, Triticum aestivum
  Clone ID: PAT_TA_5418
tgccgctcgtgctctcctggtcctcgcgaaacgacgaggggtagtgccggtcgtggctcagcaggatagcataagcttgcccttgttcttttgtgttcgaatcagatttgttggttctcagttttacatgcacctatcaatctttcttctgtatgcaggttacacgcccggcggtggccgcggcggggcgcgcgcgcgcgccgggcccgggcaggtgcgggcccgcgcgaggaaggttcagcgcgctgcacaagtcgggccacgcccggagcgccgtgccaacgcatgtgtgcgtggtcggtgggttggccaagatctgcattctgcgacttcgtcttcaccatggacacaagcaaggactgattcgtgggtcttggtagcggtgccgagcatcggcggatcgaagtggtcgaggtcgcggttgatccaccaggacgagacatgcatcttggagctagcgcagaggggggaagaagcaggttcgtctgccctggcctcgcaaatgaattgaaaccttgatgcaaaaggaaacttcctgaagaagatattgaaaatccaacatcacagcatataggagactacttattttggtcatgctgatcgattggcctatgaaacttctgcgacttcatattcaccatggacacaagcaaggactgattcgtgggtcttggtagcggtgccgagcatcagtggatcgaagtggtcgaggtcgcggttaatcg

SEQ ID NO: 5419 - DNA, 735 bp, Triticum aestivum
  unsure (1)..(735): unsure at all n locations
  Clone ID: PAT_TA_5419
ccacgcgtccgcccacgcgtccgcttgaatctgaaggaactcaaacacatctaacattcgtttacagttttgcacaagcagcagctgcagcgcaagctggtgcatcagtcgtacaaatatttgtggggcgtattcgggattgggcaaagaatcactctggtgacccagagattgatgaagctttaaagaagggagaagatgctgggcttgccttggtgaagaaagcgtatgtgtacattcacaagaatgggtacaagacaaagttgatggccgctgccgtgcgcaacaagcaagacgtgtttagccttctggggatcgactacatcatcgcgcccctgaagatactgcagtccttggatgaatctgtgaccgattccgatgaaaagtacggttatgtccagaggctgactccttcgcttgacaagatgtacaacttcagccaagaggagcttgtgaaatgggaccacctgagcctggcggcggcgatggggccagcggcggaggagctgcttgcttctgggctggaagggtacgcgaaccaggcgcggcgcgtggaggagctcttcgtcaagatctggccaccccccaatgtttgaacttcaatttgaagcagtggcggagccaacgttgaaccattgggttcagatgaacccaatgaaatttgctacttacgtgcatgtcatgtacacatattaggcctgaccccaataaaaaattaagcctgaccccntcnna

SEQ ID NO: 5420 - DNA, 1402 bp, Triticum aestivum
  Clone ID: PAT_TA_5420
gcgatcgtgtaaatatacgctctcactccacttcctcccaacctccgcccacacctggcgctctccatttccgcacccacctcgtctcccttcctccccgccccccgccaggtcggcaggtggagctcgtcaccaagctcggctaagcccgcggtttttagcctacggaggccggttgtggtggcacgggccgccgccggcaacgcgccctcttcccccgcgggcgcggtcgtaactgagttcgacgtggtctccagcttcagcgagatcgtgccggacacagtcgtgttcgatgattttgagaagtttgcaccgacggcggccaccgtgagctcttcactgttgcttgggatcgcagggctcccggataccaagttcaagagtgccatagataccgcattggtagatggtgaatgtaacacaatggagaagcccggggaccggatgtcctgttaccttaccaaggccctggggaatgttggagctgagctggctcatcaagttcctggaagagtgtccacggaaatagatgctcgattggcttacaatacccgaggaatcgtccagagggtgcatgaactgttgcagatatacaatgaacatgatatcccatcagaacgtctgttattcaaaattcctgctacatggcaaggtatagaagcgtcaagattacttgaatctgaaggaactcaaacacatctaacattcgtttacagttttgcacaagcagcagctgcagcgcaagctggtgcatccgtcgtacaaatatttgtggggcgtattcgggattgggcaaagaatcactctggtgacccagagatcgatgaagctttaaagaagggagaagatgctgggcttgccttggtgaagaaagcgtatgtgtacattcacaagaatgggtacaagacaaagttgatggccgctgccgtgcgcaacaagcaagacgtgtttagccttctggggatcgactacatcatagcgcccctgaagatactgcagtccttggatgaatctgtgaccgattccgatgaaaagtacggttatgtccagaggctgactctttcgcttgacaagatgtacaacttcagccaagaggagcttgtgaagtgggaccagctgagcctggcggcggcgatggggccagcggcggaggagctgcttgcttctgggctggaggggtacgcgaaccaggcgcggcgcgtggaggagctcttcgccaagatctggccaccccccaatgtttgaacttcaatttgaagccgtttcttcttccttaatattttcgttccaacaaagggtgttttgtttgttcctgtcaacatatttacttttgtccttggaatgtctgccggacttgaaatctgaatcgttttgtggaaatatgaatgcattttgtggcgac

SEQ ID NO: 5421 - DNA, 1292 bp, Triticum aestivum
  Clone ID: PAT_TA_5421
attttttttgctttcttcgtatgacatatatgtttatgtcttccccatttcaaacgagaacatgtcgatcccgcagctcacggcatggtcacagaagtatcaaatggtataatgccagcctataaggctgtgtgcatcactcagaggctgaggggtacatcctcattttgaattttttttgaaaagggccagcctataagaaaacacagtacagaacttagtgcacaagaaaagcagacatgtgtacatacggatgtagaatagatgctgtaatatttagagagctgatcagtttggatggcatcagggtggggactgctcctcggatgctcgttcttcccgccgcatggttcaccgcttggtgcatcgtccgtctgtctgtcggatgtccctggcgctaataagcgggatgatgcgctcaacccctggccaaaagcttagcgcttgggttggggcgggctcgtgggtcggggagggctggtgcgggagccacgtcgcctcggttttggtggactggtaagggaggaagatggcatcggctttgatgggctagagctggtgggaggaggtactgctgcccttgacttgctagcatttacagctttgctcatcggtggtagtgcctttgatgacgctcccactgctttgctcctccgtgcatcttgtttgctcattggtggcccctgttgttgacgttcgccccttgttgcatcttgtttgccatcttggcctctggcagacctgctttccttgccttcttgatactggtgagttgcggtgctatcatcctccttaccatcaaaaatcagatccacaaattttattctgatcctaggagatttggggtgattcctgacgacaccctccaatgccgacttggcaacttttacgttgaagttgtcagcagcccctgttccaagtcttacacgtacatccgtaaggcctttcaacgtgactcaagccaagagtttcaaaggtatccgatctccattggtctgagttgaatcctaggttgaggttttggagtttgggcatcgctccttgttcctagccctggcaccccccaccacactcgtgcttgcggtacgtgaggccgtagaatcccccgtcagtcatgatcatcttttctgtgggagttgtctgattatacagggcgagagcagcgagggccggcattctttccaggatttcaatatcactcctcgacagactcctaattgcaatctttaggatgcagagtttccttagctctccaaagcacttaggtatgcagaagaagatgcagcagtgcc

SEQ ID NO: 5422 - DNA, 1067 bp, Triticum aestivum
  Clone ID: PAT_TA_5422
gcacgaggtaccatgtgccaccacatcccagaaatgtatacggacaaatgacattgagaatgtgggacgcacatcccgacatcaaaccttctttgagatgcttgggaacttcagctttggcgattacttcaagaaggacgcaatcaaatgggcatgggagctgacaaccaaggagtatggattacccccagaaagattgtggattagtgtatttgaagatgacgatgaggcattctctatttggctcaatgaggttggtgtaccaaaggaacgaataaagaggatgggcgaggatgataatttttggactagtggtgccactggaccttgcggaccatgttctgaaatgtattatgatttccatcctgagagaggatccttgaatgcggcgcgtgccggatttgaatgatgatagccgatttatcgaattctataatcttgtcttcatgcaatacaacaaaaatgatgatggatctctagaaccattgaaacaaaagaacattgatacaggaatggggcttgagcgtatggcgcgcattcttcaagatgttccaaacaattacgagacagacttgattttcccaataatggaaaaggcagcaagcatggcactagtttcctacagtaaagctgatgatgctatgaggacaaatcttaaagtaattggtgatcacatgagggcagttgtttatctcatatcagatggggtcatcccctcgaatattgggagaggatatgttgttcgaaggcttataagaagggtagtccggactggtagattgataggtatgagaggtgatgggcatgagaactctgaaggtgcatttttaccttctctagctgagacagtaatcagccttagcagggagatagatccagatgttgaatcaaggcggaaatcgattcttggagaacttctaagggaagagctgcgatttgtacagactctgggaagaggtgaaaagttattagatgaacttctggatgaggcattaggtagtgctggtgatattggagacaagccttgcctatctggaaaagatgtatttcttttatatgatacatat

SEQ ID NO: 5423 - DNA, 546 bp, Triticum aestivum
  Clone ID: PAT_TA_5423
tttttttttggccagaaggaacgatttacataaacccagaaaggggcaacaatttacatatgtttgtgaatatatgctctatttcctatgtgtgtaaatggctctatcgaagatcagctggcttttgaagatagcgctgcaacaatttcagctctagccttctctagggcatccggcaagttctctggcttccgaccaccagcctgcgcaaagttcggtttgccgccaccacctccgccgcaaagtttcgctatcccacccacaaacttgcctgcttgcactcccaatttcacgactccaggactgaaggcagcgaccaggctcaccttaccgtctcctggacttgaacctaaaatcaccgcggctgggtcttggagggttcccacgagatgctcggctgcgcttttcagcccatcagcatccacatcccccatgtgctcaactaggatcctgacattatgaggttcaacgagtacagctttacttgccagggatgctgctttaagcactgcgattttgctgcgtagagatgatgcttcatttctc

SEQ ID NO: 5424 - DNA, 636 bp, Triticum aestivum
  Clone ID: PAT_TA_5424
ctcgggcccctcgcgccgaattcggcaccagctcctcccttctctcccccacgccaccctctcctccctccacgccacgaagacacccgcggcccgctgactgagcatcctcccggagaagcttccttagccggtgctggatcttgcagccagactgcgtgcactctgcggtgaagtgaatcgccggtcgatgcttgtgatgatctgagccatgagccaattcgtgccagattggggaaacatgggcgacatctccaggccactcggggaagacgatgacctcatggagctgctgtggtgcaacggcaatgtcgtcatgcagagccagggtcatcggaagctgccgccgaggcctgagaaggttccggcgccgccggtggtgcaagaagacgaggccggcctgtggttcccgttcgccctcgccgactcgctcgacaaggacatcttcccggacctcttctgcgaggaaccaccgggggccgccgccggccggcccggccgggacggtgcccctcggtgaggcggcgccgactggcgcaccagcccggcggccgcggtctcggcgccgcccggcccgcgcccgcctcccaagtccacgcacgtgtcctgctccagcaggcagcaatcgatgagcct

SEQ ID NO: 5425 - DNA, 785 bp, Triticum aestivum
  Clone ID: PAT_TA_5425
gggatgctgaacagattgacttacaaaagagaacagaaatggaagttcaatattagtacaagcagggtgcaggcccaatcaacaggcaacaaccccaggtagtatttacccgcaaaaaaaaaacccaggtagtatcaggagtaaaacccaaaacgttatattaacaatataatcagttagctagactagacattcggacgatttcccagcaaaaatgtaaaaaaagagatctgcgcgttttgctacaattttcctgccgggatcgcatagggggcagaagatggaagaagacgccaaccgcttgattcgcgtcggcgtttcctcttctccatgtatattgttgctgtgacgctgcagctcctttcctttttattgctcctcttaacttttttttgcaattaccctcatcttttgtttgggtgtatcgcgttccccggcgtggcgttggcggtagcggcaggcgtgccaccgccggcgttgccattggacacgtggtggagcgccggactttgctgcagggccttcgcccctagcgggtagtagcccagcccctgcgcgaaatgctggtggtggtgggccggcggctgcaggtggtggtgggggttgacgccgaggaagtgcgcgtactgctccggcaggctcacgccgtggccctgctgcggcggcgccatgaagggcatccgcgccatggacgggcccatctgcggcaggtactggtgcatctgcatgcccgggaacatcaccgccggcggcgccatgccgctgccccggacgcgtgggtcgac

SEQ ID NO: 5426 - DNA, 794 bp, Triticum aestivum
  Clone ID: PAT_TA_5426
ttttttttttctctgttttcgctttttcttttgctttgtctttctctgccgtggtcttccgaatccaatctttacatcggacggcacagctgccaagtacgaaggattaacctggaagaaaaattcacactaccctgcaacgtagtttatgatggttatcatgtaatcccgcatatctccttctcgtcgggacggcacagctgccaagtacgaaggattaacctggaagaaaaattcacactaccctgcaacgtagtttatgatggtcatcatgtaactacatctagaaagagatttgacggattacagaaccccgtgactgaatcagcccaaggcggcggccaaaattttcgcactgaaggttgtcaaactgtacccagtgccagtaagttgcatctaatactactttcagaaaggaggcagaacaagtgcgtaacagcattgcgggcgcctgggtcgtccttcacgagttaggcattccaacttctgtcccatgcagtcgtcatctttcactgatgccgtgtttgggataatctgatccttgtactctgacaactgaaaaatggcttatccaaaataatctggtggtggttgtttaacttccttctctattagtagagtcttcaatgtttccatgatatcaaagcgtgggtctagcttgcgttgccacccctcaagaaccaaaattgtcaccattacagtacagatgttgccatcaatgttgactttgtggcgacgaactgtgtcgagcaattgatgcatgcattcgacaggatgaaatacgtctccctccg

SEQ ID NO: 5427 - DNA, 812 bp, Triticum aestivum
  Clone ID: PAT_TA_5427
ttctgccgcttgggaaaaccttagtctgttattacagccactcaggggccgcatgaatgtcatgttggaaaatacagttgttacaaacaacagaaacgatctgcatggctatctagtgtaagaaaaggcgactaatcagatgggccaagacgaactgtgctgttaacacaagggaaaacctatgctaccttcgccagcatgtaattattgaatttctcaatgcttcattcattgtactgatctacccaaactcgactaggaacaactgaaatctaaggcctgatttggagtaatggatttttgttgggagttctggatgaattgctccgcgtccaaaattccagctttccaaatgaaaactaaatggcagcatatgttgatcaatttgccatcatgatgccccgcttcagtcagaatgctccaaaattgcaatgaccgataaggttcatgatgcacaggaatcgatagatttgcacctatctgtaacatattattctattaaagttttccatgctatcgcatcactgattctttaacgtacctgcccgcgccgccgctcgatttcaggcaaatgttaaggaagcgagcatgttgctggctctgagatatggtaacagaaccttccataatttggtttttctttaactcaataggttcaaataagtaaaggagagtctgctgccagtgagtaggggcgtcctctggggcagttgacagaacaattgagacatctgcctttttctttttattgcttgggttggaattttgcatattgacatccaagggttggcttgcttgcttcttgaatttct

SEQ ID NO: 5428 - DNA, 635 bp, Triticum aestivum
  Clone ID: PAT_TA_5428
gaattcggcacgagaagagacgaaactcccgacgcgggactccaccttcgctcccccacacgggaagaagcagacaagcggcgcgtttccccaccgggaagctactagtaaccgcggccagccgaggcttctcctccttcttcgtcttctttctcccctactcttttttgttctcctcgcccacggtttcctggccggaccacgggggataggcgggcaatggcgacggcgaggcggggaggagtgggctggagagcggttcttgcggcggtgctgcagcttctcgtggcggcggaggccgggaagtacaacgcggtgttcaattttggggactccctggtggacgccggcaacctggtgaccgagggcatcccggactacctcgccacggcgcggccgccctacggccagtcttacttcgggtaccccaccggccgctgctccgacggccgcctcgtcatcgatttcatcgcgcaagagttcgggctgccgctgctgcccccgtccaaggccaagaacgccagcttcgcgcagggcgccaacttcgccatcaccggcgccacggcgctcgacacggagttcttcgagaagcgggggctcgggaagagcgtctggaactccgggttactcttcac

SEQ ID NO: 5429 - DNA, 755 bp, Triticum aestivum
  Clone ID: PAT_TA_5429
ctttacgcaatacattttgttacttataccacctgatgaatgaagaaatgaggctttaatagcatcctatctcatctctctttaatcgactgccatgaatcccaacaaaatggatggagatatacatatatgctgctatatggagctataccttatctcttccaatatggtgtgctattttcatactctagaggcacaactggccaagcgactaggtaggtagatgatcaggaagattgtatgataggttgatccgcgaattcgccatgcaaccaacctttggcaatgtgctcatatgcggcttcagtcaagtgaatgccgtcccagctccaatgtgtctttggatcaggacacggcgtagcaccaggctcgccgcacttggctgtcagattgaagttgtaagggcccttcccgggagcgccgcagcatgctctaggcggctgcttgtgaaatccaaacttttcaggctgaagcaagaactggataactggtgtaaagtaatccccatatatgatcctgacgccagggtgcttggcacgaagcttctccagcgcacgcttgagcatcgcattgtgcacccatgaaaatgtgttgaatcgcttgaggcagccggtacgcggaccgtacccctctttaggatcaacatacatgctcaggtacactggaaagcacccagacggcatcactccaggcacaattaaatcctttgccccctcggcaatcaattgctcgacaccatctgagatgccctgaac

SEQ ID NO: 5430 - DNA, 1233 bp, Triticum aestivum
  unsure (1)..(1233): unsure at all n locations
  Clone ID: PAT_TA_5430
gcgcgcgccgcgtccccgcgccccctttcctcgatccccacagccaatcccccctcgcgcaaaccctagctctgtttcctatccacacaacctcttcctccccgcatcaccacagctgccgctgtggagcctcgcggacgcctgctattactcctccctcgctcctctattccctccctctgtggttccggatcgggtgcaggccgtcatagtggagagcatgagcgtcaaggtcttaatagtggggtggagctgcaggggaggtaaggatgccggacggatctggtgcctgtcggctgaagcagcaggagttggcagagcgacggatgcggacggggtcatcaacaggggctgtaagagaaggagctcaagtgcgccaggaggagtggaaggctgaggtcgtttgacggtcggaccagcaggagcaaggagccaacggtggtcaatttcttgcatcccatcccggactctaaaagatttcagtttgatataggctatagtttgactttttgcttcttgaagtgaatggtatagcaccatgttgattacattagatttgttggtcaggcttgtctaaagtcaataatttcttcctcccttttcaatttaagtgtaccagcctggaagcttcgaatggctagcactaccgaggccgcagggacaccgtcgcattgaggtagtgccatggccgtaggtgctgatgtcgcatgggcagaaccgcggccgcgggatctctgctgtgtagtgccacaggctttgactcggtgttgcgtgatggaagagcagtggtaaagttcgacagcattgaagcgagatgtgagatcccagcgctccaaatgatgggtcgtggccgttggagggccaacagaggacaagggctaacaaccggtggtggagggagagtctgagaaatcatgagctttttccttatgaaaagtgataaagttacaacatagttttctcaaaggtgtgcatcagtgcagattgagcaaggcacaatctgagaagaaaaacaaaaaattagaaacagtgcatcatgtgtatgtttgtgagcggtgccgttgggggcctggttgtggcgcagcccttcggcgtggtgccctcttgcgttgccgctatggtcgcctcacgttggacgggaggagataagtcaatccccaattaagatgcacaattaagatccccaattaaatggtcacatcattaggaaggggaanatngaaaacaaactta

SEQ ID NO: 5431 - DNA, 614 bp, Triticum aestivum
  Clone ID: PAT_TA_5431
acataaagcactgtaattacttgtgacaacattctcgagccaggacgaagaatatcaaattcatcttgaagcaagtaaatacatattgaaaaattcaaaagctctgggttcaactcagatggactccaaacaaaagtcacagtacagcatgttgtcaacttcctataagcattacaagtgtgactacagtagctacaaaaaaagagccccaccaggccccgctaccaccacgcctcctcaagttccagaagctcgacaccatgaatctaacgctgaagaaggagcttcagctgctgcgcggggtccagcttgttgttcgggtgtctcagcagatccgctgaaatgcgtattcgaagatttggaatgtattcctcatcgaatgacagcataacaaggccattccaattctccagtataaaatactgtagtagccacagttatagtaagttgtttgtcgcgggtaattagctggggagaacactgtgaaagactcgagatcatgcttgaaaaggggctccctcattgcaacactcttgatattggcgatcagattcttagtaatcttgtccatctcgaataggtcttttgagttcttggtcgagtcaaaaatattg

SEQ ID NO: 5432 - DNA, 888 bp, Triticum aestivum
  Clone ID: PAT_TA_5432
ttgaactcgaactgaacacatttttgtttccttttccccattccgttcctcagttcccgctccaaaatcgtcccactagtttcacaagtagagtagatagaacctcacaagaatcccaataacaaatacacgaatacgcgcccttaattttttaatagccgattaaaccggaagtcacacgcatctgatgtaggatgtctggctgtagcctgtagaccattgcccggctcagctgtcgcttctgttgggcttgtctgactcctcctgatacaccgtgtccgctgacgcgatccactcgtttgtggcggggttccccttggaggaagcatggcgctccgtcgcatccgggtcttcggagagctcgaatcgatggcgccggccgggcctgtccaccttgatgaagcccgtcccagtcgtgtgatgctgcttgccgacgcagccgaggtccttgtagtactccgtctccacgaactcctcgcccgccttcccgccctcgcacaccagtttctcggagtgggcttcgaggtcctggaacttgtcgagctcggggtgggagccgtcggcgccggggccggcgagcgcgtcggtgtacacggcggagtggtcgctgcgggaaggcttggagtggcgcttgggccccgcgccgtcgtagtacccccgcacctcgtccaccctcaccgcctcgtccaccggggacaggtgcgcgtcgctcctgctcggcctcgacatgtcgatcgatccacctctccgcacaagcgcgccggccgatgctactgcttgccagagcgtactggtggtgtgtattgttatgccgcggccgcgctcgttagcggtggtgttaattgcgcgggcggtgccggtggtggaggaggaggctgcctccgcccc

SEQ ID NO: 5433 - DNA, 1383 bp, Triticum aestivum
  Clone ID: PAT_TA_5433
caaagtcatagcagaaggtggatatgagaaaatcttccatcaaacgtttgatgtcctccctgaagaaaaactcaagaagccattcgcatgttatctgtcaacctctgctggtcctgttatgggtgtgctccgcacgaggcattggctgtgtatgccagcgaggaggaagctgacaccttgatcgacgaaatgactaggcagcttgaccccgcggcagagaagaaggccccggagccagaacctgccttccagatcctggcaaacccagcccgcgttgtccctgcgcaggagaagttcatcaagttcatcgagggcagccgttacgtccccgtgaggcccgctccctgcgggttcatcctcctccgagacacgcagcccaagcgaggctgaggagcttgtgctcaccgacgcccccgcgaccgtggccacgggcgccggcaacagcgcagcagccgctgccgcggggcaaggctcggctgccatggccgtcgacgacgagccccagccgccccaacctttcgagtactcggcgtaagctgctgtggtaggatggagcgttgtctgtactcacccactagctatacgttgttgcttattccttattcaagatgcgagggaatttgttgtttgttggaaactgtgtagaatcgtcatgagtagagaactcaactctgaacgggagttacaggatatgtgctcaaccaatgtttgcatcaaggaagaccatcttgattttatagttataggcgaacacaacctgtccaatgtaaagttggccttctgtagtgataacccacttgcatacaaggttggggacaaaaagtgagtggagctattacaaggttgccatcccgctagcccagctgaggtccgttaatccttccacgagcagaacacacgcagctgagaaatacatccaggtggtctcggtcgataatcacgagttttggttcatgggctttgtgtactatgacagtgctgtaaagcacctgcaggaagcactccaggaggcccgtattttgcaagcttagtgatgtctataggtttggactagcaaacagttgtggtacagtttgtgtgtcagacaaagtgggagttgcccatgtgtagtttgctaggtgttgtcgtttgttgcgattcgtgtcactttgaactgggattgtatagatcgtggtctgtactcacccactagctatacgttgttgcttattcctttttcaagagtgcgagggaatttgttgtttgttggaaactgtgtagaatcatcatgagtagagaactcagactctgaacgggagttacaggatatgtgctcagccatgtttgcatcaaggaagacgatttgattttcatttttatttgcaaccaactgcagtgcacatc

SEQ ID NO: 5434 - DNA, 815 bp, Triticum aestivum
  Clone ID: PAT_TA_5434
cgtccgcggacgcgtgggcggacgcgtgggtctgaatcgtacaacccacatgttcgttatggtgcagctttagctgttgggatatcctgtgcaggaacagggttaagtgatgccatttccttgttggagcctctcacatcggacgttgttgactttgtacgccagggggctctaattgctatggcaatggtcatgatccagacgaatgaatcctttgattctcgtgttggaacattcaggcgtcagttggagaagatcatccttgacaagcatgaggacaccatgagcaaaatgggtgccatacttgcttctggtattctggatgctggtggtaggaatgtcacaatcaaacttctctcgaggaacaagcatgacaagctcactgctgtgattggcctcgctgttttcacccagttctggtactggtacccactcctatactttatcagcttggccttctcgccaacagccatcattggtctcaactcgaacctggaagtgcctaagttcgaattcctgtcacatgctaaaccgtccctctttgagtatccgaagccgaccactcagcagactacgacttcagcagtcaagctgcccacagccattttgtcaacctatgccaaggcaaaatctagggcgaagaaggatgcagaaagcaaagctgctaaccaggagaagacagcagaagcagaaagcaaagctaaccaggagaagtcaacagcagaaagcaaacctagccaggagaaatcaacggacgcagaaagcaaagctaagacaacggaagatgcttctggttctacttcaggcgaggcagc

SEQ ID NO: 5435 - DNA, 837 bp, Triticum aestivum
  Clone ID: PAT_TA_5435
ggatggagagttttttctttctttctagaactagattcatcatggaaaaggtgtatcctcactaatagaaggatacaacaaccttcggtttacactgatttaggagattggccaccacacccactatgaccacgccgacaagggttcgctttacctgacaaggtctcgaccgatgtcgaacacctccatagcccgaccaattccctagggctgcttctccatccgcaagtgcctagaggagtcggcgagtgtctgaccaattccctagggctacaattgacagtgtggggttgtaccagtaacaacttgacgccacgaatttcttgatcatgttttgatcgtgaatattacagttcaaatgcatcatgcatcatatttctacagcccaaaatttacacacaacaccaacaccaaacataaatttagatcacttacttacatgcccgaattgcgccttgctcatcagatctgaccagacccaatccagacccaggtgggtgctggaccatgtgcttcttgaattagactacttacttaggcgaactttgccatgcacaccactgcacttcttgtcgcgcaatttctgaactactgatgcaacactttcccagacagtgcgtgcagctgcctgcgaccaaaatagtagcttgtcacctcgggggccttctacagcttaagcttcagatctcctgacgatcgacacaacgacggctgtgtcagccagtttccccccgctgaaacctaggtaacccgttgcgacggcagagtctgaaaatgggcttatccctgctccagacctccctacctcatgtgccctggcagcaaggtgctcggcca

SEQ ID NO: 5436 - DNA, 584 bp, Triticum aestivum
  unsure (1)..(584): unsure at all n locations
  Clone ID: PAT_TA_5436
tcgagcggccgcccgggcaggtannaaagcacaatgtattattgatcatcgtcaatgctacatcttacactacattcatcttcctacgtaagttaatcaatgttatatggtccattcccctctcggcagcgcgcggtgccccctccgcggcaaaactgaaagcctttaacattattaccaggagacaactggacctcgtccagngaaaaataatgctgattgctgctcactttgatcctctaatttgagcctttaccacaccttaccctgcccaaagctgagtggctggcataaactaagacggatctggggaatgtcacatgttactacaaaagaaggtgggggttttatcttccggacaaaatcctggtcatgacatgttcctttggtgaagagcatacttgacgacctcgtaaaaggaaatgacaataccaactgatggtccagcacgagcgacgcgtggaccaacaccagtgaacaagccttttggaccctcagacctcaatatatcaactaatgtttgcctcgtggtcattctcattgccttctgggcatccttctctatctgtctccttgtcttggca

SEQ ID NO: 5437 - DNA, 776 bp, Triticum aestivum
  unsure (1)..(776): unsure at all n locations
  Clone ID: PAT_TA_5437
tttttttttttttttttttgaacaattcgaattccgaatttctgtttccaaaagagtgccttcagaatttagtataacccttgtgctatttttgttgaagcaaaaccatttattgacgcgactacaaaattatgtacagtaactagcttgttcctcttagtctccacccatccatccccccccccccccctctgaaagtattggaccttcaggaagccagtgaagtcctggggcagttgtcgacggagcaggcaaggacatctcggtagtcgcgcgagatcgtgaagtgatcgtacacattgccgtcacggctcttcttgtactcgaacaacagggatgaatgattgaaagccgtgagcttgccgaaaccgtggtcgaagtctctgaagtgactccattgaatctttgaagtgatgaagtctgaaaggctggcaccggcgccaccgacaaccacatgcgtcgttgcctggaacgggccactgtagtgatttgatgcgttaacaacacactggctctggtacaccggacatgtcctttcataattgtggacgtgaccgtagaaggcaagatcgaccttgtacttctgccagagctcttgcagcgcttctcgccccattggttcctcaaacgtgccttcaaatccatagtaggttggtgantaccgagaaacgtgtgaaggaaataccatggtgctcgccgtaaanacaaagnantcncataattgangncgtcctgctcanctcttttacatnaaactaaancaannggcgtcaaat

SEQ ID NO: 5438 - DNA, 686 bp, Triticum aestivum
  Clone ID: PAT_TA_5438
tcggcacgaggccaattgatgttgatgatctggcccacgcgtccgcccgttctttagtggggtctctttcgaaacctgagagatcacagcaacataagtcttcatcaagtgattctagtaccactggaaatttcactaacgccgaacaaaacagtctgaatactgatggccaaatggattcccaggatttttttgggggctgtgatactgttgatataacagggactagtgtattagaagtggagaacgccagattaaaagcagaactcgcttctgcaattgcagttctctgcacttttggtgctgaatacgcacatgaatctattgatgaagggcagaatgatgatgtgttgagaaatgcaagagagaaaacatctcaggcactttccgcgaaggatgaatatgccaaccagcttcagtcagtgttgaaagcaaagcaggagcagtgcttgtcctttgaaaagcgtatacaggagcttgaggaacaattagcgaatcagtacatacacgggcaaatggtttcaggaagcaaaagcgcatcagattccctcctttctacatttaaaggtaatgactgcaacctggatggaggtaggcaaacccatctgcgtgacgaatcaagtgtggccatgggtgagacatcatcaacatctgaacagccatctaagcaaacagaaggtggtgat

SEQ ID NO: 5439 - DNA, 671 bp, Triticum aestivum
  Clone ID: PAT_TA_5439
ataaaagatttgcagtttccaagcgcgtgtttcttcttttttgtatgcggaaatatttatgtgatcttggagagtattcaaggccaagagttcaggtggtcagcagcaacgtccaaaccatagtcacacactagcacttgggtgcatcggattcagtagttatttcaggaagccatttaggctgtacctgctctgaatggaagacaagatggatcacctagaggaccaaatcttcctgctactatgatatacaactatctcctactttacaaagtggaaccaaaaatcatctagatttgacaggaaacaacagtcatctagatgaccgcttccattgctggatcgcttcgtgcaaggaatggctgggaattatggtcagactcggaagcacgtgtttcgtaattggggagatcttgtgttcctcgagccaagcttcgatcaccctgcgctcgtaggtatgaccatcagcagcaacacaaggatcatccattacctcctgtgatatagggcagatgaagtggcttggcacaactgcttttggactttcaaacttccgggaactggtaacactgcttagaacattttcgagctctggaagcacctcttgctcaagatcaggccggtccctgcatcttagcgccgtacaatgcagccccagttttgccagcatc

SEQ ID NO: 5440 - DNA, 730 bp, Triticum aestivum
  Clone ID: PAT_TA_5440
tttttttttttaaaaaactttgggggggcggcacaaaaactatatgttggcctatcgagtatttccagtgaagaatatgttcattctttacaacaaaaacaacaacaacagaaaaaaacaaaattccccattacggctatgtaccgttcttggcccccctattttagtcttgcccagggaaaaccctctccaagaaactaacgaatcgtttcgaatacaagttcggatcaacagatgatatcgaaggggggtcgaacttgagcgatttgaccgcatgctctaccctcttgggcgtgttgtactcctgcagtatgtctatgatgccgaggtagagcacgacgtcgtactcctcgaccgcgtccgtgctttccagcaatttccgagctcgggccggcatgttcacccctagctgcactctgaacctgccggtgcccggcagaacaagatcgacttcttcgtaaccaccttctgaggctctaaccatgcttcctctgatgtgggaaccgcctgctgtcgtacctggctcgtgagcaactagtagaaatccctttgaggaatttgcatcctcacaatgcagtggcacgctacaatccattgcagatgtaattccactgctttcaagtgtattctgatgtgacgtggcagccttcaagtgattgggagctctgaagtggattcccagtagcatgctatagtcaataatcgattgggattccaggaacatgctatc

SEQ ID NO: 5441 - DNA, 1399 bp, Triticum aestivum
  unsure (1)..(1399): unsure at all n locations
  Clone ID: PAT_TA_5441
cggacgcgtgggacctgaacgtctttccctcgctggccgcccctctgaagcctgaatccgcgccaaaaccccgtataatcggccgctccgctcccgcctccccgagcgcaatgggggccgcctgcgacgacgccgtccagcaggtcgctcgcctcctcgaccaagttgaggagccgctcaagaagacgttccagaatgtgcaccagggctatccaacagagacactagtgcgcttccttaaagctagagagtggcatgtaactaatgctcataaaatgattgtagattgtttgaattggaggatacaaaatgaaattgacagtatactggagaaacctataatcccagtagatttgtatagatcgatacgagaatcacagcttgttgggttatcaggatactcaaaggagggcgtcccagtatttgcctttggtgttggacagagcacatatgacaaagcttcggtccattactatgtgcaatctcatattcagatcaatgagtaccgtgatcgtattattctgcctatggcaacgaagaagtttagacgacctataaccacctgtataaaggttcttgatatgactggtctgaagttgtcagcactgagcctattgaagattttgactgcaatatctgctgtcgatgaactaaattaccctgaaaaggccgagacctattatattgtgaatgctccatatatatgatgagcgtgttgaagggtggggaaacctctactgcaagagaggacaagaaagaaggtccatgttttgagtggtcgtgggaaagatgagctcctaaagattatggaccatttgtccatcccccatttctgtcgacgcgagggttcatcaaaagcttcgttgagcagcgtcgatgactgcttctcgctcgaccaccctttccaccaagagctctatcattacatcgagcagcaggcgttgaaccaggagctcatcaagcagggttctttgcatgtagacatccccgaccaagaccccgatgatgccatgattgtggaggtcatccaggccgagtttcacaagctcggtgaacagaatgggtctgctgatggcgaccataaataacgggtgttcgtgtaagatgtcagcggcttggcacaataaatgtgtgttgctgtgatgaaactgatgatccatttcggtgtttgcgnatgtttgcttgaccagncctgcctgttgtttngcggggtaaccagttccatggggcaagactgaggtagaaaaagcaccccatgtattctagatagaaataacccccgattcccctgttgtatactttggcaatggactgtcaaatgtatgtcctctaagctaggagtaaaccctcctgtaacatggatgcaaaaataatttttagaggaccctccttccatccg

SEQ ID NO: 5442 - DNA, 766 bp, Triticum aestivum
  unsure (1)..(766): unsure at all n locations
  Clone ID: PAT_TA_5442
aaaaaaattcttataaaatgtggagtgcccaagtttaggtggatattgagcaaacgcgctgatctgctccctacattgttcacgacgtgcgcagaccaaatggaacgttataaaccaaatgaagcttcggtctcttgaaatgaaaccagaagcgagatcaatacatcacacaaggaaagctaccagcacaacgcccgatcgcagttcatcacaaggcaattccactcgattattcagctcctagatgtctacgacatgctgcagattcagagcaatccttcagaagcagaggagcctacagccgcggccgcgccgccaccgcgtcggcgccgtagtccttgaccttgccccacacggcgggccacatggccttcctgatctcggccacgacctccccgtcccaccccctcgccgcgagcccctcggccgccgcgacggccgcggccaccacgtcctcgacgccgccgtccgcggccgcgtccaccacgccccgccgcaccgcctccgcggccgtcatctttgtcccccctgaggagcatgtcccgcctggtcgcggcgtcggggaccttctgccggagcagctccccgaagtagtcgacgatcttgatgccggcgtcgacctcgctcatgtacaggaacccgcgggaggcgcgcatgacgacggagtcgtgcgcgagggccagcgcgcagccggcggcggcggcgtggcccgtgacggcggccacggtgggcatggggagcgcgagcaggtcggcgacnaggcccc

SEQ ID NO: 5443 - DNA, 546 bp, Triticum aestivum
  Clone ID: PAT_TA_5443
atttgctttcgcaattggatttggtgtgttctttggaggtattactattcctgttgttgctggtgcgactccttctctcactcaagatgaagggttttacagagaaaaatggaagcaagaatagtggagatgttgaagcgacttcattctactctagttcagaggaaacactagtagtgatgcacatgccacaaggcatgggagaaggaaacaagctcaaattctctgacattttgaaagctacgaacaactttgacaaggagaacatcattgggtgtggaggctatgggttagtctacaaggcagagctacatgatggctccaaattggcaattaaaaagctcaacggtgaaatgtgtctgatggaaagggaattcagtgcagaggttgatgctctctccatggcacagcatgaaaatcttgtaccactctggggttactgcgtccagggaaactcaaggctcctcatgtattcctacatggagaatggcagcctggatgattggcttcataacagagatgatggcactagctcatttcttgatt

SEQ ID NO: 5444 - DNA, 1006 bp, Triticum aestivum
  unsure (1)..(1006): unsure at all n locations
  Clone ID: PAT_TA_5444
aatccttgttgaagtnataagaagatggttgatctctactcccatctggcgcctcccgctagctatcaatccccaacaacattttcccaacgaaaagaccctgaaaaaacctactgttgcaaacatatatttgttttaagactgataagtcgtggtgctcgtggcgtttagattgatggaatcaagaatcctgaggatctggtcgagggcgctcttgtccttgaggatgcccatgtgcgacaccttgggcagctccaccacctccaggacctgcgacggcgagtcggaccaggccttgatcggtcccatgaggctggcgaggttcaccgtcccgtcgccgtcaccgtacaccacctccacgggccccgcgtcgaagccctcgtccccaaacacgaggctctccaccgtgtccacgccggtgcccacgaggcatgtcaccggcacgcccggctccggcaggacctcgccgagcggccgtatccgcgcccggtacggctccaccccgtcggcgaacccgatgtcgttgaggaactgcgtgacgttcttggcggagtaggtccggttgtggcgctgggagacgacgagcgtggtgttgccaaacaccttgggcgtgggcagcagccagaggttgctctcggagctgcgctgctcgtcgcggatgagggtggggtcgacgaagggcacgccgagggtgttgccggaggcgaaggtgagcatctcccgcgcgccgccgccccacggcgcggacagcgtcaccagccgcttcacgtgcgccgcgcgccaggcgggcggggcgcgcgccaggaactgcagcgcgtacagcccgccgaggctgtgcgccatgaggaccgccggcatcccgccgttggccgcgcacgcggactccaccagcagcctgaggcgctccaggtacgcggtgcccacctgcgacgggtggcccggcgcggccaggccgtagcggaagtcgtagggcgcgccgaagaggtcgcagccctcctcctcgtgc

SEQ ID NO: 5445 - DNA, 845 bp, Triticum aestivum
  Clone ID: PAT_TA_5445
gaattcggcacgagaccagacggatgctatggatatatcacaaagaaatcttctgaaaggcttaacttctgatgagagtgttgttgctaaggactcttccacgctaggtgtggtgattgttaagcattgcggatatacggcaacagtgaaggtttcgggacgcacaaagaacagcagcgatggcaaacaaaccagtgatatctctgatcatcttgatgaaatacctaacatcgatgtggatgatcatcctgatggaggttctaatgccttgaatcctcacagtctaagaataccactggccgaaaattatcaacccagaaatcgctgccagtaaccagcaccttgcatctaaaccacatgttgataattatgcgaggaaactagcatgtacagtacttgaaaccagcttgaggaagctggagaacaccccgaacaaaaatcctagacgtatcaggtgggaacttgggtcctcctggctccagcacttccagaaaaaagatgcttccgtttctgaggacagtgagaagaatgcaaaaaaatctgaaaaagattcgtctgtcaaaggtctcggcaagcactttgaacaattaagaaaaattaataagaaagaaagcactattgaagatgctaagactgttaaggaagaatctgatagcaactgcctgctgacaaatggtacggagaagtctgaaaatgtagtatttaccgaaataaggaacctgattacagaggatgctttctgccgcttgaagagtttggaagctggccttcatcaaaagtcccttgaagagctcacaaagatggcccataagttctatgatgatactgcactcccaaagctggtg

SEQ ID NO: 5446 - DNA, 1140 bp, Triticum aestivum
  unsure (1)..(1140): unsure at all n locations
  Clone ID: PAT_TA_5446
gccgcacgcatggggctcctcgctactccacggccatggccaccgccgtcgccgccttccgctctttcattcaccccaccgccattgccgccgccatcccactccctccttctcacttcaacctcaacaacttccagcggcactgcgtcgggctccgcctattctcctcctcccaccgtcgccaccccattctcctgcccgcctccacctccgctgcttccggccaagagttctcttctgacggagaatattactctgaggagggtccaaaggagtacgtggaggaagagggagaggaggcagaacccgaggtccaggcagttcgcggttactatcccccgagaaaccggccggcacttggacaagagcccgggcgaatctacgtcggcaacctgccctacaccttcaccggcgctgagctcactgcagcattctccgagcccggcagcgtcgacgatgtccagataatatatgacaaaatcaccgaccggagtcgtggctttgcctttgtcaccatggccaccgccgaggaggctgccaaggccgtccagatgttcaacggagctctgctgggagggaggacagtcagggtgaatttcccggaagttccgcgaggaggagaaaaggcagtggcatcggcagcggttgcaaggactagcttgcgttttgttgacgatgggacatacaagggttacgccggcaacctggggtggggtgtgccggctgatgcactcaagacggcattcgaggggcagcctggcttggttggtgccagggtaatcttcgagcgtatacacgggtcgttccagggggtttggctttgtctcctttcagacaatagaagatgcaaaggctgccttgcaggccatggacggagtggaactggatgggaggccactccgacttagtctggcggcccagaaccctccagctggatcaactcctagcacagtccagtcccagcaagaacaaactgcctcaggtggttctgagccagaggtcgacaaaaacagtacctccccggcgcccgctcgaggccgaatgcccgcggccgccttgccgcctactccagctattagtaactactaatagncngtaggatgtttanttnaacttggncnccgttnaaaattttccgtc

SEQ ID NO: 5447 - DNA, 832 bp, Triticum aestivum
  unsure (1)..(832): unsure at all n locations
  Clone ID: PAT_TA_5447
gaattcggcacgagacttatccaggggcagggagaacgcggcagccggcgacgacgacaggaggcagaggcagaagcagaagcagcgcgagatgccggcggcgtcggcatcgaatggggctgcggaccgcgagcacgggtgcatgcccggctgcgtgccggtgcgcgccaagcggacggccacggttacgaccgtcacgaccacgtcggcgaggacgtcgcggcacaacttcgtcaggtcagcggcgtcggggctcttccccggggcgccggtgttcaccaaccacgagtccctcccggcgctccccgaggcctactcggagttcgtctccgctttcccgcagtacggcgggctagccggctcggcggacgcgatcagggacggggagtacaggcacctcgaccgccacgtctgcctggactacaacgggatgaacctcttctcccacgcgcagatgaactcgtcgctgccgtccacgtcagctccggcggagccatcggcgtggcagccgcccttcttcgacatcgcgtacaggtccgcgagcctgcggtcgcaaggtgcagcaatgcggggacggcactgccgcggatccgcggcggggggatcagcggcgccgtcacgaggcgcatcatggcgtcccttaaattccccgaggacgataccaccgtgcgcgcgacccgcgcgncgctcccgcccccgccggagcttccccccttccccggcgcggaaggaaaactctcccctgtacactaccagncaggcgtggggcaaggccaaaccccccgcgcgggccgagtatgaaccaactccttgcgacatcctcaaccgaaan

SEQ ID NO: 5448 - DNA, 849 bp, Triticum aestivum
  Clone ID: PAT_TA_5448
ttttttttttaccaatggttgcctgtatttccaaatgcagtacagaagaacgaacccccacccacccacgaaacagagtctacattttaacagttcacacagaagcagaagtgctacaactctctctgacaaagagagtagctctttcactgccagtccggtcgagctgatcccacaaaaatggcgtcgtcaacaaatgacgcagtgaaccgaactatacccagcggcgaacatggcggtggcgacctacacttcgacggtcttctggttgagcgccgtgtacctccacctctccttctccacgaagtcggcgtccaagaacttggccacgaacgcccacagcttgtacgcgtcctcgaagttgctcaagaaccccagcgacgcattcaccacgtggatccccgcctcgccgccgccgtcgctggcccttgcctgctcaaggacggcgctcctgtcggcctcgtacttgtcggcgaaccagatgttccgcaggaagccgcaggtgagcgagatggcctgccggtcggcaagcttctgcaccagcgccggcgccaccttctcccccttccagtcgtacacgttgaacgccagcgagggcccccgctcgaacttgacgcgcggcccgtacacccgcaccagctgcttcccgccgccgtgctccgggtgcgggtgccgcagcttctgcatcgccaccaccagccagttgctgatgcaccgcagccggttgccgatggcgatgaggcccagggcgtccgcgtggtccagccccctgcactccacctccagcatgcgctcctcctctgcttcggctgctcccggcggcggccatggccgactgtctcctcgtgc

SEQ ID NO: 5449 - DNA, 605 bp, Triticum aestivum
  Clone ID: PAT_TA_5449
gcctcgtgccgaattcggcacgtcggcccgccattcctcctcgccgccgcatatcgacatcgaccgacggacgtccagtttagcagcaggatctacaccgcggactccgccagctcaaccaccgcccgcgcacctccggcgtacggcggcagatacggtggtcgcctgtccagggagagggagggttccatcgatcgatcgaccgagtgccctgccgttggttgatccgtcgagagatgagctgcaacgggtgccgcgtgctgcgcaaggggtgcagcgacgcctgcgtgctgcggcccagcatcgagtggatcgacggcgcccagccgcaggccaacgccaccgtcttcgtcgccaagttcttcggccgcgccggcctcgtcgcctccctcgccgccgtcccgctccaccaccgaccagccttgttccggtcgcttctgtacgaggcgtgtggccggacgatcaacccggtgagcggcgccctcgggctcatgtggaccagcaactgggacctctgccaggccgccgccgacgccgtgctgcgcggcgactccctgcgctcgctctccgacgggcccgccgtcttcacggagcgcgacatggcc

SEQ ID NO: 5450 - DNA, 735 bp, Triticum aestivum
  unsure (1)..(735): unsure at all n locations
  Clone ID: PAT_TA_5450
gaagaantgggaggcgtgggagcatgagctctctgagaatgaaagaatgtggagcgacactcaccgagatgagcacaaggaaactgcccgtgcgcaacgctatcgcatgatgatcaataatctgctgccgcatatattggatgatacgattcgacaggaaatcagcatgaacatcaatcaaatatctccaaactttccagatcagcagccaaggcccatccgtcggcttaattgggtggcacagaagcaggatttgcaaaatttaaatgctcgtatgaagaaatataatactattatgaaggctacggatgaggtaacaagtagtatcattagtatgatgggtggtgctatagaagatcagaagcgtgcttcgagttcaaatgctggcatttcttctcacaatctcagcgaggccgatgatgatgtgaagactttgatacctgagagcctaccgtgacatctcagctcactcaggctgttgttgaacgctgtttctttttacccccgagagactgtttagccccctctcctgtaaaacagtgatttcttcagtaccatctatgtgctgttagatggaggttgaaccccaagccgtgacttggtggcaggcaatttggctaggcactctggttagtggaatatatgtcttcccattccaaaaatacataaccaaatctatgtgctgttgcgtttttctccactcgaacagaaatgtagggaaaggctgcgtacaat

SEQ ID NO: 5451 - DNA, 2122 bp, Triticum aestivum
  Clone ID: PAT_TA_5451
tcgaccccgcgtccgtgttcttgtaacgccttattctggtccaccaggacaacataaaagcaagtatgtctctaacagaattggctggcaaggtgggctctcgtaccaatttttatccctttcagaagtacagaaagatgctcaaaatggcaatggtcttggtgacagccaaacaaacagcaacaatactcatttacttcgatgccatcagtgtaatgatgatgaaaatattgatttgacatctctttcatccttcaaaagaacagtggaatgccctctcaattttgttccgcaggcctcggctcgagatttgttcagaccaagagaagcaattgagtttgctgattcatatgtagggggctctcatctgacaccagggaaattagctctatttgcatgcttaagggagggtcctgccagcaaacaacagaaagcagtgaaagaccatgatgatgcaaaaactattggctggagtatttctgatatactgaacaaagagaatctagataaattcattccagcgacaacagctggattaaacggcacagtggatacatcagattacatgaggcgatacaagagttctttaacagatggaaggttgaaggactgtgtggatttgttggaaagcatggagcagaagggattgcttgatacgaagaagatccaccatgccagctttttgagtgcatgtaaaaaacaaagggctgttatggaagctgttcgcttctgccgacggggtgaaaatccgaaaatgagcaccttcaatatgcttttatcggtttgtgctaattcaaaagattttgaaggggccctccaagttatggtgctcctaaaggaggctgggctaaaacccgattgtaaactttacaccacattgatatcaacttgtgcaaagtgtggaaaagttgatgcgatgtttgaggtcttccatgagatggttagtgctggaatagagccaaatgttaacacatacggtgcactaattgatggctgtgctaaagctgggcaagtagcaaaagcatttggtgcttacgggatcatgagttcaaagaaggtgaagccagatcgagttgtcttcaatgctttgatcagtgcatgtggtgaatctggagctgttgctcgagcttttgatgttttatcagaaatgacagcagaatcctcagaatcgaaaggatgcaagccaattcttcctgatcatgtcacagttggagcactcatgaagacatgtattcaggctggccaggctgatcgagctcgtgaggtttacaaaatgcttcgggggtacagtataaaaggtactccagaagtttacacaattgcactgagaagctgtagcttgactggcgatttagggtttgcattgaagatctatgaagatatgaacaagatcggagttcaacctgatgagatgtttctgagtgctctggttgatgtagccggccacgctaggagggctgatgctgcttttgaaataatcaaagatgtaagagcaaagggatttcatgttggaatcatggcatacagttcctgtatgggcgcttgctgcaatgccaaggactggaaaaaggcgctgcagctatttgaggagatcaaggctatcaaattaattccaacagttccgatgatgaatgctttaattacttccctctgtgacggcgatcaagttttaaaagctgctgaggtccttaatgagataaaggaactacgtgtccgtccaaatgagataacctattcggtcttatgtgtggcttgtgaaagaaatggtgaagcacaactagctcttgatttatttgagaaactaaaagtagatggtattggcctcaatcccaccattgtcggttgtcttactggtttatgcctacaaatgttttcctatgatctttcacttggcaacatcattgtcagattcaaccaagggaagccacagattgacaataaatggacttcctcagcaattatggttttccgtcaggcaatcaccgctggtctgctaccctcaagcgatgttttatctcaagtgctgggttgtttgaggtttcctcatgacagttcattgaaaaccactttcattgataatatgggaataagttgtgatatgccacatcaccccaatacaaat

SEQ ID NO: 5452 - DNA, 569 bp, Triticum aestivum
  Clone ID: PAT_TA_5452
gtgaacagagtgcggccggacctggtaaggggggaggacatgatgtcagcgctcgacgtgcaaaaaatgctcgggttacctctgctaggtgtggtgccagaagattcagaggtaatccgcagcacaaacaggggcgtgccgttggtgctgacggacccgcccacgcctgcaggcctcgccctggagcaggcgacgtggcgtctggtggagcgggacgcgatgacggccgtcatggtcgaggagcaggagcggcccaagaagaagggcggcttcttctcgttcttcggcgggtgaagcctgagctgaaccgagccgccggtgacgtgcgtggtgtgtatagagctgcgatttggagctgcttagtcgtttttcggtttgttttgctcttgtttttcctagcgtagcacgattcattcggtgtgcttgattccacagagacagacggtcttttctttgttcttccaaatttacgccgaacattagcagagtaaatgtatgtagttttgtggttgattgcttcttgctgttgcagtgagcccctcttgttggagtggtgttgttcatggctt

SEQ ID NO: 5453 - DNA, 615 bp, Triticum aestivum
  Clone ID: PAT_TA_5453
gtagtaattttgttgctgtattgacctgccctcctcgctcctgattgtacagtaattgccttcttggcatacacaaaaatcgggacacagaaaaggtaagacctgcactatagagaaaggcttctgatatcacgctgctgatcagcaatccctttcgctaaccgcgagggcagtggaagcaactcaactggagctcctgtggggggtgcgcttgtaaattttgggttaaaccaccttcttaatgtgaggccgttgatcctcatcctcccgtgggactcctcgccttgatatttaattcctaatcttctcagcagggagccaactgcttggccgactcttccagcaagtttaagtgttttctccctttcatcaagatcaacttgtttcttttcggtgggtaatagaattgtaacatttggtaaccttgcacctgcagctagtcgatgcttcaaagacttcaatgtcgatagaagagaaacctcggctgtgtagatgtttgactttcttgcatcaatgacaatttgactgtattttgtggaagtgcttgcaactgctcctaacaagccaccttcctccagtaccgcggccgcgcccacgccatattcaccgaatcct

SEQ ID NO: 5454 - DNA, 674 bp, Triticum aestivum
  Clone ID: PAT_TA_5454
agaaaaaaatgttggccttctatttttattcccaacaatggtcgcatatcgtactttaattgtccaaaaagaaaaggacacccaaacgtggtgtctttggcaacacaaacacatgcatggctgtgtatatatagatttcgagcggccgcccgggcaggtacacatcaggtgtttttcgttctccaggttatatgcttgacgtgaggccatcccatagatcgtaattcttctcgcacgcgtctccggcttcacgctgcggagaacagcttctacaacatctctcatcgccaacaacggagagcaccttccctcgcttccgtcacgaacacgaacaggccgccgtcctttctgatctcattaaaaacgtgagagtcattccagcagcagcaaaatttcgaccatgatggagtattatgcatatcgcatccagcagcgactgaaccagtcagtagtcttgcaaacgagtggcaaactattccttcagttcatcatagacgcagcaacatgcgttgagcaatggaggctcaattggtactgcgagctacctattctcgccaccactaattgcacggcgtcacacaactcgtgagctcatgcacaacacgtacctcggccgcgaccacgctaggctctctcatagaaattacatccttgcttgaattattttgataata

SEQ ID NO: 5455 - DNA, 1269 bp, Triticum aestivum
  unsure (1)..(1269): unsure at all n locations
  Clone ID: PAT_TA_5455
tcggcacgcggcgccggcgaagccgtgccgaccgggcctcggtcgagctagctaccgagctcccggggccgtcgcgcgctcgcgtcctcgcatgggttcggagcagaagccgcacgtggtgttcgtgccgttcccggcgcacggccacgtcgcgccgcacacgcagctcgcgcgcctcctccacgcccgcggcttccgcgtcacgctcgtccacaccgagctgcaccaccgccgcctcctgctcgccaagggcgccgacgcggccgcggccgccgcgccgtggctcggcgtcgaggtcatccccgacgggctgtcgctggaggcgccgccgcggtcgctggaggcgcaccacgacgcgctcgagctgaactgccccgagccgctcaaggagctgctgcgcgcgatggcgcgcaggcccggcgcgccccccgtgagctgcgtcgtggtggacgcgcccatgtcgttcgcttccatggcggcgcgggacgtcggcgtccccgacgtgacgttcttcacggcgtccgcggccgggctcatggggtacatgcagttcgaggagctggtgaagaggggcctcgtcccgctgaagggagccgggtacaagacggacggcagcctcgacgccccgctggactgggtgcccgggatgaagggcatgcggctcagggacatgccgaccttctgccacaccacggacgccgacagcgcgctgatgcgcatccacctccaccagatgcgcgtcgtcgccgggtccaaggccgtcgtcatcaacacgttccacgacatggagaaggacgtcgtggacgcgctcgcggccttcctcccgcccgtctacaccgtcggccctctctccagcatcgtatcgtcgctcccggcgggaggcggcgacccctcgagctccacggacacgccgagcctctttcaggaggacacngagtgcatggcgtggctggacgggaaagaggcccgctccgtcgtgtacgtgagctacgggagccacgccgccgcgggcgccgacaagataaaggagttcgcgttcgggctagcgaagtgcggctctccctcctgtggttctgcggccgacctggcggccgcgttgaaggcgggagaacggcttctctgccttggtgcgcccagaggggtccttccccccactggaaggtttttgtcccctgtggtggactcatctggaaccgaatcgagggtccggcctgttgtccatgttcaacgacaccctgcggtgtatacggtgaaacgtcggatgccaga

SEQ ID NO: 5456 - DNA, 719 bp, Triticum aestivum
  Clone ID: PAT_TA_5456
gtcgacccacgcgtccgcccacgcgtccgtcatgccagccggccacggttgtttcttgcgacctcgtcatgtgtctcgtgccaaaaacaaggcgtgtcttctgtgcggcccccgaaaaagtagcgtgcctcttgctggaagcatttagtgtgtgtgcttggactccaactgtctgtccaagcgcgccggccattcacgcggcttggattttccctcgcgggaagggtcccaaatttccaatcggttgcaacaaacgcattgaatctgggtgtttcaccaccccagtacttcaccccgccccacacctctcataccaatagtgctctccctccccctgttcttgcagcacttgcaaagggaccggcgcacgcgcaaggcaacctgctcgccgtagctgctgcctcctggcctcttcttcctcagcttgcctccggtgattacactttcatggcttacttcctacccgtttgccgcgtcgaatagtagcattagcttcaaagtaatattgtagcccggcgtttaattctcttctgctgttgttggattgcgatttggagctgtagattttgatatattccattagacgtccttgcaagcttttaatttgttcttagtaccgttgcggttcacaactgcactatgtcactactagtacatcttctcttctgtacaagcaaaacatgctgctctgcgctctgccaaattaagcggcggaaaac

SEQ ID NO: 5457 - DNA, 691 bp, Triticum aestivum
  Clone ID: PAT_TA_5457
gtcgcggaattcactagtgattagcgtggtcgcggccgaggtttttttttttttttttttttttggaaaagataaacagatgcgctgcagcaccctagatcacatatacacgtatgccaagctcagggctgttcaatcacaactcgcagctattcttggtttcacatcaaccttttctaacgttttccctacgtactattcagttgcagctccgaagatcttggcctgatactgcaatatgcctttggccaagcaaacacctgatgctcaccatcaattgggtggatggcaactgaaacaagtcgacgggcgacacacgaggcattgctcccccgaaatcgttcacaggggacattaaggatatagcccctgtatgtttatttcgaagggctttcctgagactattgaaatatgtccagggggctttaaacatcacccgaccggtttcctcaaagacccttcaagagtcccaattgaaaaatgtggacaagttgctttaaggcatcacgcggcctgggccctcattgtccctcaatctccctacgcaatatgtattgtgaacgatataggatcccccgttcgctgatgcacagatctctggattctgactaatcacaagtcctgttggcctgcttgtactgatgagacttccgcagaacctggggcctcaagtactgggatattttcaaca

SEQ ID NO: 5458 - DNA, 745 bp, Triticum aestivum
  Clone ID: PAT_TA_5458
ttagaattcggcacgaggacagacagacagagagggagatagagagctcgtgccgaattcggcaccaggagagcgagagcggcgctccactcttctttttttcttttttgtaggtctataagtgatctcatagttaattctcaaattgcctcaacttacaatccgacatgaaagtcctgatcaaactgggcctaaaggaaacaaggctagagtcaatctttcacggctcaaaagtcggcacttgagtagaaggatcctgagttgcatggtacaacgcgcgtcgcgtaatactccgataaggatcttcctttctcttcctcttgaggtaagacactacattctccacttcggattcgatttgcaaatatacttcgtttgccttcttcctatccgtcagcacattgtccattcctttcatctcgattggcttgccgaataggaagtatagccgacctggtacctttgggagaacagccggtagatgcaagacttgattcccatcatctcctttcaccgtgtcccttattagtcctttaaaatcttcattgaatgattttatcgcgtctttgagatagggtatgttcttctgatcattgtagtccagaactatctccacaaagtcatcttctcccacacaaccaaatggtacgacggtaactccaaaccgtgctgccattcttacaaattctggttgatctggccaaaacaatttgtatgcctcacccttcctatgtagagcttcccg

SEQ ID NO: 5459 - DNA, 673 bp, Triticum aestivum
  Clone ID: PAT_TA_5459
gaattcggcacgaggcccgcccccccccccccgcgcccgcccctccccccgccgccgttcgcccccccgccgccgtcgccgcccgaggccgccgccccgccggctgccccccccgcggccgctcccccccccgcgccccctcgccccccccgtccgcccccccccctccgcgcgtgcccccggcggtgccccgtcccccgccgggtccgcgtcaggcgcagcggcgcggcgagccttcgcccctccgccagccatcgtccgggcgccagcgtgcgcggagcggcaagggggtcctgcgcggcggagacggcgtccggtgtggacacgccgtccacggcggacgcgccaacccccccgcacgctcctgttcaccgacacttcccggtgaagggagtcagcatcgcgttctgcctgctgcactgcgcgcttgtacgcccgatgcagttcacggcgtgaccgttcccctgccttgcccattatctctctgctcggcccttgccttgcttttctgttccttggaggactcctgtgcctcttgtgctggatgtgactcctccccctcggcctctgctcagggggagcttggcccgctcgttcttcctcttctactcaccgcttgcccgggacacggcctgggcgtctttctcggtgctcgcctcctgcctggcgttta

SEQ ID NO: 5460 - DNA, 1838 bp, Triticum aestivum
  Clone ID: PAT_TA_5460
ttctctcgagtgaatgacaaaatagttcaagggtggaatgcatctgcaccacccctctatttgtggagtcgttctgattggacagaaaagcataaggaagctgcctaggcccagattcgctcttctggggctagatccgcccgccgtgttgctccgggtgctcggtctgacccgcgccctgcgacgtcgccggctgatgcgctggtggggcctactccacgatcagggaaagaaaaggagaatataggaaatacctcatgccacccaagagaggtcaatctatcggataatgtacctgcacggagaaaagctgaacctaagagtcaacaaaatgctagatcaggaaaagctaaagagactagagagaaggctacatgtgatttcagagaggatagtccatcaggaaaagcagaagagagaaggcataaggcggcatgctctgtcagagaggttagcccatcagatgaccaccttgtgaagaaacaagatggacctggagaagagaaagcagccagaaaggccaacttcacggtgaagaagcaagctaggcccagagaagaaaaagaagctaatctatcaggtaaccaccccctgaagaaacaagctgaagctacctctcaacaaatttcccgaccagggaaacagaatagcagggatggaagcaagagctctgatgacaggagcaggaaaaggatccctgacgaggcagacagcctccctccagaaaagcaagtggaagttgcctatgaggagacaagagctattccaagtaaaaggggtatgcaccatggacagagcaatggaactaatgctcgtgtaaaggaatcgaaagggagttcagacatgagtatgtcatcatcccttgaaaacagcactgctcgtcacagatccagaagcaattccccttttataccaactgaacaaccctctggttatacgacagcgcaccgcgatagtaatatgaagtatcatgtgaaagaacctcgcgtgtctacattcaacagcgctactacttatcagggaagttatttggcaaacagtgatgggcgcaaggatgcaattggagagaggaatgaccccactgtttacacgggtgctgatgataggtcaagtgcgtacaactccagcattgaagagatgaccaaaaggtatgctcctggccgagctggggatgtgtacagtccgcaaggtcagggaaacggtggcagcttctccaggaggcaggatgatcaccttcagaccagtctttactcccttggttcttcaggtgctagatatgaccagattggttcttcaggtgctagatatgaccagattgtttcttcaggtgcaagatatgacccgcgatctttaacttcgccgtcttatgggctgttgagtacaactccacggagctcagtcatagacaagtacagtccagggttctcgggttcaagtggatctggaccgtcagtcatggacagctatgctcctggttacttgggcgcaaatgcaccaggaagaagcttggtaatggacagatatgctctacccctcgatgaaacaaactacgcaatgcgaggtgttcatgatgtccctggatatggaagggacatgcctccacagtacccctacagagggccagatccttctggcagagggccgcctcatatttgattactgaagcttcttcaagttaccctagccatgcagttttttcttctttctgactcgacctgttcaaagtgacttctgtaattaggttgtcacggatgaataggtatgcagatgatgactcgttgtttagtccttgccaatgctgtgatacctgttatgtgaaaatctctaccatgcttttc

SEQ ID NO: 5461 - DNA, 650 bp, Triticum aestivum
  Clone ID: PAT_TA_5461
cggggttaccggccattccccgtcgtcccccaccagtcctcacacagctctacctctgcccccccggcccctctcacgtgttgccgcgctgctccgcgtcccccccactagcccccgctcctggctaggcccgggctcacagctaccccaaatggttcgcaaaccaaattccaacatcactctgtctcttggcagcgccctttttgcccaatgtccaacggctccacttattctgcaccaatgcttaaaattctcctcggatacgccatttgctcagtctcaccttgaagcccctcccactcttggtcgagacaaggaaactaattcccatccagcagcgggtatgtaacgccttttaaatgccgtgtggcctaactggtgtgcctaaattccttggagaagtgtgtcgtcccgtcgatctcgaaatgcaagcttctcatcaactagcaccgcatcgacggtgtaaccatccaccgtatattctctaacccattcatgtccggtactatataaaagacgcccctcgccccgctgcgacagggtggccgtcctccgtttgttccccttccccttcaccgccggtgctattttctcgtcccccgacatccttctgaaacagggaggtcgtcttctgattgaaccgcttgctc

SEQ ID NO: 5462 - DNA, 1659 bp, Triticum aestivum
  Clone ID: PAT_TA_5462
cacctaattcttcaaaaggaggggttggtttccaagcaatattggaagctatgggaatggctgcggtaaaggcaatagctgctataactgccatcattgctggaggtcgtttgttccttcggccaatttacaggcaaattgctgcccacccgtccgccctcccttgtcctcctcccacgccccttctgttgttgggggcgcgtcttcttacggctcgggctggcttatcaatggcactgggagcatttttggctggtttgttgttagcagaaacagagttctccttgcaggttgagtcggatattgctccttaccgtggccttctgttaggtctattctttatgacggttggaatgtctattgacccaaagctgtttctgtcaaacttcccagcagtctctttgatattaggtctcttaattattggaaagacactgttagtaacatttattggtagagtgtttggagtttccaccatagctgctgttcgggttggtcttttgcttgcacctggtggggagtttgcttttgttgcctttggagaagccgttaaccagggtcttctatcgcctcaattatcgtcattattatttttggtggttggcctttcaatggctatgacaccatatttagctgctggagggcagtttctagcatcaaaatttgagcagcatgatgtcaggagtttattgccagtggaaagtgagacggatgacttgcaaggccatattattattttgggatttggacgtgttgggcagatcatcgcccaactcctgtcagaacggttaattccatttgtagcgcttgatgttcgaagtgatcgggtggcagttgggcgcgcacttgatctaccagtatatttcggtgatgcaggaagcagagaggtactgcacaaagttggagctgagagggcatgcgctgctgccattactttagatactcctggtgcaaattatagagctgtatgggctctgagcaaatactttccaaatgtgaagacatttgtcagagcacatgatgttgatcatggtgttaatttggagaaagccggtgcatcagcggttgtccctgagaccttagaaccaagtcttcaattggctgctgctgttcttgctcaagcaaaacttccaatgtccgagattgcaacaacgatcaacgagttcaggaatcgtcatttgtcagagctaacggagctgtgttctacaagtgggagctccctgggctacggcttctctcgagtcatgtcgaaaacgaagcctgtggtctctgacgacgagagcgacaccattgatggagccctggcgatctgagcccactacgcgaacgtgaaaggctctgcctcccttgtcctcctcccagggctgtacagtagatgtgttcgcgtatagaaaggtagcaaaaataatagtccgagcgtacggctgttaccgatcttggcaactcttccattttttgcatggtaggacatttgtttttttttctcttccagaccactgtttcttccttttttctttcgagccctgttacttcccgtcaagtagacggtggaagatttggttatcagggttgcacgcaggacactgagaattttgcagaaagtgtccgccattttgcgtttgctgttctactctactcttatccaagtttttgattttc

SEQ ID NO: 5463 - DNA, 568 bp, Triticum aestivum
  Clone ID: PAT_TA_5463
tagggggattggtacgggcccccccccttttttgttgaattgtgctgggtggatgcacggcagcatccttcaactaccaagtcctacgtcaaggctgcggtgctttgtacgccttagtagtatacaatactacgtatctgccttgatcgatggacgatcatcgtatccttccatatacatatatgcaagtggcgccattgatccacacgcatgtacgtaattcacattaacctcccggtcgatgggtcctccacaagcgattcgaaaccaatcgtacccggccggggccatacgcagctgcgtgcaggctaggtagtagtgggtgtcgaggccggtccgctaatggtggagtggtagctagatctcgtaagacattccgaccttgagcagctggcttcttgggatggcgagcatcttatccccttgcctgcagttcttcctgaggaaggcgtagacgtagttgacgatgactttcttgagcagcgaggagtgaggccgcgccaccacctcgttctcccccatgatgtacaccacccccttctccatctcccgctcgatgtacctatgc

SEQ ID NO: 5464 - DNA, 808 bp, Triticum aestivum
  unsure (1)..(808): unsure at all n locations
  Clone ID: PAT_TA_5464
ggcaaatataaatacagttttattaaagcacatctagatgttgcagaagagctagacgagatgacagtttgtatcggagattacagtttgtgaataaactgtcatcctcgaccaactaagactgtcatcaaaacgttcgtaatgccacctgtccccgtgaacgtcagccagaggatcctatttccaaatcaatactgaaggagtgcgacgagcatatgaggctacacggaagtacgcattctgcctgtttgttttatgcaacgtctcactaaaaggccaaatgttgcagaagagctaaattacgaattcgacacgcacgtctgcaccgtacaaatcttgcgaaagaggcaaaggacaagcatcacaccatggaatncccagagaagccaccgcatctcttttgatttccttcttccttttttctgagaaagagtgagcccagcacgactcgcgcatcttgcgcccccatcttttctgacgaaaagaggtcacatcatcggaggttgatcacttattaatggccggatttggcgctcctcgagcttctttcatcttccacatgcttcaagaaggcgtaaattgccacgtcggaagatccaccttccttgacggcgtctgcagccatccctttcgccatggccgccctctctcgaagcttttgcccttcctccgactccattaccagcctcaccttggcttgcacctcctcggccttgacggacgactcctcgtagccctccaccgccaccccatcttcatctcctccaccaggtgtatcttgttcagcctctgctccgccctggtgccg

SEQ ID NO: 5465 - DNA, 1032 bp, Triticum aestivum
  Clone ID: PAT_TA_5465
cggacgcgtgggcggacgcgtgggctttttttttttttttttttggttttttgaactataaacggcagtgccatgctgtcagtaaaactagcataatgattcaggaatgttgctcatgttgagatgggccttcacgcctcctcaacagcaagaaggttcatagcagttgattattcacgaccttcggagcgaaacgcctgaccgaagaacgaggttattcaaaaaaaaaaaaacttgtaaaggccaaaacttttaaaccgaagtatgcacaggctggacaacccgaggccaaaaagggatattttgcaagggctagcccataaggggaacttgatcggctccggttgcaatgcctatggcaccagctccgactggacctgcatcatggactgtcaaaatgccggtggctgtagcggcggcaggtgccctgcccacgtccttaatgtccccaaaactgccccggcccgagggcgccttagggcctgtgttgaggcggggtgagatgtgcccgtatgcaggctttttcattggctgctcatggcacggcacgatctccgcatttggagaccacgttagttgtctctgcatgggaccatacgatatcggcatttgtagctctactcagctctctctggcataactcatatgagaattttgccgctcaccaaacactgcaaatagcaactttactgaactcagaacatggccgctcatcgccgcctcgactttcttctgttcgttacggtcctttatcagccgcttgaaacgtgttccttgcttatcaaatcctgggtgcccttcaacatcatcaaactcagagaggttggatttacactccttatgccgaagaaggttcttgggggccgtcacaatcagcggtttccggaaatccctatgtatctgacgacgcagcacatggaaatagtttgcaggggttgtcacattcacaacctgccagttacactcctgtatctgcttgcgaagagttgggtccatttcaggtatgacaaaaggattgtcacaacctcgtgc

SEQ ID NO: 5466 - DNA, 519 bp, Triticum aestivum
  Clone ID: PAT_TA_5466
ttgctttttttttctttttggatttcttttctctgtttgatgtttctcttggagaaactgtgcataatgttcatgtatgtttcatcctttccagatgtcaaatgtatacgtatcgtacatccgtcattgtcctgctttagtacaaaacttgacaaccgggtgtaggcgcgagagatgagacgatgcagctgccgcacgggggctcctcattcctcgggcgtccgcatcaggctctaggcccgatatctgcttcagcggtttcccagatcatttgtctccaggtcccgcagcccgccctgaccctgactttggggcggaggtcagggagcatggccaggaactgcagctcggccttggacagaaccttggcttcgtagacccagacgatgagccctttggcgtcagggtgcagcaggctgagcctgtagtccacctccggcgggaagtaccacctcgccaccggctgcctcccgaggctaggcgggcagacggggtggatcttggtgagggtggactcgg

SEQ ID NO: 5467 - DNA, 619 bp, Triticum aestivum
  Clone ID: PAT_TA_5467
gaattcggcacgagacccagtccaagcacagctagccagcgccgcgccaagagccacctcgtccccggccagcgcgcggcaatgtcttccaacggcaagcccaatccgcagccccccgccgccgccgcggccaccaacggcgcgggcgcgggcgggccgcccaagatgtaccagcgccccatctaccgcccgcagggtcccgccaagggccgccgcgggggccgctcctcctgccgcttcagctgctgctgctgcttcttctgggccgtgctcgtcgtgctcctcctggccctcgtcgccgccgtcgccggcggcggcttctacctcctctaccgcccccaccgcccggccttcaccctctccgtcgcgcgcgtcaacaagctcagcctctccagctctgccacggcgcccgcgctcaccgactccatcgacttcacgctcaccgccaagaaccccaacaagaagctcgtctacctgtacgacgacttcaccgtcaccgccgccacggccgccaacgccgtgccgctcggggaggcgactgtgccggggttctggcgcggggccaacaacatcaccgtcatcaaggccaccgtcaccgcggccgcgctgggggtcgacc

SEQ ID NO: 5468 - DNA, 824 bp, Triticum aestivum
  Clone ID: PAT_TA_5468
cgtgtggcctctcgcggaacttgcccttcgctctgccactatctgcaaatatgcagatttatcccaccacttcactatttcacagtttcacagcatccaattccaacagccaatcttcgtttacccgcccccacctaaatcctatgctttttatgtcacacaagaggaaacctaggaagaacaacaccagccgaccgaaacgaataaataggagggggcaaagtggctaccgccaagcttatcccaccagtccactattcacaatttcacagcatccaacagccaatcatcgtttacccgcccccatcctaaaatcctatgctttttatgtcacacaagaggaagaaacctatggaacaacaccagccagccagccgaagcgaataaataggagggggcaaagcggctaccgccaagcgatccctggaggagagcctccgaccccccgagcgtcgaccagcgagagcgccatggccagcatcatctgctcctcaaagctgtcggggacgttgcccgaactgatgctcgacacgtccgaagcagcagccgccagactggcggccccggcctctaccgtgacgtcggcgcagctggtgctggcctcggccgcctccgaccacccgtcgttgttggagtaatccgcgccgtctcttgcctgcggcgttctgccgttggatggttcctcgaccctggtggccgaggaactgctcccggctatgctcaggtcctctgtgaaggacctttgtgacctgctgagaatgtcgtgtcttgatgtttggcaggtggctgcgctcgaagggtctccaagcatgtgttgttgctcg

SEQ ID NO: 5469 - DNA, 1181 bp, Triticum aestivum
  unsure (1)..(1181): unsure at all n locations
  Clone ID: PAT_TA_5469
ccacgcgtccgcgggcgcccgggcccccccgcgcacctggctagctcgagggagagccgagatggcggtggggaacgagtggatcaacgggtacctggaggcgatcctcgacgccgggtcgaagctgcgggtgcaaggggtgtcgctgccgccgctggagccagcgccggcgctcgcgtcggaggagtccagcgccgcctacaaccccaccaggtacttcgtggaggaggtcgtccggagcttcgacgaccaggccctccacaagacatggacaaaggtggtggcgatgccggaacagccaggagcggaacaaccggctggagaacctgtgctggaggatctggaacgtcgcgaggcataagaagcaggtggagagggattactcgcaggaggtcgctcggcggaagcaagagcaagagctgggcagcttggaggccgccgaggacctctgccgagctctcggagggcgagaaggagaccgtccccaagccggacggcgccgctccacacctgtccgccgacgagcagcgaccccagcagcgcacccggctcgcgtggatcaactccgaggtgcggctcgtctctgacgacgaggacgagcagagcaaggacagaaacctctacatcgtcctcgtcagcatccatgggctcgtgcgtggagagaacatggagctcgggcgagactccgacaccggaggccaggtgaagtacgtggtggagctggcccgggcgctggcggcgacggcgggggtgcaccgcgtggacctcctgacgcgccagatctcctgccccgacgtcgactggacctacggcgagccggtggagatgctcgagcgcctgtcctcgggcgacgacgacggcgacgagtccgggggaggcggggcgtacataccttctgctgccccggcccgccctcgccttcgaatacgtcccccaggggggtgctcttggccgctctgcccctcctcccggtggaccggcgcgctctcgcggggttctcttacccggccccccccccctccgctactcagctccaaaccgccgccctcacaacncccccgccatgcggcccctgacgcccccggtttttgcaccctanaacngtggnnatatananacnctcctgnnnnntgatgtanntagctnngtntntcacanattntgnnggtgggggttncgcc

SEQ ID NO: 5470 - DNA, 1504 bp, Triticum aestivum
  Clone ID: PAT_TA_5470
gcacgcatatttttcctctcccagccgcttcgctcgccagccagccgctctgctctccccctctccctctccctctccctctcccccgcgttcgtcgtgctcgccgccagccccggacagcgccggcccagctcaccgggaggacagcaatggagcggagcctcccccccgtccccgtccccgcggcgcgcgtgtagcggctatccacgctccctccccccgcgcggctcctcccctgcaagagctgttttgatccgcgaccatggcgatggcggcctacagcaaccaagcgcaggcgatgatgagggactacctgctggccgacccgctcgtcccctacacctccgtgctcatcggcgttttcctctgcaagatggcttatgacctcacacggatactgagctcgttttacttcaagggctattcttctttgacgaaaatacagcgtgttgaatggaacaacaggggtatgtccagtgcacatgcgatctttatcgcagcagtatcagtatatcttgttgcatctacagatcttttctccgatcgacttaatgggcctattacattccgcagttcgatcatctccacctctgcattgggggtttcggagggtttcatcatcactgttcttgtcctgaacttctgtgtatatcattcccttagtggaatggattatgtactccatcatactctttctctggttgcaatagcttacacgatgttgtcaggggaggggcagttttacacgtacatgattcttatttcagaaacaaccacccctgaaatcaacatgagatggttccttgacaccgctggactgaagaagtcgagcgcctaccgtgatcaatgggattttgatatttgttgtatggctggcggctagggggttctcggtcctgtaggtattgtcgtacgcctatgcgtgggcggacgcgtgggtgaagatgcacgcatttggttattacctgacactgaccgtgccgtcggtgctctttgtcatgaacgcaatgtggtttacgaagattttgaaaggggtaatgaaaacactgtcgaaatggtcgtaatcggattaggctctgcggaccagaagtgcaacttaactgggtgttcctgccgtgctgcactgcgtgtgacctgaatatgtaaagttatgaatatatgaattaggctttgcggaccggaagtacaacgccaacttggttggtgttcctgcagtgctgcttgagaccttgatgtgcaaagttatgaacatatcggcgtaactagggaaagtgaatatgtaaaatactagcaaacaagttagattaggctaaatcgcgctattttccggtgagctgggatttcctggcatgtactgaagttcctattccaatcctgcaatctgtgtataccaggcctggagataattccattgcacctcttttcatactaaatttgataatctaatttgagatattatttataaaaaaaaaaaaaagaaaaaaaaaaaaaaaaaaggccccta

SEQ ID NO: 5471 - DNA, 577 bp, Triticum aestivum
  Clone ID: PAT_TA_5471
tttaaatctggacttgtacccttaaaatttaattctcaaataactgggttcacagtggaaatggtgataaacaattcccacgagtttcaataccaagataagcatcttctacatgctgagttcatccccaccaagtaacaagcatagtaatctattcgtaattaaacaagatctatcctgatgaactaaccagcaaaaatttccatgtactcagtactttcccagtattttctcatgtttcatcgataagtccatcgagggttgttgatatccaggagacggccaaaagttgctaatgcatcataaaatttacggatcctgagataaccccttattgcagaaacatcggattctctgaagttggccttctctgcaattagttcaatagcacttatgaggtaatcatccatacccaggttcagtagaccatcagctagcatgcggaatgatgaaaactctggtatgaaacccttatctgccatctctaccaagaaatcaaaagcttctttaatagggccaccaccacgacagagaccacggaaaacaattttatatgtcaaagcatcaggaggctcac

SEQ ID NO: 5472 - DNA, 1050 bp, Triticum aestivum
  unsure (1)..(1050): unsure at all n locations
  Clone ID: PAT_TA_5472
gtcgagctccacctccacgcatgcggcgcgagaaacagtagcgatatccacagcaactcatcgcggcacaccaccagtgcacgaacaaatgcaaacaccaaccatgccgacgcccatggccacgcggccgacgtcgacaatggcggcgaagctgcctgcgccgtcgacaccgcggcaatgctacctcctgccaggccgccgggcagggctcgcgcgcggcgccccctcggcgtcgtcgaagaagcggaacccgtggctcgacccgttcgacgacgggccggacgaggagttcgactacacgggcgtgtactcgggcgggaagcaggaggaggacccgcggccgccggaggacgcggagaacccgtacgggttcctccggttccccatggggtacatgccggagctggacagcctggcgtccaaggtgcgcggcgacgtgcgccgcgtctgctgcgtcgtttccggcggggtctatgagaacgtgctcttcttccccgtggtgcagatgctcaaggacaggtaccccggtgtgctcgtcgacgtggtggcgtcggcgcgcgggaagcaggtctacgagatgtgcaagaacgtgcggtacgccaacgtgtacgaccccgacgatgagtggccggagcccgccgagtacacccaccagctcggcgtcatgaaaaataggtactacgacatggtcctgtcgaccaagctggcagggacggggcacgcgctgttcctcttcatgtcgtcggcgcgcgagaagggcgctacgtctaccccaccgtcaacggcgccggcgcgggactgttcctcaccgagatttcaagccggcgacaccaactcgccgacggtggctacaacatgtaccaaggacatgctgganngctgggccggccggccaaaggcgtgccgcancaaccgacgccgccgctcaaggtgtcatctccaagaanctganggcggtggtggaggaaagtncaaccgcccggcgtngaaaagggcagtacgtctcatcacggatanatcggactcntccaacatnaatcangganacag

SEQ ID NO: 5473 - DNA, 650 bp, Triticum aestivum
  Clone ID: PAT_TA_5473
gaattcggcacgaggagtggtccaactgcggcggcgacggtgaggtgcgcacacacaagaagacacggcggcgcgaggcacgccggacatggcgacgcggtagcttcgctcgccggagcagcgtgcacaaggacttggtccggcgcgctcctccgtcgagcgtagctccggagacgcgaccacgctagccgaggcgtttacgggcatttcgccggcggctgccggcgcacgctttgacggcgacggcgaggaacaaggcacgaagtccagcagcggttgcatcttctttccgcgccgtaacgagagacagcggcgttccggccatggcgtacacgcacggcggtggccgtggccgtgcggaccctaaggccggcatgctcataaacgcacagcggagcccatgatctcaagtggcgaggatgagcagcaccagtggcgccaaggtgatgtagtcgtggagaggcagcagctcacccaggagcttcgcggtggcagcaggaaaccgccggcacagccttgcggcggctggcgatggaaacggccttcccattgcataacacaccccttgatcggtaggtttgagggaattaaggggctagatatcatgtacgtgaactcaggtgccataagtatccatgccccgcctttta

SEQ ID NO: 5474 - DNA, 873 bp, Triticum aestivum
  Clone ID: PAT_TA_5474
cccacgcgtccgccggcgcccctctcctccatttattaatcccgggttccacgagagagcagagagagtggagcggtggactgacccgggggacgaggctcgactccttttctctttctcgcgccgctgtgccgcctgcttcttgcctgcccgcctttccaccaccccgtccctctccttcgtgctcctctcctctcatcctaggacgacgcgctgcagacgccgaggctagcagccagaggccgggcggggcaacgggcgccggccatgccgagatccagggggtccgagctgccgcagcgggcgtcgccgcgcgcgccgctgcacctcagaccacggcctcctccgaggccaatggcgcgcaccaccgcctcgttgtcgaccggagcagccccaagatcgccgaccgccactcgccgcgcagcccgctgcccgagaagaagcgcgcggggactcgggtggccgagctggagacgaaactggggaaggtgcaggactagctcaagaagctgcgggagcagctcgtgtccgcggaggccgccaagaaggacgcgcaggtcgcgctcgaggaagccaagaagcacgtcggcaccaaggggagccccaagccggcggcgtctcctccctcccccgctcttctagcggtcgaagacgagaagaaaactgaggaggtgaaggttgttgaagaaccggcggccgacgaggagcaggagagcagcataaactccccggcgaccgatgtgtttgaggtcgttcggaccgagtcgggcgacaaggagaaccagagcgcgctcgtcgccgatgagagcgaagaggtgagttgtggagacaatgcggcactggccgaggaggatgtggaagtggaggagacca

SEQ ID NO: 5475 - DNA, 1266 bp, Triticum aestivum
  Clone ID: PAT_TA_5475
aaaaaaaagggccatggagattaaagatagaaatgaccgcagaggcgccgagttctgcaaatgaacataacactggaggttcctagggttgcttactctacaaaacctctacataagcttctaggaaaagagaacgggagtgctgcattctctccggtctacaaagagaaaatataaaagaaaaaggagaaaaagaagtgggagtctcacatcaatcaatcctatccccacgaagtgctacaatagtgcttctgtgactggaaacactcgcacaaaagagttccccgctgattggacagtatgcagcgtggctcgctgcctgtgttacacgctgattaaagcgtccttgtacctgtcaacttttgtggtaaaatagtatccctgttcacttctgctgcaccactcatgaatcacgctcgcaaaataaatttctgcctccttcatcagaaatgatttactagctcaccaatcaccacatagaaggcacatatacttgctccttcaagttctgggtagcactttcagtggggaaccctcgcacggcaccaatagtccactgtgaaatgataccagcagcaacagcaaatcttagctccctttccaatgtatcctggtcctcatacatctcaggacaagttgtcaacttcctaatagcagcagcaacaatagcatcaccagaacccgtccggtcagttgtggttggagttatgagtgcatcctccgttccaaccacacagccatgaaacttgggtgtgtagtagtggatccgaagtgttccataggtcaccagcaagagttttattccgtcatgccaaatcggagcaatttcttcaggggtatagtggtagtactgtggccagttccttgttagatggaacccatccaaataatactgaggcggggtggctcgcttatattcgtaatacttgtgatcaaggaggaactccaactcatcccttgacacctctatgatatcagcctccttccatgccctatttatgaactcttttgtctcatcccttgacctccacaaaggcaatggcaaattgaggtcaaagaatattttgcttccaaatttcttggacagcgcaatggctctgaagagtgtgtcgtgcattgacggcgtcagcagcacttctgaattgaaatgcaacattctggcctctttcaacacatctgcattgatctcgtccttctggagcgagtcctcggcagagctcttcaccgtctcggccaccagacttgtcccgccattgccgctcgtgc

SEQ ID NO: 5476 - DNA, 1481 bp, Triticum aestivum
  unsure (1)..(1481): unsure at all n locations
  Clone ID: PAT_TA_5476
ggtaaaccnccagggtttttcccnagttcangaacggttntaaaacgnacggccccagttgagcggggngtaataaggacnccactataggggngaattgggttacngggcccccccctcggagttttttttttttttttttcaaccaagggaccatttcttataactagagctgacaacggggccatgagctgacacgttcaggtcacatgttccgcaataattaagttccggaaagaacatctccccgtcgttaattaatgtacacaaagaacagcagtgcaagacgtggcagacccaacggatatacacggaccaccactctatttctggggcgcatttacacgtactaggtatgaatcaagctaggtaacaaaagaaaaacagtgtttttgaaattattatttcacaggcgcgcaaaaattgatcctcaccccaacattctgccagcagaatgcaggtagtatacactactaggatgtgtgtttgatgcttcagccgcagttggcgagccgcacgatgaggtcgcggaagtacttggcgacggcggccttgtgccaccggagccgcttccacttgccgccgagcagcaccgggtgcagccccaggatgtgctccggcatgaagtcgtgcctcgtcaggatccccaccaccggcgacctatcgcaggccttgggcacgacgaggaggtggcggaggccgacctcgcggaagaggatgagcgccttggccagcgacatggtctccacgacggtgtatggcgacgcgttggtgaacgggtgcaggtccacgtacatccccatctcctccggcgacagctccacgccgtccaccgtgtcctgcttgccggagccgcgcttgtcgaagtcctgcgcctcgaacctcgccgcgatgctgtactccttggggtaccgctcctgcgccggcaggaactcccgcttccggaggagcacgaggaggtgcgccctgagcacgaggccgtagagcaccggcgcggtggcgaagggcggctcgtcgatgaccgggaacgcgtggtggcccgtggtgcggaggacgtgcatgatgtggcccaccttctccacgccgttgaagctccgcagcgggccgaccaccacgtcgcccacgctgagctgccgcatgtagggctcggcgtggccgtcgaggtacggcagccccttgaggcgcacgatgaggtcgtagatgctggcgttgaaggagtcggcgacggtcttggagatgagcagcacgagcatcaccagcggcaggaggagcaggttgttggtgagctccacgatgatgacgcacacggacaccgtcatgcggagcgtgccgccgaggaaggacgccgagccgaggatggccaccaggccgtggtcgaggccggagtgcctgcccagcagcatggccaccaggcggccgtaggtggcgccggtgaggatgatggggacgaagagccccgacggcgccaccacgccgtagct

SEQ ID NO: 5477 - DNA, 892 bp, Triticum aestivum
  Clone ID: PAT_TA_5477
cccccgcgtgttttctggggtttgtctgcacacccagtcttggccttcctccctcctccagcacctggccttagagttcttttcatatacttctcttgtattaattgcctttcgtgttcttgttaccaacttttacacgcagcagaattacagcagcacaagtgtcccatgcattgtatatccggtgtgcactctcctgaacatactcccaacgtcccaaaattcttgtcttagatgttagctgtctacatacggatgtatctattcgtatagctgtagacaaatctaagacacgaattttgggacggagggagtacctaacaatgctcttatcatcttttgatctccccttgagatgtaaatgccactacttttagatgatggcgttggtaggctgaaggttgtttgtttgggagcaaatgctttagtatccccgcttctgctaatttcaagcccacatattctacagagatcttccagctccaactcctcaatcatcaggatatctgacaaatgtgtcaaaggatggtgctgaagtttgtagccgctatggttgaggtacattaatgctctagcacggacctcattgaggaaaggttctaccaaacacaactgaagctcggctgcttcatctgctatcatgcaaaagaaacgcttgaaattcccaaggtggtagcatctcaatatagttctagcaaatatcatttcctttgatcgtactattgaagctggtaattggctataccaaaaagagagtgagtttgccattttgggtatcttgcaacccaaatgtagaagcacaaagagggaataatactcagcctctttattgctttcggaattgattttatgaattgtatgatacatatcaaacagagaaagaaggcatttc

SEQ ID NO: 5478 - DNA, 1247 bp, Triticum aestivum
  unsure (1)..(1247): unsure at all n locations
  Clone ID: PAT_TA_5478
gcgccgctgctgcgccgcttcttctgctgcgccgccaaatctgcctcggccacatccgccgccccccgcgccaagaagaagaacatcggcttcttgggatctccccaggtggctgcctcggtcctggacacgttgttggccgcgtccagctcccccgattccgcattccaggtcgctgccgtcgtgacgcagccgccggccgccaagaacagggggaggaagctgttgccgtcggccgtcgcgcagctcgcgctcgagcgtgggttccctggcgacctcatcttcacccccgagcgcgctggggaggagtcctttctgtctgacttgaagggggtgagaccagaactttgcgtcactgctgcttacgggaacattttgccacagaggtttcttgatattccaccgtgcggtacaattaatatacacccaagtttgttgcctctatatcgcggtgcagctcctgtgcagagggcattgcaggatggtgttgcagaaacaggtgtttcccttgcatatactgtccgtgccttggatgcaggtccagtgattgcttgcgaaaggttttctgtcgatgaattcatcaaggcaccagagctgcttgctatactattcaatatagatgaattcagacgagtcctggctgacatttgacgaagaggcggttctgcttcgcaacaggctgcgccccttggcggctccgccgcgaccccgcccccaattgcaacttttgaaccaaaatggcgaacccgatgttntagacatcaaggttatcagtacaaatgtttccacgtcatgtgacaaagttggagacgaaaacgaaatactattctcagggaactcgctgctcgttccttgcagtgggtcaacttggcttgaggtcttggagcttcagctacctggaaagaaggtaaccncggctcgggacttctggaatggtttgcgtggtcagaagctgttaaaatcaacatagagggaaatctgcattcattttgcagcacatgtgcaaaggatgcaaatgccaagacggccatatgccgtgctcagtttagatgcatcntgcagggttaaagggctgttgacatttatccttagagaaatctgcaggggggcaaaaagaaggtcttaatttttgtaaggaaaattatttagattttgngccttcnctttttttttgacaaatcaataattttccagattgtcatgcgtgtctgtattatttccagttctagtaaaaggncaatgttacc

SEQ ID NO: 5479 - DNA, 1446 bp, Triticum aestivum
  Clone ID: PAT_TA_5479
tcgttccaatttgaggaacgtgcgcctttgtttacccgcgggaggggttttgctggccttggttgtccccgcgggtcctgtcaggacggcctgaggcggggtccccgatcagatcagctcgccgtctgggccccccccttagcaaatgaacaacttggattgcaaatgcaaaacagttcagggtttagagcttcgggtatccgatgcaggtatccatgatccatacggggtactgcaatacctccaggcaaaaattgctacaataagtctcatgtaagccattcctgcattaagaagtgaggactaggtatttgactaacacaactccagcctgctgtaatgagaaaccaaacgaatatggcagaaccaaaaacattaatttcctaataactaaaccagaaattaccagccaaatttgcaccaaaatactttccaaacaccaccaccaagcatttcttttctggaaggaacaccgccaaaagtatcattcttcctgccatctccctccgagagcgctgtcattcttcaccttcgccactccaattcgggagaggactgcggcctattgtatggctgcgactcctcgggcttgatagaatttgtaaacgtgctccagcccatgatgtgcggtatgatgtaattgaaagtcgatacaatgaccgcatattctcctttggttatagggatgtaaatgttctcatcaacattcaaaagacggttttgaacactgaggttgaaaaagcgaccgttgccatctggtgttggctcaacctttagaaccttgcgcactttaccttcatcgctcctccccttgaaagggtcatgaaagaactcgcacgaatctgttagaccaagagtaagcaaggttcccatctcccagacagataatgagaacacctgcttgcgagtccaatcatactgccgaggccccacggcgggggcgaactggagcagcacgaacccctccttggccaccttgtacgccccagattcgagcggcacgaactgcggcggcctggggtcgaaggccagcgcggccttgcccttgtagatgctgtagctggcgaacaccctcccggcctggcccccaggaaccggcggatccctctccagcggcggctgcccgtaggcgtcgcgctgcgacggcggggcccgggggtcgaagtagtcggagtggcgcgcgggcacgacggagcaggcggaggagggcggcgccctggtggagaggggctgggccaaggcgagggggtgggagtgggcggccctggcgtggcgcgggaggagggagaggggctgcggcgaggggagcgagacggagagcggcggcggcatttcgccgaacgggttggggacgggcgcgtgggtgggtgtggacagccgaaccgagagggggctgtttcgtccgggaggggtttatcctgtggtgtgcggacgcgtgggtcgacc

SEQ ID NO: 5480 - DNA, 911 bp, Triticum aestivum
  Clone ID: PAT_TA_5480
agcctcaaatttgggaaatagtgtatatcccaagttctcaagtggttctcttattcccgagcatgttctttcgccttacaagaatgttggtagtgattcacgaaggaatgactttcatcagaaaaatccgagcagcagaaaccggagtggccctttgtttttccgtcaaatgaaggacacacgcccacatctgtctgttgcacctgatgaggcgtcggaaggaaatgttgtccaacgaagggggcgatttcaggtcacatcagataatcctggtcaaaaggtagcttcatcagcaagcagcaacagcaggcctaatttaccaagtggagtaacacggccagcttccaattcatccacaattcttccgacactacaattcttgatgcagcaaaattctatgcaaaaggaagtgctaagtagattgatttcttcaattgaggaaacatctgatgcttccgatgcaagtacagttggttcgtctcagtcatctggatcgcttgccagagagaagggattggagtcgtatgttgtccaactacagcgaagtgtcacagaactcgctgaggaagtgcagagattgaagctgagaaataatcagcttgagcagcagatcaacgggttgtcgaaaaaagacgaaaggttgcgaagagagggtagtaccaagcaatgatatattatattcccccctaagtccccgttgtataattcagctccccaattttgaacctggttagtgaaattaattgtattatgtttcgaaatcaggtagttgtatcaattgtaattgtaagtattttagcgagttcacattatagtataatctttgatttgtacagcatgctttgtgttatcggtgaggattagtttccgtcaactacaatgttttgatagcaaaaaaaaaaaaaaaaaaa

SEQ ID NO: 5481 - DNA, 624 bp, Triticum aestivum
  Clone ID: PAT_TA_5481
gaattcggcacgaggcctcaagtctatagaggtcttttttgaacttcttattcacttcacaggcataacaagtgttcatacagctcaacacacgcactggtactcacacgcacattagcaagatcacagaactagtagtattacgtaaggtgcagttgatgccactgctggaggatacagaactgaacatctctgcacgctacgggcatggacacatacgggtgcatcatccatcatcatagtagtcaaggccatggcacgcgcatccgtcactcgtccttgggaatgcgcgcggcgagcgcaacgccgttgacgtattcgtgcgccctgtggaacggcaggccgggcagcgccaccgccagcacgcgcatcagcagcagctcccacccttcccggaagtagccgcccctccggtatcccaggtacgcgctccgcgccagctcccgcgccgcgttcacccggctcgccacgaaccccgccgccgacgacgaagggctcgccgtctcgcccggtatctccgtgaacaccttgaggttgtaggaaacgtcgaagtggaggcagagcccgaagtgcaggaaatgggcgggggatccgacgccggaaaccgcggcagcgggtcgccgg

SEQ ID NO: 5482 - DNA, 624 bp, Triticum aestivum
  Clone ID: PAT_TA_5482
ccacgcgtccgcccacgcgtccgcccacgcgtccgggcgcaagcagacgaaccattccggattgctcgccgccgccgctgcagaccgctagtccaaccctggcgcgctcgcccgcaatgccggccaccgactcctccgcctcgccggcgcaccaccaccaccaccacacctccttcggccgccacatcctctcgctccgccaccgcgaccacggccagatccactccgccccgcccacgcccgaccaccccaacgccgccaacgccaacccccacccctcccccgccgaccgcgaagtcgacgcctttcagcgccacgccgccgagctgcttctcgacctgctcccctgctcccccgacgccgcccccgccgacgccaagaatgccccgccggagatcctgtcgatagcgtggacccagcacctgctcgactccttcctcatctgcctcgaggagttccgctccgcgctcctcggcggcggccccggggccctcgcgcgccccccgctcgaccgcctcgtcgccgacttcttcgaccgcgccgtcaaggcgctcgacctctgcaacgcgctccgcgacggcctcgacctgctccgccagtggcgcaagcacctcgccatcgccg

SEQ ID NO: 5483 - DNA, 1479 bp, Triticum aestivum
  Clone ID: PAT_TA_5483
gaactcgcccccgcccgctctcccccctcgccgccgcctcccccccaatctctctcatccccataactctcgcacgcacgcgcacgcgtctggctccccctcgccaactcccaatcccatcccatcgcgcaggcaggaaggcaggccgccgaccgccgccgcgcgcgagatcggacgcctccaccacgaccccccggctccgcagccggaggcggcgaccggtgcgtgtttggcaggtaggctcgccggggcgatatgagcgggcacgactccaagtacttctccaccaccaaaaagggggagatccccgagctcaaggaggagctcaactcccagtacaaggacaagagaaaagatgctgtcaagaaagtgattgcagcgatgaccgttggaaaagatgtctcatcattgtttacagatgtcgtgaactgtatgcagactgagaacttggagctgaaaaaactagtatatttatatctcatcaactatgctaaaagtcaaccagatctagcgatacttgccgtgaacacatttgttaaggattcacaagatccaaatccactgattcgtgctttggctgtgaggacaatgggttgcatccgtgtagacaaaatcacagagtatctgtgcgaccctcttccaagaggcctcaaggaccatgatccatatgtgcggaatacagcagctatttgtgttgctaagctttatgatataaatgctgagctagtggaggacagaggatttctagaggccctcaaagacttaatttctgacaataatcctatggtggttgcaaatgctgttgctgctctggcagagattcaagacagtagtgctcgtccgatctttgagatcaccagccatacattgacaaagcttctgactgctctgaatgaatgcacagagtggggacaagttttcattcttgattctctgtcaaggtacaaagcaacagactgcaaaggtgacgcagaaaaataataagtggaacgaagttaccaccccggccccttcacgctgcctgtccggtgcttcttgctgccgtctcgggctgccttcgacttaggcccctccttccaagctcggtggttctccggactctccgcccggactgggcgcccccgctggctcctcccctggccgcagtgcccgcccccccctccggggctttctgcgatcccggtctgggtgtgcaggcccggccgactttcctcgcacatggtatggccgtttgaaggaaacctactcaaattcctagagtttaggttccaataaaaaatgggccccaacccaagtaaccttttggcaacaaattgaaaaggtttaaatagggcttcttttccttctcttgccaattggttaactaaatttgaaccccccaaactaatttagcttggtcccaaagagaaatttggtaaaaatagggtaatcaaatgaggttctaattacggttaaacatggccttttttcagggacaag

SEQ ID NO: 5484 - DNA, 1432 bp, Triticum aestivum
  Clone ID: PAT_TA_5484
ggatcgcacgaactggtgacgatctcccgcctgctgcaccccagcgcacggagccgcttccacccctccattccgcgacatcgggacccgccttcgctacatcctcggccgcgacgccgcccccgcaagcctcctcaccgccgccctcccatccgcactgtggcccccccacgcccccccacctgcctacctctcccgcttccatgacctcaccgccccctgtccccgcaccgaagaacaggccacatgatcaagggcaatgacacccccccccccccgcccgcccccggtgctcacctttcccatacgatgcccggctgcccgcggcgccgctgcgatcgcacgcgatggtcctctgatcaggcatggcccagtcggccgccatgcccacgtggtcttccgcgacggcgcctgctatcgccccctcctcgtgccgcttctcgccggcggggctgctgccgtcctccccccgcccccgctgccccacccccaccgtatccgcccggggaggcgccccctacccaccgagcccttcctgcccgtcgggccgccccgcgcccgcataccgttggtgaatctgtggaaggaccggcaaaaagtgtatgcggaggtgtgcatcctcagatctggccgatggtgcgtccctgacatggagtctgtgacagggccccctgttgccccggtctgccttggaatgctgccacccgtccagcgctcagtcttcatggtgaccaactctgggcacaccgtgggtctagatttggccgcggggagccttttcaccctagagctaccagttggagtgcggagcaactatatgctctcatgtgcagaggattcagggatctatcttgtcagcgcagacgggtttcagctcagtgtgtggctccatcggatgtcgggcgatgacaatggtgcaggctggctgctgctggacacattttgtgtccgtgagggtcaggcatgcacgccccgtgcagaggacagttgggttcctcctcgcaatgtttgtcttgatgttgttgcggtcggggacaatgccgactttgtgttcttggatcatccagcaagtggcaccctcttttatgttcatctgaggagcagggtggttgagaaggtctgccagaggggggcagatgaatgtgggtataaacgtgcggctgctggtcacgtacgtgtatctcctgttatgatgatctggccgcctatcttcccagcgcaggcacgtgggtcatgaggaatgacccccctgtggttgatcgttgtactatctaaactgagtatgagctctgtaatatagaggtatgtactttgagttatttctcttcctagaccagcagatactgcagtcatgtaagtcgggcttgaccacccgatgtgcttttgcgcttttgtgactgtggtttctcagcacggcgagtgcccctggttt

SEQ ID NO: 5485 - DNA, 372 bp, Triticum aestivum
  Clone ID: PAT_TA_5485
accttatcgccaagaaagacaaggtttgagccactgcctgaaactcacatttcttatgtccagccgttagatccaaaatgatatacatggaatattctaatggctctcaaaagacaaatatgcccatgaatttggctttcaaaatttatcttttcaagggcacgtctgtcttttagctttaagcacatgctgagacagttaaagcgaactttggtcacaaggtcaaccaaaaactatctaggtcagatggtttttgttaagaggagcaacttgttttatattgcagagcccaaggcgtaaatataaaatacaatggacttggagtacaaggaaggaaatttaggctaattgacacctagaccgatactagtt

SEQ ID NO: 5486 - DNA, 745 bp, Triticum aestivum
  Clone ID: PAT_TA_5486
aacgagggggggcaccatcaatacatatgcgcccgagccacattacgggacgccctcaggaaatagtggatagtgcacaaccatgaccaattggcggcataatttctatatctgaattgatcctgttggccacatttgtagcaggaagagtgtccattcataaagcagaccaggccttccttctccttttttcggaatacctccttctcctttgatatcctttctttgatgtcttcaatgtttgtcctgatgttgatggggatccaatttggttgtgtagctccttgtattttttctctcgcccagcatcaatgtagacgacaggtggcgatggtctgagtcttcgcttgcctgccctgggtgcccatggcaaagaagatgcccgtgggattgcccgagatgctctggtactgccagaggccaccgttggagtcgaagaaggcctttatctgcgccgccatcatgccgaaccgcatcaagaagcagagcaggatgtcagcttgctcaccgtgatgacggggtggtcaactttgtttctttgttgctgaaagtatttgccgaggtcttcccgtgtagattttttattttccaacaacctgtagtgatcaaaaattattttcagatctccaacatcatccttctttagtccattcttacccataatccgctggtgaactgtacgcaaagcaagaaatcgaccagcaacccagcacatgtcggtgacacgttctggcccggcgttcga

SEQ ID NO: 5487 - DNA, 653 bp, Triticum aestivum
  unsure (1)..(653): unsure at all n locations
  Clone ID: PAT_TA_5487
ctccatgctccgctccgtggtgcccaagatcagcaagatggacaggacgtcgatcctgggggacaccatcgactacatgaaggagctgctggagaggatccggcggctgcaggaggagatggaggagccgcatgccggtccggcggcggcgccgctgctgagcgtgttccgggagctcaaccccaacgagatgctcgccaggaacacccccaagttcgaggtggagcgcaaggaggaggacacccgggtggagatctactgcgcggccaagccggggctgctgctgtcgacggtgagcacgctcgacacgctgggcctcgacatccagcagtgcgtcgtcagctgcttcaacgacttcgccatgcacgcctcctgctccgagatgcagagggagatgatcagcgcggacgccatcaagcaggagctgttcaagaacgccggctacggcggcggctgcttgtgggggggcacctcctcctgcaccgccaggggtccaggaccgccggcaccagcagctgcagccgcaggcggcggtgggagcagcagtaggggcgtcgcggccgcgcctgcggcgggaaaagnaagganggcaaagatttgggaggccttttgcaatcaatctccccatcataaccacttcgatntatccatgg

SEQ ID NO: 5488 - DNA, 666 bp, Triticum aestivum
  Clone ID: PAT_TA_5488
cacccagctgctcactcatcgagacacctgtgctgtgcctgtgctcacattgtgcacatgtgtacaatcgtcaacaaatccaaagcatcctcccagtcgccgaatccaaaacatatttagcgctcgcctctgtttcttctccagctcagagatccaaagcatcctccttcttctggggtaaattggaagatgtctaccaagttgatagcgctctacattacagtttgctctgttctgttcatcatatccaagatgctcatctccttcctctgctacaagaaggggggctcgcaagaagaggatcatcgagaccagcctgacaggtggcaagctggtgatcttccggtcggcggcgatgcagtcgctgagccccaaggcgttcatgaggatgatcatggggctgtcgagcaaggacatcatcggctccggtgggtacgggacggtgtacctgctgcggctggacgagaagtcggcgttcgccatcaagaagctgagcagggggagcgcggagatggaccgcgggttcgagcgggagctggacaccatgggcgacatcaagcacaggaacatcgtccctctctgcggctactacgcggcgcctcacttcaacctgctcatctacgagctcatgcccaacggcagcctggacaccatcctccacggcaa

SEQ ID NO: 5489 - DNA, 876 bp, Triticum aestivum
  Clone ID: PAT_TA_5489
gactgctttgcttaatttttatagcgaccagtctggagatatcttatactttgcgaacaattcaagttctctatgattttaggacttttagactgctttacacaatttttaggtcgttcagactgctgggattctatacacatcgctccaacaagattgtgtcttatcatcctcgacataatgaaatttatacatgtaaaactctactcactgatctgtgtcttagagcacttaaaatctatgatatgtttctggggaaatctcttttcttaaaagataaggtcactttgttttgactgtcccctgagaccctgcaatttccacaatatgttggacaaataatcttgtaaatacttctctaaggtgaggatgtcctttgcatccaccccaagaagctggtaggtctcgttctccggtgcctccaccccaagaagctggtatgtctcattcattggagccgggctatcagcctcgccggtgggcccctcggagaaccccggcctatcacccgcatcgctcgtccccgcgacgggccctgttgtttcacgggcatctcgcccggctgctcccgcgccagtagttacatccgcatctggcccccccgctcgcgcacctgctgtagtaacctcctgagtgctccccgccccggggcccgcagccgttaggagttttttgctggccttctcattgcgcaaagcaacaaatgtcaggcgagcgacgtcctgggtatccatgtatgcaatccgagtcggagcatcagttccccaaactgacttctcttctagtataggcaccgcatattgcccaattaggccctgcatgaaaccgcacaatcggatgatggtgtaatccagacctgtgtcctgaatctcgtgc

SEQ ID NO: 5490 - DNA, 619 bp, Triticum aestivum
  Clone ID: PAT_TA_5490
gctgaggaccaatctggggtaatgataagcaagaaaagtgaaaaataagaaggccaatatacataatcattccctcctcaatactctctctctcgcgcgctcgctcgctcgccctttatcaaaacctcgccaccgaaaaagaagatggcgtggagatggatcaaacaagtcaatagcaacagcctagagttatcaaaacccagaaccaatccatggagcgaccacactagacctggccgcccccacggccatcgccgtcgccatcgtgctcgtgcgcctcctcctccacgtcccccactctgatgagcggggccctctccgagacgcactgctcctttccttcctccgccgtacaaacagcaccgctgccgctgaagctgctgctgctgctctcgctgtctccatccaccgcattcgtgtcgccattgctgctgccgatgctgctagagctggtcatggacatgagcccttcctccagcttctgtagcgcgtcgtcgttgccgctctcgctgatcggcacgtagccgtttttgttcttgtttccaccggcattgccagtagttaccgctgctttggtgctagcggcagcactgtcgcttgatgtgttggtgttgcattc

SEQ ID NO: 5491 - DNA, 1953 bp, Triticum aestivum
  unsure (1)..(1953): unsure at all n locations
  Clone ID: PAT_TA_5491
ttagaattcggcacgagccccgccgtctttcttggtcccacacgcagcacccattccaacacacacacgcaacaattgcagcttgtaccagcacacagccaaggcaagattctgctaggtttggttcttggtttcttgcgggggcggcggcaatggcgatcggcaccgacgacctggaggaggcgccgccgctcctgctcctcgacgacgacgaggccgcctacccgcgcccccgccgcgtcgcgctcttcgtcgagccgtcgccattcgcctacatctctgggtacaagaatcggttccagaacttcatcaagcatctgcgcgaaatgggcgacgaggtcattgttgtgaccaaccatgagggggcgccacgggggttccacggtgctaaggttattggttcatggagctttccatgtccactctatggaaaggttcctctctcactggcactcagccctaggatcatctcagaggttgcaaagttcaagcctgacatcattcatgcgtcctcacctggaatcatggtttttggagcccttgcgattgctaaactgctcagtgtccccctggtgatgtcctaccacacccatgtcccagtatacattccaagatatacatttagctggctcgtcgaaccaatgtggcaagtcatccggttcctccacagagctgctgacctaactttggtaccatctgttgctatcatcaaggattttgaaactgcccatgtcatttcagctaaccggatacgcctttggaacaaaggcgtcgattctgccagcttccatcccaggttccgcagccatgagatgcgcgtgaggctaagtgacagtgagccagataaaccattgataattcacgtcgggcgctttgggcgcgagaagaatttggactttctgaaaatggtaatggatcggttgcctggagtaagaattgcattcgtcggagatggaccgtataggactgagttggagaagatgttcgagggaatgccggcggtgttcaccgggatgatgcaaggggaggagctctcgcaggcgtacgcgagcggcgacgtcttcgtgatgccctcggagtcggagacgctcggccaagtagtcctggagtccatgtcgtccggggtgcccgtggtggcggtccgcgccggcgggatccccgacataatcccgggggacgcggaggggaggaccagcttcctcttcgccccgggggacctcgacgactgcgtcggcaagatcaggctgctgctgacggacgacgagttcaggggcgaaatggggaggaccgccagggcggaaatggagaagtgtgactggagggccgcctccaagacgatccgcaacgagttctacagctcggcaatcgactactggcggaagaagcaggcggagatggttcagccgctgcaatggctggcgcaaatgttcatgccggcgccgaaccgggtcattggcggcggcatcaagcagtagtggtgcatcttagccatgatctaggcaggtggggggctggaagatggatggacaattccatgcattccttgtaaattcttggtctatagtgcagtgtcaataggtgagaggatagtttctgttttttatctgtgtgaaattgggatactgtgattggttgtactgtgtaatagtggaaatgtgctgagctttctggtggtgcacaagatccatcagtttgtggaagcaagcagaatccacatcagccatgtaatgcccacatatgcactccctccattcactattgtaagatgttctaccttccctcatcaaatgttatanacggggggccngtaccaattcgcctanntgatcntataccncgctcacggcctcgtttaaactcntgacnggaaacctgcgttccaattatccctgaaaaaccccttccaacgggtaaacaaagcccacntncctccaaatnccaccgaaggaatgn

SEQ ID NO: 5492 - DNA, 459 bp, Triticum aestivum
  Clone ID: PAT_TA_5492
atgtgattaagaacgccagggaagaaagtgaggatctcgccaagaatgatgggctcaggtaatgttcaatctgcttgcaatcagcactatctaagtagccccgtcccatgctaagaatccaactttcaaggggcgattccaccagcgcacgcaacaaaatgagattaacaaggaagaagcaaaccatcttcagcaatgcagctctctgctcccccgacactgtcagatggaactcaaacttggagaagtacgagagtactgatgggatgataatatacatgctcacgaagatgaggacattgggtagaaactgaaagattattgtccagaaccagcttgagccttgaagccaaacaatccatgatttggcattatccatagcctccacattgatgatccgtgctgcgttttgcattccactgagtattgacaagggcgaactggaaaacaggagcatta

SEQ ID NO: 5493 - DNA, 777 bp, Triticum aestivum
  unsure (1)..(777): unsure at all n locations
  Clone ID: PAT_TA_5493
gggccccggannttgnatttgtttcccnggcccccccattggcgggccggngggaaatttggnaggatggcgtagcgtggtcgcggccgaggtactgatgggatgataatatacatgctcacgaagatgaggacattgggtagaaactgaaagattattgtccagaaccagcttgagccttgaagccaaacaatccatgatttggcattatccatagcctccacattgatgatccgtgctgcgttttgcattccactgagtattgacaagggcgaactgaagaacaggagcattacaatgaggcaggtgttgaccgcaatccgccgcaaggctagcgaggtcttgttcatcccaagatgattccagtagatatctgatgctggtggcgccctctccactctccatcggctcctctcaagctggagctccatcactgggaagaacctgccaatgggtgtcttcttcctttccattcggaaatccctcacagccttgtttgccgtgtacctgcccgggcggccgctcgaagntatgccagcaccaaggtgcanggcctttccttgtaatccgacagcctgctcccaatcacgagtttccttgtctgcagcttccttagcctctcatcatcagtaaacccgaacctctgcgcggccattgcccacagctntttgcatctcctgacgagncagtgggcttccaactgccatnattcccccctgcacaaactcgtcaaacaggctnanngcgtccatcttggcctccagccaggagatcttg

SEQ ID NO: 5494 - DNA, 852 bp, Triticum aestivum
  Clone ID: PAT_TA_5494
tttattgcttaaattttcgcaaagttaactacaggtagtactagtgtagagtagccatagacacgagcatagacactgcagacccgtgggcggacgcgtgggtgcgcaccgacgccaaaccaagcaccgggatccgaggcagacgcccatggccgacgacgaggtggtcgccgcgtccgcggaggagtcgctgaccactccgctactcgagccagccgcgagccccggcgacccatcggtggaggtgagtctgtaccggcggggcgccggcccgcccaaggtcttccggtcgggcctgaggggccctcgccgcgaccgcctcgacgtgcgcggcatccaggcagagcacgggctccgcgccctcttcgccttcaagcccggggtctcccgccgcggcctccggatccggcccgacccggcgaccggcccactccgccgtgcccttccgcgacggcgccgccatcgccctcgacggcgacgcccaaggtgcaggtgtcgtggaccaacgcctgcgttgatgatcgcccgcccggcctgctggttgccggcggtggttggccgtggtggctctcaacggggtgcctgagtcgctactgtcctcgagcgtagtcaacgccctcttctcgccgtggatcctcgccagcgcggtcatcgtcttcgtccgtctcaggatgcggccacaagctcctccatggagccgagctactgtaatgtaataagccctcctttgtactatcaagaagaagctcctgttatctcttttctcttcagaaattatgtgcaatggagacaaaactccagaataaatgtgtgtgcagtttgcttcaacgcaaataatcatctccgctgaag

SEQ ID NO: 5495 - DNA, 598 bp, Triticum aestivum
  Clone ID: PAT_TA_5495
ggccctgctcctggtcccgccgccggccgcctccggcccgcggccgccggcgcgtgccgccccctcgccgctggtgcccgtcccggtctgcctgctcctcggccctcaggcttcgggagccctctgctgggccccggccccgccggcgttccccctgccgagaggctctggcctgggttccgccaccgggctcctccctctgcgcgggggtgcctggggccgccctctcctggggtgcccggggcgcaggcgctcgggtcttgcttcgtcatgctccggggttcctcttctgctcgccggtcgtgggtctctggtcggtgtcgtgctggatggtcccgctgtctacttctgggggttgcgcttcgtgcgggctggcgttggcgcgcccttggctgggggtcccgccggtcccgcgcaggttcgctccacaggttgctccgccggggggcgcgcctcggtaccgctttgcggcgatctcagggcacggggtcccccccaggcctcactggtacgctttgcggatgctgggttttttcttgatgtaaaggatatttctggagaaaggtccttttggtctttctacaaccgagttgtgcag

SEQ ID NO: 5496 - DNA, 689 bp, Triticum aestivum
  unsure (1)..(689): unsure at all n locations
  Clone ID: PAT_TA_5496
ggggccgcgcgccggcagcggcggctcctgccgcggccgggggcggccgccgggggggcggccggggtgcggcgcccgccgcccgtgctcccccacgagaactgcaagatcgacgacctcgagctcacgccggaggagctggagatgtacatcgacctccacccgttcaccaacacgacgccctacaccgtggtggagaccatgtcggtggccaaggccgtggtgctgttccgctccgtcgcgctccggcacatgctcatcatgcccaagtaccagggcccccagatatctccgcttgtggggatcttgacgaggcaggacctgcgggcgcacaacatcctcggcgcgtttcctcacctcgcgaagaagagcaagacgcactgaagctgaagctcaagctgcctgaaagccagcaccatttttgttttgggaattactgttactgtcgacgtgtttcctgtcttgaagcaagagccacatgattcacttgctggcgccacgattctttcttttcttcctcattcttctctgtaattaggttcaggatttgcttgcgtctcatttttttttcttttcttcggggagtggctgaataatttgctgcccatgtaaaatcacaaatacgcccatgatgcaataagcagagttttttctttaaaaaaaaaaaaaaaaattatngaaagcaagat

SEQ ID NO: 5497 - DNA, 982 bp, Triticum aestivum
  Clone ID: PAT_TA_5497
ccgcgcgggtctcgccccccgcctcaactcaccttgtagtgtccgtccactcttgtccggcgtcgcagctcactccttcaccagcaggcaggagctagtgctgctgcgtgttggccatggcagcgatgaagcccgtcctgtacagcgcggcgatcagctcctgctcctaccgggtccgcatcgccctcagcctcaaaggcgtggaatatgagtacagggcggtggagtggaatgatacagattatgagaaaatcaatccaattaagtatgtgccagcactacaagatggggacatcttggtttcagactctcttgcaatcatattgtatcttgaagacaaatatccccagcaccctcttttacctcaagatctgaaaaggaaggctcttaatctgcagattgcaaacattgtgtgctcgagcattcaacctcttcagtgttacgctgttatcgggttgattaaaggcaaattgggccccgatgagagccttcagatagtgcatcattacattgacaagggatttagagcaattgaaaagcttctggaaggatgtgacagtaaatttgctactggagatgaagtccaactggcggacgtgttccttgcgccccagatacacgctggcgtgacgcgcttcgacatcgacatgtcgaaatatccacatttggagagattttacaaagcatacatggaaatcccagcatttcaagccgcacgccctgaaaaccagccagacgcgccttcgctccgtcagtgaaaaatgcagttgtttttcaaagcgtttgtactttgtaataaaactcggagattcccttgcggtgtccatggatgtacaagaagctcgctcttgtagaagtgaattagttgagaataatgcaattcccctcaatgggaaaagaatatcacgctgcagttgatttatctgtatgtgcacttcagagtaaagcagggcattccctctgtcaaaaaaaaaaaaaaaaa

SEQ ID NO: 5498 - DNA, 509 bp, Triticum aestivum
  Clone ID: PAT_TA_5498
ccggggcggcctaaacctcgccgccagcgcccgcatcgaatgccccgcgcgcatcgcctgcccgccccggccccttcgtcgcccctcctggcgggctacccctggcggcccccgctcgcgtcgctccgcccgcctcggccgggtcggcggccctcctgccgaccgtcctcgggggcgaccccccctcgagccgcctgccggccggccggcgtctgccgcgccgctgccccccggccccgccgccggccgcccctgaagccgcgaacctgccaaccgtccacagcctgccctgcttaaccagggctcctccgccggacgacgattcgccttcgtcttcgcctccagtgagttgtcccttcactttggacgtggcctccgctatggccttggtggcctcctggtgcagcaggcgcaccgcgaagctcacaaacaggtgctcgcacagggtgagcaccgtcggggcaatcttccactcaggctcatttcgcagacggcgccaagaccgaacc

SEQ ID NO: 5499 - DNA, 575 bp, Triticum aestivum
  Clone ID: PAT_TA_5499
ttgtggctgggtgtcggcgcgggaggcctcatgctgctgcgtcttcttctcctcctctacttgagattaaggtacagaggaggcacaggaaagtacggagcactcgtcctccccaggtttgagatcatgcttgcaatccttgcgatgccttgcgtatcccaagcgtctgcagcactcatcagaggtgggactaccggagggctcgccgtcgggatcgtgctcatcggcatcttgacggcgttcctggtggccctgctgctgttcctgtcgctgggcatcacgacgggcaggctgctccagtacaaggaggtgcaccaggaggggcaggagcaccgctggtaccaggagatcgtcaggcggtcgctcggccccggcaagcgcgggcagtggacgtggaaggaccccgcccgcgccgcgcggctcgtcaagctcggcccgctgttcgaggacctgcgcggcccgcccaagtacatgctgacgcagatcgtcgtgggcggtggcgggaagcgggcggcggcggaccagcggatcatggcgtcggaggacgagaacgaggacgcggaggcgccggtgat

SEQ ID NO: 5500 - DNA, 574 bp, Triticum aestivum
  Clone ID: PAT_TA_5500
ttttttttttgatgaaaaattcagatagcaccactgctgcaggcctcacacacacacacacacacagtcagttttggcagggttatggagcatttatttattcaagtgcaagcactcctagtacctaattaagagagttcccaacaagtagggctttgggatacataaacccagataagaatcgtgaggcatgcgctgcagatggcatggcaaaagggcagagtggtcttgcttcagtacgtgctgcaggggtctgctagagcttcacaccaagagcgtcacaggctccaagacatgtaggcggcgagcctctcgacgggcccccggcggcccaccttcactcccccgcggcaccgcagcttgatccgcgccaggtgctccaccgggatccacgcaaagctaagcctcgccggcgcgtcctcctcctcgcggtcgggctccagcgcctccctcgacctctggacccatttggggtggtaggtcacctggtaccacgccgaggccttcatctcgtacacccggtccctctcgtcctcgtccaagacggcctcggtctggcccggcgcctcgatgc

SEQ ID NO: 5501 - DNA, 461 bp, Triticum aestivum
  Clone ID: PAT_TA_5501
cgtccgcggacgcgtgggcggacgcgtcggctcccgcctcggcagctccgcaggccggccgtgctgcccatacccactcccctctcccccgtaccgccccgtctccctccgtgcttctctcgctcgctcgcctgaagctggtcggtctccccccaccgcgccggcgagatggagctgaagcccggcatgtcggccctcgtcaccggcggcgcctccggcatcgggaaagcgctctgcatcgcttttgcacaaaagggtctatttgtgactgtggtcgatttctctgaacaaaatggaagagaagtcacttcgctagttcaaaaggaaaacaaaaaggttcatggagatgttggagtaccgtctgccatattcgtcaagtgtgatggttctattggaggtgatctagctgctgcttttgcgaaacatgtagacacatatggtggactagatatctgcatcaa

SEQ ID NO: 5502 - DNA, 2432 bp, Triticum aestivum
  unsure (1)..(2432): unsure at all n locations
  Clone ID: PAT_TA_5502
cgtccgcccccccgtccgcgcacacgcgggctaccccaatcggatcaccaacccctccaaaactacgaagacggacggagcaagatcggacctcctcgtcccccccagcagccagctcccccctcggcagctcccctggcccccctacctgcccatctcccccccggctcgcccccgtctcgccccgggctcttctcgctcgctcgctcgcgcgaagctggtcggtctccccccgccgcgccggcgagacggagctgaagcccggcatctcggcccgcgtcagcggcgtccaccgccggatcgggaaagcgctctgcattgcttttgcacgaaatgttctatttgtgactgtggtcgatttctcagaatataatagaagagaactcacttgtctagcacaataagagaacagaaaatgtaattgagatcttggagtaccgtttaccgtatacgtctgttgttatgattctattgaaactggtctagctttatgctgaagcgaaacatgtatacgcttatgcaggacttgccatcagaattgattgtattgctaagttcaaataaaacattagtttatgatgatatatcagaaggaactagagacatggaggcatgccataaatgtgaactttgtcgctgttattgatggtactcgcattgcaagtcaaataatgcgatcccagaagaagcctggtgtcataatcaatattggttcagctgcgggcctttatcccatgttcgccgatcccatatatactgggacaaaaggtggtgtcgttatgtttactcgatcacttgctccattgaaacgccatggtgttcgtgtcaacgtgctctgccctgagtttgttcaaactaatatggctgagcaaataaatcaaaaaatagtacatgcaactggtggatttttgaagatggaggaagttgttaatggtgcatttgaacttataaaagatgagagcaaagctggtgcttgcctttggataactaagcggagagggatggaatattggccatcagcagaggaacaaagaaaatatctgttgaattataccaagtcaaaaagaacagtaacaaagaatgtatttcctagcatccaaacacctgagttttatgagaagatagttgttcacacactcagccataatttccgcaatgctacaagacttgatcgtgtgcgattgagattgcccattgaaccacaaagtgcgctagttaaaataatatacgctggtgtaaatgctagtgatgtaaacttcagctccggacggtatttcagtggtagtgctaaagaaactgctgcacgccttccgttcgatgctggttttgaggctgtgggaattgttgcttctgttggagatgcagtgagccatgtcaaagttggcagtcctgtggcccttatgacttttggaagctatgctgaatttacgatggttccagccaaacatcttcttccggtgccaagaccagacccggaggtcgttgctatgctaacatctggattgaccgcttcaatttctcttgaaaaggcaggtcaaatgacatctgggcaagttgttttagttacagcagctgctggtggaacaggacagttcgcggttcagcttgcaaaactagcgggcaacaaggttgttgccacatgtggtggcgaaagtaaggctgcatttctagcttccttaggtgttgatcgagttatcaactaccagcatgagaagatcaaagatgttctgaaaaaggagtttccaaaaggtgtagatattatatatgaatctgtaggtggggacatgtttgatttgtgcttgaatgcgctcgcagtccatggacgcctcattgtaattggtatgatctctcagtatcaaggagaggagggatggaagccgaagaactacactggactatgtgagaagattcttgctaaaagtcaaactgtggctggatttttcctggttcaacatgctcacatgtggcaagatcatcttgacaaactatttgagttgtatgcctctggaaagctaaaggtctcgctcgaccctaagaaattcctgggcgttgcttccgcagtggatgcggtagagtatcttcattctggcaagagcgtcggcaaggtcgtcgtctgcatcgatccagcatacagccagaccctcgcaaagctgtagcctgtagtccgcagagatgtcatcacaaagcatgacgcaggaaatgtaatttatgacaagtgcgtacgttatatgtgcacattcagtgtcgaggcgaggaacttagtagttgcatagtgaagtcactgtgtagctcggttgtctgatcggtttgcaaccggccaagcgttatatagaaaccaaataagtgtacgatccaacataccatgcctaaataaatgaatagattgctcagttcagtggtgcgttaannnnnnnnnnnnnnnnnnnnnnnnn

SEQ ID NO: 5503 - DNA, 634 bp, Triticum aestivum
  Clone ID: PAT_TA_5503
ttttttttttttgagaaaaccttcaactgcggccctttttctgtatagaaaaaatgtctccctcctcctccacaaaattaaagtattgtatagtagtagtaggagttaatctaatctacctatgccatctccaacttggtagtactgttgtatgtatatcatcatttgatcattgcctaattacactatcacagtgtcatctcagcagctgcacccagcttagcttactgtggagtgcagcttgtcaaatcgacgtcatcgtcaatcgatctatgctgttagaaatccatccatgcacccgaccagatcaatgaagatcaagagaagaaagaagctggctacaccgtggatgcggaggaggaggatgccccgccggagctggcgatggacctgtcccggcggtcgtcgctcgacttccttttgatggccctcttggcctcctcctccttcatgtccacgaacgttatcagatccctgatgctcctcagccgctccggccgccgcaccgggcagtcctccggcggcgttccaccttcgtcatcgccctggttgtacttgccgtactggcacagtatcctggtgaagaagatgaccaatgcaatgaagcaggcgacgccggagatgaggaagagtc

SEQ ID NO: 5504 - DNA, 1182 bp, Triticum aestivum
  unsure (1)..(1182): unsure at all n locations
  Clone ID: PAT_TA_5504
gcggaggcgagcgggcccgcagctcgagcggccacggtgatcagccctgaggaggccgtggagtgggtcaagaaggaccggaggcgcctgctccacgtcgtctaccgcgtcggcgatcttgacaagactatcaagttttatacggagtgcttagggatgaagctgctgcggagaagggacatcccggaggagaggtacaccaacgcctttcttgggtacggaccagaggactcgcattttgttgtggagctcacttacaactatggtgtcgaaagttacgatattgggtctggttttggtcattttggaattgctgttgaggatgtcgaaaaaacagtggaacttattaaagcaaagggaggaacagtaacaagggaaccaggtccggtaaaaggtggaaagtcagtcattgccttcattgaagatcctgatggttacaagttcgagcttatagaaagaggtcccacacctgagcctttgtgccaagtaatgcttcgagtgggagatcttgaccgtgctataagtttctatgagaaggcatttggtatggaacttcttcgcaggaaagacaatcctcaatacaagtataccattgctatgatgggatatggccctgaagacaaacatgctgtactggagttgacatacaattatggtgtcaaggaatatgataaaggaaatgcttatgcacagattgctattggtactgatgatgtctacaagaccgcggaagtcgttagacaaaacgggggacaaataactcgtgaacctggtccattacctggcattagtaccaagataactgcctgcacagatccagatggctggaaatcagtatttgttgacaatctagattttctcaaggagttggaagaatgagttttcaggaagatgtcatcttcgaacaggtttcattgggctttttcctcgagttgctagcaccccccaatgaaatcttgtaaaagcctctaagcgaggtttgtagataggttgtccaatctactgtgtcatcgctggttgttcatagggaattaggtttgctacttcttatgatgtagatgtgcaatccgttttgttagcggagtaaaattatatgtgcattttattcttctgacaagccagacagtattcccaggtatgcatttgttcctgcattcaaannnnnnnnnnnnnnnnnnnnnn

SEQ ID NO: 5505 - DNA, 1067 bp, Triticum aestivum
  Clone ID: PAT_TA_5505
gaattcggcacgaggtcgctccccgctccgcctaccaatttacccgcgcctcgcttaaatccgccaggcgcacccaggggggcccaaaccctagcccgggccgcgccgcgcatgggcaagtacatgcgcaagcccaaggtctccggcgaggtggccgtcatggaggtcgccgccgcgccgctaggggtccgcacccgcgcacgagcgctcgcgatgcagaggcagccgcggggggcggcggtggccaaggaccagggggagtacctggagctcaggagccggaagctcgagaagctgcccccgccgccgccgccggcgaggaggagggcggccgcggcggagcgtgtcgaggccgaggccgaggccgacgaggtgtccttcggtgagaacgtgctcgagtcggaggccatggggaggggtaccagggagacgacgccctgcagcttgattagggactcgggaacgataagcactcctggatccacaacaagaccgagccactcgaattcccatcgcagggtgcaagctccagcgcgccatattattccatgttcagcagagatgaatgagttcttctctgctgcggagcaaccgcaacagcaagccttcattgacaagtacaactttgatcctgtgaacgactgtcctctcccaggccgatacgagtgggtgaagctagactgataattctccaggaaggagagcaccatgtacttctccgctccctccaccttagcgtcgtggtaaaggcgcgccccgtcgtgttagctttgtttccgttgtaaaaagaattaggttagcctgtagtagcctcaatggtcgtgtaacatacagaagtaatgctgagttacaccctaatccctcaaactccaatgtaaccgttagcagctcattctgtaatgaccacctctagggcctgatcttatcatctgttaccagttgccagactaatgtagtagagctagctagatattgtatcacagcttaacttgtaatgtgggctgggctgcagtgccatctgcattccagtgttgtgctgcattgcacctgaagaaaatgtaacttcc

SEQ ID NO: 5506 - DNA, 627 bp, Triticum aestivum
  unsure (1)..(627): unsure at all n locations
  Clone ID: PAT_TA_5506
ccacgcgtcccggcccgggcacagacaaccccgacgcagccgcgcgcgcgcacagagccggagagagagagagagaggcaccgggcccatcgcatgggagcgcggtcgacggcgaccgcgggggaggcggtggcgaggcggggcagcaggaagaagggagccatggcgccgtcggtgggcggcgtggaggcggcgtccgcggcggcgatggcgggcggccggcgcagcagggccccgccgcggctggtgggctacgaggagctccccgagtacctcaaggacaacgagtacatccgcggccactaccgcgtggagtggcccatccgcgacgccctcctcagcgccttctcctggctcaacgagacgctcaacgtctggacgcatttgggcgggttcctgctgttcctggcgctcgccgtcgccggcggcggcccggaggccgcccacgaggtcgcgccggggatcatgaggttcgtggtgggatcagctaattcgtcgtggaagagcgatcaatcgggcctgccgagccatgacgcggcggcggcggtcctgggcgggcacggngtgccgcggtggccgcggatggtgttcctcgtgggcgccatggcgtgcctggccatcagcgcg

SEQ ID NO: 5507 - DNA, 1223 bp, Triticum aestivum
  Clone ID: PAT_TA_5507
tctgctttctctctctctttctcgtgcagctcacgcagtagccacgtacatctctctctctcgcaccccgcgcgccctccgccccccgccgccggcctccggtccggcggccggccgggcctccgccgggggctggccgctgcaggatgccacggcgagcaggggcctcccgttgttgatgcgacgttcccaatggcgtcgcgcagcgccgcgctctgcttctccgccgccgtcaccagctccacggctaccggcggcggcggcaggggcaggagccggaggcgcttcttggtcgtctgctgcgacggcggccggagatccgacctgctctcttcctccctcgcggccaaggtgctgggcgcgccgacgaccttcgacgcggcgaagctgacggtgcagcacgccgccggccccgcagcgttcccgagggcctacacgctgagccactgcgacttcacggcgaacctgacgctggccgtgtcggagaccatcacgagcgagcagctccggcaatgggggtggcggcgcgacgacgtgttcgccgagtggaaggagatgacctgcaccggcgggccgggcggcggggagatgacgctgcacctgcactgccacgtgagcgggcccaacccgctgcaggagctggccgccgggttccgctactacgtcttctccaaggagctgccgctggtgctcaaggccgtggtgcaccggcgacgccgccctcttcgccgcccggcccgagctcatggacgccccgcgtctgggtgcacttccactcctcgtcccggaagtacaaccgcatcgagtgctggggcgccctccgcgaggccaccaagaggagtctgctggacggggggctcgtcgacgagctccagagcgagatcaccgagcgacgaagcacatggaacatattcaacgccctcgtctcgtttctgctatgatcgggccggcccgggtgtataggcatctacgttgagaaagatttgggagagagggtaagcggtgcgttgcattgctcgtgaggaaaagaggatggaagatttatgctttcatttcattcttttgctctgtctggtcattctgggcaataccttgttggccagatagaaactctggactccattcttcagttcctgacatgtccattactgccaaccaaatcggtgcattcgttcaccttgttatccccccgcgtgtgacccccttgtttatcgaaaaaaact

SEQ ID NO: 5508 - DNA, 1604 bp, Triticum aestivum
  Clone ID: PAT_TA_5508
tttgttctagatctgctgttggtcttaatacaagggttggtgttgctagcttcatcaccttgctggtacagaaggtcatgattaacatcaagccatacacggcgatgttactgaaattactttatactgctgttctggaggaaaggagttctgcagccaaaagggcctttgcgtcttcttgtgctgcagttttgaaatatgccagccaatctcaggctcagaaacttattgaagacaccgcttctctgcatttaggtgaaaaaagttctcagtcatctggtgcagttcttattaaatcgtacttgagcaatgcagcagatgttattagtggatacaatgcagtggttatccctgtaattttttcttcaagatttgatgatgataaagagaccagtgccttgtatggagaactttgggaggatattcctagcagtgaaagagtaacccttcaactttatttaccagaaattgtatcccttttgtgcgattgcatgtcctcatcatcatgggctggcaagagaaagtcagccaaggctacaaaaagtctatgtgatgcccttggagaacctgtttctgcgcaccaccataatattctcaaatcacttctgaaagagctaccaggtcgattttgggagggaaaagatgctgttctggatgcactagcttcactgtgtttgtgctgccacgccgctataactgcagacgaaccaactatgcctagtgttattctgaatgctgtttgtgctgcatgcagtaggaagccgaaattgtaccgtgaagcagctttctcgtgtttacagcaagtgatcactgcattcaaagatccaggattcttcaatagtgttttccctatgttgtatgaggtttctaatcagtctgtcatttttaagacaacaaggagttcatcttcactaagtacatctgctgctgctgagcaagatgaaagtgcaagtgtctccgtttctctccacaaggtgctcaactgtgctgcatctagcatcactattgctttgccacaagatattatccaccaaaagaagaatatgttagaggttctgttgaactctctttcacccgaggagggttggcaagttaaattgtcatccttcttgtgtatcaaagaattgtgctacaaattttcggattctggtggtagcacggcgtggcctgaaggcacagatgattttgttcaggagatgtttcattcagtggcgtcaaaagtagtagactccatacgcttagttaagattgctcaggttcatgttgctgcttcagagtgccttcttgagttgatcaaattgtatagagacttcccgttggaagagagaagagaggccaagtttgagggtgaactaatccaactctgcgagtcagaaaaaagtgaacaggcaaaggcacttttgaagcaatgcttggctgctctcaaagagctcactggcgtaaccatgacgataggttagatgtacactttttcgatacatgtaaaatctgctacatgaaaatgctgccagtggcacacttgaaatttatggcaaagtggttgcattgcacgtttttcagctatgcaatacgaaaatcagcaatttatcaaaaaaaaaaaaaaa

SEQ ID NO: 5509 - DNA, 695 bp, Triticum aestivum
  unsure (1)..(695): unsure at all n locations
  Clone ID: PAT_TA_5509
gaattcggcacgaggtccaccgctcaactgtcacgcccctccctatacgctcttgctgcttaccattcgttcttcctccttgtcgatcttctctcactcacagcgtgtgacactacccacgtctacggcccagcgggctcgcactcgctgaagccgccgcacccggccacatggcggcagacggcaccggcggccggacgaagccgaagccgcacgccgtggtgataccctacccgctccagggccacgtgatcccggcggcgcacctcgccctgcgcctggcggcgcgcgggttcaccgtcaccttcgtcaacacggagtcggtgcaccagcaggccgcgcgcgccctcggcgtcgaccggcggggctgcgacatcttcgccggcgcgcgcgggtcggaggacgtgcggtacgagctggtgagcgacggcttcccgctgggcttcgaccggtcgctgaaccacgaccagttcatggagggcgtgctgcacgtgctcccggcgcacgtggaggagctgctccgccgcgtcgtcctggacccggcctccgcctcccccccgacacttcttctgtggcagnacctggcangcgctcgggtgcctangtctcntctggacgaccggngtntctncgcctctatacaatgactgctacaagcangcactnaanncaaagnatatacaacacacatcacn

SEQ ID NO: 5510 - DNA, 662 bp, Triticum aestivum
  Clone ID: PAT_TA_5510
ggatttcataagacattacgcaaaatagaatcacattccacgtccattgatgatctataccacttaccgattgcaccacacggcactgagtcaatgaccgggcacacactacacacaagacaagagtacaaagacgcttattcgcggccacttccccaacacccgacatgcgcgcttctggcccatcggccggctcagcttaacatccgccgcaacggcgcgttagctcatcgacgaactcatcgaagctccgctgcgatgacccgccgtgcaacgtggcggcctcgagcgtcgccctcatcttcttcaccgcctcccggagctcctcaccctctttcccggacatgacgccctcaatcctcgccctcacctcatccgcgaacaccgcgccacggtccccgataggcacgccgacgcgccactcccgcacgacgagccgccggttagtgaactggtcggtgagcagcgggaagcagagcatgggcactccggcccacacgctctccaggacggagttccacccgcagtgcgtgaggaagccacccagcgcggcgtgggagaggacctccacctggcagcaccacggcaccaccagcccgcgcccggcggacgcgaacccctcgggcagcgggtccaggtcgtcagagctgacgatgtccggc

SEQ ID NO: 5511 - DNA, 767 bp, Triticum aestivum
  unsure (1)..(767): unsure at all n locations
  Clone ID: PAT_TA_5511
gaattcggcacgagctgatacgtggcgtgtcaagtttctatacgcgatgatttccctccacacctccccgttcactctcctgataaagctcgagcccggccggaggcggctcgcgctgccgcagtatgccgtgctccggcggccggcgccgaggagcggcgtccgcgcggcggcggtggccgagtccgtcgacgcccagctccggcagttcgcgcggggcggggcgacggaggacgacgaccggctgcagaactacgaggccctcctcgtcacccgcttcctcgacatcatccaggacctgcacggcagcaacttcagacgagtggtcgaggagtgcctgcgggtgtccgccgagtaccagcgcgacgcgggcgaccgggcggcgaagcttggcgagctgggggcgctgttcacgagcctggacgtgggcgacgccatcatggtgtccagctccctgtcgcacatgctcaacctggccaacctcgcggaggagatccagatggtgtaccagaagaagatggagacgagccggcgcggcggcttcgccgacgaggccctgggcgcccaccgagtcggacatcgacgagaccttccagcggatggtgggcgggctggggcaagactccccaggaggtgttccgacgcgctcaaggtcgcaagaccatcgactccgtcttcaccgcgcacccaaccaatccatccgggcncctncnaagggggggggcccgggtaccaattcnccnnaaataatcnttttaancccgtaa

SEQ ID NO: 5512 - DNA, 1010 bp, Triticum aestivum
  Clone ID: PAT_TA_5512
gccggccgttccgggaaaaaatagagccacgcgtccgcccacgcggcaccccaggggaacgtagagcccagaagggaggggggctcgagcgatgcactcctgggggacccggctgctggccgcgtcgacgacggcggcgctcctcctcatcgccacctgcgccgccgcctccgcgctcgacgccttccacgtcccctccgtcgaagcccaagcccacgttacgaagataaatcgattccacaaacagatcaatgggaacgacaaggtgaccttgaccttcagtctatctgcaaatttggaatcacttttcacgtggaacacaaagcaggtatttgcctttgtgaccgctgagtatgaaaccgcgaagaattccctgaaccaggtttcattatgggacaagataatacctgacaaagaccaggcaaatgtgcaagtggaggtgaagagcaagtatcccctgactgaccaggggaccagtctgcggggcaagaaagttcagcttgtcctccactggcacatcatgccgaacgccggcgcaatgatccgaggcaagatgcctctctcggatttcactctcccagacacctatacttcctgaaaacgaagctgtgctcctctgctccatctgataaattatgtaggaggctcgcagttgtagatctataagaagaatcctctagtgaatgcgaagcttctttgctgcactcaggaccgtgttgttgttaattcctgatttgttgccgttcgcaatgtggatatatatataaatagcatgttattgatcaaaacccccaacgttcctcttacaaattcccacccgaggggcaagggcatatgacgcgtaaaattgttaaatccctgcaatttttaaaaacccctttttatacaagcgccaacggcaaatccttaaaaataaaaaaccccgaagggtggggttttcccgtgaccagccccttataacacggtctcctcttaggcggaaactattagaggcggttcctctcaatccg

SEQ ID NO: 5513 - DNA, 1343 bp, Triticum aestivum
  unsure (1)..(1343): unsure at all n locations
  Clone ID: PAT_TA_5513
cccacgcgtccgcagaatcttctgactccgaatcatcggatgaagatgactctggaaggatatccgtgtgtggcgaggatagctgtgatccggatcctaaatttgctaggagttcttcgttcaaggcggatatttttcggtctagcagaacctcagaggacttcgcgacatggcaacgcattataaggctggatgctacccgggcaaatgcggaatggatttcgttctcccgtaaccaggccgaagtccccaaggagaaagccctacagtctgcagcatctgttgggttgaaagattatgaccatttggagccccatatgatttaccatgctgctcggttggtcggacttcttgaagcgtatgcgatctacgatccggagatcggttactgccaaggtatgagtgatctcttgtcaccgataatcgcggtgatggaggaggacgacgcggcgttctggtgcttcgtgggtttcatgaggaaagccaggcacaacttcaggctggacgaggttggaataaagaggcagctgaagatcgtgtcccagatcatcaagcgcaaggactcgcacctgtacaggcacctgcagaagctgcaggccgaggactgcttcttcgtgtacagaatggtggtggtgctcttcaggagggagctcaccttcgagcagaccgtgtgcctgtgggaggtgatgtgggccgaccaggcagccatccgggccgggatcgggaggaccacctgggggaagataaggctgcatgccccgccgaccgacgacctgctgctctacgccatcgcggcctgcgtcctgcagaggaggaagctgatcatcgagaagtacagcagcatggacgagatactgcgagagtgcaacagcatggccgggcagctggacgtgtggaggctgctggacgacgcgcacgacctggtcgttaacctccatgacaagatctgagctgatgcaggtgcccgctctccctcgctctcgcggcggcggcgatggaggcctcgtcggaactttgaggtatctatgctgctgctgctgctgctgctgctcgtcgaaagcgttctgttatcttctgtcaagttcctggcaccgcacgaacgaacccgctcctaagtatagagggtgttgtagccaaccgcaggggcgccctgggcgcgccctcgcataccaagcactgaattaccaccgctatcatcgttcaactgtcagatgccaacaacagtgttttcccgacggctgtcgtccccgctgctggacttctcgatgatcagcttcctccccggcggcccgccggccccgatggcgcagagccccaggccctcggactctacggaaactggn

SEQ ID NO: 5514 - DNA, 1241 bp, Triticum aestivum
  unsure (1)..(1241): unsure at all n locations
  Clone ID: PAT_TA_5514
cccccccttttggagggaatctggttcctgatactagtacaaatcgctgcaaaatgtacagattgattatgaacaagcagccggggaaatggaggacataagcagagctatattcctcttgatggcactaacagaaagagaaaaatctagttctttcatggcggtacaaaactacaaatcactgcaagcaagcaacaaaaacgaaacggcagcaacggggacgacaacgagcagaagaagatcctagctagtcctggctgctgcggttgctcagggtggacgcgctccgcatggaggagcggcccatggactcgtcgatccggtcgagccgcggccgccacggccccgtcgatgcggcggcggcgcagctcttggcggcggggcggggcggcttcgcggtctggccctcggttccggggctgccgcggcggtgctgggcgtcgccggagaagagcgagtcgacggcgctgggcgcccggcccgccgcccttgcgcgcgagcgcggttaggcggttcatgaggcaggcgaggtccaccgcgaaggactcggcctggaagatggagtgcgggagcaggaagtagacggtgcccggctgcagcgcgtcctccggccggaacagcgcgcgggcccggcttgcatgcaggtgcgccgacgagcacgagcacgtaccggcacgatgagggcgaggagcccgtggcgcgcgcgacggtgacgggcgccccgtcctcgcccgcggggaagtcctccacgtagccgttggtgtggatcacccgcacccccgcgaacggccgcagcccgcccccgccgcccgccgcccccgtcgagaagccgcaccccatggcggttaaaccagctggtccgagctcgaattgtggaggctggggaggatggccggatcgctggaccggtcgggggtcggcgggcgcgagtggtgggatggcgtgggcggggctatatgctgggcgccgggccggcgggggcgttgaaccggctgacggccggcatgtggcgcggggtcgtgggcgtggacgacgggcggacggacctgacgaagagctagcgcgcgggcggtggcgtcgcgtggcgcgtggtgtggactccgtctggtgccgaattcctgcagcccgggggatccactagttctagagcggccgccaccgcggtggagctccagcttttgttccctttagtaggggtattttcgcgctcggcgcaataaaccgctnngngtancaaaatc

SEQ ID NO: 5515 - DNA, 579 bp, Triticum aestivum
  Clone ID: PAT_TA_5515
gggttcaagaaagcgaacacactgacaaagtattatgtattacgttgatggtacgtacatgtagcacaccatggaacgaaaaatacaaacatgaactgaaacggaatacagatacacactctcttttttttgagaaatactgaaatacagacactcatttagggacgtggacatgagcgaaacgccggtgtttttcttccgggcgatgcaagctatagcctatagaagtctaaaacccacaagttcagcttcagcttgtacgtaactcagcacatgaagtagagatgatcatgggtgagaaggcaccccaggaatcaccaccagcgggccgttaatggtactggttccggttcccacaaccggcaggtctggcaaccccgaacccgaagaagccttggactcggcgacgccggcaccgcgtgtcgctcccagtgcgccgtccttctggctcagctccctcccttcgcaggacgcgagcaccaccagcagcaggagcgcgacggcgaggcacttcgccatattgctaactgggaggttctaactcggagtagagtactacggctgaggacaggagcggca

SEQ ID NO: 5516 - DNA, 2097 bp, Triticum aestivum
  unsure (1)..(2097): unsure at all n locations
  Clone ID: PAT_TA_5516
ggttctcccggggcggcagtgcgaccaacctcgggggggcgttcttctccccgcacggtcggaagcagcatgatttgctcaggtcctggaagaaacaactaatgttagctaaagaggctcggcggctggatatattgtgttaccggatttttctgggtcataaggtcctcttctccacggagaagtactcggtcttgcataaatttggcgtcaacccctggcagtaaccgcggccggagctggcaccgcctgcccggtccgggaagggggcgcgccgttgtcccagtcgtccgtcgcggggcgctcgtggcctggatccttctgcggaggctccagtggtcctgtagtcgacgttccctcttggtgctcctgcttgctcccttgtcggtccgccctttccgttgccggcgtgcgtcacctggctccttccttcatctcctccgcctctctccgtggcttgtgtgcggcctcgctggccttcctgctcccatggggtgccgcgcgtgtcggcgtcgctcctggcggcgcctcctgcttccttcgcggcatgtccagctgcccccgtcctccgtcgggctaaagcatgggtcgtcactggtcccgagccggcggccggctttatggtcaaggtaactgcattctccgtctccagtgagtttgcgccatgggaagccagggtaagtacaagctctctgaaagaaagtgatctgaagggtttggctccaggtggtgctggattagtagaccaaaataacaggagcccaaagacaaatagtggtggtcagtctgatcgttcttcagagggagttgactcaaacaataatgcaacagtgtacactgatcttaacaagtcgccggaaagtgattttgagtactgtgaaaatcctgagatccttgattccgacaaagtgcctcatcaccccaatgggcctagcaataacttgcaaaacatgcagatagttgcaagctaggggaccaagaggtcactgaactgggaggaaagcctcctggggctcccaagcgtcaagctttgggtganggagcctaattcaacagttcaagctgctttacttagggagtcttcaaactcaatggagcaaaaccaaagaagcgatgttcctatatcacaggatgcatcaaatgcaactgctggagttgagttggcgcttgttcctcgatttgttggctctatgccacccactgcaccaagagttatggaaactggtaaggagactggtggaaggagcttcaacacaaaaccttctgacaacatctttcagaatggctcctcaaagcctgaaagagagccagggaattcgtcaaacaaaagatcgggtaaattcgaggatgctggccacaaggatggatgccccgaagcaacttatgagtactgtgtcagggtggtgaggtggctggagactgagggctacattgagaccaacttcagggtgaagttcttgacatggtacagcttgcgtgctaccccgcatgatcggaagattgtcagcgtgtatgtggacaccctcatcaatgatcctgcaagcctctgcggccagctgaccgacaccttctcggaggcgatctacagcaagaagccgccttcagtcccctctggcttctgcatgaacctctggcattaagcgcgacggaagctgtcaccgccttctcttcctggggagggtgtgtgccttggtcccattctttcgtagcagatcgatcgttgcattgattcttcattggagatttcattgaagcagtagttgacttatatacaatgtgttgttggttgtaaccttgtctgtccgctgtcaccgtaggaggtttatgttacctggcaccttatttcatctcttctgctactctctagtctgttgcgtcgtctcatgctgtcttggtagcatgatgagctgcgcgagtcgtcagttgcgtcgcctcgtgctacctttgtagcatgaggagttgagtcgtcggtcgggttaaagcatggaacatgagttgtgctgagtcggtcggtcgggttaaagcatggaacatgaaatcttctgtttccaactgttgcaagaagaatgattcttatgtaaaaaaaaaaaaaaaaaa

SEQ ID NO: 5517 - DNA, 1313 bp, Triticum aestivum
  Clone ID: PAT_TA_5517
atccggcccctgggaattcatccgtccgaagtcacgagatattcaggcgcggatattcctcccggcaaggctcgatgcagttactgcgagagcccggcaggagtcattgcgaactcacttgcctgattctctatcctccccctattcgctacccttctataacacactacattccgattaatactatttctaactcaagaaaacaaaatcgagccccggggccgcggatcgcgagctgggccgatcaccgcgtgctcgcccgtgcccggagtggcgtggcggaggcggtggcaatccgcacgggcgcccggcgtccggtcccggacccgccgcagctccggcaaggcatcctccgggtgcccgcgcaggtccggcagcctgagccgtccccgtcggaccaccgggagcacaggcactccacccttcccgtcccgctgcatgtggcgcaccgcggcttctgcagcagcggccaccgcaccgccgccgcgggcctcccctcctgcatggacctgttggccatcgccacccccgccagcatccccagccccgccgacgccaccgcgatcggcgccaccatctccggcgtgtgctagatcctcctcgtgaaagccccgacagatcggagagacagagcagagaggccggggctgggccggatcgacgcggagctcctgtcccgccacgccggcccggacgcgcccacgcccggaggctggtgcgcggggacaggggacaacgggagcgacccctgctcggtcgtcgggaacaccagctttcttcagcctggccgtggggccgtgcggctccagcggctcgtcacgtcgctcctgtcagacgagaagttccacccgcggcagtgcaagtgatgatatgcttctgatgccagagctgcttgcggtgtgatgatgcatggatctcctgccggcgatgtacgcacggtcgatttgaccgcctgcggctcgccgttttgtcggctaggtagcagaccatgccatgtatgatgatgttgtacgagtacgaccagaccacgtagcgtaagtagagtttgttgttgtatcaccacttgtaagactactaaagtctgaagaccacaagatgatgtatcatcgacatcgactcgacggtatgaacctgaagacgggaacttggtgatgaaagactgctgatgtttctgaagtttgggtatctctgctggttggaagaaaacagaagaagggttacttattgctgcctgagtaagagccatcctgaaggacccatttctgttactaggattgtgttctaacagcaattcctgttattattcagtcagc

SEQ ID NO: 5518 - DNA, 892 bp, Triticum aestivum
  Clone ID: PAT_TA_5518
gaattcggcacgaggaggaacatagcaactccgcaagaaagaaactgctctacaatactgacaataaagtagcagatgaagagggtaacaacccaagctggaatcaaacgatcaccgctgtgaagtctaaggaggtgtttgaagaagctaatcatcccattcccagcaagatgctgtctggtgaggctaaaatacaatgagcccaagcaatagaccaacttatcgagctaacaaaaatgccccacacaagagtttgtgtacctcttcagtacaagctactggtaccagcgggaagacccctggaatgaagctttctgcttatgttgaccaggctgtggagcaaagtaccagtgctgcaaacatggaggtcataaaggagcatcaagagttggaggagaagatgaaggaaactgtatatcttgacaacctctctcacaaggctacagaggttaagagcaacccaagcaggaccctgtcaaccactgctataaaatctgatgtgtttgaaaatgctaaccacaccattcccaccaagaagctgtctgatgtggctagaaacaaggccccaagcaaaagatcaactgacccagctaagaaaatcaccccacgcaagaagccgcgcagctctgcagtgcaggctaccggcaccagccagaatacatctgtaatgaagctttccacttctgatggccaggctgctaatcaaagtaagagtactgcagagttggaagcataaacagttaggagttgaggagaagtaaacgaactgtatacttgacaactttctacaggctacagaggagtataaaacagtttagtatttttgttagaagttgttttgttgtactacacattcctcatatctcatctcttgtggatgactggaagatct

SEQ ID NO: 5519 - DNA, 773 bp, Triticum aestivum
  Clone ID: PAT_TA_5519
gtggcaatgaacttgaagcactaaactcctcatatgtcttggacatcgacactcaaaaactgggagtgggctgcggcttgcaaccctatctaaaataccttttgaaaatctcctaagaagcccttaaaatggagatttgtcgctgtaacatgatcataaggattataatactccaaatgacgttgagcatgaacataaactttacaatgtcaataaattgactacttcctgaggtcaagttccacagaccctaggtcctccatgttcaagtatgcgacatcgatgccatctgtttcacaaaataaaacggtcacagtccaaccatccaactctcagattcggaggttagatcacacttcaaccagatggtacaggcacttacgagattagtaccaacgctgtgcttaaagagcaccgttaatattcagccattttcaagaacacatcgttccaattgacgctataaattttagatatgtagtttgtcatgccaggccgaatggccccctccctgggcccccccatcctgcgattgcagttcagattctcctgctgctgctctgctagcgatttctcctcatctagttcatgctcaattagtgcaaagttctccacctcatgtctcctggagagtatcttcgatttttttagaatctcataatcaggatctctgtggcccacccagcgaaattttaacttactcccaggtctccgggggcgatcattgaacatctcagctgtagcatgcttcgccctaacaggccttggaattc

SEQ ID NO: 5520 - DNA, 726 bp, Triticum aestivum
  Clone ID: PAT_TA_5520
gaattcggcacgagttttagtcccaagcatagggaacttgttctcatattcacacattcaacccacgagagactaacaagtgaccacagcataactagtacatgaaagcaaatagatcaaagtgactactgactaggtattactagaatagttaaaataacattgctcaaagccacaatggcatggaccagaacatcaaaatacaaaataccatgctgcatagaagatctgacccatatttagcatgtgaactctgtaatcatggagctgctttgggtaaccattccttgtaagtgggaatgtaaggatcgcaccggagagtaaagtaactctcaaaactgaagataacatgaaatttcctcttttccatatcgtatgacacaagctgttcatcccgtccattaatttggaaaatcagattgccttctgaatcaacagcgacaaaagtacacacctcatcatcgcctgccgtctccgacatgtcagctgtatgcttcagtgtccactgcccagtagcataatcctcaagtacccagaccgtgagctgacactcatcatcagaataattcatatgcaaagcatacaagcgctcctgagagtgcccgatgaagccaatatcggacgtgtcctcaacactgagcggcatccgaatcttgtgccatgtcttcccctctgtgtccactgtgataactgaagaatctcgggtagtcaaatgcagggtgccgc

SEQ ID NO: 5521 - DNA, 758 bp, Triticum aestivum
  Clone ID: PAT_TA_5521
cgtcgccgctcgcgccccccccccccgcgcccgccgctcatcaacattcaacaggaattcgattcgattccgcttgcttcagggctacgctgcgctgccgccggagtggccgcctccacccccgcgccggggcggctgtgccccgcgcttagggtcggccttgcccggggtgttcgccttcggtgtgccgcctcccggccccctgggggtccccggggggatgcctccccccgcccgtgtctggggcgcgtggggagtgtcgggcctggcgggcgcccggtgcgcgggcggtggtgccgggggcgccggcgcgctgggcaccggcgctgccgccggcgacgcccggccgccggggctccagccctgccacggggcggccccgccccccacccccgccgccgccgccgccgacacgggggcgagcccctcccccccgcgcgctccccggccaccccccccccccaccgcccgcacctcgccccccacccggcgctcctccatggcaccccccaccacgccccccccgaacccgcccccccgccccctcccccccttccgcgctgcctcccacgacgggccccccctcgtcctcccgccgccccgcccccccccccgccgcctccatgccgccgcagccgccccccctgacatcaacctccccctcgccgctgacccgtcgcctccccctccggccatgcagaccaccaacctccatgaatccaacgtcgacatgctggatgttggcctcggctgcccgc

SEQ ID NO: 5522 - DNA, 660 bp, Triticum aestivum
  unsure (1)..(660): unsure at all n locations
  Clone ID: PAT_TA_5522
ccggccgccgccgtccctaccccgtcaggttgtctcgcagccgcgccgcctactctctcccctctcggccatcgacccgccgtctcccccccgctccccgcgccccccggctgcctacatctgcacctggtgtgccgaacggggcccagctcctcgcgagaagctatcgcgcggagtgcggcgctggagccacagattgcaccaagccgtgtggcttccgaacaggggtagcgtctccgctcctcccggccgcgctcgcgtctctcctccccgcacagctcaccttgcggccgtcgcggtgagcctccgcctcatgctatggcgcggctgccgctgtcgccatctccaccggctttcacccccgtcaaggaagagcccgacgtcnacaccaccaccgncgncgntcgcactacgcgcccaccgccccgcaagaagcgccgccgggaccaccttccggtaaccccaacccagccgctgctcacgccccaaactattctgtncgggatttcgaaagccgattccttccatgtcaagcggtgcggggagctggaggacctaacgccgacgacagcgcccgcctccataaagagcgagcctgacgctgacgacgggactggcaaggatgcaggaggggaaacattgggcgcaccactgcacaag

SEQ ID NO: 5523 - DNA, 670 bp, Triticum aestivum
  Clone ID: PAT_TA_5523
acaaattaccaagacgatcgaattgattgatgaacttaatccccacaaaattagtactatcttgcgtactgccctggggccactcttgggcgttgtttgacttaagcgccacgatcgtcgtgcactcgcccatgaatccctcaggaggccactccgtgtcagctgataacgcccatccgaacagcccagggcaatcatcgatcattctaggaacgggtaatcggtgtatccgacggcggggtgggcggctccggcgccggcgccgtagaaggtggcgctgacgcagtcgttgagcggcgcgcccagctcgaacctcctcggcaggtccgggttcgccaggaagagccgcccgtaggccaccaggtcggcgtacccctcgccgacggccgcgtcgccctcctcccgcccgtacccgccgctggcgatgaacgtgccgccgaacgcctccctgtacggcagcagccgccgggacacgcgccgccggccgtccaccttgggctcgatcatgtggcagtagagcacgccgaggtcgttgagccggctcacgacgtggagcgccagcgcgtgctcctcgggcccggccgtgaactggtccagccgcaggcccaggcggtggccgccgatctcccgcgccacggcctccaccacctccagcgcgaaccggcaccgg

SEQ ID NO: 5524 - DNA, 1647 bp, Triticum aestivum
  Clone ID: PAT_TA_5524
ccacaacccatgggttagccatagccaaaacccgtggtgtgtcacccgcgtcattgggcatctccgtcctctcttcgccggttcccacggggttaaaaagtttaagccataccattcctcgcccaattttgttctaatcaatcacctttgccccagttccatttcggaaagcttccatggagcccgtgttcttctcactggaggaggcgatgcccgagcccgactctaagacttggaggacctcgtcgccgccgctggaggcacacatgctcgtcgcacgactcggaggagtgggcgccggcgaggtagtccgtggacgagccgtggctgctcaacgtccccaccgcgccagtggcgaaccccgaagcttcgacgctttaccctaatcccacggccgaggggagccgcaagaggccgtacgacgtccatgacatggtgggcgcggtggaggtcatccccacgccgcctgcggcgagcccggaggtggaccccgtggcgtacaacgcgatgctgagactgaagttggacgcgcatctcaccgccgtcgccatgttgaggggaatagacggaagttggacgcgcatctcgccgccgtcgccatgttgaggaccactcggggaatttgcccacaaagctcccatgacaatggagcatcgcaaaattcagattccatccaaggctcagaaaaccacaccggagatgtcagtttgcatcaacttagctcttcctcattggagccatcaccatcagatggtgatatggaaggggaggcacaaacaattggaactatgcatattagtgcagagaaagcgaataagaggaaagaatctaacagggattcggcgagacgctcaaggagtagaaaagcagctcatgcgaaggaactagaggagcaggtctcactattaagagtcgcaaataactctttgatgagacatcttgcagatgtaagtcacagatacgtcaatatctctattgacaatagggtactaaaggcaaatgttgaaaccctagaagcaaaggtaaagatggccgaggaaactatgaagagggttacatgcaccaacaatttcccccaagcaatgtctagcatatcatctctcgggattcctttcagtggctccccattgaacggtatctgtgataatccattgccaacccagaacacctcacttaactacctccctcccacaacaacaaattttgatgtgaacaacaactacatccccgagccagctctggcgttccagatccaggatcaaataccttcgctacatatgcaacctatgtcatgcttggatcatcacccgcagaggatgcacataggtattcctacatcagcacctactccgcaacgggaatctactacattggattcaactgaaatagtcaacatggtgatgtagtaggaattttatgggagacctgagcaggaattacttttctcaaattgttttcgttgttgttgttgttaaccgttgggggtatttagaatggtttcttcaacttgttaagtggacatttcttagacttgtttaagaaatatatattgttgttgtttcagaataagaacctagacatagttggtctttgataactaatacatatattgaaggttattggacaataaagtgatgtggttgagtc

SEQ ID NO: 5525 - DNA, 887 bp, Triticum aestivum
  Clone ID: PAT_TA_5525
gaagcttccacggtatgacaagtccgcttttggtggaagaggtgaccgggctgacccttcgacatggccagaggttgaagggcccacagaggttgttctctttgaaggatggatgcttgggtttaaacctcttccaaatgaagttgtaacagcagtggatcctcagcttgaggtggttaataagaacttagaagcatactatgacgcgtgggacagattcattgagtcatggattgtcataaaaattaaggagcctaactgtgtgtttcagtggagactacaggcagaggtagctatgagagctgatggtaaagcaggaatgtctgacgaggaggttatggattttgtatcgcgctacctaccagcataccatgcgtatttgcccacgctatataaagaaggaccaaatggcgcgaagaaagaccatctgctggtcattgacatagacgaagagaggactcctatctctggtagttgagtgctgagtgtacattctgaaatggatatcttgactaagtggttgagcttgggatttctgatctttctgagaccacttctgccaagcaagcaccaccgtcctcctgtttcttacagcttaaatatatcctaaacgtgtaaattcgatgtataccaagttttgctatctattaaaagaaactggcatctcatttttcttccaaaaaaaaaaaaaaaaaactcgctcgtgccgaattcggcacgagaagaagaacttccacttccctagctttgatagaaaacaaacaaggaaaacagagaagctcacaccatggcaaccaatgggtactccaatggcggcagcaccaagggaaagcccatcaaatgcaaagcggcggtggcgtggggtcccggcgagccgctggtgatgc

SEQ ID NO: 5526 - DNA, 982 bp, Triticum aestivum
  unsure (1)..(982): unsure at all n locations
  Clone ID: PAT_TA_5526
gtttttttttttttttttttttttttgcccagataactgatcatcatttttttattttttcatttaaaatccactatacatcgttcaacacccttaccgctgtccagggcacgtgtcattgccctcaacccctactccatgcctcatgattcattccacatgcctgttggcccgtcggccctcacggctctcccctgctcttccttgagtctcgtagggcctggtccgacttgttctaccgtgtcctcccgtgccgtccggccttaaagaggcttgaatttcaaatttcattcttgtttgtagtaacacaaaacagagtagacagtttggatgactgcaagaactaagccaataacagctgccaggaggccaacggctagccaggggttcctcaagtacctctgctttagccacgcaatccacctccgcgggtagctctggaaccgcttctcaagcttcttgcatgtctcccgaaggtagttgcagttggggtcatccgggtcgaactggatccccttgcaaaggtcggcgaagcatttggccacctcttcattgttcccatggccatgcacgatgacgcctctcttcgacaggagctccacgtccttcgtggtgcaggccacctgggatatgaacacgcagtatgccgtgacgtggctccccaccgtctcccggttacgttgctccagctctatcaagttacgtaataaccgccatgtctcggagtcgatgtccaggcaggggacctccagagtgccgccaccgccgtccaacttcacgtcgaggatgcagcggatgagacccttctcgcccatggcccgagccttgaacttcactcccacgaagttgtactccgtcaccgagcgccaccggcgcacagacacgggatcagcggtgccaaacggcacgcacgagcatgggggcagtaagagcngntggccgggncccaatgagccccaaaacagagagagcgccatgangg

SEQ ID NO: 5527 - DNA, 1168 bp, Triticum aestivum
  unsure (1)..(1168): unsure at all n locations
  Clone ID: PAT_TA_5527
gganccaaatacatatacttggcagacatgatgcgcttcatgaggcaggaggaagccatcaaagctatgcatctttttgaaggagcacaggagcactgcagggtcagcaagacgtctctgttcatctggccgggccgggcgtttagcgagcgctcagctcgggcccgatccctcgtcgcttcgacggctgcagggagcatgcgcaccctggtgcgctgggtcgccgccggcctcttggtgtctcctccctgccttcggtgtccgggcggcgccgccgcacgctcctctgcctgcacctgggcacagcttcttgtggcagtttttgtgttcgggaatactatgaagacaatttttgaggcaattattttcttattcgtgatgcatcctttcgatgtcggtgaccgctgtgagattgaagaagttcaggttgttgtggaggaaatgaatatcatgacgacagtcttcctacgttatgataacctgaagatctattatccgaacagtgtgctggccaccaagccgatttttaatttctacaggagtcctgatatgggagaaggaattgacttctctattcatgttgccacgccggtggaaaaactagctctcatgaaggaaagaatactacgttacattgacggtaagaaggaacattggtacccgggtgcgatggtcgtcctccgagatgtagatgacaccaacaagctgaaggtatccatatggctccggcacacgctcaacttccaggacatggggatgaggttcgtgaggagggaactcgtgctccaggagatgatcagagtgctcaaggacctcgacatcgagtaccggatgttgccgctcgacgtgaacgtgcggaacgtgccccctcttcagtccacaaggatgccgacgacatggaactatgcctgaagcggcgaacgcgagggctagaagatacagcagctacctgcaggagcctggcagcagcaactatagcggatagccattagctgttagtttgcctcccccccgaaatgagtggctggtagtgtgtctgatgtgatgagtgtgttctgtagtataacaagctttcgtgcacttgatgataggcaatacagatagtggtccattggaaatgttgaaagcggcctgccgtcgccgctgaaacttttgttgaaaaaaaaaa

SEQ ID NO: 5528 - DNA, 642 bp, Triticum aestivum
  Clone ID: PAT_TA_5528
gaattcggcacgagtttttttttactaaatgtactgagttgttttaaagaatccaaactgtcggttattaacggaactacatacaccatttcctgcatatcagagaaggcctcgggccatttatggagaatatgcacccattaagagcacaattttctatacatatgttccgtctggaaaacttatgcaacatcggcatagaaatcttgaatcgtcattcgggccgcaacaggaatcctcaccgttttctggtccttacgccaagtaatgctaccaaaggtgtagtccccttgcagcctccacataggcgacaacttcaccttaaatgaatggactctgtttgtggcattgaacacgagaactgttggctcaacctccatcatgactccagctgggctctggacttctacgtggtacactgagtcggcctcgccgacattcgtcaccgtcctccacacagtgatcgggcgcctcaactcagacaccgcgatggtgggtaggttcaggtggtatgccggtagcgtcgtcgcgtcacaactcacattcgtcctcctgacaatggtgcacccgaagaatttgttgtagtcacggggatcgatgtcgtagaccaagccgggatcggctgcaccagtggggttgatg

SEQ ID NO: 5529 - DNA, 681 bp, Triticum aestivum
  unsure (1)..(681): unsure at all n locations
  Clone ID: PAT_TA_5529
agtctcatgaacactggaagaaatgttacaaatgttctgcatccttttgacactaccaatccaaagtgatcgtttctatgggcaatttttttcacaagccttatttaaattatgtgtttgataaataacactggctctgaactgtacatgaccataaaaagtgcatacatagatcattttcctgtgataatatgatatacaaaaatccttgataaataaagtgtatctatgtcaatagtactttctccctcccgaaatatctgtcgcaacgaacacacattttgaactaaacatcatttttcaattacatccttatacaattcaaaagttggcgatccgctcctccctctccctcgtgattcactccttcctctcgtcgtcgcctccagatctcgccgctggctccaggcctctgctcctccctgcagctccagacctcttctgcccgcagctccaggcctctgctcctccctgcagatcgccccaggccttgccccagggagcgctccgcaggcctctgctnctagcgagnctcaaggcatgggggagccccgggccggctacatacatgggggaggagcagcaagactcgtgccgaattcggcacgaggcaagctatatacctacatagtacagccatggcccccaccgtgatggcctcgtcggccacctccgtcgctc

SEQ ID NO: 5530 - DNA, 942 bp, Triticum aestivum
  Clone ID: PAT_TA_5530
tgctggcgcgtttaatgggggggtttagggggtgtcccccttccccttcaaatttgtgctccggttaaggggggtgttttgttgggccctcaggtttttctcctccagtggtttaaaaacgggggggtcctaattgatattacgcggggctttccaaaggtttatccagtgcaaacccttttaaattgggtttcaattaattttatttcagttcccctttttgtataaccttttttttttttttttttttttgtgttactttttttttttttttttttttttttttttttttttttttttttttttttttttttttttttttttttttttttttttttttttttttttttttttttttttttttttttttttttttaattagcaccgatcgctctttattaatgcttcgattaaataggcggtttctgtacaagatgatgatgatgacgacgacgatgtcaaactccgaagcagaaaaataaggattaattctaggctcgcaatcgcaacccccccagctcagtaacgctactatgtcctcctcctcctcctcctccggcggcaccgccttcttctcggactcgccgccggctccgactcctccgactcctatagctgcagcttatgttgctgcttctgctgctgcggctggagcctgcccttgaggaaccccctgcacaccttcttccagaactctttgtccggctgccgcacgtcgaagctcgccttggccacgtccacctggcagtccaggaggaggttctggcggaggaggcggtcggcgatgctcatgaggatgtccttgctgtactcggggtggccctggacgcccatggcgcggtcgcccagccggaacatctccacgccggtcttgtccgaccgggccagcacctcggcgtgagcaggcagctcccacacctcgtcctggtggaactcgatgat

SEQ ID NO: 5531 - DNA, 633 bp, Triticum aestivum
  unsure (1)..(633): unsure at all n locations
  Clone ID: PAT_TA_5531
nttnnnnnnnnnnnaaaannnnnnnnnnntttcccgtccgcccagccccgacccccaccagacctccgccgcaaaccgaatccctcgccccgccccgccccgccccgaaaccctagctaggcagccatgggcaacccggagaagctgatggcgcagatcttcgacctcaagttcacgtccaagtcgctgcagcggcaggcgcgcaagtgcgagaaggaggagaaggagcagaagctcaaggtgaagaaggccatcgagaagggcaacgtggacggcgcgcggatctacgccgagaacgccatccgcaagcgcaccgagcacatgaactacctccgcctcgcctcccgcctcgacgccgtcgtcgcccgcctcgacacgcaggccaagatgcaggccatcggcaagtccatgggcaacatcgtcaagtcgctcgactcctccctcgccacgggcaacctccagaagatgtccgagaccatggacagcttcgagcgccagttcgtcaacatggaggtccaggccgagttcatggagggcgccatggncggntccacctccctctccacgcccgagaccgaggtcaactccctcatgcagcaggtcgccgacgactacggcctcgaggtctccgtc

SEQ ID NO: 5532 - DNA, 1231 bp, Triticum aestivum
  unsure (1)..(1231): unsure at all n locations
  Clone ID: PAT_TA_5532
ttcgcgtcgccctcccctaaaaaatccccaaatccctcgcccctcccccaacccccaccctcaccaacgccgaccccgatctcaccaatcccccggaaccgcaaaccctagccagcggcggcggcggcgatgggcaacccggagaagctgatggcgcaggatcttcgacctcaagttcacgtccaagtcgctgcagcggcaggcgcgcaagtgcgagaaggaggagaaggagcagaagctcaaggtgaagaaggccatcgagaagggcaacgtggacggcgcccggatctacgccgagaacgccatccgcaagcgcaccgagcacatgaactacctccgcctcgcctcccgcctcgacgccgtcgtcgcgcgcctcgacacgcaggccaagatgcaggccatcggcaagtccatgggcagcatcggcaagtcgctcggctcatcccccgcgacgggcaacctccagaagctgtaccagaccgtggacaagcttcgagcgccagttcgtcaacatcgaggtccagaccgaggtcgtggagggcgacactggcgggctccacatccctcgccacgcccgccaccgcgcccccctccccgacgccgccggtcgccgggcgcaggtcgcgcacggccacggccgcgggcatcccccagtgcctcagccgaagcgacaccgaccgcgactcgtccgtcgcgaagaggaaactcggacaaccgtacgacgccacctcccgcctcgctaggcccgcggcctgcacgacggctttggcacttcacttcacttccggtacggccacatgcaattctctccccgcgcccgccgtcggttagtgctgcgctgctcagaccgccacggacccgtagatattgttcacgtccgtgtgcgtgctctctggcatcgcaattctaagcggaactgatttaaacactgcgatgtgatatgacgtgttattccgaagcggaattgtgatattgatagtctgagtcagtaattgaacatgagcttaataacttcaggtacggctcatgcaatgttcactcgcctcgccgtacgtcagttgtcaagggctgctcatatctgacagccccgtaaatattgttaacgcccatgtgggcgctctctttgtctgggatctctatgtggaactgtgatatgacgtgttattccgaatcggagtgtgatattgatattatgagtcagtaataatacatgtgcttgagaacaaccaan

SEQ ID NO: 5533 - DNA, 901 bp, Triticum aestivum
  unsure (1)..(901): unsure at all n locations
  Clone ID: PAT_TA_5533
gaattcggcacgaggccacggacgcaggacacctttcccccgatgctcgccggcggcgaggacggcaacggccatctgccgcggccccgcaggccgcggcgcgtcggaggcatgggatctccttcgggccaggcggcctcggctctgccgcaccccgctccgcccccctgcaccgactacgacatggcctacttcaaggcctactcccacatcggcgtccacgaggagatgctcaaggatcatgtgaggactaatacttacagaaatgctatcatgcatcacaaagatctaatttcaggcaaggtcgtattggatgttggctgcggcactggtgttctttctatattttgtgcttttgctggtgccactcgggtctatgcagtcgatgcaagtgatattgcgttacaggcaatggaaattgtgagggataatgagctgtctgacaaagtcattgttttgcatggacgaatcgaggatgtcgaaattgaagaaaaagttgatgtcattatatctgaatggatgggctatatgcttctatatgagagtatgctggggagcgtaatttttgctagggataaatggcttaagccagggggtcttattcttccatctcatgcgtcgctttatcttgcgcctattacaaattcgcacagatatcaggatagtatttacttctggcgagatgtatatggtataaaaatgtcctgtatgatgcctcttgcaaaacaatgcacattcatggagccttctgttgagacaattagtggcgagaatgttttgacatggccaacggtggttgcacaagtggattgctataccatacaagctccagatcttgaaactattaccgctgcatacaagtttacctcaatgttgcaagctccattgcatggannngcat

SEQ ID NO: 5534 - DNA, 697 bp, Triticum aestivum
  unsure (1)..(697): unsure at all n locations
  Clone ID: PAT_TA_5534
gcacgagggtccggctcgagctgatgccgagttagagggattacaacaagcattgaagattctttctgacgctgaaaagcagataagactttccagtgagcgttcaacatggttcactgctgctctgctcccgcttggttctgggcatgattcagaaataacccattcaagaagcagcagtaaacaaagtgctaaagcagccagtgagaccatgttagaagcagtaagagaatcctctgcaagcaggagtgtgtctcatcctctatttactattcgcggttcaaggaaaacattggaccacagaacagccagtgggcactccagtcctcatgatcttgcttcattatcttcccggatgaggcccagtgacaacttaatttatggagaatgtagatctgttgatagagttctattggattctgctcaagcaagtaattctactggagcaaaagcctataattaatggaagctcaagaccttgtccaaatttgggcgaaaatgcatagacaattgtcactcaaaagacgttgcagcagctactcctctgatcaatgggaaactaacatccatcaaaagaatttgaaggctatttagttgctttcatatcatttgaggacagcaaaataatgtctcgtgcccaaagatttgtgagtagcatcagaaattcgatggggacagccctgatcaacgtggaagn

SEQ ID NO: 5535 - DNA, 922 bp, Triticum aestivum
  unsure (1)..(922): unsure at all n locations
  Clone ID: PAT_TA_5535
ggggcctgcctcccctagctatagctctagttcctttcagtcagtatgttggatgatgttgtggagagggccatcgagagggggtttgcattgccaaagtcgaaggtggccattgccttgacctgcctggacctcttgacctttaacaacgctcaaacaggaaacacatgttggaggaggagaccacaagctaattgctttctaggatgatttggatgagtggatcagaggacgacatgagcaggtatttccatttgatcatacccaaaatgataacgtatacactcacttaagatgcccgcgcttctactgagcccctgcaacatgcatcccttgctctcggctgcctccaaaattaatagctcaagtctctcaacacgcggatggatgatgttgtggagagggccatcgagtgggggtttgcattgccaaagttgaaggtggccatcgccttgacctgcctagacctcctgacctttcacaacactcaaacaggaaacacatgttggaggaggagaccacaagctaattgatgatttggatgagtggatcaaaggacgacatgagcaggtatttagcggaccatttgatcatacccaaatgataattaccctaacttaactcactctcatacatgcatgtgcttgtgtggatgcaatcaagtcactagcatgtgcagggcaatgcggcaaatgaaatttcaatactcaacacacttctatgtggattagaagaccacaggtggagtgtgcttggacggcagcttggccgccagctgcatgcccttctaggcggccaggcagagattctttgcctcggcaaccgccttggcctagagccatgcnnnnntcgtcgtcgccgnnnatggacgccagcaatgacatcgatctctgtgataccgacgaagttggttgtggggcnn

SEQ ID NO: 5536 - DNA, 1307 bp, Triticum aestivum
  Clone ID: PAT_TA_5536
ttcggcacgaggagcattgctaccccacaccgacctctactcctgataggcgccttaccaccaaagagccagcacctaagcatgccaacattgctaccccacaacgaccttctactgctgaaaggcgccctacacgcagagagatggcaccgaagcttgctggtattgccagtccatgttggccatctagcgctgaaagacggcctgtcgcaagagggattgcagagaagaatgctgatgttgtcaccctgcgtcgaccatctactgctgagaggcgccctataaaaagagaacctgctccaaagcatgccgatgttgttcctcttcgcaggccttctactgctgagagacgccctgttgccagagacactgggcttaagcatgctaatgttggcaacccttgttgcccttcaactcctgaaccatgcctcagcaggggaagtgcagcaaagcatgctgatgttgtcatcacttcttgtcgcccttcaacgggagaaaggcgagctgttgccaaagagaatgccctaaaattggatccaaaaacaccaataaggttgagagcaatgccgggtgattcaaatggtgctatggccacagcggctactccccagaaggcaattactcgaaatcttgttaaaactagcaaaccagagatgaaaagctatgctaaggaaaggttagaacttcaagttggcgggaaactaaaatctagttctgttaatcttcctccaaggaaagttttgacttcgaatgttggagccaatcgagtcgtagagaacatcagaaagccaaataagcagggcattcaggagactgttggatctcgagtatttgcatcaaagaatgcaactcctttgcagaccggaagcgcaaagacaagggtaccaaacccgccgccgcctcccccaccacgcagggcatcccagtcgccgagcaagccaagcccaagccccaataaattgtctgttggtggtagaaagccaaaggcttctactccacactggcactaacccatccccaagtctccatccttcctctaggatcctgcagaacaagatagctttgaacctgcgaaggaatcagatgcaactctgcgcggccggaacatcatccgtgctattccccgtgcccacggttgatgctggcctgcgtcgctaccaccaccacttttgtcacctgttaaccgtagtaacgtatgtacctacgtgtatcatatccactaatgccgccgtagctctactggcttaagattatttacccctacctagaacgttgtaaatacctgaaataaatttgagctttagctg

SEQ ID NO: 5537 - DNA, 1031 bp, Triticum aestivum
  unsure (1)..(1031): unsure at all n locations
  Clone ID: PAT_TA_5537
gaattcggcacgagcccgccctccgctccttggccgccgtctacggcgtgaagccgaccacccgcctggtccgacaccattcccggctcggcggcggcctcagggccagctccgtcgccgtgaacggggaggtggggctgagaaacaggagcgggaagaaagaggacgcggtgaaggaggagaaggacagaggactggagcccctctacgacgatgggttcgggggtgtgaccgtcaaggactacttcgctgccgccagggccctgtgcaaggacgacggagggccgccgcggtggttcagccccgtcgagtcaggccagccggcggtggaggacgcgcccctgctgctcttcttgccaggaactgatggtgttgggatgcgcctcccgttgccccccccggctttgggcaaggcctttgaagttcgttgtttgcatataccangtaaatgatcgtacaccatttgatgggctattacaaattgtcgaaaagtctatccaatatgagcatgatttatcaccaaatagaccgatatatcttgttggagattcctttggtggatgcctggcgcttgcagcggcagctcgtaatccacacatcgatttggtcctcgtactggtaaacccagcaacatcatttgcaaagactccactgcagccaatattgcctcttttggaagcaatgccaagcgaccttcatgttacagttccgtatcttcttagttttggtatggctgaccctctgaagatggctatggttagcattgagaacaacctttctcctccagaaactcttcaaaagctgtcagaaagtctcacttctttgctgcctttgctttcacaattggcagatatcataccaagggatgctcttttgtggaagctcaagcttcttaagtcaggagcagcctatgccaactctcgtcttcatgctgtacaagctgaagttctgtttcttgccagtggcaaagacaatcttctgccgagtggagaagaggcagatcgactcttcaaggcactgaaaaactgcag

SEQ ID NO: 5538 - DNA, 1063 bp, Triticum aestivum
  Clone ID: PAT_TA_5538
aactgtgccaccgagaagttgtttaagagttttcttggccgtggtgattcaataaatgagataagaactcaaccattgaagccttcgctcttcatttctgcaagcaaggatgagtctgttaggctatggaatgtccatacaggtatctgcatcttgatttttgctggaggaggaggtcacgcgtccgcccacgcgtccgtggacttccacccttctgatatctaccgaattgccagttgtggcatggataatactgttaaaatctggtcaatgaaagaattttggccatacgtggagaaatcctttacatggactgaccttccatcaaaatttccaacaaaatttgtccaatttccgcttatgacttccgtggtgcattctaactatgttgactgtactaggtggcttggtgacttcatcctgtcgaagagtgttgacaatgaaattgttctgtgggagccaaaaataaaagagcagggtcctggcgagggtagcattgatgttcttcagaagtaccctgtgcccgattgtgacatttggtttatcaaattctcatgtgattttcacttcaatcaattagcaataggcaaccgcgaaggcaaaatctatgtgtgggaagtgcaggcgagccctcctgtgctaattacccggctgagtagtccgcaatgcaaaatgccaataaggcagactgcagtgtcgtttgatggaagcacgatccttgcctgcggcgaggatggcagcatataccgctgggacgaagtggaacatcaagctgcaaaaaattgaagcaaccgaaaacccccatgccgtgggaccccatggcaatgccagccagtttgagcttgacttgggggtttgttgtgtgcttacttagtcggttgtacccatcagcctttagcccagaagctgggggaatgagcttacaatgttttaagttaggatgttgttgactcgatgatttgatggatgtttccgtttattaggttggctgtatcatgtaccgaatgtgggagttaaacttaaatcctcgttcctactagtttgttctgtatcaaaaaaaaaa

SEQ ID NO: 5539 - DNA, 879 bp, Triticum aestivum
  Clone ID: PAT_TA_5539
gaattcggcacgagggtccagctgcttcttcgaggagatcaccaacgtgtccgccttccagaacgtcatggatctcaacttctggggcgcggtgtacccgacctacttcgcgctgccctacctgaaggccagccgcggcaacatcgtggtcaccgcctccgtggccggcagggtccccgtggcgcggatgagcttctacaacgcgagcaaggccgcggtgatccggttctacgagacgctgcgggcggagctggggccgcacgtccgcgtcaccatcctcatgccgggctacgtcgtctccaacctcaccatgggcaagggcgtgcagaaggacggcaacgtcggcttcgacgaggacgcccgcgacataaacgtcgggccgctgccggtggggaggacggagacgctggcggaggtggtggtggcgagcgtgcggcggggcgacagctacgtgacgtggcccgggtggtactggccgttccacatggtgatgtgcgccgcgccggagctcgtcgactgcttctccagggccttctacgtctccaagtccagcgacaaggacggcgacgcgctcagcaagaagatcctcatggccgtcggcggcgacaagttctaccccaagaacatccgctcctcccagccccaataagtcgatcatgacacagagctaagccagccatgcacgcagaaaacgtatgctggcttggtttagcaccaaagtatagcagtggtgtacttgggtctcttcttttcttctcctctctcgttttttcttcttcttttctttcggtgtgatgtgatgtgagtccatacgatgtgagatctgttgttgtattggtggtacacgacacaggcggtgttgcaaagagtggtgcttct

SEQ ID NO: 5540 - DNA, 1316 bp, Triticum aestivum
  Clone ID: PAT_TA_5540
ttttttttttttgatggaagaaataacgttcataaaaaataaatcagtagcagatagaaaacataaacgggccaacaagaacttgtagtatcgaacaaccgcatttgacattgccaactgacggcagccaccctcgctagccgcctaggccaccgacggcacccagtcttgcctccaaccggttcctctcatatatcaaagctgttcctctccaaatgctgcgagtccatcaactgccgtgcaagtacaaaagagcatgacgaagtagttatatatcaaaaccgttcctctcaaatgcggcacgtccatcaactgccatgcaactacaaaagagcatggcgaagtacaaatttccaacatagttcttgtgtgccgaaaactatccatctaccaggctattaacgcttgtgctacaagcgaacttgtcaaaacttgtgcttttctgagattgtgatcatatcaaaatccacctgatttcttttgtagaatttcctcaaatctggtttctgagattgtgatcatatcaaaatccacctgatttcttttgtagaatttcctcaaatctggtttctgagactgacaacatctggttcagaatcaacctcaccccacaaccagtcatctgagcataccgaggttttatcctctgctctaaactgtacccaaagtactgtggaaatttcacgagttcataccttgggtaccccatcgtcagaaaatattcatatttgggaatcaaattttcttgcaagctgagagtgtgaataatcccaaatctatttaccataatgcccaatttcctcgatgctgaactccctctccaggaaaaactctgtgatcggcttcagctttgactctatgttcaaaccaaaagcctggggacatttctgaataagagatgcagcatctgcgccgatcgaccggaagtagtcagcagttggtctgaggttgtcattgacactgtagctcatgagatgaggacatcgtgtgagaatcttgccgatgttttccttagaaactcctagttcagtaaggtagctcacagttatctccaccttctgcctgctatatgtgagaaatgcagggaaccggcatatcaccttgctccactgagttttgttgacaccaatattctccatataggccatcataggtttcagattatctgtcaagctgattccacatagctgaggcctcttcctgatgattccaggtatgcctgacctcggcacaccaagctcaagcagtagctccaccaggggctttatcttgcgatccacgttgtagtacgcaaatgctgggaacttgcgcacgac

SEQ ID NO: 5541 - DNA, 1012 bp, Triticum aestivum
  unsure (1)..(1012): unsure at all n locations
  Clone ID: PAT_TA_5541
accgcccctgtttggccccgaaaaaccgcccctcccgactcggcagatcgtcagcagagagagaaaccggccaccccgcatgttggcgacgttgcctcccgagtttgcccaggttaaacaacccatccggagccggagaacgtcagaagaatccagaggcacccccgagtttgttggcgatgttgcgcgcgggaggaagccggctcgtcgcccccggactccggcgtctcctcggcccgggcgccggcgagagggctgcgccggggctggcggcggcgggggcgagggcgtaccacgagcgggtggtggaccactacaacaacccgcggaacgtcgggtctttcgacaaggacgaccccaacgtcggcaccgggctggtcggcgcgccggcctgcggcgacgtcatgaagctgcagatccgtgtcgacgaaggcaccgggaagatagtcgacgcctgcttcaagaccttcggctgcggctccgcaatcgcgtcgtcctccgtcgctactgaatgggtgaagggaaagcaaatggaggaagtagtgagtatcaagaacactgagattgcaaagcacttgtcacttccaccagtaaagctccattgcagtatgcttgctgaagatgcaattaaagctgccgtgaaagattatgaatcaaagaaggcgaagctgggagacagccctgcagagaaggctgccgaagcatgaacatgatatatgcttctgttctatgagggtgagaaatggtgtgcaatgttcacaaactccagtgttgtagcatgtatcataaggatgaacacgaacaatttgaaataaatgtgctgtcatgttaggagaagttgtgcatgtatagcagctgctacgaaaatttgtgcatgtatagcaactgcttggaagtcgtaatagtacacttgatgtcatttgcccgttctaaaaaatattcggttctatattgctggttattttggaacaaaaaaaaaaaaaaaaaaaaaaaaaaaaaaaaaaaaaaaaan

SEQ ID NO: 5542 - DNA, 1545 bp, Triticum aestivum
  Clone ID: PAT_TA_5542
ttttttttttttttttttttgcttggtccatatgatacatgcttttgccttgcatactccacctggtcccccttgtttcctttcaccccccgctcccacttttttcggtcatatgctcgtcggcaattggcacttcgcacggccagacttctgtttcgcgactttgtcgctcatgctgctagtggtcgtcctggtaggggggctctgtgtttgcgatctacccttcgcccaacccgaaacatgtccctggtgcactccctatggcacgcttcgtggcttcagggcgggtggacgaccgccatcgcaacggctgtacttctcaaccaatgctagaaggttttctagttattttgatcctccaacatcgaagaattcatcaacaatggttctgagcacaccgtttttggcccaagatatgcaagcatcagaaagttcaggggggaattgtagcagcagcagatagataacaatatgtcattttctgtgcaaattgtagctggttcaacttgttttctttcacccacctatcaagatgcagaagttcatcctagtggatagattgagagaatgtgaaatcttcatcagccaaagcaaaaagttcttggttgataccatatggcaagtattgtgtcttcaggatgtgagaacctctagcatcagaatgtatgatgttccacttgcggtctagacgttcgagcgtggtatagaagggaaacttaagcgcatagtccatctctccaaatagtagcagttggggcgccgccctgtgttgccgcctgagagtacctgcccgcgcggccgcttaatttgaagcattctatacaagattacgtataaatgacacaagtaggatgtgtgtgtaaaacatcagaactcatgtatccaggagcatgggtccgagagatggttgggccagccatctaaatcctgatgtactgacaattcacccaacttttcatggtaatgaactcgcacctgagaaatttggggctgtcttggtcattctaagtttgcagccaaacagaacatacatgacaaaatatgcattgttggttatccaatatttgtccagatgacctgcttactcacaaacctgcatcgtcatcgttgttgattactcggcattgtaatcctagaatgcaaaaacccgattaccatcttgcaaggacttgatcgcctacaaagcagcctggtcataagcaaccaagcaggctctctgtgcacatgccaaaaaaaaaaccttcactccatcgaaggcgactgaagttttacgccaccttcagattcaacaactcaattattccagaaagatgttaggcttgaagagtccttcaaaccgaaccaaaaccaataagcccgcgtgccgacaaacacaagaggcagtttgttaggacggcgggagagacagagaggagggactggtggtgccactgcaggcttagacgccagggctgcggtgtagtggccggaggaacaatccgagttttcgcatccttggatagcaccttccaaacctggagtcggcagtctcttgccttttttttc

SEQ ID NO: 5543 - DNA, 702 bp, Triticum aestivum
  Clone ID: PAT_TA_5543
aatccgcaccccggacgccccaggaccagcagcagtcatgacgccctccgccgtcgccaacctagccggcgcctccccgctgcccgccttcgcgcccagggccaggtccaggcccaactcggccagcccgggcccgttcgggcccgcgccgcgccggctcgccgtcgccgccccgccgcgggccttcttctcctccgcgccctaccagccgccggaggagggctactcctcccgccgggagtacgggctggtccccatggtgatcgagcacacctcccgcggggagcgcgcctacgacatcttctcgcgtctcctcaaggagcgcatcgtctgcatccacgggcccatcgccgacgacacggcctcgctcgtcgtcgcgcagctgctcttcctcgagtccgagaacccgctcaagcccatccgcctctacatcaactcccccgggggcgtcgtcaccgccgggctcgccatctacgacaccatgcagtacatccgctccccggtcaccaccatctgcatcggccaggccgcctccatgggctcgctcctgctcgccgcgggcgcgcgcggcgagaggcgcgcgctgcccaacgccagggtcatgatccaccagccctccggcggggcccaggccaggccaccgacatcgccatccaggccaaaggagatcctcaagctgcgcgaccgcctcaacaagatcta

SEQ ID NO: 5544 - DNA, 447 bp, Triticum aestivum
  Clone ID: PAT_TA_5544
cgaagaacagcggaggaggggaaaacaagggaacggaggagccgtctccagcttgatgggtggttgcaaggtgcaatcctttttgcgttcctgtagctgtctcgttggatttcaacattcaatgcttaattcttacataaggttacaacttgttattctgcggcagacggtttatcactagctaagctgatgttttgctacttgcattaatctgctgctgatgatggatgcaatccttgcttgcttacttatagccatatcacagttgatgttatgtttgtctgaaatcagggtagcccaacataaaggataaacgcggcatatttacaacagtaggcacatttttcgttggcctattggagcaagttgggaatggtataaaacaaatttctaattactgattcttgtatcctgtgttcgataattttagttgcgccttgttgatgt

SEQ ID NO: 5545 - DNA, 1908 bp, Triticum aestivum
  unsure (1)..(1908): unsure at all n locations
  Clone ID: PAT_TA_5545
agaaagaaaaagagccgataaggggggacgaggcgagacccccgcctcgacgtctcgcctcgccctatccgtttcctccgtttcacactctcctccccttccttggtacaagccctcccctgctatttccccctcacatccgaccacaaatccgcaccccggacgcccccaggaccaccggcagcagcagccatgacgccctccaccgccaccaacctagccggcgcctcccccctccccgccttcgctagccggcgcctccccgctgccccccctcccagcccgggcccgttcgggcccgccctccgccggcacgccctcgcccgcgcgccgcggcgccccgcctcctcggccccccccccgccgccggcgcccttctgcttctccgccctccgcgccgcgccgggcccggcgggcacctcccccccccgggggtccgcccccgtcggcagcgcgccgagagcatctcccccggggagcgcgcgcaccggatcttctcccgcccccgctccaggcgcggcgcgtccgccttcctcggcgtcgccgacgagcgggcgtcgcctctcgtcgcgccgcagctcttcctcgactaggccaagacgccgctcacgcccagcagcttcttcatcaactccgggggcggcgtcaccgccgggctcgccatctacgacaccatgcagtacatccgctgccccgtcaacaccatctgcatcggccaggccgcctccatggggtcgctcctgctcgccgccggcgcgcgcggggagaggcgggcgctgcccaacgccagggtcatgatccaccagccctccggcggggcccagggccaggccaccgacatcgccatccaggccaaggagatactcaagctgcgcgaccgcctcaacaagatctacgccaagcacacgggccagaacatcgacaagatcgagcagtgcatggagcgtgaccttttcatggaccccgaggaggcgcgcgaatgggggcttatagacgaggtcatcgagaaccgcccggcctccctcatgcctgagggcctcagtgccgttgacccgcctcaccacggtgggggcgccggcgccaacggccgtggcagggacagggatatggaggagccctccgcggtatgaggggtggccaggcgacaaaggtgaaacctttttctgagtccggtggctatgttgtttgttgttagatctaagttttgattcctaatacaacaggtcaacttggtatcctcttcctgttgtttccaattgcctgaactgagctattgccgatatttattgcaactcgtaaaaaggaatttcgttcctttgatactgataaattgatagtgtggtgaatatcagttatacgatcaatttcaagtcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcgccccttttaaaggacccaacttaaccaccccggccttgcaacgcaaaactttttttttggggcccccaaatttaaattaatggcccgccttttaaaaacgccgggacgggaaaaacccgggggtgccccacctaaacccccttgaaaaacacccccttttccccncttgggntattaccaaaaagcccccccccaaccccccttcccaaaatttccccaccccgattgggaaagggaaccccccctgtacgggccctttaaccccccggggcgcgggcggtttccccccatgnnggcccgttacctttgccngnccccctacncccccgtccttcccctttctcccccttctttttcccccccttccnccgcttttcccccgncgccccnaaacccgcgcccccctttaacgcccccc

SEQ ID NO: 5546 - DNA, 1983 bp, Triticum aestivum
  Clone ID: PAT_TA_5546
cgcctcccgggttcggctcgagctcgggcccatctcggctccaccctgggctcctccgctcgatatgcaagctcacttgatttcccctgacactccacgctcaatctttgtttacttccggggacttttctatgacactgggaacgaccctgagggcgggtactatgcaagaggtgcgcgagcttcgctatgggagaacttcaagagcaaccctctatttgacatttccacggaccaccctgccacttactacgaagacatgcaacgtgctgtcttctgcctctgcccattgggctgggcaccatggagccctcggttggttgaggctgtggtctttggctgcattccagtcagcattgctgatgatattgtgcttccatttgcggatgctctgccacccaaggaaattcgtgtatcgaattcccaaatccaatctcatagttaattaaactcggctctgggtgccggagacccggcagggcggtgccgtccacgatgggatcgaaggcggtatggctccccgtggccctgctcctggcggcagtggccctctcgtccgtcctgacgccgccggccgccgcggccgctacggagtccggcgaggccgaccacgccgttcagcagcacagcgagcgcatctcaggaagtgctggtgatgtgctagaagacaatcctgtgggaaagttaaaggttttcatatatgacttgccaagaaagtataacaagaagatggtcaccaaggatccccggtgcctcaatcacatgtttgctgcggaaatattcatgcatcgtttcttgctctcaagtgctgtgcggacactcaaacccaaagaggctgattggttctacacaccagtttatactacatgtgacctaactcctgctggtcttcccttgccattcaagtcaccacgggtgatgaggagttcgatccagtatatttcgaataaatggcccttttggaaccgaactgatggcgcagatcacttctttgttgtcccacatgattttggagcttgcttccattatcaggaagaaaaagctattgaacgtggcattctcccattgctgcgacgtgctacattgggtgcaaacatttggacaggagaatcatgtttgcctgaaggaggggtcgataaccattccaccctttgctcctcctcagaaaatgcaggctcaccttattcccccggacacaccacggtcaatcttcgtttactttaggggtctgttctatgacaccggaaatgaccctgagggtggttactatgcaagaggtgtgcgagcttccctgtgggagaacttcaagaacaatcctctgtttgacatttccaccgatcaccctgccacttactacgaagacatgcagcgcgcggtcttctgcctgtgcccattgggctgggcaccatggagccctaggttggttgaggctgtggtctttggctgcattccagtcatcatagctgacgatattgtgctgccatttgctgatgctatcccatgggaagaaattggtatttttgtggaggagaaggatgtcccaaagttggacacaatcctgacatcaatgcccatcgaggatattctaagaaagcaaagattgcttgcaaatccatcaatgaagcaggccatgttgttcccacagccagcccaaccacgagatgcattccaccagatcttgaatggccttgctcgtaagctcccacaccctgagggtgtatacttgccacctggcgagaagcatctcaactggactgccggacctgttggagatctgaaaccgtggtagggaagagttaagagcttcccatcctctttgccacataggccccatagaaatagttcatacttcctcttacgtgatgtaatagaaacacagtgccacgggtgtaaattacacccaaggcgttatctaacatgagcaatttctgaagttggtaatctagaaagaaatgaaatggcattgttcttaaaaaaaaaaaa

SEQ ID NO: 5547 - DNA, 766 bp, Triticum aestivum
  Clone ID: PAT_TA_5547
atgataacagcaacatatatatatctttacctaataataaagcaaactgggtttctggtcgtccgtcatccacttttacagaaaacaccctgactttactgataatcaacccgcaatcctattatccagtcaacctgaaccggtccgggcaacagaaaagaaaaaaaacacccgagccccacgaccttgcctcccatccggcctgcgccccccccggccgcccccccccacccgccccgcccccgccgcccccgcccgctccttccgccgcccgcccccgctgccgggcccccccgccgctcctggccgccacgcggatgtcctacagcggcggcgcggtcggggctagtcccgcccggggtgcaggccaagctgcgccgggtcctccgcctggtcgacgggcgcgccatggaacgggtggtggagcgcgcggcagcggccgcgccccgcgcccgcgagccgggcccgccggtctccctggacttgctccggttggtggcctggagcatgccggggcgagacggacaacgtgagtcgcgagcaaaggatgaagcaaggatgagcgccgcgggatcggccgggcctctgggggcatgtcgcaggtggcggaggctgtgggcggggccgtccgaaacggatcggaggcgaggctgctggccggatctggagcgcgccgatgactggggcgggatggccagatcagacccacggcagaggagcttccatggcgcctatgggttcctcaccgataaggcctcgtccgaat

SEQ ID NO: 5548 - DNA, 761 bp, Triticum aestivum
  Clone ID: PAT_TA_5548
actaggaagtcaatgctaactttactttgagcattcttgtaagtaaagcttcaggaatatgaagatagcttcaaaccgatacaagaacacaagctgagctgcaggcaccggggctctcttgatccctgagcggtctctcaggggcgctggacgctgtggtcgcttgactacgaaaaacttatctccccatgagattaaccaatcccaattaaaacgtgaatatgaaaattaggctagaataattataggtaagaaattaatggggtggcactaataagaagagaaatattagctagtatcacagtacagagtcacatcacatgttcaatttatccccggtgccacctctcttcatccatggaaggctccccgcttctgaacaatcatctgagccggccggtaacttgcccttcagattagaccactgccaaatcttggacatggagaagctctcccctttgttccgtgcgcaaattttctttccctccataatgtcggcattcacacaacttatacccggaggtcttgttctcatcgcaccatttcttcttcggcccggctggagagccacctgaagctcagaagtcccaagaacatactggtaggtgcccatagagaagcatttccttgcatccaaactgctgctgctactctctccttcctccctcctcagcacagcagaatcgccgtgtccgccttcaacagcaccctgggtgcccacgttcttgaacttgccgagcctcaccgggaacactcttttc

SEQ ID NO: 5549 - DNA, 993 bp, Triticum aestivum
  unsure (1)..(993): unsure at all n locations
  Clone ID: PAT_TA_5549
gcaggnaattcggacgcgtgggcggacgcgtgggcgcgccagcccgcccgccgcctcacgcgctcctcccggaatcgcgcaccgccgccgccatctccgccctcgacaccaaccccttgctcgcagccacagcgtgaggcaggatgaggaagctcaagttccacgagaaggaagctgctgaagaagtccaatttcctcctgtggaagcgggagggcggccaccgcgaggccgccgttacgcagcgatacagcctcgtcgacagggacgactacaagaagtacaacgggatttgcctgatggcgcagaagctcgtgaacatcataaagcagatggatcccagggaccctttcagaatcgagatgacggacatgctgatcgataagctgtataatatgggtgtaattccaacaaagaagagcttggttaaatgtgagaaactttcagtgagcgccttcgccaggcggagacttgcaacaattatggtgaagctcaagtttgctgaacaccttaaagaggctgtcacctacattgaacagggccatgtgcgtgtaggcccagagacggtcaccgatccagcctttcttgtgaccaggaacatggaggacttcatcacctgggtggattcctcaagatcagagaagaagatcatggagtataatggtgcattggaatgattatgatgccatgatttaaggatatgtcgtgatagtagaaattttgggacgtacattggtccaaagtatcttctcctgtaagattttttaaacctaatatggcaactaaattatctgttgcaagtttacttgtgggatgaaagctgaactgctatagaatgcaaatgccacaatcagttcatacttgtcttctaccgctttaccttgcacatgctgatacagtatcatacataaattttgatgttcagctgaataaaaaaaaaaaacgttctactctgcaagttgattgaattgcttgttgcnaacaaaaaaaaaaaa

SEQ ID NO: 5550 - DNA, 615 bp, Triticum aestivum
  Clone ID: PAT_TA_5550
ggaactgcagcagcacaatattagctcataaagcacgcatgtcaattttaacagggaggtgacagtcttacaagatggatgactgatcacaaagcatggcgatctgttgaaatcaaactcaacatcctctaaaaggtatcacagagcatggcgatcggttgaaatcaaactctaccatcctcccaaaggtgggcgatctccaaaagagagacatagttcaatggatcatatgtatagacgatagatgccgctgacggtggtgtgtctagagacggtgcacatgagagagagaggcaccgcccttgcttgtgcttgaaaaggaaggtgcacatgtcaccttgctggatgtttgggtggtggcgaaactatgattagttcgtcgtgatggtggccctcttgtcagttccaagcatgaagcgatcgtcgtgatggtggtccatctccaagcttgactggtaggatatcatcgtctccgtggatgtactccttcaaattgttctctgcgtatttcaccttatacaccttcaaatttccccctttatattgaaaaccttgttggagaggctatggcttttgcttcttgaatgggcataatactcccagagatgtaattaa

SEQ ID NO: 5551 - DNA, 590 bp, Triticum aestivum
  unsure (1)..(590): unsure at all n locations
  Clone ID: PAT_TA_5551
tttttttttttttttttggnggcanacttgttttcttctctttgtggtgtcatgccggaacatgatcattctatccacatgtacatcacacacctataaaaatctgtacagtttttactccgagtaagagtaggagtgacccggagggagacgctgggaaaacttgcgacgacgccacgcaaggaagacggcacgtcgctaaaggttggagggggaaaagtccaccgtgccggcccaggtgtcagcatgagcccgccggctgctgcggcggcttcgtctgccgcgacgacgcgctgctctcgccaacgccggcgagccccatctctatgtctctggcagcgtcttcttcctgaggcgctgggggcggcgaacgcgccgccacacccgagtagccgccgcagcccgcacgccccgggcggccggcgcttgcgcttgcgacggagtaggcgctgattgaggtgtcgttgtggcgggagcctgctgcggctgcgcgcggccggtgctgacgtcgtcctgggaagccgaagaagagcacgttggtggggaagttggccgtctcctcggctcggcctggnacggcnccggcggca

SEQ ID NO: 5552 - DNA, 825 bp, Triticum aestivum
  Clone ID: PAT_TA_5552
gaagggtcagataacttacatatagacaaccccattatctggagtcactcattgtacatctaatcagtttacatgcatacgagagtgaaagaacagtgtagatcgtcatacagatacaattaagcacaagtactcgagggaggaattcgagcggccgccccgccaggtacgtatagaagttgaattaatcgagtcgagatcgacaacggatgggtcataacgtgtagttgacgtcgatgaagctgaggatctggtggacggcgccgacaatctcctcggccgtgaatctcggctcgctcgtgatcttgacgttgaaggagtagaggacggtctgctcgatggtggtgatgttggtgtggaggatggacatgtgcatctcctccagcacggcgatggtcttgatccagctgctcccggccggcggcgagacaggaccttgatcaccgcgtcctcgcccagcacgcgcacctcgatatccgccaggctcgacttgttctcgcccacctcctcccggagcccgccgccgcacgcgtccaggtcgatcatcaccttggctccggcggcaccgtcaccgttccccgccccggggaacgagaggctcggggagacgtagaacggcggagcctcatgcccttgcggcggcggcggcggctcgtggatggatgccgccggcaccaccggggcggacgcgtcagcgaccggccgtggcgtgtcgccgtacaggcgccgccgcttctgtgactcgaggcactggattagctgctctagctcacgtatgaactctatggctccgcctatgatggatgcttgatctccctgcacggc

SEQ ID NO: 5553 - DNA, 684 bp, Triticum aestivum
  Clone ID: PAT_TA_5553
gattcggcacgagcccatccccgccaggccgccaccatgcgccaatcccgccatcgcccgtcgatccggcgcgcagttccaccctcatctctctccctgatctggcagccctcggccacgacgctgcgagctctggccggcttgacctcgtcggctcgtcacccccattcaataggtgctggacgccgctcctcgggaccgcggcggtcttcttcatgggctctctctcccttcacctcctacgccatgtatcggccccttcctgaagctcctcctcatccgtgtgcccccctgatgtcgccgagtggaccacgcccacacccgcctccgcccgcctgtaccaggccacatcagattctgaaggcggctttgaaagggcgtgagatgatgctcgtcaagactaactgaaaaggatggggagacagtactgaagaatcgtgatctatggcaagggtgttgatgtctatggcgatgattgttatgatctatttggcgacgagcattatgatccatatggtgatgaagggtgacgagtctagtgatctttcttcaagacgttcaacaaagtgaaatcatggggttttggtcaatctagcttatgcataatgcttggaccattatatcttagtttttttttgcattttaaactttctagattgttcatcatgatcaatgtaattctga

SEQ ID NO: 5554 - DNA, 552 bp, Triticum aestivum
  Clone ID: PAT_TA_5554
ctcgcacaaaaccgcatgacccacccctcccgtcggccatggcgtgccagcagtcccgcgcctacgcggccatcctccagcgcagcgccgccgccgccgccgccgacccccgccgcgtcgcctccctccacgcggcgatcctcatgccgggcctcctcgcctgcgaccagttcctggccaaccacctcctcatcgcctacttcaggtcgccgctccggccccgccgccacggcctccgcctgctcgacgaaatgccccgccgcaacgccgtctcctgggccgccgccgtctcggggctcgcgcaggggggccgcccccgcgaggcgctcgcgctcttccgcgcgatgcgccgcgagggggccccgcccagcgggttcgcgctcgtgagcgcgctcaacgccagctcgctcgtcgcccccgccggcggcgcgcacgcgcggcagctctacgcgctcgccgtccggctcggcttcgagtcccacgccttcgtgctgaacgcgttcctcgccgcgatggtccggcacgagcggctcgccgacgccgtgcggctgt

SEQ ID NO: 5555 - DNA, 810 bp, Triticum aestivum
  Clone ID: PAT_TA_5555
gtcccgtagtgcaaaaatagaacttttcagctttcttcaggttcgcaaaaaacgctaaacaaggggcacttagatcattaactctgtagccttgacaaagcttcacaagctgctccaggctcacaaaatgatacataaggggacttcatgtgtgttagctccaagccaaaattgagacaaatttacagatttctccagaagtttctgatcccagaagcaagcgatttcaggctccctactgctcctgtctcgcttgatccctgcacctcggccccgcgggtctgttggctccgaggtacatttcctttgatcactatgtcatgttcagtttgatcagatacagttggttcagttggatcctggaattttttcccattgttcgaatgcaccttgttaacttcagtttccccttgacgattcccaaggtctgacttagtctccagttccaaagatatgggtgcttcagtcttcatgccatcaatttctgcttgtctcgatacagtcaggtcatttgcatctgctgctgcagtacatgaatcttgcttggcaacctcggtttctccactgtaatgagaggagtcttgtgactctagagatcccaatggttgattgttttctatgattgtagcgcccatagcagagtctttctgggagaggagtgtgtcatctgggttcaatgcactgctcccgctttccccgagccttgatggctctgcacatccccctggctgattgttttctatgattgtagtgccctgcccgggcgcccgctcggagaggagtgtgtcatctgggttcaatgcactgctc

SEQ ID NO: 5556 - DNA, 1418 bp, Triticum aestivum
  Clone ID: PAT_TA_5556
cccacgcgtccgcccacgcgtccgccgcagaaccgaccgcttggggctcgaacgagagcctttcctcccccgcggcggcggcggcgcaggtctcgctgataaggggaacacggtggcgtactcctgagaatacgtttgcgtcctccggtagcgggaagaggcaggcaccaccgggatccccttcccctacctcccttacgcctgcagggcctcttttttcttggtggggaggaaaagaaaggaaagccgaggaggagcctcgaggaacttctcggctcggcttcttctccaatcccattcattgcctttccagtgattcccacggcccgcagctagctccgccgtcgcgctaccggcaaagcgagggagatcaggctgggagagggctgcgccccgggcaggagagtcggcgtgcgctcggcttgaaggagacggcactgtgagatggcttcgccggagccatcggcgggcggcgatgcggccagccagagtgctgcggtgcagccgcaccagctgcaaacgccggaggagatcaaggggcaggagatgatgaacaactgcgccgtccggagcgtcctcagtggtgttttggggtgggtggtcttggtgtacttatgggactattttttggagctttggaaaatccaataatgtcagaggagatgacagcaaggcaacaaatagtctaccaggcaaaatcagatgggtatggaaaagtatgagccatgctaagacctttgcagtaatgggcttgattttctctgcagctgaatgcgtcgtagagaaggctcgggcaaagcatgacattaccaattcggcagtagctggctgtgtcacaggaggggctttagctgcaaaaggtggccctcaagctacatgtatcgggtgcgtgggttttggtgccttctctgtggcgattgagaagttcatggaacggcatacttgaatcggtgatggaagcgttgcatccgataaaccaagtgatgcgtctttgtaccaaatcattagcaggattcagcattggccaaagaggttttggttatttttgcaatattcagtcgttggcatgtacccagagatggggtaacctaaatttcaagtcttgcggctatccatccatagcactgagtagctaaattagtctgtagccagtttgatggcatgtacccagcgatggggtatatacgcattttcgctgatgcaatctcgcgccatgtatctgtgtctgatgtctgaatggtttcagagaagtctattttactttttatacttgtgcgtgggcgtggcaatgacttgaaatctgctctggtcttgtaccctgataggctgacaaagtaataatagcattattaagttctctctagtattcaatgcgattttttttctgcgaataaaaaaaaaatgcaattatacaatgt

SEQ ID NO: 5557 - DNA, 1383 bp, Triticum aestivum
  unsure (1)..(1383): unsure at all n locations
  Clone ID: PAT_TA_5557
gcgtgtcgcgccgagtcgaacactgagcgggnaggcnccntaccgtggggccttcccntatgccgcctcgggggttaggcccgcgcctnatnttcgcctgtgccaataccaccgccgcatcatcttcctccactccgtcccgtcggcgcctgcgcctacgcatcccgccttaccagggccatgccaagcccatcggcttctcggcgacggcgatgtgcgccgccggttccctgcccggccctgtcgcgcaggacgacgacgcagtgtcaggatatcgtctccctccaaaggaaattcaggaaattgtggatgtgccaccgaaccccagttaccatctctcccctcgccgagataggatcatgttcctgaaacgtagagctatgcctccgttgtccgagctcgcaaaacccgataaaatacttgctggcatacggatcgattccagctctaacatgaggagtcggatgtccttttatactgggattagtatccatttgctgatggatgatggaagtttgggtccagagaaagtggtccatggatatccagatggtgcaaaaattaattttgtaacatggtcaccagatggtcagaatgtggccttcactgtgcgttatgaagatgaggtcattagctgatgctttggatatgaaatgggagcaccctttgaggggatatcagaatctggagaagctcggccacttttcagacaaacagacataagactgaatgctatttttgagctatttgtgtgggtggatcattctaccctgttggtctgcactattccttcatcacgtggtgattctctgaagaagccattggttccttttggtccaaggattcgctccaatgagcagaacaatgtcatccagatgagagccacaaaagaaatgctgaaagatttgcatgaggaagaattgttcgattactatgcaacctctcagttagtactggtttcgttggatgggatagtgaaaccagtagcttcccctgctatatatactttccttaatccttcaccagatgaaaagtacttgatgctcacctgtgttcacaagccatattcttctatagtctcgtataaaaggtttcccaagaaggttgagttgtggacagttcatggtagatttgtccgcgaactttgtgatctaccccttgctgaaaatattccaattgcagccaacagcgtccgtaggggaaaacgtttaatcaggtggaggcctgacatgccttctaccttatattgaaggatctcttggtgctatggattgcatgcactggtatatgaatattggcacaagacacgcagaacaagaacatgggtcatctcccctgattgcaatgatcttagcccacgattattatttgatagatcttctg

SEQ ID NO: 5558 - DNA, 972 bp, Triticum aestivum
  unsure (1)..(972): unsure at all n locations
  Clone ID: PAT_TA_5558
gaatgcggctcgtcctacattatatggatgctgtgtattggtggaagagattgtacaaagaccctcaaagctagtttcgatgctcacgaatgagaaacctgtatttccacgccggagtcgttatgtagtaaccacgccacggtgttattgcatcctgtctaggctgccattctttgaactgcattttggggtgctgcagagtattcttatggaagaacgacttgaatggctcacggatggtgttagcatgctaacctcattatcgcctgaagaggactgtgaggatggtgatatttgtgaaggctccgaaatcgtaggacaggaactgtattttggttgtacaacagtagaaaaatcctttgaaccaagtgtggaagtttctccaaagcagctctctgacacggacaacaattctgagtatagggagaaccaactggatttcatctcccaagaagtccaacaggaaagtggttctcctgtcaaagaagaacaaaatgttcttgtaacaggaacagctactcagtgttataccgcagaagagtctgacaattctgtttcagaagatacagcgactggtgtatctggagttaagcttgatgaaccggattccttacccatcattccgaatgaatctgataccaaggaaaattctcatgttctttcacatgaagatgtgaatgatggagaacttgatatctttgtcaatgatactatcttgccgcttatacggtctcgccttagtgaaggatctgaatcatcaccaagttccaagacttccttcngaaagcatanntttgagaaatgataccccgacttggacttgnggagccanctcnatnggcatggagacgtantcggcacaacagtnnatgcaanggctagggcaaaagtaggtcctaaaagtggcggnaatccanagttgcatgtccngtcagggtnaacacttatttcaccgtgggngcngcgntcatg

SEQ ID NO: 5559 - DNA, 1023 bp, Triticum aestivum
  unsure (1)..(1023): unsure at all n locations
  Clone ID: PAT_TA_5559
cggacgcgtgggcggacgcgtgggccgacttgcgggtttttttctgttttttttttttgccagaatgcaagcaaaaatttgatttcattccatagtaccagccgattcatcatatgtgatgcagctaagatagcgacctgaccatttcgagtgccatactagcatgcaaatagaggatcaacaccgaaaaaagaaaaagaaaagtgcactccttcaatggcccctggcagcatagatcagggagattgcggccaccatggtggtggtggcggcatacacccacgcccagataccacccttgttcttcttctgcgcttcagtcactgcgagctgcagctcgtcagcctcactggtaagggcctcgatcttcccattcttttccttcaatgcaaacctcaactctccatcctcgctgcagcctttttaccatcagttctccagtgccttgattttagacatcagcttccctgcttcagccttctcagcatccagtgctttctgaactgaattcttctcgctctgcaggcgtgactgctcggtatcaagttcatcacatgatgtttggagctgtgacatggaaacatggagctcctccaactcagccctcagcttaacggtctgagcatccttctcacgtgtcaccccctcggctgcctccttgtcagcctggatttcctccaccttcctcttgaggctctccaattccttcacgatttcagtcttctcagcatcgaatgccttggaagcaacctcctttgccttcgccaacacacccaattccaccctgagcctctcaacctcttctgcagacatgctgtgtttcttctctgcttcagcaacctctgattggagcttatcacttttgcccttcaacaaatcaagctccctcttctttgccattacttcagcctctaatccccctgtcttagtcacagacaatgcgagctctgtttccaaagaggccacccttgcatccatctcagccttctggatcccagcaccttcacctcgtancgaattcct

SEQ ID NO: 5560 - DNA, 1279 bp, Triticum aestivum
  Clone ID: PAT_TA_5560
ggcgcgtccgcctccccaagcccgcacccagacgaaatccctcgctagggttttactcgccgcgcccccgaccccaaatccaccccgaaactaggtcatccatgtctggcggcgggcaagcagcggtctcgttcctgacgaaggtcgcaaaggtggctgccgggttgggcttgacggcatctgtcgtctccacgtccctctacaccgtggacggcggcgaacgcgccgtcgtcttcgaccgcttccagggcgttctcccggcggtcgtcgccgagggcacccacttcctcgtcccctggctccaggaagcccttcctcttcgacatccgcacgcgcccgcacagcttctcctccacctccggaaccaaggatctgcagatggtcagcctcacgctccgcgtcctcgcccgccccgatgtggaacgccttcctgaaatcttcaccaacctcggcctcgactacgacgacaaggtgctcccctccatcggcaacgaggtgctcaaggccgtcgtcgcccagttcaacgcagaccagctcctcaccgaccgtccccacgtctctgccctcgtccgtgaagccctcgtccgccgcgccggcgagttcaacatcgtgctcgatgacgtcgccatcacccacctcgcctaacgggccacgacttcgcccaggccgtcgagaagaagcaggtcgcgcagcaggaggctgagcgctcgaaggttcctcggctgcgcggtgcaggaagctcgagatgccgtgctggctatcgttgcgcgcgggaggcagacgagcgagttccgcacggcgcatctcagatgcccccgctgttgtaggcaatgggccaacgcagctcatggaggaggccaggctgagcagggggatagcgggggtgagtgcgcagtcagccgatgtttccccacatccccccatcgtcgacaacggccccgctgctgcttgggctcagcactgccccggcgaatgcattgccacttatcggccactggggcattagtacttccgtcccatgttttaccacacctatcttacttcttgcaatataatacttggttttgattgacaatgatatggatatctgaggcagtattttatgattttatcgtatgaatggagacttcttagtatggaggagccatttaacaattgttgtatttatgtcgccaacctgttttgtcagggttaagctttgatggttgtgttgaatttgcatgctagttacgcacttatgcttaaaaaaaaaattatgactccgaagcaactaaaaaaa

SEQ ID NO: 5561 - DNA, 1145 bp, Triticum aestivum
  Clone ID: PAT_TA_5561
ggacgccgctgggcaagcggcgggaagtacgatacgatccgaacgcgtctcgcctactctgcttcctctgctccccggctagctagggtttgctccctcgccgccggcgcgcgtggccgtctgaagcagatccatcccatcccaggtttttgtgatggctcccgctattgaagcagcagagaaggtcaaggtggcaagcgcacctgttaaggctcctgttcttaatgaaagaacactatcatccatgacccggagacctggttcagcgcattcttggcatgatcttgaaataggccctgatgcaccaactatcttcaactgtgtcattgagatacctaggggcagcaaggttaaatatgaacttgacaagaaaactggactgataatggtggaccgcgtgctttattcatcagtggtgtaccctcacaactatggattcattccccgcacactgtgcgatgacagtgatccgatggatgtgctagttattatgcaggagccagttgtgccgggctgtttcctccgtgcaaaggcgatcggcctcatgcctatgattgaccagggagaagcagatgataagatcattgcagtgtgcgctgacgaccctgaatacaagcatttcaatgatatcaaggagctcccacctcaccggttggctgaaatcagacgcttctttgaggactacaagaagaatgagaacaaggaggtcgctgtgaacgactttctgcccgcgactgctgcttacgaggccattcagcattccatggatctgtatgctacttatgtcggtgggaggggcctgcggaggtaggctgctgcctggaggttcggctcgacgcgctgctccttgtcgtcggggccgggacgatgttggcgaaaaccggagaatgagacactgtcaccttacgaactaagtactgttattttgttggtgttggcatatgtaccactggttcttatgaccttgaatgtactagtagttagcacaagaaagagtggcgcaatattcttttgtggcctcggtgcccctatgttgttaccttcatgttgattctcttgacgattcaagtcaggcataaaaaattcgttgtcaatttctcacggtcagataatcaagtatgtcaggctgctgattcctttacacc

SEQ ID NO: 5562 - DNA, 610 bp, Triticum aestivum
  unsure (1)..(610): unsure at all n locations
  Clone ID: PAT_TA_5562
cctctccgctcccttccccccngagctgccggcagcctcctcctccggccgccaccgctcgccagccgcctataaatcctccgtctcgccgcacccctcctcagatctccacgcaaaccgccgctaccgatactcgtcctcctcacgcacgcgcttaatcatcttcttctaccaccttcttgcttccactaccaagagaccgggagccgagcagagctacccaagaacctgtcatcgcccatgtctgtgcaagtggcctcgccggcgacggcaggagagaggaccatggccacgacggcgtggccgtacctggagtacatggcgcagtgggagcggcaggtggagcggcggcagctgttcctccggagctaccacttctcccgcgacgccgaggtctcgccgcgcgcgcgcacgcgccgcgtcgtctgggccggggcgcgacgcctgcgccgcgccgccgcgaaggggctccgccggctccgcgcgcgcatccgcctctgcttcggctgggccgcgcccgcgctccgccgccgctcctcgccccgccggggcggcgtccacgggttccgctacggccgcatcccccgcggaaaggcgccgccggccgccg

SEQ ID NO: 5563 - DNA, 748 bp, Triticum aestivum
  unsure (1)..(748): unsure at all n locations
  Clone ID: PAT_TA_5563
gcacgaggctcgcttccgaattcggcacgaggccacttcgtccttccgcttcttcccccgaagcccgaatcctctctctcctccccgtcataaacagggacctcaaacaagttctcttgtacctccgcgcctcctcggatttgatttcttcgttcgttgcggatttccctcccgtctgagtactaatttcgctcggtttcccaacaaatttcgatatccatgctccacgtcaggctcgctcctgggcctgcaccgcgtaatttatctaggagatgggattccagcgcatacctacatagctggtgttccgttccttgtccaagcaggctcagtctctcgagggcatattcaattaaatcttcttcgattggtagcgccacgggactttgtcttgggcaatgttgccgcatcaagcctttgtcctgcaaatgcaagctaggtaggtcttctcagccgccacctgactcgaggcaacattttagtgcatcttcatccgcatcagaggcggttctcactgcgcagtccgatatccggaaactttttgttgccaatgagaaaatcggcgttctgctgctaaaccttggaggcccagagacccttgatgatgtccagcctttcttgtttaatctctttgctgatccggatatcatccgtcttcctnnngcgttccgctttctgcagaagccgctagcacaattcatttctgttgcaagagcgccaaagagcannnnnnnnnatgcatccatag

SEQ ID NO: 5564 - DNA, 1763 bp, Triticum aestivum
  Clone ID: PAT_TA_5564
tcgcgggccgcacgcagttgccttgttgctttctccttctccaagtaaactcagtttccacagctccgccgcgccgccgattcgccagccatgccgacggtatgcataaaatggcagaagcaggtatttccaggcatagagattgatactagccagccgcctatggttttcaagacccagttgtacacactgactggtgtaccccctgaacggcaaaaaattatggtgaagggtggaatattgaaggatgacacagattggtcaactttgggacttaaagatggtcaaaagttgatgatgataggtacggctgatgaaattgtgaaagctccagagaaaggccccgtgtttgttgaagatttaccagaagaagagcaagcggctgcattggggcacagtgctggtctctataacttggggaatacatgttacatgaattccactctgcagtgtctgcattctgttccagagcttaagtcagcattactgagttattcagataatgtgaggggcaatggggtggatcaagcatcccatagtttaacagttgcaactcgtaatactttcggagagcttgatcaaagcgttcgaccagttgcacctctgcacttcttacagatgctgcggaaaaaatacccccaatttgctcaacagcaaaataatgtttacatgcagcaggacgcagaggagtgctggacacagctgatctatacgctttctcaaacacttacatcagaagcaagtgaacctactgctgctcagatgaaggaacttttcgggattgatcttgtgagcagggtacactgtgcagaaagtggtgaggagagttcagaggcagagtcggtttattctctgaagtgccatatatctcatgatgtaaaccaccttcatgaaggactgaagcatggtttgaagacagaacttgagaaggtttccccatcactgggccggactgctatttacacaagagagtcgagaataaatgagttgcctaggtacttgactgtgcagtttgttcgtttcttttggaaaagggagtcaaaccaaaaggcgaagattttacgtaaagtggattaccctctggagcttgatgtctatgacttctgctcggatgagctgaaactaaaacttcaaactcctcgacaggtgctgagagatgcagaaagtgccaggtttggtttgaaagtagaggtgaaaacaagcagctcacagaatatcgaggggtcatcaactagtgctggggaatcatctagcatggacattgacaaagctgattcttctgtgccaaagaaacaattaactggcatctatgatttaattgctgtcttgacacacaagggaagaagtgcagattctggccactacgttggctgggttaagcaagatgatggaaaatggattgagtttgatgacgacaacccaagcatacggaaggaggaagagattttgaaactatctggtggaggcgactggcacatggcatatatctgcctttacaaagctcgtgttatctgaacctgagttgataagttctcagccgaatttgctttatatttccaaagttgtgtgcattccttgcctgtttttgtgtgccacatgagcggatgtattaaagtattgatgaattttccagtttggttcaaatgaagtgatcagtgtccattctgatgttccttgtctactagaatatttatcagcactcaacaaatatggagaaagatttgtttgattttttatttaaacattatttatttcctcgtgcc

SEQ ID NO: 5565 - DNA, 703 bp, Triticum aestivum
  unsure (1)..(703): unsure at all n locations
  Clone ID: PAT_TA_5565
gaattcggcacgaggtcgtgtgtctcgcggtctcctcccctccccccatggcctccgccgaaatccccaacgccgacaccgcggaccccaaccctagccccaaccccgccgcccgttcgccgtcacctccgctccctccgcgcaagcgccgcctctccctctccccttcacggtccacctcccccaggcgctccgtgtctcgctcccgctccccccgcgaccgccgtagccgcagccggagccggagccgtagccgcagccgcagccgtagccgcagtcgcagtcggagccgtagtccgcgccagcccgaaggcaagcggcggcggcaaaacgacctcaccgtcgaggcgtgccgcgactacctgcgcgacaggtgcacccgctccgacctcgagtgcaagtatgcgcacccgcaccaatccgtttccgtcgaccgggactccaaggtgaccgcatgcgccgattcgctgaggaacaactgcttccggggcagaacctgccgctactaccacccgcctcctcatatacaggagtcgttgctgagatcaattggtttggacgtcccacaggtgaagacggtttgcagagatttcgcacgtgggcgatgttcaagatcagcaaatgagtgccgcttcttgcaccattcatctgttcaagagtgtgcaattgtttgccaagatntcttgcgtggnnnnnntgagnn

SEQ ID NO: 5566 - DNA, 1042 bp, Triticum aestivum
  unsure (1)..(1042): unsure at all n locations
  Clone ID: PAT_TA_5566
ataataacaaaaaatactccatctaacctctcgacgtaaccaatctgtgttagttgaaaggacagttgttcttggataagttccaggaaaaagttcaacatactttcttggactatatttccagtgggtttgagctcaattttatggtggctgtagattttactgcttctcggcgcgaccctcgcgtaccacaatctttgcactacattgacccctctggcagaccaaactcataccagcaggcaattctaggggtaagcgaagttctacagttttatgacaatgatagacgattccctgcatggggttttggtgcaaagataccacgaggatctgtatcccactgtttcaacttgaatgcaagcaccaatgactgtgaggtagttggagttgaaggcatcatgtcagcgtactcttctactctttacagcgtttctctcgcggggccaaccttgtttgggccagtgatcagcaaagctgcagaaattgccagccattctgtgcaatatggaaacaacaaatattttgtcctgctcattatcacggatggagttatcaccgaccagcaagaaacaaaagattctattgtaagggcatcagatttgccattgtcgattctcatccgtgggagtccgggaatgccgatttcactccaaatgaggttcctggatgcggacttcggtaagcggcttgaaagctcaacaggcanggttgcgacgcgcgacatcgtccaattcgtccccatganggaatccaaacaagtgggcagtcaccgttgtccaananctgctggaggactgcctgggcagttctggagtaatgcgcaccgggacataagccgcacgcccagcangcctancgccgcagccaccctctctcccantgtaagaanccgccggccgaccaanagctggncgcctactncactgnantgnaatccgcgcacngctncaancccgnntcgtcncaaccactagnacgaccctaaactttcncatttactccgaaancctaataaancccctgttttccaaggnagtgg

SEQ ID NO: 5567 - DNA, 604 bp, Triticum aestivum
  unsure (1)..(604): unsure at all n locations
  Clone ID: PAT_TA_5567
gcacgaggacaccggagaaccaccccacgaaaaaaatcccccgagaataccaaaccgaactcagcaacctccaccatgtccatgtccatggccaccaccgccctcctccggctcgcgccgctgccgccgcacccccgcctcctcgccccgacctccaagaagcccgccctcctcgcgcccctcggcagcggccgccgcgccctgcggctcgcgagggccgccggcgacgggctcgcggaccagaccgtctacaacggcgtgtacgggccctggtccgtggacgacgccgacgtgcgggaggtgctgctgtaccgggccgggctggtcacggccgccgcctccttcctggtggccgcctcgggggcgttcctgccggaggggaacgcggtcggcgacgccgtccggcggggcgccgacctcttcttcgccgccggggccggggggctcgggctgtcgctcgtgctgatccacatctacgtcacccccatcaagcggttcctccaggcgctctgggcgtcggcgcgtgctcggctccgtcggcacctacgccctcgccgcgcggccgcnnnncgaggggctcgtccggtacgtgctcgacaccccg

SEQ ID NO: 5568 - DNA, 714 bp, Triticum aestivum
  unsure (1)..(714): unsure at all n locations
  Clone ID: PAT_TA_5568
ggctccggcacgtcccggtcggtgcgtctctccagatctcgtgcggtggcttgctacgaagcgcttcctctcgcgagcttcgtcgccccccgccgctgccgcctcctcgtcccccgccgctgccgcctccgcgggtccccccgctccgcccacggcgggtccccctgaatcggcggcgggggcgaccggggcgcgcccgggcctgccgagcgctctgcccacggttcccccgcttctgcctctggagtccctcaccgccctctccgctccggtccctccactccgtacacgcgcttctggcgctgttggtacggggtttgcgccggtcgcgccggacgggccggtcatgactctcgcgggactcgcgccaatcgcgcctgtcgcacgtgtcactctcgtggctcacgaggttctggctctgctgcctctgcatcatgagaatgtagtgaagttggtcggctactgccatgaagcacaaaagaaagtggtgcanaacaatggaaagatatattggtgcagacattgttgaaagnttactctgctacgagtatttgccccangggaaccttnanaaaatttttttgagggtatcctgtgnaaatgggactggggatacacgcttnaaaancnntnaagggggatctngccaangggtttancctttctngcacannntttaacanttgncccatnannggantctttaaanccttg

SEQ ID NO: 5569 - DNA, 655 bp, Triticum aestivum
  unsure (1)..(655): unsure at all n locations
  Clone ID: PAT_TA_5569
gcacgagtccttcctcccctcccctctcctcacccctcctacacagacgcgcgaatacacttccgcgacaccttgcaagaattgcgagaggattcaagtcggcgtagatagacaagatatagtttgctggttcttgggtcaagctagctagagaccattggctctgccgatttgtgcggcacgccatgtcgcaggaggaggtccacgacgccggcctggcgctgggcctgtccctgggcggcggcggcgggggcggaggcgacgggtcgtcgtcggcgcaccgcggcagcaacagcggccggctgaccctgtgggaggcggagccgtcgctgaccctcagcatgccggacgacaccaccatgaccggcaccgcgtccggcggcgtgtcgtccatgtcggtggggggcgcggtgaagagggagcgcgcggaggaggcggagctgggcgagatggtgtcgtccacggcggtgggtgccgaggaggacgacgacggcagcacgcggaagaagctgnnnctcaccaaggagcagtccgcgctcctggannatcgcttcaaggagcacagcaccctcaacccggtgcgtacgttcgtacgcgcctacccgcgcgtactagtcacgttcgaatcgattcaccgctgctgatagatagnnnn

SEQ ID NO: 5570 - DNA, 1140 bp, Triticum aestivum
  unsure (1)..(1140): unsure at all n locations
  Clone ID: PAT_TA_5570
cgttcgtccacgcgtccgtaggcactggcactgcactggcgctcctcctcccctcctgcaacccatcagtcctcactcatctgtctctccacaccgtctgtgggagtagggagtaccgctcctaataattgatccttcgctctccattccctcgttgatttgttgttactctaaagatcaccaccaaccaccctcccctcccccaaaccctcctcccaaccacaatccaatcttttatcaagaacaaattaaccacccctcaccctttgccccaaaacaatcgtctaatctttggtctccgcctctacattgctcccaaatccaacgtctcgggccctgccgcccctcaaatccaccctttttgtcactccatcctgtcctaaattcccctcctcgcccaaaagccccagcgtttcccactgcatcatcctctgcgaaatccaatcttggccgcctggattgcccattcatttattctctgagggaacccaagctttagcgggctgctctgttcgaaacccgatctctctttagcaccgaattctgcaagaaagccagagttgttgcggagatccgccattcctggttgagccgacgagcttcgccgccgcggtccgatgtcggactcggaccagagcaccgtcgtcttcgggctccacctgtgggagctcgttggcatcggcgtcggcgccgccttcgtgctcctcctcgtcctcctctccctgctgtgccttctcgccaaccgccgtcgtcgccgtcgccgcgcccccgccggccccgtcctccacctcgccaccgtcgcgcccagtgcccatcccaagaaccccaccaagccgcccaaggacatccaagaggtgccctctcgcggcgcgcaggcccccgtggggggcaccgcgcccaaggtgccgctcgctcagattctccangcgtncccgcaagagtccatccagatcgagaccggcagggagcaccgcatcacgttcccggagcagncggcgncccaccatcagcgtaccggggggccgtcgtctcccgggccaagcgccaaagccncngaggtgccccgagcccggcgtgcccgagtcttaaacctgggtggggccactggtcactctcaaggacttaaggaacgaccgcaat

SEQ ID NO: 5571 - DNA, 748 bp, Triticum aestivum
  Clone ID: PAT_TA_5571
gaattcggcacgagcccagacggtcaagagatcaaggacgataccatggagtgcggccgtaggcaatggcaagcgcagctggcggggctcgcgctcgcgttcctcctctttgcgcctgcgttggtgcagtgcgcgggcgccgaggccgacggcgagaaggacgggctgccgtcgccggggaagactgtgccgccggttccgcctgggtggaccggcgactcggggtccgcccaggggtccagccctgacggctccacctggaagtacgagtggggatgggctgccgggcctgttggaaagggctccggtttcggatacggttacggttaccgtggcagcggtgatgcaggcggcgggggccaaggtggtggcagtggcgtaggaagcggaagaacgtttggtccacgcgatcgcggatacggtggatatcccggtggctatggtggcaacggtgctggtggttataatggggaaggagcgtttggcggcgaagatggtggcgctggctggaacaagcgcggtggattccgcggtggagggtggcgttaaaaactgaagccgcctgtgtcgttactctcttagccatgcagagatgcgatcagtatacgtcatggcagaaatcataatgctaataaagctaaagcagtctatatacttctataattaaacgatggtgtacttgtacggttgtaccctacgaatgttgtatatcattgttgcatgttctctcaaaaaaaaaaaaaaaaaa

SEQ ID NO: 5572 - DNA, 690 bp, Triticum aestivum
  Clone ID: PAT_TA_5572
tggaagctaacgcctcattagtgccctcttcaactttaattttcttcccttgttcgccaaagaaagaggtcggcccgaggggggctagactccagcgaattcctccaccatactgtttttccatggatcattccagctgagaattaaggaaagaaatacgcatcccgggcagcgcgcgagtgtgatgcgcgcagccttgccggcggcgcggcggcgatggatttaccgtggctggacctccccttcaccttcctcacgctgctcctggccacccgcctggcgtacgactactacggcgtcgtcgccgccaccttcgccggcagcttcgccctccagatcttcctcttctactgcttcgcgcgctggtaccgccacaccatgggcgcccgcgccgagctgctcccgtcgacgtcgcagcagcacgacgaggggtccccgcccgtcctgaccccgctgctggagacgtcgagcggagctggcgccgccgcggccgcgggggccctgctggccaaccggtgcctggccttcgtgttcatggtgttcgtcccgctcatcatcgtcgtcttcgagcggagccaggcggacgtcgtcgcctacgcgctctgcctcgccaacatagtcgtcatggtcgtctggctctcgccggagacgcccgactcgatttcggccaccaagtcgttcctggggctc

SEQ ID NO: 5573 - DNA, 1050 bp, Triticum aestivum
  Clone ID: PAT_TA_5573
cccagccggaggtcttgctcgcgctgcggcaggagtaactcgagaggcggagccagcggcccgccgggcttcaagtcgcggcgcccaaacccccagtgaactattggagtcaattttcttgaaaggaccatatgttgaaccatcactagcttatcctgatgatccaatagaagaactgtcaattgatgacatagaaattgatgatgaagtgcccctatcccctccgccagcatcatcctctgcttgtcacatgaataagaaagcaacaattcggcacgaggagagcgaaactgtttgaagggtcaagtgatgctgacaaaccaagaatgagaagtacccaagaaattctcaccaaatataagtttggcggggatgcaacagcagcagctgcccatgcgaaggataagctcatgcagcggcaggagaaactcgagagaataagccagcggaccgcagagcttcaagacggggcggaaaatttcgcctcgctcgcccaggagctcgcgaaaacaatggagaacaagaagtggtggaaactgtaacctattcggggttttcacatcactgcatcctatcctacacaaagtacgtccagctctcggtacttgggaatgccttatttgccggttgttatttatcgtggcatggttccgcccattccgccccgcctttgtgctgtgtatatttatgttcatggacaactgcagcttgtcaaggtgattgtctaccttgccactaggttgactcactcactgacagacagacagacagcatggcttgtttggatgcattagcttaggtttatgttgtatatcaccatgtaatcatatgcaccatgggtggaaagcgtggggcggaacctacttgccgtacatgatttcttttgggtggtcattcagtcgttcgttctgtctgtaaaggtaaaaggagacaataaaccgaacggcttacattgagaaacttcaaagagcctgtgtggcattgttagttggtggtatctgatgtgacaccttctcttgactaatacttgaactgtgcctatcaagttgc

SEQ ID NO: 5574 - DNA, 639 bp, Triticum aestivum
  Clone ID: PAT_TA_5574
gagggcgccttctctacctcacctccaccgattggcggtcggcaagaggttatggcggaaaatggtggggctgcccgtgaagcagcaatgctgggatttcacataaaaccagtattctcttattacgcgtaccatggtccaatttttcgagcgatggtacaattatgccatggaaaagaagatggcatcagcaattatggtttcatttgtcattgcaagagttgcggccagtctcagacttttggatttgacgaattggggcagatttcttgcggatgtgcaaatagaacagtaggcccactttggacaggtcctctccatgatcgctcttccattaccgaaatgctaaacttggctgtagaatggggatgggcacacacaagtgagaatggtgtcactttggaaaaacttcttggcaccatgattgaggagagtgacccaaggttaccgcctggatatataagacttgatgagattgccagccgagcaaaagttaactctccaccgctcggtacactcatccattcattgcagaaggaaggttatgctgcttgtagatctcatataggtgccaatgctgtcaagaccaactctcccatcagttcttgcattgtggttgcacgggagatccgaaatttg

SEQ ID NO: 5575 - DNA, 1077 bp, Triticum aestivum
  Clone ID: PAT_TA_5575
tttctggcttgaggtttttttttttttgttcttgagaacaagaattatcttgtattccttactttgtgggcaaacataatgttcacttacaatcgctcgtgtactcaactgtatgtaaacaaaatctagatttacatgagtagtgatataccttgataacactccacactaaacagaaaacatctttacgagctgaaagctcttgaaattgcatagatgaagtccaatagaccagtccccttgagaaggcctttaccagttaaaagttcaaaatctatcaacaatagaaagccaattatggcagcttttccgttgaccagttcattgtaagcagtgaaaccaaaaccccctacaccttcatcaaccaccattctcacctcttcgatgttgacatcagatgcagtactccctggttgagctttcccgctgaacagaatctcagctgatccaccagagctagcagcgcccctaatgctgatgtatatattttctccatccgtttttgcagggtacacgaatagttttctcaatacaggtgtcagagcccttaaaacagggtttttcggataccactcttttatttccccagtgcgaagatcaaaggtactatctgttgatgggcaaacaatgcagccatcctgcgtgagcttggcgttgaggaggccctcggtgtacgcgccctcggctggggagcggttctcaatggcgaagacctcatccttgtaccagagaagcaggatctcctccccgtcctgtacgatcacacggcgctctccccgcgggagcgccgccagcggcaccaccggtaaccagctgctgccccctccggtctctggtggcgccgagggctcggccccggacacatcggtggcacggcaggtgagcctgtagtggcaccggttgcgggcgtggaagaaaaccaggtggctacgcggggtggtggttgttgctggagacgaggagatacgacggtggaggaacgaggaggacgcggttgtggtggtaatggccgccattgggggaatgcagggaggcgtgtgggggcggaggggttagggtggtggaggagggcggggt

SEQ ID NO: 5576 - DNA, 662 bp, Triticum aestivum
  Clone ID: PAT_TA_5576
gaattcggcacgagcggccatggcagtacagccgctgcacttcgtcctggtgccgctcctcgcgccgggccacgtcatccccatgctcgacctggcacgcctcatcgccggccgcggcggcgcgcgcgtcaccgtggtcctcactcccgtcagcgccgcgcgcaaccgggccgtcctggagcacgctctccgcgcggggctcgccgtcgacgtggccgagctgcagttcccgcgcccggcactggggttgcccgaggggtgcgagagccacgacatggtcaccgagccctcccacatcatgctcttctatgaagccgtgtggctgctcgccgggccgctggagacgtacctccgcgcgctgccacggcggccggactgcctcgtcgcggacacttgcaacccgtggacggccgacgtcgcgcgccggcttgacatcccacggttcgtgttccacggcccgtccgcgttcttcctcctggcgcaccatagcctggccaagcacggcgtgcacgacaacgacagcgtcgccgccggcgagttcgagcagttcgaggtgcccgactttcccgggcgcgtcgtcacgagcaaggccacgtcgcgtgggttcttccagtttcctgggatggagaaggaaaaggcgtgacgcgctgcgcgccgaggcc

SEQ ID NO: 5577 - DNA, 411 bp, Triticum aestivum
  Clone ID: PAT_TA_5577
gaattcggcaccctaggcgcaccttagccttctcgctaatctcgctccgtcctccggatacccaccttctctgccgaggcagcggaatctcccccgatggaggcggccgccgtcgcttcctccggctgcgggctgcgctgctcgctttaccccgtcccgaaccagcataggagaggcgctcgcctgggcttagcggccaagaggcagcagcgctgcgccgtcgcttgcgggcggttgctgctccgtccgaacgctcgcgtatacacggcggcatcggcgtcggcgtcggcggtgatagatagcggcgccggggactcccgggtgaggaggaagaggctcgcggtgttcgtgtccggtgggggctccaacttccggtcgatccacgaggccgccctgggtgggaaggtgaac

SEQ ID NO: 5578 - DNA, 1071 bp, Triticum aestivum
  Clone ID: PAT_TA_5578
ggaggcataaacacaaagacttggtggtcaagatttaagatttcagggcattaacagttttctcctcaactggaaagcacagagcatcaaaatagaaaattaaaagccttgtgcgcataaacataaacacttgatggtcagaaattgagattgtgacatgttttccaactttgtgaagaaataacttctccttggatggcgtcagctagaacttgcagaccaaatttcagagcctccactttcgcctcctcagcccctttcacattactgatttgccggccagcagatagaaccacagatcccagatgattcctaaccaccatcccgatgtatgtctggctagtctccgccatgagacctttaccgttatcctttgtcagtgcacactggttgtacctgtgcagaaatttcaccgaggcagatactggagattcccccccgtccgtccgtcccctcgttgaagaagaccctgtgactgcgcctgcctgggtgcgccttctcagcacgtgcatggtagagaaaagttgacccgagaaagaaaggcattacctgcatgttaagaacgcaccatctagaagcaaaagtaataaacctaatctcctgctatgtgcacgacagcattatatatgaagttgtgctatcaaatagtataacagtagcagcctaggtcaccgccattgcggcgggcggaggatcagacggaatcctgcgcggcgaggtcaacgaaggaggcgtgggccggcgaggatctggtcgtggagctcgccgatgcgcacgggagcggcgtggtggcagagatgacccgaccctaggggtccttccaggacgccttgcaccgtgaccccttgtgcttgatcaggatgtgtggtgcccgcatcgtctccttccccccggccgccgccgccatctctcccttcctccgccgcttcgatcccttcgggtggttggctccgttcgctcaggccagcagaggaggagcggcgggcggccgcgacgggaggtgtcggggcggcagcgacgggcgacgacatttgaggaagggagatgggggaggggatcggcggcggctgc

SEQ ID NO: 5579 - DNA, 802 bp, Triticum aestivum
  unsure (1)..(802): unsure at all n locations
  Clone ID: PAT_TA_5579
gaattcggcacgagcctccccgcccagtctcgacagtcaccgccggccgcctcgctctcagctactcgccgccgccgcccccccaccccccacccccgcgtcctcctgttgtctgcttatcaattgaatttcggaccccatttcggattgggaagccgagcgcccccagggccccaaccctaggcaaggtaacccgccgccctctcgccggccgcgacgatgccgagcttccctccgccgggcggcgtcaccgtctgcgagatcaaccgcgacctcgttgtggcggactccctgtcggaggatcgcgccaaggaggcctacggggatgtcctcgggatggtgttcagcccaattcctttccagccggatgatctcctagccaagcacgaggctcctgctccagacgaagctgagctccctgagagtgtccccagaacaagtttggtgtccaccatagccgagtccttcaagcaaatgctcttcccttcttgcaatccaaaactgctagaagaatttgatacccagaaagtaagctggaatccacacaaacactgtttagcatttgtatctgggaaggaccaggttacggtccatgactttgaggattcagatggtaaagaatcgtgcattctaacaagtgaacatcaaaaggaagttaaagctattgaatggaggccaaatagcgggaagatgattgcgttggctgcnagggangtatntgcctctggtcagcatcntattctggcantntttgctcgtgnantctggtntccctcttcttctttggcgctccctagaggtt

SEQ ID NO: 5580 - DNA, 879 bp, Triticum aestivum
  Clone ID: PAT_TA_5580
gccggccgggttgggctcctcgcgtccgaacagacgcagccaacagcgccccctctgaaaaaaaaaaagagaacagcaacgggaataatctcctttcctcctcgtccgcgtgcgatcgacgcggaggcgccgcccgtccccctcccctccgctccgacccgaccccatggccttcatgcgcacctcctccaatgcatcctctggcatgggagttgctcctgatatcagggagacattcctggagcttcagatgaagaaggcatttcgctatgttatcttcaaaatcgaagaaaagcaaaaacaggttgttgtggagaagacaggggctacaactgagagttatgatgatttcctggcttgtctcccagaaaaagactgcagatatgccctttatgattttgactttgttactggggagaatgtgcagaaaagcaagattttcttcattgcctggtcccctgacacatcccgcatccgcgccaagatgctgtactccacctccaaggaccgcatcaagcaggagctcgacgggttccactacgagatccaggcaactgacccgaccgaggtggagctcgacgtcctccgtgaccgggcgcactagggcggatcgatgatcacccgtgggcttcagtcggatgcaaattcatgctgtccgtggtaatgctgttgccgcagtgttgttaataagacagatatatccaggtttcctgtaaaacgtaagagtatcattcagctgttatgcatggctctagctgatgaagtgttgtccgaggtctctactcgtatgatgtcggagcctgtaaacgcaagaaacaccccttgaaaaacgcatgtgttgtggtattaatactggtttgctaggcttggattctcctg

SEQ ID NO: 5581 - DNA, 1027 bp, Triticum aestivum
  Clone ID: PAT_TA_5581
gccggccgggtcgggccccgccccctcgcacagacgcggccaacagcgcgccctctgcaaaaaaagagaacagcaacgggaaaataatctcgcctcctttccctcctccccctccccgtccgcgtgcgagtcgacgcgagaggcgccgcccgtccccctccgctcccccccgacccgacccccatggccttcatgcgcacctcctccaatgcatcctctggcatgggagttgctcctgatatcaggggagacattcctggagcttcagatgaagaaggcatttcgctatgtcatcttcaaaatagaagaaaagcaaaagcaggttgttgtggagaaagacgggggctacaactgaatgaagttatgatgatttcctggcttgtctcccaggaaaacgactgcagatatgccctttatgattttgactttgttactgggggagaatgttacagaaaagcaagattttcttcatttgcctggatacccctgacacatccgcgcatctcgccgccaacgatgctgtacaccaacctcccaaagggaccagcatcaagcaacgagctctgacgggttccactacgcagatccacggcaactgacccgaccgaggtgcaagctcgatgtccctccgcggaccgggccgcactggggcggatcgatgatcacctgtgggcttcagccggatgcaaatccatgctgtccgtggtaatgctgttgccgcagtgctgttaataagacagatatatcgaggtttcctggaaaacgtaagagtatcattcaggctgttatgcatggctcctagctgatgaagtgttgtcccagggctgctctactcgtatgatgtcggagcctgtaaacgcaagaaacacccctgaaaaacgacataacttgcggtataaacaccatgtgttgtggtattaatactggtttgctaggattggattaacataaaaataccagaaattcagggagaaaaaaaaactcgagggggggcccggtacccaattcgccctatagtgagtgtatt

SEQ ID NO: 5582 - DNA, 988 bp, Triticum aestivum
  unsure (1)..(988): unsure at all n locations
  Clone ID: PAT_TA_5582
gaattcggcacgagccacctccctccccactttccgccgctgtcagaccccaccaccgtcgccccacttcctccctctctgccctcgccctgcctagctcccctcgggcaacctcccccgccgccaccacttgggctcgccgtggtgaaaaccagatccagcccccctccccggcggcaacccgcaccggccggccatggatccgactcccccaccaacctgcagcatctgccgatgaatcgagccacctctctaccggctaccttcatccgcctccccaccacgaccactatccacttggcctgattcacgggcgtcgaggagccaggcagtgtcggcggagcaggtggcgggtgagggtgcagcgcggcgcgcgggctactggcgggggaggatggtgcaggaggtgcgctcaggggagcggcaggtggaggtggtcgtcggggcggaggcgccacgggaacccaaggcgaggggcatcgtcgggaaagagcacatgcagctgctcctacgcctcgatggggtgtggggcgccagcggtcgagcttgatggagtgagtctccctgttgccaccaccccctactgatccgttgaccacaagatccccttcacccctccgcctccaggcacgatggcggcctctcgccggcgcatcctctccttcgacatctatccgaggcctgctctcctaggtgcctactacctttcggcagtggtggggattcggcaaagatctgcttcgccacccctcatccctcgttctgtggcatcaaggccgggacgcccagcacagcggcgagggtgccgcangtcaacggcatcccgcccaactctgtcgtgtgcaantgcaacctcgcggtgctgcaagttctggggcngcgggaatgaacaacatgttgtccttcactgacggcgaacantgcagataaaatgtcnttcaagtaattgtggttgccgtgcaattccaagcncatgatggaataacgg

SEQ ID NO: 5583 - DNA, 640 bp, Triticum aestivum
  Clone ID: PAT_TA_5583
ttgctttttttctctgctgccgccgtgagggaaaaccgtctgcggcgcctggggcgccagggtgtagacggccagccacgcgctgcaagcgcctgagccgggggcgtaggatgctccgccggtgggcggcggagctgcagttcaacgggcgtgctgctgcacggcgacgtcggagttccagtgcaacacacatgtggtgggcggaggagctgcagtgcaacagccatgtgccggcggcggagcagtgcaacggccatggtgttgcgcaccgtcggcggagctacagtgcaacacggtggtgagtgatgtagctccagtgcaacggggcgtggtgttctgcgctagcggcggagctgcaatgcaacacgccgatgttgctatggagtgtcgtcgggggccgccggtgttgctatggagcttcgccaggccgccagtgttgtattggagcatcactgacgttgctatggaccgtcatcgaggccgccggtgttgctatggagcattgtcgggggtcgccggtgttgctatggagcgtcttcgggtccgccggtgttgctatggagcgccgtcggtgtgctgtattgccgcatcgccgggcaaccggtgctgtattgaagcatcgttgggaccacgttgtgtt

SEQ ID NO: 5584 - DNA, 732 bp, Triticum aestivum
  Clone ID: PAT_TA_5584
gaattcggcacgagctactgtgagataagactctttgctgctagattacgtaaaacaattcatcaactaccgtatgtctgccttacattcccccacccgtataaaacactctgtttctattagcatggtgaaacttaataatgaaatgagctgagttagtttactgtaagctaaattgactattgtaagctacaaatgtaacactggacaaatccgaacaagaacattgctattacttcaatccaaagtagcgaccccgaatataaagctaaagttgacaatgttacatttggtaatgaattcttggtatttcgggttgatgcagccagattaattatcacattgccatcaacctttctatgttgctcctcctttcaacctttcttgcctactagccccttgctggtctctcttggagattgcaatattcgatgacgcatggctcagatgttggttgcaaggtcaagaataggggtgctactagatagtttcacattgtgcctttgtctgccatttccagtgccaatgtttcaatcattatgtttcggatatttttggtgtcaatatttcgatcattatgtttcagaatggctgacacgttggctgcaaggtcaagaatgagattactactagtttcacatcttgtaatttttgtatggtgtactttgtaatgcaacccaagttgatttaatatatgagaaattcccgtttaaaaaaaaaaaaaaaaaaaaa

SEQ ID NO: 5585 - DNA, 829 bp, Triticum aestivum
  Clone ID: PAT_TA_5585
gaattcggcacgagaatctccactagtggcggcggttgcctcgtccggaggttcagcgcagtcggggcgccgaggccgtgcgatgcggggcggcggctgtgccggttctacggttccaagggcggcgtaggcagcgcggaggcgaggggcgccggggcagcggaggcggcggcagggagcagcggacggtgcagcgagcaggagcacgcgcgcctcggggagagggaccagcaggagtggctgagcggcgagagattcctcagcgactgcaagaagcgtgagtcgccgttcctcaccaggcgggagagattccgcatcgagttcctgcgccgcgtcgtaccgtgggagaagggaaacctcacatggcagaatttcccctactacgtcaacgagaatgcaaggcagctgctgcgagagtgcacggcatcccacttgcggcacaagggcatcacgtcagagtatggctctcggctaccatcctctggagggaggatagtgctccagagcttgccaggaaccgaactctacagagagagattggtaagagctcttgcacatgagttgcgggtgccactactggtcctggacagcagtgttctagctccatatgattttggggaagattattcagaaagcgaggaagaagatgagcatggcgagtcagaagatgaaggttcagagtctgagatggaagatgaaggcgatgaagattggacaagcaacaacaaagctaaatcagctgaaagtgatgacgaggatgctctaaaatccgtgaaagaactcaaaaagtccgtggatgacctcaagaagctggtcccatgtactattg

SEQ ID NO: 5586 - DNA, 1716 bp, Triticum aestivum
  Clone ID: PAT_TA_5586
cgccgctagccgcccgaccgctcccgtgaccgccgcgacggccgcttcccggcccagcccggcgccgcccgcgcccgggcccccggctcccgctgtgtcaagtgatgtgggtgaaggattcaaggggacattggtggattgggtatatcagctcaagagcaccggccgaatcgccgatgctgtggataagtcattgaagggctctgatgcagagatcagcgagttcttgaaggtggcttttcagtgtattgtggctcggccaaaggagaggatctcaatgtacagggtttaccactctctgaagagcattggaacgggccgtgatgtctcggagcagtttgacgaatttccgctggcctataacaaggaccgatcgtcaaggctgagcttgccgacctccctggcagccacacaggacttcagcacaagccacatcgtggtggcggggagctcgcgggcagggaccgcataccgggccgtgctgcgcgacgggtccgcgctgacggtgaagcgcctgcactcatgccctctctcagagaaggcgttcaggtcggagatggggcggattgggcagctgcggcaccccaacatcgtgccgctgctggggttctgtgttgttgaggaggagcggctgctggtgtacaagcatatggagagtggggctctttccaaggtgatgaaggagccaggggagacattgctggactgggcgacgcggctcaggattgctgttggggcggcgcgcggtcttgcgtggctgcaccatggtttccagatgccacagattcaccagaacttgagctcgagtgcggtgcttctcgacgaggactatgaagctcggatcacagatgttgggctcacaaggctggtccggatggcgccaggtgaaggtggagacacaagccccttcctcaatggtgacttcggggagtttgggtatgttgccccagagtatgctagcaatccagttggtaccatgaagggcgatacatatgcgtttggggtcatactattggagctcgtgagcgggcaggaggctgcctctgtatcaagtgatgtgggtgaaggattcaaggggacactggtggattgggtatttcagctcaagagcaccggacgaatcgccgatgccgtggataagtcattgaagggctctgatgcagagatcagcgagttcttgaaggtggcttttcagtgtatcgtggcgcggccaaaggagaggatctcaatgtacagggtttaccactctctgaagagcattggaacgggccgtgatgtctcggagcagtttgacgaatttccgctggcctataacaaggacgactcggacacctgatggcggcgaacgcctcggatggattgtgaaccgcttggtcaggcttaatatgctactacttgcgtagctctggctgttgaattgatcgagagcacgccgagacatccatggcaaaaccattattactgccggataatcagttcgatcatggcaccgtctcatggtgagataatcatgtaagctgtaagattagtctgcattgtctctttaagttattgctagtgcttgtagtatctcggtggaactgtaattcttgttgtgtctaaattctgatatcaccttcttggaacaactggcctgctctccagtcccctatacaaatgagactggcattcaaaaaattgatcctttataaatttatcttaattttattactactt

SEQ ID NO: 5587 - DNA, 686 bp, Triticum aestivum
  Clone ID: PAT_TA_5587
acctgtcagttgaattttttcctccactccatccatttcgagctttctaaaacacatcgattacaagataacaagaatccatgttgagcccacttgccttcttgctgtgctgctataaagatgcgtcactcgtcaatctccacagcctcttactataatcttctgtgtctctctctgcatgcacattgcttgcttgcctatctcattgcttttgcataatttccctcagatcctgtctttctgctattttaatccatgatttcatcttgcagttgcagacaagaacagcgaggccagctccagcaatatgagcctgaactctgaagaaggtttgatgtgcaaagatatatcgcactcgtcgcaatctagtgccccttccctggcccatcccctgagcccatgccgctaccagtgcgtctccacgctcagaggccactcctcctacgtctctggcctcgccgtcgacggcatctcgctctacgtctcctcgtcggacggacacatcaggctgtggccactggacatgagcagcacgaccgtgcaacacgagggctctgttgttgccgccaccaatagctccataaagtgcctcatggccaccagcgatggtctcgtcagcgcccaccaggacggcaagatcagggtgtggcagcaggccggccggcggaaaggcgggagcagccacc

SEQ ID NO: 5588 - DNA, 601 bp, Triticum aestivum
  Clone ID: PAT_TA_5588
gaattcggcacgagctcctccacctcctcccccctcatccatggcgatggcgacctctcacttgcccgactaaacaaacaagcaagctcacgcaagcgcgcacccagacccactgagagcccggacaaaggggtcaagaagacaaggaagaggcgccggtagccactagccactcgtccggcatcccgaggtcgaccatggagaagttcctgttcgaggagctggccggggacgccgtgcgggagctgctgcgcgcggtgcagggcaccttcctgtgccgctccaccgccgagcgcctgcgccggaacgtcgagccgctgctgcccctcgtgcagcagaacggccgccacgcgctccggagcaacgccgagctgggcgagctcgccgtgcagctcagggaggcgctcgacctcgcgcgccgcgccgccgccgccccgcgctggaacgtgtaccgcaccgcgcagctggcccgcaggatggaggccgccgacaagggcatcgagcgctggctggcgcgccacgcccccgcgcacgtgctcgacggcgtgcgccgcctccgcgacgaggccgaggcccgcatcggccgcctcgagcgccgcgt

SEQ ID NO: 5589 - DNA, 1106 bp, Triticum aestivum
  unsure (1)..(1106): unsure at all n locations
  Clone ID: PAT_TA_5589
agttgatagagctgacaggaagatcggcactagagaccatcaaattccccacccgcaaccctttgctcgactcaaaaccctcgacaagcgctgtcgacctcgcgcggccgccgcaacaatggcgtcccttttcaaggacccgagcaagctgtcggtgtacagggaccggcggttccctgggacgcaggaggagtttgaggcggcgctgctggcgtcgctgacggtgtacgtggggaacatgtccttctacaccacggaggagcaggcctacgagctgttctcccgcgccggcgagataaaaaagatcatcatgggcctcgacaagaacaccaagaccccctgcggcttctgcttcgtactgtactactccagggaagatgctgaagatgcagtaaaatatattagtggcacaatgcttgatgatcgcccaatccgtgttgattttgattggggctttgaagaaggcaggcaatggggccgtggaaggagtggtggacaagtccgagatgagtaccgcacggattatgatcctggaagaggtggctatggcaagatggttcagaaagagctagaagcacaaagagaattagttgactatggtgtaggttttcaaacgaatgctccaccgcagtttgatagagctgacaggaagagaggatatggcgaccggaatgacagaggagattaccaacggagacggtcggcaccagatatggccaggagagcaactgactcggattctaagagagatgctaatcaagagcctgaaaagaatcccaggtttcgcgagaaaggtgattctgatgatgaagatgacgactacgataagaaacgccggcgctgaacccgagaagcaaattgctgccatattcaaatgcacaatagtagtattatctatccgtttgtatgccatatgacttgattttcccttgagccattcacattttgcctgcattttagaatcagttcatcaacatagtgcagcctttgcatgacttgcaccccctgaaactcttgcatgtgtatgctgctgattaagactattaagttcaaaaagaatagtgaccattggggtgctgggcactggattaagtttnaaaaaaaaa

SEQ ID NO: 5590 - DNA, 565 bp, Triticum aestivum
  Clone ID: PAT_TA_5590
gtttttttaattaacatgacgatgctaggtacccacttacgaatccctcgaattactccattacaggaagatcaagcttgagctacaggaggttgaggaggagtacaggaggtaggagatgataggggaaagaggaagccgccgttgccgttcgtgatcccaagcccggatgactcttcgctgcacctcccgtggatatttgtagtctgccttgccctggagtggcgcccaaccaggcccggcccatgtgctgatcacttggtgggcttgttgcttcgcctgtcgtggcagcagtttgggctgccaactgatcgacgcaactgtggccgtatttgggtcgctgacaccccctcctccttaacaaccggcttgcccccaagccggtgctcgttctcttctagctccgcaaaatgcaatcctcccgggccccactgctcgcaagaagttgcatgttcaactgactgtatgaactgccacatgagaaaagctatgggataatcttcagttatggatctcattgcatgcaagccagcacaggtactagagctcccagaaatacatggca

SEQ ID NO: 5591 - DNA, 619 bp, Triticum aestivum
  Clone ID: PAT_TA_5591
caagccggcacgtggcgcagcgccgcccgcggccagccggttcctcctccggcggcctcctcctccgccccctccgcccccccccccctcctccccccccccccccccgcctcccccccggctccggccgctccctcctccgcggggctgcggtcggcccccagccccccccccgcccccccgccggcgcccgctcctccggcgcgtctccgcgcccgaccagcgcccgccggcggcagggcccgcgtccccgccgccgccgctcctcgctgccccctccgccgtcccgccattgcttcccgcggcctcccgccggccgccgagcgctcctcctcccccctccccctcctgcccctcctgctcctccccgccgcgcccgcctacccccgtgccctcctcgttgtgtggtgatggacatcgagggcaccaccacccccatctccttcgtcgccgacgtgctcttcccctacgcgcgcgccaacgcccgcgcccacctcgctgccacataccacacccagcagacccgggaagatgtcgccctactccgcgcacaaatcgacgaggatctggcagagggggtcaccggcgccgtcgcactcccaccgcccgacgacatcga

SEQ ID NO: 5592 - DNA, 1377 bp, Triticum aestivum
  Clone ID: PAT_TA_5592
gtccgcaataatgttcttgtattgtgctggtgttgcggtcgcgtagctctcccctatcccggccctatccggggcgcatctggtcggcccctatgcggtccctacggcctccagtcatcctgccgttgtcttggctctctcgtggctctctcgccgtcattacccctgctttttcgtagcgttcttctagcgcgctgctaacccctagcccccccctcttcccccgtcccccctgctccgcccctcctcccttctcgcaacccgccccggcgactgtgctcaggcccctgcccactaaagtacactacaaaagactgactgaatatcaaaatacatgtctgttgtcacaccttccttgcttgacacaacccgtcgaggcgatttttctcagttccctttccactataggcatccaaaatgtcctcttttgcatcttatccaggtaaatcatcaaacttggagactcagcctcttctcccagaacatgaacttaataatactttctagaagaaggtaatatcagtgctacaataacacaagacttgacaatctcagcgcttgtataccaggaacttagaatgaaggagcaagggcttcgggattgacacatgatggccgctttgcattgtagtagaaataggcaatcatttgaactagttcgtcagctgttcttatctctttttctctgtataggattttgtttcctctcaagaacagcaattgcgggcattcttttgcttggagtgcatatgccaagtccctctcaatattcagatcaatcttcaccctccgccgaggtagccgatcttttgtatcccagtatacctttctagccttttccaattcttgaagaaacctccaattgtcagccgccctgttgtagcgctcgaagactaggacgataagggggctggggtggaaggcgaagctctcccactccaagcagttgatctccttgacccagccccggtcgacctctccttcccagtcgatctccacgccgtccaccgtcacgttcttgatggaatgcttgtcgaagtactccgacgcgcggaccccccatccgacgtcggcgtccagtggccagctcgggtcctcctcctccacaaccgtcttctgctccccgttttcctccccgggctccgcatcggaagcccgctcttcctcctccttcggcttcaggatgtcgcctttgccttggaggacctcggggtcgcgctcctggatggaggcgaagacctgctcgaggcggtcgcggacgaagtcctccacggcggccgcctcgcttcggcgaccgcggcgtggtttgcggggcttggttgtggggaactccgcggtgacgccttcgggattctgggggccgacgcggggttcggg

SEQ ID NO: 5593 - DNA, 968 bp, Triticum aestivum
  unsure (1)..(968): unsure at all n locations
  Clone ID: PAT_TA_5593
gaattcggcacgagcatagctctggggcgtcgacttcgacggccgctgcatcgcagctccggcactgtcgactccggcggccgctgcatcatagctctggggcgtcgacttcgacggccgctgcatcgcagctccagcactgtcgtctccgacggccactgcatcgcagctccggcggcgtcgtggccactgcatcgcagctctggcggcatcaacggccgctgcaccgcagctccggcggcgtcgactccgacgacggcgtcgcagccactaccgttgtgctagttggtgtgcttggagcgcgagtgggcgttgcatgggttttttctctgttggagcgaagagagtgggttgaggggaagtacgttcgcgggacagcaagcaaccggctacggtgtacacgatcggacggttatcaaggcggcttataactgcgaactatcagccgacttacgcctagcacccgcctttgttttcgcaggtaactgccacaacaactttttatgcaaacaaaatagaatactagttgatttggtagacttttctatagccatgtgaatggttctttcttttggaaaagttgtattcataaattgaacattgctgtgcacgtacacatgtactatacaagaatgagntttcaaagccattgaaagatntaattaaaaaattaanctttgattcttgtaaaaaaaaaaaaaaaaaaaaactcgagagtaccttttaaaagcgggccgnggggccccaatcgatttttcccccccggggngggggtnccaaggtaaagtngnccccaaattcnccccttaaagnggagncggnattaaaaaattacctgggccggnnggtttaacaacntncggggactggggaaaaacccctgggggttacccaacttaaatngcctttgnaannnaaatcccccttttccccacttgggggtnaanaaccaaaaaagcccccnccct

SEQ ID NO: 5594 - DNA, 820 bp, Triticum aestivum
  Clone ID: PAT_TA_5594
actctatatggaacagactagcctgagaggcaagtctatcaagcactatactcttacatcacgttttgcatgcgtaaaggggtctctgcttgaacgcaggccagaaaatgccgctgccaccattaaacttcttcacaagcacttgcctgatcagaagaaaccatttgtgaaagatgaactccaaaagcttgttgctgaatggccaacagaggtgataaaaaggcagaagaaggatgataggaaggcaatggaggaagctttgattgaggacatcccaaagatgatcagctccatggcgaagtcgggcctcgatatttccgtggatctggacaagctcacccgtcagcctgaagcagcgtagagaagcaacaccgctgctggacacctcgacgcggcagctgcaaatcctgcggcacacctgatacccgaggagaacatttttaactgggcgggatgtgatgattggtttgacacggtagcactagaaccctccgataataacgtgtacactgttgtttggtactagatggagacaaattctttttggtgggaacacatgccgttcattcatcaaatccatggacggctaattctcaacaaaacatcgagcgcaacacagtttggattttgttttcaaagaattcatgttccaaacggcaagtaatcttagtgtttgactgccaaatgcagtagcaatcataggcttttttatctacatattctgggtctgaatacatgctgtctcatatccagatatgcgagttatcgcctggtggagatttcacaggcttctttggaaaaaaaaaaaaaaaaagcccct

SEQ ID NO: 5595 - DNA, 548 bp, Triticum aestivum
  unsure (1)..(548): unsure at all n locations
  Clone ID: PAT_TA_5595
attggccacagccgcgcgccgctcccgcgaccgcgaaaaccctatccacctccacccagagccgccgactcctctccctctcacctcccgattcaggtccatgtccagcctccctccacgcgcggctgccgatctccagcgccgccgcgccaaccatctcccgctccacctcggtctcccaccctctctcgctccgccaccacccccaccctctccggctccccctccccatgtgtagcctcctccgttccgcgatggggcggccgtagcggcgctcctagatctatgtcaagggcagccccctgctcgtcgtcatgggcgcggtggtcatgaggaaagtggttgaggacggcgagatggaagttgtagcctacccgctgcccaggacaaggacggctgccctgacgctcccccttcttcacaatctcgcgctgggagagggggggggcgctgtttcttcggacactangcttatcaaatcgccatagtgactcgccagacaccgcttgaaggangtggtgtgatgtatatggaacatgtcccatggg

SEQ ID NO: 5596 - DNA, 755 bp, Triticum aestivum
  Clone ID: PAT_TA_5596
cttgctccctcggcggcagatcggattttccccaacttggcgttcgcgttctctcggcgtggtggtgctctgctctgtattgcgcctggttgtgcctggagctccccggtgtggtgctggccggcgttgtgccggggggggtcgcccccttcccctttcttcatcagtgttcttatttttcgtgctcaggtaccccctcatgtgtctctgttgtggcgatgcctatgcgactacactggtggcacacaggtgttgtggcgtcgtctcggctcatgtaacctttcgattgcgccccacgacacaggtggtgtcgcggcgttgggcagtctcggatgcgcggcgcctttcgattacgtcgacggtgcagtgtcttggtttggtctactaggtgatgctctttggccttgtcggtggcacacaggtgccgtggtgtcgtctcggctcgtgtgtcctttcgattgcaccccacgacataggtggtgtcgcggcgttgtgtactcttggatgtgaggcgccttttgattgcattgatggttggtctcggctggccaatggcgttcgactactttggcggtgctcttattgtgtagtctgttctttccctgtttgtttctctcctgtattgtgtgtgtctttttttatctcttcttacgtgcccccttgtatttctggttcacttgaacctatcttgtaataggctgcaaagccttataggcaatatgaatacaattcagatggggaaatctcccccgggt

SEQ ID NO: 5597 - DNA, 999 bp, Triticum aestivum
  Clone ID: PAT_TA_5597
gaattcggcacgaggtatcaacacctccgcgtggagcctccgaggcccagccctgcaaaaactcgccaatcccaggaaaccatgcgcctccggctcacggccgagacctttacatccgcgacgcagcgacaagcacgcggtctcggcagcatccaccggccaaggcgagcagcaacctgcccctgccgtcgcgtcgccgcgggctcggcccgatgccgacacgttcagcgtcgagttcctgacgcgcgacggctgccggctgggcatctcccggtacccggacttcgcttacaacgcccatggcggccgcggcgtgggagccgggcgtggcgcgagcggcacggcggaggcggatggcacggtgctcgtcgatttcgacgtgtcgagcctgtacatcccggcgatgtccggcgccaccactaggttcctagggctgccgctgccgccgttcctcaagatcgacatcttgcccgaggctctgcgcgggagcatcgatcggacgactggtcaggtcgacctgaagttcaggtcgaggttctgtttctcggttgggagcatctaccaagctccgccgttgttcgttgacacaacactgacgtctgaggagtccagtggagccataagacgtggaactggcgaaagattggacggcggagggagatgcaagctggtcggggtggccgtcctcaaccccatcgatgacgtattcatgaacaccttcctcaacctgccaaccgagtgcattgcttatttgaacgccaccatctccatcgccagcgccacctgatcgtgcctgttccgtggtctacaaatttcgtgaaacacctaaatcacacaaaggaagatccttgagtccttgttgctcggcgaataattaattgtacgcataatctaagttcttgtatataaattaccacgtgtggctagtgcccggctagatgtgccgtaaagtattacaaaaaaaaaaaaaaaaaaaaaaaagtcgagactagttctctc

SEQ ID NO: 5598 - DNA, 591 bp, Triticum aestivum
  unsure (1)..(591): unsure at all n locations
  Clone ID: PAT_TA_5598
aaggctggaaatctttaccatcatccatatgatctcggtgtctatcataatattgtttcggtcctaggccccaacatgctatgctggttctgccctgtatcgaggaacataggcaacggcgttcgtttccgcacatcgtatgatattccgctatctacaccaccatccaaagcagaaaagcatctggcaatgtcttgagctcttgcattgagagcgtatattgtgggatcaaatccgtgaatcatgccgcaagtgtaaggtacatagcgggagctgaggagcttcaagagtatttcctccaggccccagggatgtatctggagttagaaatcctaatctagctagttattccattatactttttggccagcttgatgagaagaatcaccgatgggcctcaatagatctggagtggcctggctcgcctgtactcatacaaaaaagtctgaactggaagagtcaaagactgctctgttgtaagtacgtgcctgtagtgtcgtttaccctgaagtccgtatattgcgtttgtgtggcagagtgagggaaggggccagtgtccaattgnaaaacgttgtgtataaaaaaaaaaaa

SEQ ID NO: 5599 - DNA, 721 bp, Triticum aestivum
  unsure (1)..(721): unsure at all n locations
  Clone ID: PAT_TA_5599
tttgatcgtagcagagtggttttgattgtgccagtgcggctacgactgctaccccgcgcccgcgcccgcgccgacgagagcagaagaagcgaagcgaattctagaaggagccgtaaataaatactcctcctagccggtgagagcaacgcgaattcggcacgagccgtcccataccacacaaccactagctagcaaccagagactcactgccgccgccgccgccgctgcttgcattggaggcgctagcctaaggctgtgccatcttcgttcttcgacgacgaccgcgaaaattgtagggctggcagactggtggccggccggcgcggcggccgaagcccaagccgaggagatggggagcatggacggccacccgctccagggcaaccacgcctacgcccacgtccctgccggcagcaacaacgacgaggacgacgcgtcgccgccgccctcggccggcggggggtcctcggggtcgggccgccggccgcgcggcaggcccccggggtccaagaacaagcccaagccgcccgtggtggtgacgcgggagagccccaacgcgatgcgctcccacgtgctggagatcgccagcggggccgacatcgtcgaggccatcgcggccttctcccgccgcaggcagcgcggcgtctccgtcctcagcggaacgggcctncacaactcagctcgcaacccgccgggacgcgcncggcccctttccttcggg

SEQ ID NO: 5600 - DNA, 483 bp, Triticum aestivum
  Clone ID: PAT_TA_5600
ctttctatttccctttctgtttcagatctgagtacaagccaggactaagtagtccatacacacaaacacacaacgccacacacctaaccagacccactcaagtcacacttgcatggtgctagcctgaccggtggaccctgggtccacctgtctgtcgtccgtcgacaccaatagtggtggggacgtgacactttcccccccttgagatgcaagctcctcccagattgaagcctccggaaaacgcgctcgaagaacataataatcttcccaggttgcatgatttgtagcaatgccgtgccactggactttgatctgaggaattgctgagttacctttctttaccatccgtcgttcaagaatcgcctcaggctgcaatgtaacagccgacaattctggtggctcatgcaagtctgcaaacactggagagtagtttgcagtaaatggcttcaattgggaaacatgaaaaacaggatgtatgagact

SEQ ID NO: 5601 - DNA, 321 bp, Triticum aestivum
  Clone ID: PAT_TA_5601
cagattgtacttataatagtatgtgcatgggcatatacatagccatcggaggcattcacatacaaacatgctttctcgagtcatgtggggaacatggacatacacatatgcttatcttacgatcaaacaagaaagataaatggaaaaggaaaacccaaagcattgtcagagttgacaaaaccgcaatggcactttatatgtggcccgtggtgagtgagctgtttaggccttgccggactcctcgcagaccggtggcttgaaggcgaggaagctgacgcactgcacctggcgcatgtggtcgaatccgatgatgcggacata

SEQ ID NO: 5602 - DNA, 217 bp, Triticum aestivum
  Clone ID: PAT_TA_5602
gcaactgctgcagtaagaaccactttcacactgtaggagtctacaggcccgaagtctatattcaacacggcgtagcacgcttaatgattacaaccaaaggaaatcttgattggaaaataccaaggctttaattagctacttgatcatccagcaaccaatgtagagcagcatatatctgaccaggcctttacaagatttattgagcttgcctaccctg

SEQ ID NO: 5603 - DNA, 1000 bp, Triticum aestivum
  Clone ID: PAT_TA_5603
gcccggggacatcatcagtatcaaacttggagatatcattcctgccgacgcccgcctcctatacggtgatcctttgaagattgatcagtctgccctgaccggagaatcgctaccagccaccaaagggcctggtgacggcgtctactctggttcgacggtcaagcaaggcgagatcaaggccgttgtcatagcaactggtgtgcacacttcctttggaaaggccgcacttctcgtcgactccaccaaccaagttggccatttccaacaggtgttaacagccatcgggaacttctgcatttgctccattcttgtgggaatctgcatcgagattattgtcatgtatcctatccaacacagggcgtaccgccccgggatcgacaaccttctggtgcttctaattggaggtattcccatagcgatgcccacagtcttgtcggtcaccatggcgattggatctcatcgcttgtctcaacggggagctataataaagagggtgactgcaatcgaggatatggctggcatggatgttctttgcagtgctaaaactgggaccctgactctaaataagctcagtgtggacaagaaccttatcgaggtttttgaaaacggacgcgttgaggaccaggtgattctgatggctgctagagcatcccggatagaaaatcaagatgccattgatacggcaatagttgggatgctaggccatccaaaggaggcgcgtgctggtgtgcaagaggcccatttcctgccgttcaaccctactgacaaaagaaccgcgttgacatacattgatggcgacggaaagatgtaccgtgttagcaaaggtgcaccagagcagattctcaacctggcccacaacaagtcagagatcgcacaaaaagtccacgctgtcatcgacaagttcgcgggacgtggacttcggtcacttggtgtagcatatcaggacgtgccagacggaaggaaagagagccagggtagcccgtggcattttgttgctctc

SEQ ID NO: 5604 - DNA, 1764 bp, Triticum aestivum
  Clone ID: PAT_TA_5604
gagtcgcgcacgcagtgatgcggcaggttttgagcaacgctccatggcggcaggatctccttgccatcggtggccgcgcgaaccagggctccaagagcagcagcaccggtcaaggaagctccttcgtctccagccccggcacccgccacccctcctcgagctaggaggcttgtgagggtgagcagcaaggaggagagggtggtgaccgtgcctttcgcaaagccaaagcaccacattgcggattcactcgaggatgaacccaagctcggtgttgaagaggaggcccaacgttctcggttgactgctgtttagctactcaacaccgtgctggaatatgattgaggcgacctgacgcaccagctcgcccttgcgcgctgcaccatcactcggcttcaggagcagcatgacatccatcaggcgcattaccctgtggcgtcaataaatgaccaatgtactagtgccatgagcaaaccacagcctcctaagcccccctcaccgccgccgccgccaccaccacctagtaaaatcctcggaagagccccggcaccgccacctccccctccgcaacgtggcacaacaggcacagtgaacaaggcaaccgcgttggttgagatgtacaactccctgaacaagcgtgacaccaagaaagctgtgactgtcagtgctgctcatcacaacagcatcgtcggcgagctacagaaccgctccacgcacttattggcgatcaagacggatgtcgaaacaaaaggagacttcatcaatggtctcattaacaaagttcagatgactacttacaccgatgtggagcaagtgctgacctttgttgattggcttgatcaacaactttcaactctgtctgatgagaccggcgtgttgaagcacttcagttggccggagaggaaagccgatgcactccgggaagcagcgttcgaataccgggatctcaagtgtgttgtaacagagatctcttccctgaacgccgacgatggcagccctacttcgtgtgaggctactctgaggaagatatcaagcctgctggataagttggagaagagcatgaagagactagtgaatctgaggagctcagtgatgccgtgctataaacagtttggaattccgaccgatggatgcttgattcagggattgcttcgaagatgagggtggcatcagtaacactggcaaaggtgtacatgaaaagagccctcaaggaaataacagcttatacaggaggagggaatgaggctgttcttgtcgctcaaagcgtgcgtttcacatatagggttcaccagtttgcgggaggacttgacagtgaagcgatgcgcgcctttgaagagctaacgcaacgttctcggttgactgctgtttagctactagacgaaacgaaatgactgtcgatgaatgagatgaaacggttgacgatatatagcttctcagggtacaaattaatgtcgtgggttttgtatggagcatataggctagtagttcattttgaattgatcaataaatgtaatttgtactactattctacgcggcacgccgatcttgggagcaaggggcggagagacatagattatttcagttctattgaagactggagtatatatacttgggaaaagtagacacaaactttttgtgctcttaagaactccctgtgtacacaaaaattgtaagacgttttcgcggtttaaatttaaactgcaaaaacatcctatatttgtttacggagggggtaccatatatgaatgtaacgttgtaacattttac

SEQ ID NO: 5605 - DNA, 1648 bp, Triticum aestivum
  Clone ID: PAT_TA_5605
tcggcacgagggttgccttgaaacaatagagttaaaaaacactgacagtagcactaaatgccaagaaggagtaacctaacaaggaaataggaatcccttgaacaaaatacactggcaagcaacgaagagacacgtacggccacacagagaatggcgaacaacggcggcagcagccgccgcggggacgacggcgtcggcgtcggcgtgaccccatcccgatggcgtttcttccggccaacggccggcacgccgctggcggccgccggcagcatgagcatccgctcggttctcaaccgtctcaactcgtccgtcgacgcgtccgggacgcgccccgtcgtgccgctcggccacggcgaccccacctcctccgcctgcttccgaaccgcgccggaggccgacgacgccgccgtggcgagcacctccttatgaactttcaacgggatcacctctaaccgtccgccggatgcgtccaaggcctactacgattatgatccccgttcttgcccatcccggggataacatcttgctcccaagaccccggttttcggtctacgaaacgaagaccacattcagcgtgcccgaggttcgatatttcgacctcgtccccgaaagaggctgggaggcagacctcgagtctgtgaaggctatcgctgatgagaacacggttgcgatgctcatcatcaatcccagtaacccttgtgggagtgtctactcacatgatcatttggcccaaattgcaagaaaccgcaggagaacttggcatattggataattgctgatgaggtatacgaccacttggcatttggaattaagccttttataccaatgggcgtttttggcaagacggtcccagtcatcaccttgggagctatatctaaaaggtggcttgtgcctggttggcgacttggctggatcgcaacgtgtgacccaaatggcatcttaaaggaaaccaagattgaccagtccattcaaaactatattaacatcacaagtgattcctgcaacattcattcagggagcagtccctccaaattatagccaacacaaaggaagaatacttcaagaaaattcttgatttattaagaaactcggcagatttatgttacggtaaaataaaggacatcaggggcattacatgtccgcacaaaccggagggatcaatgtttgtgatggctaagttggacctctcttgcttggatggcttttctgatgatgtagatttctgctgcaggctggcaaaagaagaatctgtaatagttttaccaggtactgcactcggaatgaaggattgggttcggatcactttcgccattgacctgccatctcttgaggatggcctggaaaggctgaaatctttctgcgagaggcatgctcgagtagaagcctaagctcaaagatgattgagcttttacactgctgtggcgaatcgccagctatgcgttggatcgccctggtgttgtttccaataatcgcttctctttatgtccccccaatgaagatatttagcgttccacacatattttgtactcttcctggttgactcgtaccggtttggaagtggcatactatcgaagaatggtgtaatttgtaaccattattggttacagtgatttaagggtcagtattttccggccttttgggtcgggtt

SEQ ID NO: 5606 - DNA, 873 bp, Triticum aestivum
  unsure (1)..(873): unsure at all n locations
  Clone ID: PAT_TA_5606
gccatcgcaccttttggcgtccctgtggtggacttgccccatccttctgtcgggggggctggccctgtgccgctcgaggcattccatctaattatcctatcgcaagggttgaccctttcgcccctatttgatcgccggacaggactttggcaagcttcaaaatagatttttatcacgcaacccagcaaatgttatattgtcaagtatggaggttgttgctcaatccatggggtttaagacacatattcgcaattataagatgagggtggaaggtccaaatgcgaacaagactagccatctcacaattatgcttcaaatttttgaagttgccccatcaatctttatggtggaactagagagatctgctggagatacttcagagtataataagttcgtaaacaactactgctccaaattagatgatatcatctggaaagtttctgctgagaagggaaaatctaggacatcccggctatcgaagcgctaatttatgcacctattacaatttatctgtaaccatgtgggtttgctgcaggtataatgcgtattgctgttttgttcggattacgtacatcacgggcttgactaatgagtgtactagtgcagtttatcataattgatctatgatcttttagttatatactacccccgacctaaaacgtcttatatttgtttacagagggagggggagattgtgtttagtgccatgattgtatactacgactagtcgagtctgcttgtacaaagaggtccatctagtagttctgacatgtcagttttcatgtacagaaatgtgtcaaacaaactgtacttcacttgtctccgggtttgttcggggagttgacataattggtgtgacttgtatactgccnn

SEQ ID NO: 5607 - DNA, 571 bp, Triticum aestivum
  Clone ID: PAT_TA_5607
gaattcggcacgagctgtccccttcctagacggcggctttggagtcgagggcgctgctatttgagcctcaaggtggctccggccgcgagcgggtagggcttcgggatcaaggtattcgtgatggccgacatcgcgtacagttcatgctgcgtcaatgaggttggggcatcacgtgtcgtcaactgcgcgcacacccgcttgaacccagaagcttccatgttcgaatcaaactgcgcagatcactccaaactttccaccatggattgcccacctgctgctaatgtcggaatccacagggtttccatggagacaagttccagtgatagattcacagctctgagtagcattggggaggagtatatctgcaaggataagctccccctccttctaaagaagaagctcgcacccatttgttacgtttggtttgaaccatctcacatgatggacatagagcagcaggggattatgaagacgatctatgtaaacaagatagtccaagctggttgcactgttaaaatattgatggcagattggtttctgcagcgacatttcaagattggcactgacctga

SEQ ID NO: 5608 - DNA, 289 bp, Triticum aestivum
  Clone ID: PAT_TA_5608
gattggcttgtgcagttctgttcgctgtatggggattcatcgtgtagatgctttcgatggtgatttggtgtgttgctcgtccggagccgatgagctgtgcacgtctgtacctttctgatggacatgtttcgatttgttgtagttctggtatcagaatccttgtttccttgatttgggtgtacagaaccatcaataagaacatcatcactgttgattggtgtattgaaaaaaaaaaaaaaaaaaaaaaaaaaaaaaaaaaaaaggaaaaaaaaaaaaaaaaaggccccta

SEQ ID NO: 5609 - DNA, 596 bp, Triticum aestivum
  Clone ID: PAT_TA_5609
ggacaagaccaactggaagaccaacatgctgacgggcctcttggtcccttacattttcttcaccatgcccggtctgctcttcggcttcataaggggggagattggcagctgggttgcgttcgtttttgtcgtcctgcggctgttctttccgcgccacttccctgattggctggagctgcctgggtctctgatcctcctcacggtggtcgcccccgccatcttcgccgacaccttccggggctcctggctcatcatcggcgtcggcgtgtgcctggtcatcgggtgctacctgctccacgagcacatcaaggcgtcgggtggcctcaaggaggccttcaagaagcccaatggctggtccaacaccatcggcatcctcctcctcttcatctacccggtctgggccgtcgtcatgtggttcctgtagaccgttcgccgctgtttttggggttcatcatgtgatgtttttctccggcgatttggtgtcgatgaaccatgcgctcttgtacctgttgaatgtctcggccatgtttcgatttggtgtcacgtcttaatttgtttccttcatctgtgggtacatagccatcaataaaaacgtc

SEQ ID NO: 5610 - DNA, 997 bp, Triticum aestivum
  Clone ID: PAT_TA_5610
cgcacgagcccatccatccatccatccgtcttgagaactctcgaggtctcggcgagtcgggggagatggcgccgtcgtcgttcctcgcgatgaaaacgggcgcggcggccggcgcgtcggaggcggcgcaggcgctgctcgagtcggacctgcgggagctgggcctggccgcgcggaagctcgccaaccacgccatcgtcctcggcggcggcctcggcttcggccgccacttcctcaagtggctcgccttcatcgccgccgtatacctcttggtattggaccggacaaactggaagaccaacatgctgacgggactcttggtcccttacattttcttcaccctgcctggtgtgctgttctccctcgtaaggggagaggttggtgcctggattgcattcgttgtagtcatcctgcggctcttcttcccgcgtcacttccctgattggctagagctgcctgggtctctgattcttctcacggtggtcgcccccagcctcttcgcggaccacttcaggaacgacctcgtcggcgtcttcatatgcctcgccatcgggtgctacctgcttcaagagcacatcagggtgtcaggaggcttcagggaggccttcaggaaggccaatggcgtgtccaacaccatcggcatcgtcctgctcttcgtttacccagtctgggtcctggtgctctggctcctgtaggacatctactgctatcggtgtggccattgattggcttgtgcagttctgttcgctgtttggggattcatcgtgtagacgctttcgatggtgatttggtattgctcgtccggagccgatgaactgtgcacgtttgtacctttctgatggacatgtttcgatttgttgtagttctggtatgaggtctttgtttccttgatttgtgggtacataattagtctttgtttccttgatttgtgggtacataattatcaataaaaacatcatcactgttgattggtgtattgaaaaaaaaaaaaaaaaaa

SEQ ID NO: 5611 - DNA, 1016 bp, Triticum aestivum
  Clone ID: PAT_TA_5611
ccacggccatccatacagaaaaaggcaagaggagaaacgggcgagtgatgaactgagagagaggcttgggaggtctcgcgcgctagcggatggcgacgccgttgctcccgaggaagacggggcccgcggcgggcgggtcggaggggtcggaggcgccgctggccgcggccccgcgggcggtgaccgcggccggcgcggaagcacgccacccacgccgccgtcctccgccgccggcgtcggcttcatcggcactttcctcccgtggtgcgcgttcgacgccgccgtatatctgttggtgctggacgagacgcactggaagaccaacatgctgctgggcctcctggatcccttacattttcttcaccatgcccggtctgctcttcggccttcttaagggggtcgattttgggtgcttggctttgacgcttctgttgttgtccgtgcctgcgggctgttctttccaccgccacttccctcgagcttgcctggagctgcctggcctcttcttctccgcccaaccggtggggtcgcccccgcccatctccgcggcacattcctcgccggggctccaggcctcatcatcgggcgtcggcgtgtgccaggtcatcggggggctacctgctccacgagcaaatcagtggcgtcggccagccgcatcggcggccttctcggcagcccaatggtggttctaaaaccatcggcgctcttgtccttctgatcctcccagtctggccactggtcatgttgtgcctgtagattggttgccgctgttttggtggtggtcgtgggatgttttggtcagtggttttgtgtcgagtcatgagccgttcacttttgtacctttgaaccattctggtggacatgtttcgatttgttgtagttctggtattaggtctttgtttccttgatttgtgggtacataatcatcaataaaaacatcatccctgttgtctgttgtttgtgggtacataattatcaataaaaacgtcatcactgttgctctgttaaaaaaaaaa

SEQ ID NO: 5612 - DNA, 1110 bp, Triticum aestivum
  Clone ID: PAT_TA_5612
ccacccctcgctcactccatccgcccatcgaacgaccgcggcggcaagaattacgaacgacgcaccaccacgctccgcttccaacgctccgccgggcaacacgcaccaccgccctacacctccacgccccgctcctccggcgggggcgacggcgacggcgacagggggcatcatcctcccccttcccggatctcgtctctgcctcaaagattcactcacatccggcgaagatgacggccagaggtcatcctcctctttctcaccaagcgggtgctgacttgtgggtctgccatgacattcgaagttggctttatccgaagactttgtgttcaattgcttggtgccttttgattcatctgtcattgagaagtttgcactcagagtaagaaagccaacatcaagttgtggtacatgatgtcgaggaaggagtggagaaaagaccggagtaggacgtgattgttgctttgtggcccatcttgttcgaaaatatccctgcattggacatggcaacttataatccagaactttttatagtgcaaaaacttgacgatgtatcaataactcttgtaatgaatgcttttatctccgcacaagacaacggcttagggcaatgctcaatcgacaatttatcaagaccaatatattaagcttgatgaagtgatgtataaggtgtagtaatatttttaaaaatctagttgacatgaacctttttgctgcggctttattggttgaaggaggagatttttgagatgtagatagcataagccagcatcaagttgtggtacatgatgtcgaggaaggagtggagaaaagaccggagtaggatgtgattgttgctttgcggcccatcttgttcgaaagtatccctgcgttggacatggcaacttataatccagaactttttatagtgcacaaacttgacgatgtattaataacttttgtaatgattgcttttatttccgcacatgagaacggcttaggccaatgcttgatcgtcgtgaaatgcagaccgatattttaagcttgatgaagtgatggataagttgtagtaatatttttaaaattttagttgacatgaattatgaacctttgttatgtgcctgtgatttt

SEQ ID NO: 5613 - DNA, 648 bp, Triticum aestivum
  unsure (1)..(648): unsure at all n locations
  Clone ID: PAT_TA_5613
cccacgcgtccgcactccttgtatgaagaaaggctctgcaaagaagagcagcggaagctcaagctcgatggagaaggtcgagtacgcccagctacgcaccagcgacgccgacagcgaagtgtcggtggcggcatcagggagcaccggcggcaggttgttcagcaacagcgacagcggcatcatggacgcgttcatgggcgtcggcgagtactcgggcatgatccacccaaacagcaagttcgggctcgggttcaggaggtacggcaggtccggcgcaccgccgacggggttcgggcactccgggatgggcgggtcgaacgggttctgcgacccggagcacgggttcgccatcgccgtgacggtgaacaagatggcgctggggtccgtcacgcggcgcgtggtgcggtttgtgtgcgaggagcttggcgtgccggtccccgacgagttctccgccgccggggagaaggggcccgacatggtgctcaacctcgcgccgccggcggagtaggttgacctgtagtaggaatttgaaaggcacggcattaattaacacggtagatatttaatacacacgcgcgggggtcattttgacggggcgttttacactgtaaaacttcagtagcggcttgtacctgtgaaattgnaatt

SEQ ID NO: 5614 - DNA, 467 bp, Triticum aestivum
  unsure (1)..(467): unsure at all n locations
  Clone ID: PAT_TA_5614
ggagaatcagcgtccaaaacactcaagagatcgcgagataagcagcaggccgaacggacatggagatggcgcacagagaccacctcctcgccgccatgcacggcgtcctcggcgtcgccgtcctcatcctgtgcctcgctgccgagctgtccgtcctcgtcttccggcgccacgcggcgctgtacctcctccccgtctgcgcgatgatgacgcacctgtggcgctccggccgacgtgcggacatcggcctggtcgacttcgcgtacctgaagccgccccgccggctgcgcgtcaccatcccgggcctgctcgagcacctccgccttatcggctgctttgacgacggcagcgtcaattcatgtcaagggtcgtcgaggacagcggcatgggcgacgagactacttccgccgggctgnatactccgccgtcgcaagcacgccgaccgtcaagagcgggatctctctcca

SEQ ID NO: 5615 - DNA, 1105 bp, Triticum aestivum
  unsure (1)..(1105): unsure at all n locations
  Clone ID: PAT_TA_5615
ccacaaacccccgaccgccggggcttatccgctcctcctcagctcagctcagctcgctcccccaaactgccacgccatggaggcggtcgccgccctcgacgcccgcgccctcttctcccctcccaccgccctcccctcctccccctcctcccgcctccgcctcgccgcccgtccgcgcgcgctcgctgcctcccccgccttcgtcgccgccacccccaagcagcgcttcctgaccccccacccggaccccgccggtggccgcggcaccagggatgtcgtcgcgatggttatcccgttcctgaggggaacagcgtttgagcagccgccgccggatttggcctcattcctttacaagaacaggatcgtgtacctggggatgtgcctcgtgccgtcggtgacggagctcatgctagccgagttcctctaccttcagtacgaggacgcggagaaacccatctacatgtacatcaactccaccggcactaccaagaatggcgagaaattgggttacgagacggaagcttttgctgtatatgatgctatgaggtatgtcaaaattccaattttcacactctgtattggcaatgcatggggagaagctgctttactcttggctgctggtgctaaaggtaaccgtgccgcacttccatcatcgacgataatgatgaagcagccaattggtcgatttcaaggtcaggcgacagatgttgacatagcaagaaaggaaatacgaaatgtgaagatagaaatggttaagctgctgtcaagacacattggtaaaccaatggaagagattgctcgagacatcagacggcctaaatacttcagcccaagcgaggcagtggattacggtatcattgacaaggtgctgcacaatgtgaaaagccaaacagatgccggcctcgtgtccgaagtcaagaaagaattaatttaacaatggggtgttacacgtaggcgtatttttgtagcaagattttttggataggcaaatgcaatgcagaagtgttaggctgggggattctggtacgggattgccgttttgatttcgtggctcaataatgctcttgtttcaaaaaaaaaaaanaaaaaaaaaaaaaaaannnaa

SEQ ID NO: 5616 - DNA, 1135 bp, Triticum aestivum
  Clone ID: PAT_TA_5616
tcgataactccactcagtcatttcatatcactgaaataaacaagaatatttctgatatcactaaaagcaaggaattattgagctgtttgtatgaatcaacaatcatgaagatgggagtgcggcacctgcaggaggaaaagtctcgactagcaaaacaaaatgctgacaaggcacatcaaaattttcttgccatggcagagcactttaatcacctcattgagaattccaaagagtcaaatgataagcaagctcaagtagtgtgcgaagaaaattgttcgttggtggctctaactcaggaccttcagtctaagcttaccaaattggctgctcaaagaaatgaagcgcttacagctgttcaggagattaaatttcaatgagatgcacgtctagcaacttcgctggaggaagaggctacagcagtggagcaaattatccaagaagataaattagctctattggtacgtaaagaggaccaagcgacactggggagcataatggacgcgtcaagaaagctccaaaaggaagccgaagagatcattttgctgagagaacaactgctggaccggggtcacatcattgatatcatgcaaggagaaatatcaagcatcctcgcccgtgtaagcaagcttaaatcagccctggtgacaactagcagctcagctaattcttcccacaaggatgactgtaagagtgcgtcagttgacacagaccggcctttggggaacgatgactgggagggtcggccccctcccccccctcccaacgcccctgccacatcttcggtggcccgcgtcttcgtcggggtggtgcttctagctacctaccccgcctgtccttctggtcgctgtccacctatctcttgggcactaagcgggcagcagcttcgtggctcgcccgcggggtgtgcgccaagcggcggtggctcctccccctgactgcgactctgcccgcggttcctcccacccctgcagggcttcggcgctccccctgtggcttcttgcggccatcgagatgggcctgctccaggccttactgttgtaattaaacttggttgtaatctatctgtcatgtaaataaacatgaaattatgtgcctatgtttgtacagaatcaaatcatatatatggcaaataata

SEQ ID NO: 5617 - DNA, 705 bp, Triticum aestivum
  Clone ID: PAT_TA_5617
gaatcggacgcgtggggccaaccagagcatcccgcccgctctcgcctcggtgtcgccgccgcccatggccgtcgccaagagcaaggcaggcaagcacgccgccccgctgctcggcaagtacgagctcggccgcctcctcggccgcggcaccttcgccaaggtctaccacgcgcgctccctcgtcggcggcgaggccgtggccatcaaggtgctcgacaagccggagctggccgccacggccggcatggacgcgcgcgtgctcggcgaggtctccgccatgcgccgcctccgccaccccaacgtgctgcgcctccacgaggtgctcgccacgcgctccaaggtctacctcgtcatggagctcgcccccggcggcgacctgctctccaggctcgcctcgctccccaagcgccgcctccccgagcacgccgcgcgccgcgtcttcctccagctcgtctccgcgctcatctactgccacgcgcgcggcgtctcccaccgcgacgtcaagccgcagaacgtcctcatcgacgccgacggcaacctcaaggtctgcgacttcggcctcgccgcgctcccggagtcccaccgcgacgacggacgcctgcacaccgcctgtgggacgcccgccttcgccgcgcccgaggtgctccgccgcaaggcctacgacggcgtcaaggccgacgcatggtcctgcggcgtcatcctcta

SEQ ID NO: 5618 - DNA, 1058 bp, Triticum aestivum
  Clone ID: PAT_TA_5618
ggtccttcgtcctccgtctcccgctccccccccctcagccgtattcgtctccctccttctccatgaatgcctgcgctctgaactcgatggaggtgaaggcgaagccggcgaggggcgggaagaggagcagggcgagcggcggcacggcggtggtgctgctggagaagaaggagtccgagaaggagaggaggaagcgcatgaaggccctctgcgagaagctcgcatccctcatcccaagagaacactgctgctccagcactgatacaatgacccagctaggcagcctggacgtgggggcgtcatacatcaagaagctgaaggagagggtcgacgagctgcaacgtaggaggaactctgtgcaggccttggataccttaagaggagatactagcatcccaacacccactaccaccactaccacaagcagcggtgcaaggtcgccggaagaagagaaagcttgggaggcatcggaaccggtattgcaggtgcggcaacacgacgattcaagcatggaggtgagactgatatgctgcatggagaggccgatcaagctccatgaggtgatcaccatccatgaggaagaaggtgctgagatcatcaacgccaatcgctcggttgctggccacaaaatgttgtaccccggccgcgcccgcgccttcagctcgagaattggcatagatgtttcaagggtttctgaacgactgggagcattgagccgactcttttcgcacgaaaagcaggcaccatcgtgcatgcgcagcattgaggtccccaagtacactgatgggaccaacctaactcctcccaaggagctcatcagcaacaacgatataggtggaactaataaggtacccaacccccgagtgtgagtattgggctgagcaagatcaattgatgtggagttcccttcttgtgtcaatatcaacagagttaatcgagtaggtgtgggttgtgtcaaccatggttgagccttggtctacctttgggtgcatgttctccgctcatccatgtaactagaaaatatgaggaagaatttctcttggtaaaaaaaaaaaaaa

SEQ ID NO: 5619 - DNA, 804 bp, Triticum aestivum
  Clone ID: PAT_TA_5619
gaattcggcacgagcagccctagcctcaatccacagccgccatgccctcactcctcctcctcgctaccactcccttcctgctcctcctcgcggccgcactctctccctcctcaccacggcacccataggcggctccctcctcaccatggccccaccataggcggctccctcctcaccatggccccaccataggcggctcatgcggtggtggaacggaccgcgcccccgccaggatgcatggtgattgtgccaggtttgtgctctggctcttctgttgggtacacatgaatctatgatccagattctagctacaccctttactacaacaatctcaggctttactgaaaagtgtactgcttatatagttgatatctttaattcatatggtcgtccgctggatgatcactggtcttcggttcatatggtcactggctggaagcttgctgttatgtttgcttcatatggtggtcgactggaagctcgcggtctgaatgatctcattgtctatggccggcaatacacacttttcattactaccagccaagtcttctcagagtgattgaataaattccattcctttgtgctgcattttcccttccatggtttttgctcaaaatggcataatatgccacttgcacccccgttggtctttgaaatttagtaactccagtttttcatagataacaattgtgcagtctttgtcctttccacttaccattaccatttttgtgatgatacttcactagaaatttgtttggtactcatctaaaaatagattcataatgaggtcacttttccaccttt

SEQ ID NO: 5620 - DNA, 978 bp, Triticum aestivum
  Clone ID: PAT_TA_5620
gaattcggcacgaggcggagcctgtagattctggggggtcctgcggtgaaatcagcagactctagtcaccatggttaccgtcgccgccgcagccgccagttacgacgacgaggttcacagccgtgccgcgctgcgggaggccttcggagactcatcagacagcgattccgacgcgccccgcggcgcggctagcaccccgccggttcacggggcgggccgcgagcgctggagatgggcggcggtggcgggggtaaggggcctgtggctctgcgccgccttcctctcgcccgacgagcagtcgcgccttctcgccgcgatccaacgagaagaatggttcactgatgcacacaaccaagcaatgagatttggtgatctccctccatgggccgtggaactttctgcacttgttcgggaagctatttgcgttggtggtgttgatgctagtgttggcgctgggtggatgaacgaggatgaagacgcatgtcctttgccgtcagatttgctgtggagagaaccgctttttgatcaactgattgcaaacagatacaagccaggtgagggtatttgtgcccatgttgatctcatgcgcttcgacgacgggattgttatagtctctctcgagtctgcatgcgtgatgcgcttcagtcaagaaggtgctgcctgtgatacgcaaaagcacggggagagcgaatgcacaaacgtccccgtctacctgaacccaggctcacttgtcgtaatgtcaggcgatgcacggtatcactggaagcatgagattaatcgcaagccaggtgctcagctctggaacgggagtgagcttgagcagcatagaagaacttcagttactctgaggaaactcagggcttctcccaactaaaattggcattgttaacatttgttgcataatgttatcgttttggcaatgttataccgattattttgcagtgcagtgtatcatggaaaagtttaattaggttgcta

SEQ ID NO: 5621 - DNA, 426 bp, Triticum aestivum
  Clone ID: PAT_TA_5621
cggacgcgtgggcggacgcgtgggcggtgcgcctgggtgactccgaccaccggcattgagagcgcgctggacagcgggaactgtcgcgtcaaggaggacgccatggacggcggatcctgggcgctgcacgttgctgccggccacgggaggatgccataccctttgggcgcaacaaactcttggccatagcctcttccgcttttcacaacaaggaaagagatgcatatgagaggaagagagcctcccccaagctctgtctaggcgatgcatgggaaatttggaaatttggaaactatcaaggagatgtcgaatgatgaatatactcagatactgagacacattctaaaacgtgtttacgcaggtgatggggctgctgccaacttgggcccgctcaagaacggcgactctacaggaggggggggggtg

SEQ ID NO: 5622 - DNA, 2258 bp, Triticum aestivum
  Clone ID: PAT_TA_5622
gcgtccgggacaacatctgcatatattacagttattgtccttctccttggagctgtgtgttctggactagctggatatgttgggatgtgggtctccgtacgtgcaaatgttagagtttcaagtgctgctcgacggtctgcaagggaagcattgcgcatggctggccgtgcaggtggtttctcggccatcgttgttgtgggcatggctgtatttggtgtggcattactctatgcaacattttatgtttggcttggagtagattcacctgattcgatgaaggttacagacttgcctcttctccttgtggggtacggttttggtgcgtcgtttgttgccctctttgctcagttgggtggtggcatatacaccaaagcagctgatgttggagctgatcttgttggaaaggttgaacagggaataccagaagatgatcctcgtaatccggctgtcattgctgacttggttggtgacaatgttggagattgtgctgcccgtggtgccgatctttttgaaagcatagcagcagaaattatcagtgcaatgatacttggtgcaacaatggcacagcgctgcaaaattgaagatccctctggctttattctgtttcctcttgttgtccattcttttgacctagtggtgtcatcagttggaattctctcaattaggggaacacgtgactctggattaatatcccctattgaagatcccatggcaattatgcagaaaggctattctattactatactgcttgctgttcttacctttggagggtctactcgttggctcctgtacactgaacaagcacctactgcatggttcaattttgccttgtgtggcttggtgggcatcatcacagcatatgcttttgtttggatttccaagtattatacagattataagcatgagcccgtccgccttttagctctttcaagttccacaggacatggaactaatattattgctggagtaagtttgggaatggaagcaacagccttaccagttctagtgatatctgtagccattatatcagcattttggttgggacgtacctgtggcttggtagatgagcttggcaatccaactggtggtctttttgggacagctgtagctacaatgggaatgcttagtactgcagcatatgttctcaccatggacatgtttggtcctatagctgacaatgccggtggtattgtggagatgagccagcagcctgaaagtgttagggaaatcacagacattctagatgctgtgggtaacactacgaaagctaccacaaagggatttgctatagggtcagcagcactggcttcctttctcctgttcagcgcatatatggatgaagtagctgcttttgcacagttgccattcaaagaggttgacatagcaattccagaggtttttgttggtggtttactaggttcgatgcttatattcctgtttagtggatgggcttgttcagctgttggcagaactgcacaagaagttgttactgaggtcaggaggcaattcattgagaggcctggaattatggattacaaagagaagcctgattatggtcgttgtgttgcaattgtggcctctgcatccttgagggaaatgataaagccaggggctttagcaattttgtctcccatggccgttggcatcatctttcggattttgggccatgctacggggcagcctctccttggagctaaagtcgtcgcctctatgctcatgtttgcgaccgttactggtatcctcatggcactcttcctgaacacttccggcggtgcctgggataatgctaagaagtacatcgagagtggtgcacttggtggtaaaggcagtgaggctcacaaggctgcaattactggcgatacggttggagatccgttcaaagacacggcggggccttcaatccatgttctcatcaagatgctcgccacgatcacactggtcatggcccccatcttcttgtaatcattggttgagctcgccgttaaccctgcggagaaatatctatggttcttgtagatgaggcattaacatgaatgggatgtaatgattcgcttttagtttattttgccacattgagaggagaggttcagtgctgcccattttgatggtgcccgtattttacagttgctatttggacaagtgatgcaaacgttggagaatatatatgctgtgacagagattagaatggacatcaaaattcatatgctttgtatgcagagatctcttaattgtttaaaaaaaaaaaatcttctcttcgt

SEQ ID NO: 5623 - DNA, 700 bp, Triticum aestivum
  Clone ID: PAT_TA_5623
taatagtgatcttatattattttgtcggaagtggaaagcctagagcattttttcttactgcccactacttttccaggcactactaacctcttgtacatgtgtgcatattgggacaatgatgatttttcttggggataaattgttgccgaggaggttgagcagagatagttaggtggaacatacggagactaatatgtccaccaaaatgttgagtaacatcttgagggtggggttgagcgtcatgaccgaggacagcatgggcaattgattagctgcttgtagccgactacttgatgaggtttatgacatcaccaatcacataagcacttaccatcaggtgtgcattgacccttgagaaggcttgaacaacatcatattggcttgtgattgtctctccgcggttgagcgcaccaattcctccactatcgaccaattgctggttggtgtcggtatggaggatatcaaagccatgtcatgctctttggcataagtgacttgttctcacattagtatcttagctcatcgatttgaactttttgtatgttctcgagtgcaccagtgtcaatttttgtagatggagacgtgcgttgcacgtgcacatttactagtaattatagataaggacttttggcttaagcctcctttatctcttgataagacatgtcttctctgtcgttcttcttgacacacgcctacacac

SEQ ID NO: 5624 - DNA, 1401 bp, Triticum aestivum
  Clone ID: PAT_TA_5624
gtgccggaggcgcgtccccggccccccccggttgttctcctgggtttcgccacgagcttattacccttgcatttgatgcataactaacacatatttggtagtacacaatatcgtgcaaaaacaacttactacttacacttctcctatgacgctatttactgacttacatttggccaaataaattaaatcaaaatgtccatacatgtgatcctgaagtgaaattacaacagttatttcgggacgcagggagtatatgatattttgatactaaactgaaattacaacattatagactatacagtatatgttgagtattctccaaagggccagaaggagccattcagatggttgcaatcatcaactgatttagtgatttcagaggtatcttcagaaaaagcattccagttgctcaggaaattttgttgtaaggagacatactcatcaccataagactgctcataaacttctacttgctgagcgggataggaggaagacgggaatccgcttgccatgcctccatattcaccagattcgaaagcatgattatcctactgaggagtcacctcttctgcggagtcctggtagtatcccaaattcatcgaccaagaaggttgataagcttcaactgggctgtcaggtacatatgcatagggctgtatctcacatgactgtgtcgatatctccgggttatcaatatggttggtatatgttgagaaattctcgtggtactccagcttgtgagaataaaatgtttccggaggctcaacctgaacatgcagtggttgttcaccagtgtgctgattgtagcaataaataggttgagatgaaaatgtactttctatgccataactgggcaaaacctcctgacactgaggttcctcctctctgtaaacatcctggtagctctgattgggaaaccaggtaggttcatccggaacaacatcaacactgtaagactgttcgtaggatgtgtcatatgagccataggtagaatgggcatatgcatacgtatcctcttttgcattgtggtatgaagatagccaattgctctgatcgtgcgcctggccagcgtcgtgccactgcacattcccatgcacctcgccgtggtcgtgccactgcacattcccacgcacctcgccgtggtcgtgccactgcacattcccagttgacggcacctcggcgtggtcgtgccactgcccattcccaattgccggcacctcaccggcgtcgtgccactgcacattcccaattgccggcggcggcacctcgacgaccacggcgtcctccactccccccttcttgttggcgtacacggggaccccgtggcagtcggtcccgatccgccgctccccgtacccgtcggcgggccgaagaggaacctcgtccgaattcctcagcccg

SEQ ID NO: 5625 - DNA, 1026 bp, Triticum aestivum
  Clone ID: PAT_TA_5625
cgaggagctcaccgacgagctcatatccgacaacatgatcgacttcatgatccccgccgaggactccgtgccagtgctcatcacgctcgccgtcaagttcctcagcgagtgccccctcgccctgcagcagctcgaggaggagaacatggagctcaagatgaggaaaaccgacctgggtgaaaccttgcaatggactgactacatgtccttgtcattcacgcagcatgtgataacggagacgctgcggatcgggaacatcatcagcgggatcatgcgcaaggcggtccgcgacgtcgaggtgaaggggcatctcatccccaaaggatggcgcgtgttcatgtacttccggtcggtccacctcgacgacatgctctacgaggatccctgcaagttcaatccatggaggtggaaggagaaggacatgagcactagcagcttcaccccttttggcggtgggcagaggctgtgcccgggcctggatctggccaggctggaagcttccatctttctccaccacttggtcaccagcttcaggtgggtggccgaggaggaccacatcgtcaacttccccaccgtgcgcctcaagggaggcatgcccatcagggtcaccgccaaagactagctgcctgtcaatcagacggtcgtccttgatcaactccccgcagcagccaagccagccatgcatatacatgatgctgctgctgcaagtatggtatcttccatagcaaggttgaaaggatccttaaaacaagctagctaggcaacatctgatctgagagtacatagttatgggcatgcatgtataagtgttgtagggaagggttaattagccatggagtaagtgccactcatcaccgtggctcgttaatcatagccgaggaagaagactctgaccgatgatgcatgctgttatactagtataagtagtaaatgcttaagtcacaagggataaatatcccacctgtcatgggagaacttgcatccggccggccccgccgggggtctaaccccgtgcggctctctcct

SEQ ID NO: 5626 - DNA, 741 bp, Triticum aestivum
  unsure (1)..(741): unsure at all n locations
  Clone ID: PAT_TA_5626
gtgtgttgggcgccacataacatcttattacatccatatctatatttcagcaaacctacctgaatgctgagcaaaggcatacatgcagtgtgttacacgtaactgtatattacgtccagnacaacatttggccaatccggcttgaatgtaaaaccattcaaacacgacgcttattggaacacattaagtagatgagagaagcaactactagtatgcaatgcattattaacccccagaagtcatgcatgccgctcaccaaatgggctttcatctgacggcggggcttgtgggcccgagctactagtagtgtaggtatcttgctgcattgaggagggcaccgaagtagtgttcaacaggtggttaaggtcaggcaacgacacaccacgttcgaggacctccattgcttccttactggtaggcctcttcctactgtcaggaagagaacaccagagccctaggatagccacacgctccatctgcctcatgtccgagtcgccacaaccatgtagcctgtcatctgtagcttccatcaccctgcctcttacatacagatcccagacctgctccctggactttcccgtgcacgtgatgtccaagaggacgatcccgaagctgaagacgtctgagctaaggttgaacttgactttccccgctttcctgcactctggatctatgtacccttctgtcccaacagcagtcgtcattagcgtcacgttgtcttggttgccgatccttgacagc

SEQ ID NO: 5627 - DNA, 721 bp, Triticum aestivum
  Clone ID: PAT_TA_5627
ttttttttttttttttttgggacgaaatcccaggtccttggcttgttcatgtatgaacagctaattatctcaaatataaatacatgggcttacatgacaacatgtgatgcacaaatatctagctaggtattcgatccacttgtcaaaatgcctactctacaaagccattatgcaaaaggaacttggacgttgatcataaatgctgagtgggcaccaaatactcttgtaagttgtaactgttaagtatggacaaagatctacgaaggcatataactttaggaagaatagcccctcaacgtatgcccatgcatcgtatggttgtaacatgtgtagctgtactcccatcagcatgcactgagaggtcttctaggagtagagtataaggaaacgaaccctcccacctcttgttcaaaaacatctttacagaaaagacaatcagaaatatacttgtgtccgtctgtacatggtcagcttatttcacttggtcacctctcaaacctattgcgtcagaaatatcttcactgctgccttcaggcaatttcatttccttcacttcctcaagctgcctgaggagatctaacctctcggggccatatgtggatgggatcatggaaggcacatatctctggatgaaagccaaaatagcagcatgcccaacagcagtaactggtagaagcatgagtattcctattggaacgacagatgccaaatctgtcagggt

SEQ ID NO: 5628 - DNA, 630 bp, Triticum aestivum
  Clone ID: PAT_TA_5628
gaattcggcacgagatccatccgatctgctccccctctgtcccccacccggcgacagcaaccatctcgtcgccgctctgatgctaaggccgccgccggcgccactgctccctccagcttcccgcgcttccctccttcctccccacaaagccgcaaaccccaacgccgaacccactcccgcgacctccacgaccgccagagccacacccatgggcgtggccgcgtcctggccgcgcgcgctgggtcagcgcttcaacccgggaggcgtggccgcggtggtcgccgtcgcggcgtccgagccgcgtctagcgctgccgcacgtctcggtgcaggacatccggtggctggactgggcggagctccgccgcgccgggttccgcggcgtggttttcgacaaggacaacaccctcaccgcgccctacgctcccgagctctggccgctgctgaccacctcgtttgaccagtgccgcgcggccttccccggcgccatcgctgtctacagcaactccgcagggttgaagcagtatgatccagatgggtcggatgccagtacgattgaggcgactatcgacgggttcatgtgattaggcatgatgcaaaaaagcctgctggagcaacttaagaaatagag

SEQ ID NO: 5629 - DNA, 954 bp, Triticum aestivum
  Clone ID: PAT_TA_5629
ggtgcacataatgtgtatgactgaatagcaaggggaaaatgtttgcaagagcggtgtaattgcaaactcacctcaaaagtgctctaaaactacacaagggtctacggaatgaacgaatctcagctgaatctgctaaaactttctgtctagccgaatggaactattgtcaccactttgttcttaagaagaataaatggaaggaaatgagtagagcaacaaaataaagaatctgtggcactgaggtgaaactacttttgaggtgagctcaggtaatgcacatctgccatcaacttcctagcttctaccaggaaagaacaccaaagttttagcagattcagctgagattcgttcattctggtcacccgtaaataggaaaactcaatctgcatagactgcccaattatccgtccgggccagtgcatcccatgccttaggcttcgttctggccaacacacgctttattcagggggcggcaacaagaatacaaagcccgagttctcccggatgagtgggggcggttcgatgtcagatatgtcaatctgctgcattgatttggatatgtcatcgacggagaacggtatgcttgagtcatcatccagtagaaacgaattgcttacaggattgttggagtcttctgtcatcaatactctcatgtttgatatgacctctggggacacgctatgtgttccgtacttgtcatcccagtacatagtactgatcctgtatagctgttgtatactaagtacctgaacaggatattcagggttgttataaaattccaaggaaatccaacttttcaaacaaagggacgtaatgaaagacttaatgtatttctccactcactggacagaggtcatgacttatttcgtccaacgttttctttggcttttgatgaatcaccaggaaaccaatagcttgtctaatatgtttaagctcatcccaggctgaacctgc

SEQ ID NO: 5630 - DNA, 642 bp, Triticum aestivum
  Clone ID: PAT_TA_5630
tttttttttttttttttttttgttttgggccgtgcgttgcacctatgtattaaattattttttttgcgcccaataatgggtattcatacgaatacacatgaataccctcagcgccgccagtgcaaacacatgtgacaaactagctgaaacaccccgattgggacatacactcccgttcccaaacacacgctttcccttcaactcaactcaacttgaagacgcggtgaactcgccaaaacgcaccatggaagtacacaagataaccagtgagacaaaggcccgatcttcatggcatgcacggatcaaaatgcagtcatgaagcacagctccaagccttccaacacggtgcagctttaagactctcgtcaactcagtttcagaagccggcttagtcctagcacaaaccaagtcaagtcaccctccaaatcttcacattgcagtccaacgaaccgctgcaaatcagcgcggagcagccaccgcgcgggctctcctcgcgctcgctgccgtggtcgcctcccgtcaacaccaatgccaggctcttcacggccgcgccatggccgtccaggacggccgagcaggagtactcgccttccgctccccgtggccacaccctaaccgtcctgtccgcggacccgctgcacg

SEQ ID NO: 5631 - DNA, 1414 bp, Triticum aestivum
  Clone ID: PAT_TA_5631
catcttaaatgacccttataagtggcacatcacaagtaatgtgcagcgaggggattgtaatgtcatagaaaattcagatggtgatggaaagctgaagaagaagaaaaggcgccactcggagtcttcaaaggatggtcctactactcaaggtgtgacaaaaccatctggatccattgcaaatgctcaggtggagactgtaaatgaaccaagcaaggtgaatcaaggggattctaccgtaacagaaaatccaactggtgatgggaagcgtaaaaagaagaggaaactccgcttggagtcttcaaaggatgatcctttgacaaaatcatctggacccactacaggtggaagctcgacacaacatacaagtgacgatcccctaaatgcagagcatacaacacaaggcactataggagaagcaacgggtagtgattgcaggaagcttgatggaaccgcggatgtagcagcaaccaatgtgattcatgaggtattggcagatttaggatgcacagacaacttaagtggagatccagtaaaggaacatactgaaggtgttgttagtgcagccttacctctgaaatatccagcagataatcagtctgatgatcttaatgatgttttgactgagaatacagcagtgccagctgatggcagaaccaaatccagtaagcgtcagagaaagaagacttcattgaagcatgtttctactgatagcagtaaagatattcagtctttgggtgtgcaagtcagacaggttcccacagaggacttggaaggaggaaatgacaccaaagaggaattgcttctggaaggttcttcagttgacgctcctgcaagtactggtcaagtattacggcagaaaagcagaaagtctttgaagactcagactcctacaatacaggaaataaatcatcctacacatggacaagataatcagttcataaaggatgaccaggaaaaatatgtaacggggggtgcgcctcgtaatgacaaaaatatagtaggagctccaacagaatcatcagtacttcataaagatggcacaattatcatgcatgataagcctaatgctcgaaagggaaggaagaaatcttccaagactgaacttcagagtcaggatactgctttggaacaaggttctgttgcagatttgatgaactccagggctcaggagggagcagctattcctaaaggttctgctggtgctgttgaaccaaatgattctgcagcgattcgttctgaaaatggcaaaattaatttcttggaccattttagccccagtgtgatgaatggcccatctgtttctgcagaaaacaatgatgaaactactataagggaagttaagggaaaaaagaaaagcaaaagaaaaccagatatgcagtctcaacatgctggtattattgaaccaaatgatctg

SEQ ID NO: 5632 - DNA, 710 bp, Triticum aestivum
  unsure (1)..(710): unsure at all n locations
  Clone ID: PAT_TA_5632
cccacgcgtccgcggacgcgtggggctggacaccccgggcgccggcgtgccgatgagcgtgttctggctggtgccgcantacgccatccacggcgtggcggaggggttctcgtcggtggggcacatggagttcctgtacgaccaggcgccggagagcatgcgcagcaccgccgccgcgctcttctggctctcggcctccctcggcagctacatgggcacggtgctggtgacggcggtgcagagcgccacgcggggcggcggcgagtggctccaggacaacatcaaccggggcaggctggacgcctactactggctcgtcacctgcctcatggtgctcaaccttggctactacctcgtctgcttccacttctacaccatgaagccactggaggtggcggaagacgacggcgaccacgagaaggagtgcgagctgtcctccgtccacaaaaatggcgacggcggcgccgccggcgggctggtataagatcgtgtagagggagggtatagtaattacggggaatctggttagtaagcactagtaactagttacagaacacatgcgtgcacaaccgttgcaacgtccaaatggccttggatctagctagtatagtgagtatcccgtgacaagatccaattgtgaagataatgttcctgatcttgtcgcaaaagaaagaaaaagaagataatgcagcaaaaggcaaccatgatat

SEQ ID NO: 5633 - DNA, 1158 bp, Triticum aestivum
  unsure (1)..(1158): unsure at all n locations
  Clone ID: PAT_TA_5633
cgagggtagctgagtcgccaactccacttgtcggatcttgccccatatggagctcgccggagccgcacaccctcagccgccggagtccgacgtggcgccgccccgtacgcctccgcaggcgccggtagaggattcatgcaaagatacaggagacacaaggatcactgaggaaaattcatgcacaccgccggacttaaatcttagtcaaccaaataattctggccttaatagttcgagtgcgtgtgagaaccagacatccaacggtgatgagatgactgaaccagaatccacactggaagcagctaagaccgagggtgatggatcaaacaaagagaaggtcctaaagaagccagacaagattctgccatgtcctcggtgtaacagcatggacacaaagttctgttactacaacaattacaacatacaccaaccaaggcatttttgcaggggttgtcaaaggtattggacggcaggtggaagcatgagaaacctccctgtcggtgctggtaggcgcaagagtaagagctccagcacaaactgtaacggtatattgattccaggagacagtctatccgctcctggaggtgatgcttccgtcattccattgcctataaaggaaaatcaaccagcagttaagtttgggtctgattcaactctacctaactccatggcttctttgttgagagttgaagagcagaataagaacagcaaccctgcgtcaacagcacatcccagaaatggtgagaaccagacctgtccaccttcagcaacaacttctgataatccacggattgagtcagttaaagcagcagttggggtacatcaaaatggattaccgggggattcatgggcgtcctcccatgcctcctatacctgcttcccggcccctttatgaccatggaacccactgggatgggngtctgccntggnanaccnntgtgccagcccantgacctgnaattgtcaaaaangcctgggggaacnttaatggaatttcnccannggccgnccnggntttgggccnccnttttttcnntnngcnnttnnnnggnnnnnnttnnctnnnnannggnnngggnnncnngnntnnccnnttttnntnnnnnnccccccnnannnnnnnnnttnnanngggttnnnnnntnaaannnanggttt

SEQ ID NO: 5634 - DNA, 738 bp, Triticum aestivum
  Clone ID: PAT_TA_5634
tttgaattcggcacgagccttgcagatctttatgcagattactttttcaaagcaaccttggatgagaacttccgggtagctgatattgaggttgaggtggaaattgattcacacaagcaagacagggagcatatcccaactttgtcgattgaagcaacattatttgataattctgaatcatctgatgatttgaattcagacatgtcagctgctaacgtggtcaacttgaagacaaagccagagcctaagggcggcccttgccatggttttcatggttatgttcttggtggaaaagtggaaaatccaaagctttggtctagtgaaaaaccgaacttatacactcttgttgttctccttaaagatgccaatgggaagcttattgattgcgaatcatgccaagtagggatccgtaatgtggtcctggcacacaagcagatgcttgtcaatggatctcctgttgtaattagaggtgtcaacagacatgagcatcatccacgtgttgggaagacaaatttagaagcatgcatgatcaaggatctggtcttgatgagacaaaacaacatcaatgctgttagaaactcccattacccccaacattcaaggtggtatgagttatgcgatatttttggtctttatgtaattgatgaagccaatatcgagacacatggctttgatgaaactagccatttcaaacatcctacactagaacccatctgggcaaattctatgcttgatcgt

SEQ ID NO: 5635 - DNA, 666 bp, Triticum aestivum
  Clone ID: PAT_TA_5635
ccggcgggcttccacctccaggcagccaaacatgggagttgatggagctgctcttgcagctaatattatgcagaatatacttatgggagccaaccagttccagcagtatttacagaatcagaactttggtggctgcccaaatggaatgcccatggcccagcaacaatttatgccagggagcacaatgagtgcaaacatgatgccatttggtggaccgccggtaaatcatccttttggtcaggcatctcaatttccttttggggcaaggcaactttggtcagtttccacacatggctggcaaccaagcgccacctgctggatttcccaacacccaaggatttgggcgcttcccatcacaacatgaggatggagatcagcctcctggaaatgcaaacatgcaaggacatgggcgcctcccttcaccgcacggagatggaggccagcctcctatgcagttcaattccctaccatcaccccgcggagatggaggtcagcagcctcctatgcagttcaattcgctaccatcaccccacggagattgaggtcagcctcctatgcagttcaattcgctaccttcgccccgtgcagattgaggtcagcctcctatgaaattcaattcggggcagtttaatcaggggaactcatccttccgtggtagaagaccac

SEQ ID NO: 5636 - DNA, 1281 bp, Triticum aestivum
  unsure (1)..(1281): unsure at all n locations
  Clone ID: PAT_TA_5636
ccacgcgtccgatccatctctacaatcaaccagtgtttcttcaaagaaattcgaaaaccatgctatgctatcaacagtacaactgcatagtacagatccatggaagcaaaatctagcagctggaagtggaactatggtacctgctaaacttcgccgtgctctacaggcatcacgacactctctacatgggggagttcctcctgtcaagtcctcgccgcagactaatccatcatacaactataatgcttcacatgttggatcggacctccgtaagatggccatagctgagaaattccaaccaagctcaaagccaagaagctatgtaaatggtttaactggaaagttgagttcagtgtgtcggccgaacttaagtaaagaaaaacagccaagaggttcgacgtcctcagaaatagttgccacatcctatacatcaaggctgcatattggcaatcctgaggggaaaatcatcattaagactgatcaatataacagagatgacttcgnnntggtgtatccccgtgcaaaattccgtgttatcaagcgttggggcgaggcaaatgttcacaaatccatcaaatatggtgtctggtcgagcggtcttcagggaaacaagaagctggatagtgcatttagagatgctcaaatgatagctgcaagcagttctaccttgtgtccagtttttctgttcttttcggtcaatgaaagtaaccatttctgtggtgttgctgagatggttggccctgttgattttcaaaaggacatggacttttggagcatggatagatgggttggaagttttcctgtgaggtggcacattataaagaatataccaaatgtcgccttgaaatgtatcttgctgcggaacaatgaagataagcctgtcacctccagcaaaaatacacaagagatacactatgttcccggaactagtatgctcaggatcttcaaaggttcaaaaacaaatggatgtctgcttgattgcttcacggtgtatgaggcggaagaagcaagaggcagaaaatgcaggatgtccaagcttaggcgtgatgctccacgtttcatacctgtcccgaagctgtctctgcaccatgcctacgttcctcggcagcccaaagctgacagaatactgatggacagaattatcagggagacgcacgatctggcaagcaacggcatgcagcagagctcatgggaagaacctgggaacctggctagatattctgccaaggcatctgcacaaaaagaaaaccgtagctctggaaaacaagctcgtgaggatgt

SEQ ID NO: 5637 - DNA, 651 bp, Triticum aestivum
  unsure (1)..(651): unsure at all n locations
  Clone ID: PAT_TA_5637
gctcgccagatcagaagccttgtcgtcgtctccctcgacctccaccgcccgagctcgccatggtcacgacggcgtcggcgcgcgcgcaccagcagcacggcgggaagcagcagcagtaccagccgctgcggcgcattgaggggctgagcctgaggtccgcgctccgcagcgacccgcgcgtccccgcgctggccgcggccgcgctcctcgtcccgctcggcgccgcgctgctggccctctccggcctcttcctgctggccacgctcgccggcgtcgcgctctcggcgccgctcatcctgctcttcagtccggttctcgtgcccgccgccctcggggccgcgctggccgtcgctgggctcgccgccgctggcgcgctcgccgtctcggggctctcggcgctcgtctgggtcgtggggtacgtcaagaggggcctggcgcaaggcgactccggccgggtgggcggaatggtggtgcagccgttggacagcgggaagccgcgacgccaagagggggcgccccccccctccgggagccggcccgagccctggcccctggcctcggccctcgcgggacntcacacgccggattnncaagactaacttgagaacacggttaattatgacttcgccnctnctagctttatntncaatt

SEQ ID NO: 5638 - DNA, 681 bp, Triticum aestivum
  Clone ID: PAT_TA_5638
acgaggggacttgcgtcccgcagcatttgacagccccgcgttcctgcccagtgcagcgcctcgatgcctagattcaaatcaaactcttccagtggcaacgcgcaacgaccgttcatggcgaggcagacgacgcagccgccgttgagcacgatctcccgattcgagccggtggaggcgagcacctggctagggtgccccacggcggcgccaggtacggcgctcaggtacggcgtccacgaggagccccgtgtgaccaattatttcgccgggtccaagaacggcaagggcgaggaggagggcatcgtggtgtctatcagcctgtccaagaacgtcatgaagaactcgcccaacccgtcggcatctcgagctcatccaacctggcggcgactctagctcgcgcccgccgcatcaatctcatgcccaccagatcatcggctccccgtcgaagacaacgcgatgacgcactccagctccctgctgccccacctcaatgtgaactgcacgaggacgattgctcggcggttgcctcaccctagctctctgcttcaactcatgtcggcccggtgctgggcatggtgttcacggcaaccacgccggcgtcataggtacagtggcacacaaccaatcccttcctctatctcttctggagggtggcgaggaattgatatggcctgcggttga

SEQ ID NO: 5639 - DNA, 1095 bp, Triticum aestivum
  Clone ID: PAT_TA_5639
cgccaacctcaccggcctccccgccgacgcgtgcggcaagcgcttgcaggccctcatcgtctcgtccggggtcgtcaagacgtaccagcccgccgtcgacgagggccccaacctcttcgcgcccaccgacgacgccttccagcccaacgccgtccccgacctgcgcaaggtcatccgcgccgacctcgggtgccagctggagtaccgcgtcctggcgcagtacgcggccaaggcgccgcgccaggccatgaatggcggaagccccaccctggcctccacccgcaaggggaagtacgccctctccgtggtcgcccagggcgacgacgtgtccatggacaccggcatggacgagtcccgcgtcgcgtccgccgtgctcgacgacaccccggtgaccgcgcacacggtggacaacgtccggctgccgccggagctcttcggcggcgccccgtcgcaggcacccgccgcgtcggccgatggccacgcctcggccccggcccccgaagcgtcctccgcgccggcgccctcgcctgaccacgacgagaacaaaccgaaacacaagtcgccagcgcattccccacccgcgccgccggctgatacgcctgacacggcccccgccgagtcgccggagggagacgaggaggcggacaaggccgccgacaagaacggcgcgaccgcggtgggcatgagcatcgcggccatggtggcctctgtcgctctggtcggcgcgtcactcttctgatctgcccaagtgttcgacatcgagcactcgttttgctttcctgtgggcgcgaatgatgtgatgcactccgttcttggttgcgagttcgtgggccattgaaatgctcatccgaagttgttacttcttcctggttggatcatttgggcgattgtgatacattccctggtagtttcaccagctgcctagaaatctattaagtttgattttgctatgctcgttccagttgttgatgcattgcattccatctgccaagaactccattccatatcctgatgcagttatcttgcattctcgatgaagtagcttgtgaacagagatttgatcttacaaattaatcgatgcattggttcgtcgcc

SEQ ID NO: 5640 - DNA, 935 bp, Triticum aestivum
  unsure (1)..(935): unsure at all n locations
  Clone ID: PAT_TA_5640
ccaactacgacatctaccgaaatattgggaggctggtgggaactgcaatttggcctttgctgcagctaggcttgggcttcgctgctccacactgggacatgtangagaggaaatttatggaaagtttcttcttgatgtgcttgaggccgnaagcattagcgttgttgggatgcttgaaaatgctgatgttactgcatgtcgacaagcctatgagacgcttctatgctgggttcttgtagatccatctcggaccgaattagtctcgaggggatgcttgaaaatgctgatgttactgcatgtcgacatgcctatgagacccttctatgctgggttcttgtagatccattccagaggcatggattctgcagccgtgcagactttagtaaagagccagctttcagttggatacgtaaacttccagcagaaaccaagatagccattcatcactctaaaatattgtttagcaatggatatgcttttgatgaattttcccctgatgtgattgcatctgctattgattgtgcgattgatgcgggaacatcagtattctttgatcctgggcctcgtggaaggtctctcttacatgggaaccgggatgaacaagagagcgctggagcacgctctgaggctcagcgatgttctccttttgacggcagatgaggctgagtccctaaccaacatcggaaaccaattcaaggcanggcaagaattgctaagaaagagggaacccgaacaaaatggggttggcatcaaaatggggtcccgggggggtcatgtcacgaaagcgcgtttatgtnacttcttaanatcgcttgtgaacgttgatcgaatactcatgcgcanncttcggtcncaggntgcggatacaccatcacaatnatcgngtnaccacggttgcagaggattccacaaaancgacctaaacgtcangagaa

SEQ ID NO: 5641 - DNA, 1146 bp, Triticum aestivum
  Clone ID: PAT_TA_5641
gcacgaggggacagggatgctgcgatccctcgccgccgccgcgcgctcgccggcggccgccgcgtggcggcgcctcctccaccatggcagagacatcggcggtggggaggaggtggagagcatggcgtaccgcatgtcgatgctgcgggctccccctgtcgcgcggaagaaggatattgtcagctctaactcgtgcagcctcatcggccgcctcaacgcgccggtgcgcctgcaccggaacagctccgaggaggacccgaaggcttacaccttcctctgcgttacgccctcttcctcgtcctcgtcgacctctgccaacttccaagtgacactgcagctgaagggcgatctggcaaatgtgtgcctgaagcatttgaagtacaatgaccttgtacatgtatctggttttctgaactcttatcataaagtcagtggaactggtgaaaagtatgtgtgctataagattcacgtcaaggaactgaattatgttcatgatcccaagaatcctaggaatgataaagactcggtagatccagcatcaacaccatctgcggatactcaaacacttgaagaaatcaagtacagagaaaggcttcgtctgtggcaagtcttctttgccagcccttacgagtggtgggataaccggcaatacaaaccatacgccagttgcgctgatttcaagcacaaggacacccgtgagcagctatggcttcatccagatgaccctccttgggtaagaaagcagctcgaattgattgaccagcaaacagcagagagtggtcgcagggatggcagagggcgcttgacaaacccaagatggaacgctcaagacttcaactactctgacgaatgtgacgatgatgagcaggacacgcaaaggcaggcgaatggatgactgaattctgcaagatgactgataaggcgggtctcctgcactgactatgcttgactgtaaaactgaatggaagtgtgtgtgtgtatagatggttagagaactcgatcgcaggactcgtcggactatgggatttggtccttgtgtgcaaatgctgaatagtgtgggttgtaactcgtgtgcctccgccgcggccacggagggaatctggacatccgatgcactttattaactcttatctagtgatgtttatc

SEQ ID NO: 5642 - DNA, 700 bp, Triticum aestivum
  Clone ID: PAT_TA_5642
ttttttttttaatggaaatcgtcatgcttgttcaaatttcattaaaatatatgtagacatttaaggtacacggtggttgaatgaccaggccccgtcggttgaacgactagctcggctcctgtaccactgtgcacggacagataatacatctacggacagataatacatccgttttagaagtccgccgtggggaaaaaaaagacacacggcgcacgctagaacggccctcgggccgtatcacgggcatcttatttattcagctcgagttgctcaatttgtttttattcagctcgagccttagctcaagaggactagtaggcagcggacagccagccggggccggcagctcagtgctgtccgggcagcttctccttgatcttgtccacgagtcccttcttctcgccggcgccggcgccggccattcctgcgtgcccatgctggccgtagtctccgccggccccagttcccgcggccgtgtgctgcccataagccccgccagctccagttcccgcggccatgtgctgctggttgtctttgtggccacccgggagcttctccttgacgcccttcttcctcctcccgcccatgccgtcgtcctcagaagacgagctggagctggagctgccggagcggtgcagtatcccgccggtcttgtgctcctccctgccgtgctggagctgcccgccggcgcccgtgaacg

SEQ ID NO: 5643 - DNA, 663 bp, Triticum aestivum
  Clone ID: PAT_TA_5643
tcgcgtacctcccagccaccccttcgccagctctcttcttgatcagacaagctacgttcgagaaaccgcaaagatgtccgacttcaacgccatcgcccagcagttcgttcagttctactacaagactttcgatgagaaccgcgctggtctcggtgccctctacaaggagacttctatgctcacctttgaggcgcaaggcactcagggttccgctgccattgtagagaagctccagaacctgccattccagcagatacagcaccgtaccgacactgtcgacgctcagccttccgctgatgacggtatccttgtgctcgtcaccggtgcgcttttgcttgcgggcgaggacaagccaatgagcttcacccaggccttccagctcaagaacgctgatggcaactggttcgttctgaacgacgttttccgtctcgtataccccgccgcgtaggctatccgctcgctgttgagcgtgatttcaccacgccggtgactttggggcgtgcatagagagtcactgagtcttagcgactttgaacacgactgacgcgattttcttacgagttttgagcattttggcggaggcaacataggtgcggatgggatcgaggatcgatgcttgacgcagtcatctttgggagtgtagctactcacgagttctacaca

SEQ ID NO: 5644 - DNA, 1240 bp, Triticum aestivum
  unsure (1)..(1240): unsure at all n locations
  Clone ID: PAT_TA_5644
ccacgcgtccgnntcgggcaccaggccccagtccccgccgaggacgaggcattgcgaggtcgggcccggcggcggcggcggcgcggagcagccacggcgccaggaatgaagggcggcggtggcggtggcggcggcaaggagtccgccaccggctccttcctccgcttcctcctcctgctcctcctccccctcaccgccctctatttcttctacacgctccacctcctcctcgcctccgccgcctcctcgtccgccgcctcctgcccgccggaccccaccgcggtctcctcccgcgtctccaccaaccgcaccgccgcggcggtggccggcagtaaggccgcccccgcggcggcggcggcgtccacggccacgacgctgcagcacgtggtgttcggcatcgcggcctcgtcgcggttctgggacaagcgcaaggagtacatcaaggtngtggtggcgcccgcgcggcgccatgcgcggctacgtctggctggaccgcgaggtgcgggagtccaacatgtcgacggcgcggacggggctcccggccatcaagatctcctccgacacctccgccttcccctacacgcaccggcgcggccaccgctccgccatccgcatctcccgcatcgtctccgagaccttccgcctcggcctccccggcgtgcgctggttcgtcatgggcgacgacgacaccgtcttcttcccggacaacctgctcaccgtcctcaacaagttcgaccaccgacagccctactacatcggctccctctccgagagccacctgcagaacatctacttctcctacgggatggcgtacggcggcggcggctttgcatcagcaagcccctggcggaggcgctcgcgcggattcaggacggctgcatcagccgctacccggcgctctacggcagcgacgaccggatccaggcgtgcatggcggagctgggggtgccgctgaccaagcacccggggttccaccagtacgacgtctacggggacctcctgggcctcctcgcggcgcacccggtggcgccgatcgtgacgctgcaccacctggacgtcgtgcagccgctgttccccaacgcgcccgcgcgccctgcggcggtgcggaggctgttcagcgggcccgtgaagctggacccggcggggataatgcagcagtccatctgctacgacggggcgaaccggtggacggtgtcggtggcgtgggggttcgccgtgctggtgtcgaggggggtgacct

SEQ ID NO: 5645 - DNA, 1393 bp, Triticum aestivum
  unsure (1)..(1393): unsure at all n locations
  Clone ID: PAT_TA_5645
ccccgcgtccgctcgcacgcgccgngatggcgtccacgctcgcacctcctcggcggcatcaccccccaccgccgtcgacccggaccagccccggccgcctcctccacctctcgcgctccgctgttcctgctcgccgtgttcagctcgggcgggcctcgacggtgtcccctcgcgccttcttcggccgcgccgacctcgacggccttctgcagcgcgcttggcggggcgccaacgcgggggccgagcgcctctccttcgaggcgcgacaggccgcgcagcgcctggacgggcggtactcgatctcgcgccgcgtggccgaggccgcgcgcgcggcgcgggaacgagccgctgagatcgacgccgagctcggcgtcggccggcgatggcggtccttctccgtcgacttctcccgcagctggcctaggtatcggagggagctgagtgacttcctggcgactcctatcgggagagccttgtctacacttactttcgtgtggcttgcactgtcggggtggctcttcagaattttcattttcagtacattcgtgctaccatttgcagcccctcttctccttgggacctttgctaacagggttgctattgagggatcgtgcccagcatgtaaaagacggttcgtgggctaccgcaaccaggtgatccggtgcatgaattgccaaaacattgtgtggcagccaaacagcaggtcctcgggaggcggtggcggtggtggttcaagaagctcagggcctgattacatcgacgtggagttcgaggagaagtgatgaacgcgctgttcttgcactttacacgggctaatcaggcgtggaggagagggaatgagaagaccgtgtgctcaggctgcgattggtgagccgttttgtatatgcggctgtgttcgttattaggtgtgttgttgtacattatatgtgcctgttattacagatgggctggcatgcgcaaactcacttctggccttgcagtacttgttacattttgtgagtgcagtagggagactgtaatttgtagagcatgcaaatgccacttcagtaatgaatcttggaaagcaaaaaaataaataaaacccgtgcacatctatcataaaaaaaaaaaaaaaaaaaaaaaaaaaaaaaaaaaaaaaaaaaaaaaaaaaaaaaaaaaaaaaaaaaaaaaaaaaaaaaaaaagggggggaaaaaaaaaaaaaaaaaaaataaataaaacataaagggggggggccgttttaaagaaccaaagttaacaaccgggggggggggggggaatattttttttatggggccccaaaaatcaattgccgggcccggtttttaaaaccggggggaggggaaaaccctgggggtccccaatttaaatgggttggaaaaaaatccccttttc

SEQ ID NO: 5646 - DNA, 835 bp, Triticum aestivum
  unsure (1)..(835): unsure at all n locations
  Clone ID: PAT_TA_5646
cgaccgggcgggaggtggtgtgctgcaccccgccccgggggactcccgggtacctggacccggactaccaccggtcgttccagctgacggagaagagcgacgtgtacagcttcggcgtggtggtgctggagctggtgacggggctgcggcccgtggacgtgggccgggagcggcgggacgtgacgctggcggactgggtggtgtccaagatccagatcggcgagctgagggaggtgatggacccggcggtgctgggcgagctccccggcgtgatgcccagcgtggaggcggtggcggagctggcgttccggtgcgtggcgccggacaaggacgaccggcccgacgcccgggaggcgctggccgagctgaggaggatccaggggatgctccccgagctgtccagccacaaggactcctcttgactttggattgcacagatcagaactgagccagctctgcaaaatctcggattgttgatggctgcggttcaaatcctgatctctttggctgacagattagtcgcactgatcgttgcatttgtcgaagacgagtgcctcattgtggatgaccggatggcaaatctgttcagacatgtcgcgacccaaatccaaggtacgtggaggtttatagatatactgagatcaatcaacggtaggaggacactgtgacagtaatacgagcttgattgtgtcggttcctgtgagctcaaggagtagcacgagcaagttccacccgcctgtcagggtcgacagagcgctggtcatccaaacggaacgctccgggaaaaatagcccgcctgtccgtctcaggcgggttgttttcccgtnataatttc

SEQ ID NO: 5647 - DNA, 1129 bp, Triticum aestivum
  unsure (1)..(1129): unsure at all n locations
  Clone ID: PAT_TA_5647
nnnnnnnnnnnnnnnnnnnnnnnnnnnnnnnnnnnnnnnnnggggntntttttacggaccgcctcgagccggccgggccgggttctccatacagcgggactcctctcgcgtaggcaagagcttactctcaaccaaggtgaggaaagtgtggatcgaatcgaaccgaacccaatcctaagcaagcgaccggaaggaaggaaggggatggcgatggcgctgttgaaggtgtatgcggaccggctgtcgcagccgtcgcgcgccatcatcatcttgtgcaaggtcaaccggatcgacttccaggagctcaccgtggatctcgccaagggacaacaccgcgcaccagagttcaccaaaatcaaccccatggcacaggtcccaacaatcgtcgatggaagattcaaactatttgaaagccatgccattctgaggtatcttgccaccgtcttccccggggttccagatcactggtaccctgctgacttatttaccagagcaaaactcgagtctgtcttggattggcatcactctaatctgcgccgtggtgcagcaacctatgtactgcacaccgcgttgggtcctgctctcggtctcacaccgaatcctgaaaccgcaaaagaggccgagaagttgctgtcacgatcactgggaacgatcgaaaccgtgtggctcaaaggcgatgccaaattcttgaatggcaacccccagccatcaatcgcagacctcagcctcgtgtgcgagataatgcagctggaggttgttggtgacgagaggcgtgacagaattctgggacctcacgacaaggtgcgcgcttggatggagaatgtgaagaaggccaccagccctcattttgatgaggtccatgagctcatcttcaaactcaaggcgcgcttgaacccagtatccaagctctgaatacatggatcctcctacatttacccaattcttctttcttcttgggatgaaaaccaagtactagcatccatgtactgtacgatgaaagaaagaaataaggaacaacaagaaccttgatgcttgatgctttgcttgtgctgtaaatcttcttccttgatgcttgatgctttgcttgtgctgtaaatcttcttgtgtacaaaactcaccttgctgttct

SEQ ID NO: 5648 - DNA, 1257 bp, Triticum aestivum
  Clone ID: PAT_TA_5648
cccacgcgtccgcccacgcgtgcggcttatcttccctaagcagggagagcagagcagaggtagagcagagcccggcagaaagggggtagggcagagcttcctctcaaccaaggtgaggagggtgtggttactttcccttaaaaaaaaggtgaggagggtgtggatcaatcgaatcgcgtcgaatcctaagctgaggatggcggcggtgctcaaggtgtatgcggaccggctgtcgcagccgtcgcgcgccatcatcatcttgtacaaggtcgaccggatcgacgtccaggaccacggcgtagatctcgccaagggacaacaccgcgtacccgaattcaccaaaatcacccccatgggtcaggtcccaacaatagccgattgaagattcaaactctttgaaagccctggcattctgaggtatcttgccaccgtcttccccggggttccagatcactggtatccggccgacttatttaccagagcaaaactcgagtctgtcttggattggcatcactctaatctgcgccgtggtgcagcaacctatgtactgcacaccgcgtcgggtcttgctctcgacctcacgccgaatcctagaaaccgcaaaagagtccgagcagttgctgtggggatcaatcgagaacctgttcgcaaccgtggggctcaaaggcgacgcaaatttcttccatggcaaccccaacccaacaatcgcagacctcatgctcgtgtgagagctaatgcagctggtaggtggttaggtgatgagcgacgtgacaggaattctgggaaatcaccacacgttgatcgcgttggttaggagaatgtgaagaaggtcaccagccctcattttgatggcttacatgcgctcatcatcaaagtcaaagccccgcatgaaccgcgctgcacacattccctgaaaagatggcccctacgctgggtttccaacatcttctttcttcttgtcttgggattaaaacaagtactagcatccatgtacttgtacgatgaaaagaaagaaatactagtattgtttcattacgacatttcgacattaagtaagcaatactagtattggtgagtgagccattgtattctgtttcaaccagactgatgcgatcttacagcttgtactcttcaaaattgatgtttcattacggtacaaagcgaaacaggcatacgattcagattccaggctccagcacaaaaatctccttgctcttctagtgctgtacgtgcccccttaaaaaaaaaaaaaaaaaa

SEQ ID NO: 5649 - DNA, 1113 bp, Triticum aestivum
  Clone ID: PAT_TA_5649
gaaaaggcaaaaaaaaaacttaaccggaagcgccgtatccctctcgtcggcagcggcgcggcggcgagacgagccgagggcgccaggcggagccattggacccggcttcatccaccggagcttgcctgcatgtaaacttgtcatggctatagtatgtagtgtaaagcagatggaagcgagtcagcaacaaggatttggagttgaacagaagtcaggaccagagcaaacagatgagatgctagcatcacaggttaaccaaaagttcacggaaatgtgcctagacgacactgctgtggaagctggcattgttcaagaaaagcaagatgatccagaggcaagattggaggttcatcagaagtttgctgaaatgtgcctagacactgctgtgggaactgatattaaccaagaaaatcgatctgatcaagaggcaagatcggaggctgatcaaaaacctgcagaaactatcaggcagtgcacagttgtggaatccaatgttaagccagaagagcagcaggctgctgctaatccaggtgtcatttaccgctgcaaaaagtgtcggaggatggtagcaacacaagagtacgtcgtcacgcacgaggtaggcctaggagaggcaggcttcttaaagcgcagaaacgatgcggatgagaagaagcctgaatgcagtgcctgcatcttcgtggagcccatgaagtggatgcaggctgtggaagaggggtacgtttcgaacaagctgtggtgcatgggatgcaagacccggctgggatcgttcgactgggcaggcatgcagtgctgctgcggagcgtgggtgatcccggctttccagctgctcaagagcaggatcgacgagtctcacatgtgattttactcggccaagtggccttgccattgctgggcgagttagtggttagcggtgatactgcagcagcatatgtaggaactaggaactgatactgtcagatttgtttctctgtataaagtgcgcttatcttgtccaccacatcagctttgcccagcgtctgttttgattgacggctcttaaccagtacgtacttccttcgtctcaaaaaagaaacctataaattttctgtcaggtccaaaaaaaaaaaaaaa

SEQ ID NO: 5650 - DNA, 1312 bp, Triticum aestivum
  unsure (1)..(1312): unsure at all n locations
  Clone ID: PAT_TA_5650
gcccgctccccctccgggtgcccctccccctccctgcgcgcctctcccggtcggcgacgtggtgcgctgggatggctccgcctttgcccgggcgcactgataatgaaataaaaaactactggaacactcgaataaagaaatgccagcgcacctctacgcctatatatcctgctgaaatatgcctgcaggcttcaaatgaagagcagcatgagtccactgacttcagttttagcgagaatctggccaatgatctcctccatggaaatggtttatatgatcccagctccacgtggggcgatttcattgatgaccaagaagctctgtcttctgcgcccctgcttcccgaccttctgtgggccactttccccgtcggggcggcgagcctaatcactatgcccccatccatcatggggaccaagcgggctcgctgggcggctcgtttacctcggctccctggttgtgagatgccattcttcgggaacactcgaataaagaaacgccagcgcaccgctacgcctatatttcctgctgaattatgcctacaggcttcaaatgaagatcagcatgagtccgctgacttcagttttagcgagaagctggccaatgatctcctccatggaaatggtttatatgatcccagttcaacgtggggcgatttcattgatgaccaagaagctttgtcttatgcgccccagcttccagatgtttctttcagcaatttacctggtctgtactttgagtcaacaaaccatggcttcgtggatcaagttaaccaagcagaagttctgaaagaatctgagatttcatttccttggttgaacgcggccatcaatggtaccttcgatggcagccatgccttttcaaatggcaacttctctacttccaggcccatgactggtccctggaagatggagctcccttcactccaatttgctggatctgatccaaacaactggtccgcatactcaaggacctgcgccgcgcagggtgccaactttgctgatccctgcatgcgctcatcagcggcaatggcatcagctaagtttgagcacatgtgcatgataccagggaacagcggtcagttggaagagccgcttccagaagctcatgcagtaagctctgcagagaaccagcagctgtccgtggggagnncgagtgcctctactggctcaccctgcgatgctatggtggaaacatcnnnncttcatttcttggaacgggatcccaacctgtacgcccttgtcaacagctgttcgcccgcctcgcctctttgccangcancgnntgatgngttaccgtgctccgatttttc

SEQ ID NO: 5651 - DNA, 507 bp, Triticum aestivum
  unsure (1)..(507): unsure at all n locations
  Clone ID: PAT_TA_5651
ctgcgcgcgtgcggcacgtcccaagctggtcagactagagcggctgagcctctcaaagggcgtgctgatacttggggtataagtatcttcggagaagaatcattggccgaggcgagatgacgatgcatctggagcttttcttcttcttgctcatgccgtaggaggaggaggagaggccgccgtcggctggcatggagttcccccattcacacttggctctctcggttgctattgttcagttcaggtaggaaggagggttttgttcttgtgatctccgtgttcttagatttttcttgtgttcttagatagggaggatggggttgcatctccttctcctcttgttgcgtgtggttggttgcagcgtgattgtatttttcttctatcaaggccaataaatctttggctgtctctttccctatgtgatttgttcgngatgacctcccggaaatgcatgtgtttctggatgcgattatgattgtaaaaaaaaaaaaaaaaaaaaaaaaaaaa

SEQ ID NO: 5652 - DNA, 523 bp, Triticum aestivum
  unsure (1)..(523): unsure at all n locations
  Clone ID: PAT_TA_5652
tcgtgaacggcttcttcgcggtcgacatcctgctcactttcttcgtgccctncgtcgacaacaagtcttaccttgtcgtcgacgatccgaagaagatcgcactcaggtatctgtcgacctggttcatctttgacgtttgctccacggttccattccgctccatcacccgcctcttcaccaggcacgagcacagcctcggcctcaagttcctcaacgtgcttcgcctctggcggctgcgcagagtcagctccttgtttgcaaggcttgagaaggacatccgtctcaactacgccgtgatacgctgcacaaagctcatctcggtcaccctgttcgcggtgcactgcgccgggtgcatcaactacctgatcgcggacaggtacccggacccggcgaggacttggataggcgcggcgcacccggacttcagggaggacgggctgtgggtgcgctacgtcacgtgcctctactggtccatcaccaccatgaccaccaccggctacggcgacctgcacgcccagaacgc

SEQ ID NO: 5653 - DNA, 862 bp, Triticum aestivum
  Clone ID: PAT_TA_5653
ttctccgccgccccctcccctcggaagaaacgtccgccgcgtgggcgacctccgccgagcgccgggcaagatggggttcatcggcgaccaggtggaggcgatccgctcgatgcaggtccgccaggtgctcgcgcagatcatcagcctcggtatgattgttacgtcggcattgatcatatggaaggggttgatggttgcgactgggagtgagtccccggtggtcgtggttctttctggtagcatggagcctggcttcaaaaggggtgatatcctgtttttgcgcatgagcaaagaacccatccgtactggagaaatagttgtttttaatgttgatggccgtgaaattccaattgttcaccgtgtgattaaggttcatgaacgccaggaaagtgctgaagttgacatcctcacaaaaggtgacaacaattttggggatgaccgactgctgtacgcacacggtcagctgtggcttcagcagcatcacatcatggggcgggctgtaggctatcttccatacgttgggtgggttaccattgtgatgactgagaagccgatcatcaagtaccttctgattggcgcgctgggcctgctggtgataacgtcgaaagactgaagattccaccttgtcacagggtcgtagtttggtcttgtagtagcgcagaagtaaccgacagctgaagatgttgcatcgtgtattgaatggaagttttcatgtgtctgaatatgtatctggcccgccgaacaaggtgttacgcaacactcatcttctgatagtcctaactaatgatgtcaatctggttattgcattctgttttgacttctcgtgtattgaatggaagtaaccgacaccactttcgacgtt

SEQ ID NO: 5654 - DNA, 975 bp, Triticum aestivum
  Clone ID: PAT_TA_5654
cgcagacctgccttctgttcgagtcctcgcaatcgtgcgttcttcgccgccccctcccctcggacgaaacgatcgccgcgagcagcagatccccgtcgagcagccagccgggcgagaatggggttcatcggcgaccagctgggagtcgatccggtcgatgcgggtccgcgaggtcgtcacgcagattcatccagccccgggtatgattgttaccaggtcacactgatcatatggaagggattgatggtcgcggacagggaagccagtggtcgatggttggttcgttgtttgtggtgagcattggtaggtcgtggatttaaaaggggctgatattctgttttttgcacaatgagcaagagaacctatccgcactggtggaaataagtagtttttaatattgatggccgtgaaattccaattgttcaccgtgtgatcaagggttcatgaacggcaagaaagtgggagaagttgatatcctcagcaaaagggcgattaataattttggcggcacgacctgatcttcttgtatgcacaagggacagctttggctttcagaagcatcacattatggggcgggctgtaggctatctaccatatgttgggtgggttacgattgtgatgactgagaagcccatcattaaggtaccttctggattggccgcgctgggcctgcttgtcataacatcggaaagacgtgaagctgtcaacctttagcacactagtttatcattgtaatcagcatgggcagaacaagttttgttgcgccgtgtaccgaatggaagatgtatttttatctgttttgactgttgtctctgccctaaagcctaaacctggctcttatgcaatagttatcttctgatggtcttaactaatgaatttgatctttctattgcattgggtgtaacagttgatattttcagggaaaggaaaatcaaattccgtccctgagctctgctttgcctctgtcaatcgagc

SEQ ID NO: 5655 - DNA, 1775 bp, Triticum aestivum
  Clone ID: PAT_TA_5655
ggcgtccggcctactctcccactgtccccgaatctctcacccgagaggggaaaacccaaaactacaaaaatctcgccgccgaccaccgccacagcgacggccatgtcggtggacgcccccgtccctacgctgcgtccggaggagcgggcaggcctcctggcgctgctcgcatccgctgcgcgcccgctggccgacgttgtagccgacttcctcgcgcgcttcccccgcgagcgccgcctccgcgtcggcgctacgctctgcttcctcctagaggacaagaaaatgcttcatgcaaccggtcgtctaatcgcatttgcaattcttcatcagagctattcctcacagccagtaaatccctatgttcctctgctgttaaatgcagcttgtgatgaatcatcagataaatcagaacaagcatttgtccaacttttgttgacttcggccagcggagacaataacaatgaggtgctgcaaaagtcagctgtagattacgtaaatgggcctgtttctgcatcacaggccttattgccacgggaacaccttgagaagcaattctgcaggagtattgtacagcctcagcctcaagttagtagtttcagaagcgctactgttagatgtgctataccagatccagatatacctcagagtcgtgccaattcatcagagatatcagcgcctggaagcaaacaaaagtctacttccgatgatagagattctgctcttgttgctttactccaagaaaaatcatggggaagactgggtccccaatggataaggccgaaccccccaagacttcatatacttgacggggagctacagtggctgaatcctgacaacaatcatgagctattatgggattatagcatgtgtgctgaaacgagtcgtggggctgcgatccgtgatttgattgccagagccttaaaaggtccacttgtacctgctcaacaggagcaagttgttatagaattggtgaaggactctaagctagtctatcactgtgggatgactccacagaaacttccagaccttgttgagcataatccactcattgctgtagagcttctttcgaagcttatgaactctcctgacattgcaggttattttgatgttcttgtgcacatggagatgagcctgcattcgatggaagttgtaaacagacttactactgcggttgaactcccgacaggatttgtccacgaatacatctcaaattgtattcaatcttgtcaaaacattaaggataagtacatgcagaacagactggggagattggtttgtgttttcctccagagcctcatccgaaatcagattattaacgttcaagatcttttcattgaggtacaggcgttctgcatagagttctcacgaataagggaagcggctggcttattccgtctgctcaaatctttggagtgaagaaacaagttataagctggtggtatcattatcaaacgtttggagtttctggttcgtcgtagttgtctggccactgtgggtgttcaagatcagatgatgtgtgtcaattcttgcaaaatctgtggcaccctcgctacgacaatgcacacccttgtaagagtcgataaaaagggtcgccaatagcagatccagatggtacgctataagtggttggtctacatttagttctgtttgtatacttgcgaatgtatgtcgacagataatagatgcatgttttggtctattcttttgtatccatgtaatcggaacaatacctgatctgtttattgtagtctgttttatttggttcaaccaaaaaa

SEQ ID NO: 5656 - DNA, 1280 bp, Triticum aestivum
  unsure (1)..(1280): unsure at all n locations
  Clone ID: PAT_TA_5656
cggatcgcagttacccacgggataaatatcacacaaagtgtgcacgctggtggtgacgccataagcgcttcgaatctgacgacgacgacgaacggcgacggcgcggcagatagatggatgcggccgaagccagtgcgagatggtgtgtggtcactggcggccgcggcttcgcggcgagacatctggtgctgatgcttctccgctccggcgagtggcgcgtgcgcgtggccgacctggcccaagtcatctctctcgacctagacgaggagcagggtatcctcggggccgccatccgcgaaggacaagccgtttacgcgtccgccgacctccgcgacaaggcccagctggccaaagattttgagggggcagaagtagtttttcatatggctgctccagactcatccatcaacaacttccatcttcattattcggtgaatgttgaaggaacaaagaatgtcattgatgcatgtatccattgcaaggtgaagcgacttatctacactagttcaccaagtgtagtttttgatggtgttcatggaatttttaatgcagatgaatcaatgccttacccagataagtttaatgattcgtattcagaaacaaaggcagacgcagaaaaattggtgatgagagctaatggtagggatgggcttcttacttgttgtatacgcccaagtagcatttttgggcccggtgataagctactggttccttctctggttgctgctgcaagggcaggcaagtccaaatacataattggcgatgggaacaactattatgatttcacctacgtcgaaaacgttgcctatggccatgtttgtgcggacaaaactctatcatctgaagatggtgcaaagagagctgctggaaaagcctacttcgtgacaaatgtggagcccataaagttctgggagttcatgtcgttgcttctagatggtcttggatatcaaaggccttcaataaaaattcctgtctctgttatgatgccattgggctcatgtggtggaatggacttacaagtcgttctgcaagtatggcatgaaggttcctcagctggacaccgtcaaggatcaggctcctctcatgcaatccgaacattcagttgctcaaagagccaaagatcagcttgggttatgaacccattgtatcacccaaggatgggctggaagagaacaatagagtcgtattcccatatgcaagctcagaaccaaggantatacaaagacttcgatttgcttgggaagggaattttcaaaaacctccttgggaaatcnaacaan

SEQ ID NO: 5657 - DNA, 717 bp, Triticum aestivum
  unsure (1)..(717): unsure at all n locations
  Clone ID: PAT_TA_5657
atactttgaatttcttgacaccgacatcatgccggtcacaagcaagcggccacggatttcactttggacgtctgaaattgtagcagaatatgaaaggcgagactgcacaagcagcgataaattgctttacggcaggctcccgacaaagcgtgtctcggaaacacccttcggtcaaatcaacagacagccaaaagtcacactaggtgcctcgtatgatgaactcctgcagttcaccctctcaattgttccagaggaaaaccaccagatggttttagacgagcttccaaagattatgcatagcatgcagagcgagctttttgattcaatgcaaaatgtactcgccaagaactttatgaacctgctgaaactgatgtcgtcaatgcattcttcatcgcctagcaaaaaacagaatagcacagacaaagattcaaggtgcgtgcccatttcagaggctccgacggttccttgtggtagccactccagcttgcaaatgacaagtaccacactggctgaaagaaaacaggataagcctgaagcaaaaacaggggtagaatgtggctcagggcangaaacagagcacgtttttacagctgaagaaacaaagccattgtctgaagtacaaaggaagaacaacaaagcccccgtacccgtgctcttgagttttgaggatacaagtgatgaagttttggcggaatgggacaaacaagcatgtgccaa

SEQ ID NO: 5658 - DNA, 1549 bp, Triticum aestivum
  Clone ID: PAT_TA_5658
gccccctcgcccccctcccccccgcgacgcccccgccctctccggcgtccccccccccaccgcaccccgggtagcccccgcacgccgccccccggcgccgcgcggcgcctcacccccggccccgcccgaggagcaggggcagggagtgccgggcggcgctccccgccggcatccctgcgcacgtcgccggcgacctccgcgccgcacttcgcgaccgccatccccacccccatcctcaaccgcgactccgagcaccagcccgagcagctccccgagcaagacaaagcccaagacgactcagaatatgaccatgattctgatcaacattctgataactctgacggtcccgatacatcatcgattaaagcatttttgtccccgtgtagctcgacgaattggtctagcgaacttttacccgagttgagcccggagccgagcgaagaaatgggatccccagctgtgacaccagttcggagggaaacaaagggaataacaggcttgctacgttccgttggaaaaatcattagtaaagcggctaggataagcggttggaaacacaacttggaacataaaactgacaaagagattgcgaatgatgctgaatcagctgcacctgcattggagctcgaaggaccaaatgaagttaactccctgaccaacatgccagctatgtcagagccatctgtccttttgtccgaaacaatgcgatccactctttattcctctcttcctattctggcccaaggaaggagctgggttttgctatacagcacatggaggcatggaatatctttatctactttatatagaaggagtttgctgtgccctggttactcactcctggtagttggggacagaaagggggcgatttttggtggtctagttgaggctccattacagccaactagcacaaagaagtatcagggtaccaataactgctttgttttcactaatttacacagcgatcctgctatataccggccaacaggtgccaataagtattatactgtgtgctctgctgactatttggcactaggaggtggaggtcatttcgcactttatctagactcagaccttttgagtggttcaagttcaaattcggagacttttaacaaccagtgtctgtcacattctccagactttgcagttaaagacgttgagctatggggcttcgtctatccttcaaggtacgaagagatgctcaagctctgtcgtactgagaagccaggggtatgccgattttgagtttaccggaccaatgtgtgttacatctgtacagttttaagtaggcgtcgctagaattttagtgtgcaggaccatggtagaagtattggaaagtgagaacttgtcttgtcgagcgagtttgctgagatttataaattctgtaattttcttgttatgccagcggaacaggcttactggtggttgttcgaattacagcggcaaatgtactgcattattctcatgtcttcacaaaaatgaggctgatccatgggagtacgtgtggaacataaaaaatgattagaaaatgtagggaagacgatgtttt

SEQ ID NO: 5659 - DNA, 734 bp, Triticum aestivum
  unsure (1)..(734): unsure at all n locations
  Clone ID: PAT_TA_5659
gttcagccttcgaatccagtccgtcgagtcgcccgacgccctcgccgccctcaccgtcgccgccgccgacgatgtcggcaccagcagctccgccgccggtggcacagccgcatccaatcccatctccccgcgctccagcaaccctctcccctccgccacatccgccacaactcctctcgagctgcccggcgtgacctccgccgcgcccgcacggaaccctaggacccaccacacccgcggcatcctccacctctaccgctcctcttcctcctacgcctccgccgtcgccgccaccgccaccccctcttcctcctcctccggccccgccgccccgccgctcccctgcgactctctgctcccgtcatggcgcggcacgcgcctcctggtgctcgccgtcccagcccgcctcacgccagacgacttcgtccgcttctgcggcccctacgtcgagcacgcctctgagatccgtgtcatcagcgacgatggggtagagggaccggtacangcgtggcttggtggagtttggagggattcagaaagaggtggccgatgggattttttacnctggggaccctccaatggggctgggagggtttctttcgtccctttcagaaggnntagaagggttgttggcccatgggtttctggtttttaataagtttggcctggtggccaaattaccaacattccatttcccaactggaaggttngggcccggttcaatcccccaaccc

SEQ ID NO: 5660 - DNA, 1307 bp, Triticum aestivum
  Clone ID: PAT_TA_5660
ccttgccgcgccttggtacctggtggtctgtttgttttcgctcggtggtcaggacggctccgtttaccttgcgggggctgtgccgtggctcctgcctgccgccctcgatgctacgctcccgggctggcttccatcccccttgccgaagccggcggttccccctgaaatgctttcggcagaagaaaaggatcaagctgttgctgcagcaacacaaacactggagttagcattcttgttattaagaaagggaagagagaccatggggtaaatggctgtcgaagacaaggcccatttgagtcatcagagcttgttttccttgagttgcatgcaacggcaattctctgtctcccctctggggaatgcatgataccacatgcaacatcatgcacggcgctgacgagtgcactttattcaactgtcagcgaccaggatgtgctgcatcgtcagctgaaggtggaagttaaggtctcgtctaaagatccttgctgtattgaagttgcgctccgttgcttagcaacagaaggtgatgaggtttgggcttcatgaagccaatgatggaggtcttctcgctgcaattatggccgctggctttaaaggtgaactcaatcggtttcaacctggagtttcaatggaaatttcacgacttgatacttggtattctgattgtaatggttcggttgaaagtactgctgcttatatcattcgagggctttgccgaagatgctgcctgccggaaacaattctacgctccatgcaggcatccatctccctttccgaagctggcgattctctagatcgttgtgataaactcatcgagttagttgcttcatcagattctgggatgatgcacttgttcagccagcagcagttacaggagttcctgatttttgagagggagtgcttcatatgtaaaatggagcttgaggaagagcagaggcctgctgatggctaagccactcatgtttaaattatcaggtgccgcaagtttattgaagcctgaatctctcccaaggtcttgccttttgtctctggcacgttcgtcacaatgaacagaatagccatggcccaaacggaggcgaacaactatcttcctgcaagatttcgaggcgagggagaagaatgttcctgctagatttgcattagcagtcagatgtccctggatgattcatatattagacaaaaaccataggggtctgatgtagatttggcaacaggggaaatatctgcgtccaatccgattgaccatgtcaatgtaacaaccaatttctcagtttatatggtgttgtaagaaaaaaaaaaaaaaaaaa

SEQ ID NO: 5661 - DNA, 471 bp, Triticum aestivum
  Clone ID: PAT_TA_5661
tcagtccgccccacgttttcctcctaccgtcgccggcggccggccaccggccgtctccacctccagccagccatgtcgaagtacggaaccatccccatctcctcctcctcctccgatgccccgcctcccggctcctctccgctcgacttcatctcccgggccaaggcccgcggcgcgtcggcactcgcgacgcgccaaccctggcgtgagctggccgacccaaaggccctcgcggtgccccgggggctaggggacgcctacctccgcgcccgcgccaacctcgcgcatttctccatgaattacgccatcgtggtcctcggcgtcgtcttcctctccctgctctggcaccccttctccctcatcgtcttcctcgcctgcatggtcgcctgggtcttcctctacttcctccgcgacgtcccgctcgctctcttcggccacaccatcggtgacggcgtcgtgctcgccctcccc

SEQ ID NO: 5662 - DNA, 746 bp, Triticum aestivum
  unsure (1)..(746): unsure at all n locations
  Clone ID: PAT_TA_5662
ntnncnnnngtggatcgnnnnngccaccccttcatggcggcgggtgggggtggttggtgggctgcgccgctggcgaaatggggaaggaggagggcgaaggctaggatgcgcggagagaggcgagtacctttctgatatcaagcaaggtggtgaaactgttttcccgagatccgaggatactcaagccaaggaagggacaccttccgattgtgctggttacgcagttaaacctgtcaagggcaacgcgattctgctgttcaattcaaggcctgacggaatcgccgacaaggacagccagtatgaggcctgttctgtccttgaaggggagaaatggctcgccataaaacatatgcatgccagcaagattgataaatcaaaacgttcgccggcatccgaggatgatggttgcaccatgaagatggtaactgtgtcagttgggccgctgccggcgaatgcaacaagaatccagtgtttatgattggaagtccagactactatggcactggcaggaagagctgccatgcgtgctagatgtttttttttttgttttcgtgcattgcccttagggatgtctcttggcattttcgttgtttaatacaggcattggtgttgtaagtggagaatgattcagcaaattgtgcacttcccacagataacctttactgttgtcaggaaatgtagtacataggtattggattggctgctcttatgaaattatggaatttaattctgacctcagtttgttc

SEQ ID NO: 5663 - DNA, 620 bp, Triticum aestivum
  Clone ID: PAT_TA_5663
tgcctatcttcacaacattcaagagctctttagtcctgccaaacaggcttcgatgattccctcacacaaaatattcatatttggtcgtgcctgcatgatgcgtgtgtgcatgatggatggtcatgcactactgtactagctagataataagcttgttttgctactgaatgattgaacggtgtctcagtttgtacctcagttagctcaccgcctaaaattgcgacgggataggcactgtttggttcgtgctcccattcttcgggggctaaacatatttgtttgtttgatttggagcagcaggcgctttccatcgacaaccgggactccacgcctaagctgttgattacctcattttattcatcttctccgtatattcattcgattgcctgctacattcttcttcattgcacgggcatgcatcttggctcatgaccaaccgaaattagtagttcacctgcttgctaaatttatttttatgccttctgttttgtcgaattttactgagtaagcaactgggagttgcatccaacctttgtcggttcagcttctcttttatgttctgtagatagatgttggttcaatgctgttaattttgagcttctctcttttatgttctatag

SEQ ID NO: 5664 - DNA, 477 bp, Triticum aestivum
  Clone ID: PAT_TA_5664
accaacggacgatggaggtgccgccaccgccaccgcccccgcgcccgcacgacggagaaggagagcagagcatggcactggcgacgcagccgcctcagctccgcgtcggcatcggagcggcccccgcggcacaccggcctccgagccccagcatccgggcgcgcggtggcgggaggaggaggacgcgatctgtgtccgtagcggcggccgcggcggaggggagggcggccgtgaagggggcggcggcggaggtggtgcgggagttctacgagggcgtgaaccggcgcgacctggcggcggtggcgccgctgatcgcggaggggtgcgtgtacgaggacctggtgttcccgcggcccatggtggggcgggaccgcgtggtgggcttcttcggcgagttcatgggctccgtcagccccgacctccgcttcgtcatcgacgacatctccggcgaggatccctccgccgtcggcgtcacct

SEQ ID NO: 5665 - DNA, 656 bp, Triticum aestivum
  unsure (1)..(656): unsure at all n locations
  Clone ID: PAT_TA_5665
aaccccccgcctcccgcaaccctagccacgccccccgcgcccgccgctccaaaccctagcgccgccgccgccgccgcccccctccccttcctccgccgccgccgccgccgcccccctccccttcctccgccgccgccgcatcatgacggcgtacatggcgaaaagcggagaatcgggcgactcgccggctcccaaggaggcgctgcttccagcagggcacccggccggccaccacggcctccaggcctacaccggcaactacatcgaggtccctgcaggcacgtgcgtcgagtccccctaccactacagcaagtaccccggcctcggccccaagattgccgccggtgtgttcctccgcaccccgcccgtccccgtcaacctcgacctctcggccatcgcagggcgattctccaacctccagtccatggcgctgtccggcgacaccaccctcgaagccttcaggccacccgtgacaaggatttttcaaccctctgttgtggtgcaatccccacgggattatcgcactattgccttaattcgcaactacatgaggaaggctagggtactgcggggcaagagaatctggaagctctaattgacaagcgaattgacaanacatgagaagaaaaagcttgaagctgagcgtctccttctat

SEQ ID NO: 5666 - DNA, 770 bp, Triticum aestivum
  unsure (1)..(770): unsure at all n locations
  Clone ID: PAT_TA_5666
tggccaagttctccttcgccgacgccgacgccgacgaagaccctccacccgccgccgctgggtccgacaagaggaagagggacggaagtccggcgcctgacgacggcgcggccggtggagggccgccccccaggcccggagactggaggtcgcgggcggcgagcgggaggagagggcggtggcggggtgcggtcgggaggtggggagggtctcctcccgcgggcggcgcgacgcggcggggatcagcatgcggatcgacccggacctgctcgactgctccatctgcttcgagcccctctgccctcccctctaccagtgccaaaatggccatgtagcatgcttgtcctgctggtccatgctcagcaacaagtgtcatgtttgttctcatgatgcgatctttgcacggaacattgcactggagaagattgtcgagtcaatcaagtcctcctgcgcatatgccaagtggggctgttgcgagttggtcagctacacgcaacgaaacactcatgaagaatcttgcctctttgctccctcgacgtgcccgattcctggctgtggatacagaggcttcacagggcgttggtcaggccacttcctcgtcgaccaccacaagtgccgatttcttgcacttcgtttacggccagccatttgaagtgaacttggagggcgtccctgcctttttcttgttctcctcgggagaaggacgatcaacctcttcctgctcctgaaacaagaaacaatgacgcccttcgggcatgnccttttccgtg

SEQ ID NO: 5667 - DNA, 820 bp, Triticum aestivum
  Clone ID: PAT_TA_5667
aattgcgtgccacatcataaaaaaaatctagttggcatacataatactgtttatgatactatcgttacgaccagccttacacaacaaaccacatttattacaaaaggacctgcagtgactctggtacatgaccaagaggccaaaagcgcaaaggagaaacagaaaatgatttcagtatggtttgaaagaatgcagcagaaaactgtcaccctgtggtgtcaaatctgtctatacaaaatacttatgcatgtcaggattatgcgttgcttctcaaaaccatgcctagctacaacagcagctattggcgccacagcaccgcgtctggcaggagctcgactctgctggctacctaacaaaaaagtgcctcttcccatcatcatcccctctagaacgccaactcttcttcctcttggcctgtttgaggcaacgtgcctgccgtcgccgcatcccgaaggtcctcagccttctcggcactgatgtcgagtaaatactgcaaccttgacaacttatcctgcttcggaatgctcttcatgtacacacagtacaggtcgtcaagctctcgtggagtgggccatgacaaaggcttcgaagcaggcacggcagcatcacatgcgagcaggtcgttcagtgatgaaatcacaccatctctcttcttctgccgaagcaaagcaacagcctggacaagggcgttctccaacctaaccttcgcaatgtcctgaacaatcgacctggccttctcagcacttatgataagatcagctggcatctttacatacacttcctcttatcaaattcacctgtgcctgatgagaatatctcc

SEQ ID NO: 5668 - DNA, 951 bp, Triticum aestivum
  Clone ID: PAT_TA_5668
ggttgatgaggccgaggctctgtcccttattaggaaggtgttcatcaagtatttcatgaatggcggtattgaagagggtgagacaggcattgggaaaggcgagttcatgccagttggttcagatgggaatgttgttctttcattcagcttgttgaatgctgatccatttgattgggtctatgattgggagtccaaagatattggcgagagaatccttactcctgtggtcgaggccctgcgaccagttgctgatatcaacatagagagtcacgttctctaccacactccgaagtcgtcctattcttattctgacgataaattggggggcaatgtccttagtatgggagacattcctttctttgtaaactcaaatgagtggcacttggatacatcgatttcagctacaggacgatcaaaagttcttcagtttgtggtgtatattccatctgcaagggaatgccctttgtacttgcagcttccagatggggagctttcgaaaactaatgcatttatttccccaatgtggggaggtgttgttatttggaacccaccaggctgttcacttggttcaaagaaggcgcatgggactcggagacaaatgtcatcacaggaacttatggagactctggaaatcttcattgggcagctaagacagttatttggtctaaaaccgaactatcatgcacatggcatggatgtggcaactaaattcctagttagtgaaaaggggtttgcgcaatgggaattggatttactatacagacatcatgcatgttccaaccttttgtcatgtgtcgccaccttggaatctctttccagcttggtccagtcgctcccaagaatgattgttatggatgaaattgggaggcaggtagagctttcgcttgaagccgcaagcttagctcaaaggaacgccacacttggaataagtgactcttctgcagtgtctgc

SEQ ID NO: 5669 - DNA, 1017 bp, Triticum aestivum
  unsure (1)..(1017): unsure at all n locations
  Clone ID: PAT_TA_5669
gcacgaggctccccgccgctcctcttcccctcgccgccgagaggagagaccgatcccatcccatcccggcgggagctccgccgcagacttccccatcagctgctttcgcgtgcgcttccggcgggttggagcgatacggtttcgacgtgtccgtagcgcgatttcccccgccttatcttgttgggcggtgcggttccttgtgagggagggttcttgggggtttggggggcatggacccggtgccgagtctggtcaaggaggaggaggaggaggagggtgcgcacgggagaggcgattcgccggcggccggggcggcgccaaggccgatggaggggctgcacgacgccgggccgccgccgttcctgacgaagacgtacgacatggtcgatgaccccaacaccgacagcatcatgtcgtggagcgccggcaacaacagcttcgtggtgtgggatccgcacgccttcgccacggtgctgctgcccaggcacttcaagcacagcaacttctccagcttcgtcaggcagctcaacacctatggcttcagaaaggtggatcctgacagatgggagttcgccaatgagggtttcctacggggacagaggcaccttctgaagaacatcaggcgccgttaacctccccctcnatactgcctccaatcagcagtcccttgggtctttaccttgaaggtggggcactttccgatatgatgccaaaattttacccgcttaaaaaggacaacnactgtttttatggaaaatttgngaaacctaagnaaggacagcaanacacnaagccgttttaaccatgggaggatagtacttgnaccaacaanacacaacaaatgatcatcatggaacntctgcngnacctgaatctgaacaatgatgcaagaatggatgagaaggantcatgaccttcncaaaaagnggcccncatnacgtgcctaacttancgtggtntagacacacctgacaaaattnccgttttttnncaggncaggattttcgggccggcgng

SEQ ID NO: 5670 - DNA, 379 bp, Triticum aestivum
  Clone ID: PAT_TA_5670
ttcccgggccgaagggggttgaaaacttcatgaactttatcacaattgagtacggtggtccgaaatcagatgtgctctgcccgtgtagcagttgtatgaattcagttacatgaccccagtcaattgtgcaaagtcatctacacttgtatgggatgtcggtcacatatactaggtgggttcatcatggtgaagctgtgaacgtcaatgttactaactatgtggaagcagcagatcaccatcttgatcagcctgatgctcaggtggaagaggaggaggacgaggaggtgctggcggcagagccagtgagtttgaccaacattgaaacaattcgacgaaatgcttgcacatttcgtgaagtttcacttgcagaaaaacaatg

SEQ ID NO: 5671 - DNA, 2181 bp, Triticum aestivum
  Clone ID: PAT_TA_5671
ccgcgccgacccttccttcttcctcctctctcctcacctgcaacctatccaccgcccccccatgcccttcgcctcccctccaagcaagctccccatcgcgaccaaaaccctagccctacgatgtccggctcaggcgggccctcaggccgcggctccgcaggcggcactcggagcttcgacttcggcaccgacgacgtgctctgctcctacgacgacttcgccgccccctccgagcccaagcgacccgatccagtcgacaaggattttcatgagagcagatttgggagaccatctgttaaagtttatgaacaagagagttatgccaaagaggatgtactttctgctgttgagaaatgcatgaagaaatatgctgataatttgctaaggtctcttggaaggtatcgcctgcaagccttaagatctctgagatttattgccactaagcttgcagagggttgataggcgagcttcgcgctgcaggtgctgggtcgatcacacgtgattcgaaatttctaaaagctccttgatcgacagtctacatgaacgtggaacagggtcttagtcaaatctgtttgaagacaacgcaataagttaaaccggatactaagaagggtgctaagcctaagtttcaacttacacacgatgaatctaaaaagaaagacggtgtcctgactccttttttccccgcgccaaagcagctggatgacaagcgagatgcagcaagtcagcagctggcacttgctttacctcatcaggtgaactcatcggcacttgtacctagagcttctgtgcaaatacaaaaatacaacgagaaacccgtgcgcccgacagcccctagctctcttgtaccgcagcaggaccgttatgctgttagccaagccattgtatactacccacaacaccaagctccaggcaaccaggacacacagggtcagcaagtacaacaagaggtgcaatacctgccattaaggcctcaagctcaagatgtccatgcttcatcccagcctcagtcagcaaatcaatcccagccccagtcttacactccttaccagcagcagtggcagcagcagcagcaaccctctcgttcatctcctgcaccagtggctcagcaacagcagcctttctcccagccatttcctccacctgtgcagcagccccaactatctaatgctcaccagtttccaacacaaccagcgcagcagtcccagctgcctaatgttcagcagtttccagcacaaccagcgcagcagtcccagttgtctaatgctcaacagttccctccaccacagctgcaaccacagcaatccaaccctcatcttcctcagacagcacaaccacaacatcctcatgtgcaaactcagatgagaccctccactcccccaccaaactactctggtggctatccaccccaccagccattgaacccatcccctgaaactctgcctggcagcgcggctatgcaaggaccatacaacaccgttgctccatcaggtgggagtcattcggaagtgcaatattcatacggtggacctggcatcccaccgtctcagccaccaccgcagcacagcatgcaaaggcagcagcttcctcctccaggccagggttcttttgggccgcctccaagtaagggggcctatcctccgcagtatgcaccacaggggcatccgcaggggggttacaacacatcgtatggcggctacccgcccaatggtccttctgcagcccaggcaccacagatgcctccaggtggtgctggtgtgagccatccagggtcatcgcatcatcacatgatgcgtggccatccatatggagatatgattgagaaggcaaacaccatgggatatccaagggaccaggtgctgaatgtgatccagaggatgaccgagagcgggcagcagatagatttcaatgcgttgctcgacaggctgaacgaatcagggtccggagcaccccctcgtccgtggtgatttcgtccaggccctgtttcgctggaagccgtgtgtgccacagggtggtgtcgtgatatctgtctaaatcaatctaaataaataagatttgatatgatgccgtctgttgatttgtccgtacaatgtacatacaaacattgagcttgaatttcatgtacccccctgactcgtgcacgtgcacaactgggttacggagatcgttctgaaacaaatt

SEQ ID NO: 5672 - DNA, 610 bp, Triticum aestivum
  unsure (1)..(610): unsure at all n locations
  Clone ID: PAT_TA_5672
ccaccccttccctcgctctcctctctccctcccacgacaaaatccagcctgctccaagatccccacgctctatccctccctccctccctcccctctggcaagatccagcgcgcggcctccctctcctcggtccagatcgacaggtccaccacctacacttccggcgatccccaatccggcgacagagatggctgctcccgcgccggccttcttcctcgccccagatgccgctgctcgtctcctctccggtgaggccggaggagccgccgcggtcgaggtagccgtcggctggagccccgcctcttctcctctccggtcaccngtggaggtccgccgcgtccaacctcctcgacggcgccctgaaccctaggcagcccatctcttcctcccatggccatggccatggtgagcctacaagatgtgcagcagcagatcttcgagtacaacggctccgcaacctgcagccgccggtccgggacgagcgcagtgccggttcaggtgtccagcgtcaaccagagcgcgccccagatgctcgacggaacgcccgctgcaccgcctggtctcaactttcttgccctttgccaagctgagggagagggctaggggctcg

SEQ ID NO: 5673 - DNA, 352 bp, Triticum aestivum
  Clone ID: PAT_TA_5673
caatctgccattattatttgtatgtatgtgttcaaaatgaccacctagagattcttgatttgctcctggctgcaccgttgggtttctcgcggctttgtttcgtttgagttctattggtcaaaattgaatttgttgatgcttacagtttggactggtccgtttgatacgtctgcactcgtgatgcggaacattttccaacatagtgtgggttcagaagtggggaaaacaattggcttgcagggttcaggctactttcttgtgcttgttttgccttgtgattacttgaaactgcaacctgcaggttgaatgggcgctttatattttaaggcggaagactgaagcaatgaaaact

SEQ ID NO: 5674 - DNA, 1710 bp, Triticum aestivum
  Clone ID: PAT_TA_5674
accggtccggaattcccgggtcgaccccgcgtccgtgcccccaccccaaaaaaacgacgacagccaggacgcggcgatctcggagaaggcgtcccttccccgccccaaatccgccaccgccctaccttcggaggtttctggatctcggatggcgtcagcgaagtcgtcacggtcgaggccggccggccactcgggggtgttcccggtgggcgcggcggcgacgggggttggtggtggtggaggcggcggtggcggcggcgacggcggggtgcagctcgccgacaagctcaagatcttcaagaccgacaacttcgaccccgacgcctacgtgcagtccaagtgccagaccatgaacgagaaggaaataagacatttgtgctcctatctgcaagatctaaagaaggcttcagctgaagaaatgcgcagaagtgtttatgcaaattatgctgcattcatcagaacatcgaaggagatatccgaccttgaaggcgagctcttgtcaattagaaatttactcaatacacaggcggctttaatccatggtctgtctgaaggagttcagatagattccctgacttcgggtactgaaggttctacagaagaggacatatccaatgttgaaggccaggagccttcagaaatacagaaatggtctgcagatttccctgacatgcttgatgttttgctagctgagagaagagtggatgaagcgctagatgcactagatgaagcggagcgagttgctgcagaccggacacaaactctaactacagctgaaatttcggctttgagaagtgccgtctctgataatcgtcaaaagctggcagaccagcttgctgaagctgcctgtcagtcttctactcgtggcattgagctccgtgctgccgcttctgctctcaaaaggcttggtgatggccctcgagctcacagtctattactcagtgcacataatcaaaggcttcaatgtaatttgcaaacaatacatccgtcaagcacctcatatggtggggcatacactgctgcacttgctcagcaagttttttcagttgtagctcaggcgctcagtgattctgtggaagtttttggcgatgagtcatgttatgcatctgagctggttacatgggctacacagcaggttttgtcctttgcactcctggtaaagaggcatgtgttgtcttcttgtgcagccgctggaggcttgagagcagctgcagaatgtgttcaaatatcaattggccattgttccttgctggaagctcgtggtctatctgtttctgctgtcctcctgaagcagttcaagcccagtcttgagcaagcattagatgctaacttgaggagaatcgaagagagtactgctgcacttgctgcagctgataactggacactcacttatcccccaaatggtattcgcccattagctagatcttctgttgctaatttggcacttcaaccaaagctctcgagcagtgcacatcgtttcaattctatggttcaggactactttgaggatgtcacaccactccttagcttgcagttagggggttcgacaatggatgggattgcaaaaaatttcagcttgtacgtcaatctgctcataagtgcattacctggatcaatggatgacgaagctaacatagatggtttaggcaataagattattagaatggcagagactgaggaacagcagttggctttattagccaatgcatc

SEQ ID NO: 5675 - DNA, 790 bp, Triticum aestivum
  Clone ID: PAT_TA_5675
ctccggctcggcgggctggtctctgctcttcccacgcactcggggtcgctggcactccgctggtgtgtggggtccgaccgggctgcggctgggtcgtcacctgcggctcccgcggcctctggaaggggggtgcggtggtggcacggcacccgcgcggcctggcactgcacctgcacgtgcgccggccgggggtccggctctgcccccggcgcatcacggccatgctcccaggctacgcatgttggcgagtgccgcgcgtggcgcctgctcggtcccctcctcgccatgggcgtgcacccctgggacacgtggtggttcatacacatcatggttaattccgctcttcgcgtagtcaggttgacagccacgctattggggagcaactcatggagatgatgacaatcaagggagccatctatgtgacttccaaccacggggccagctagaaggtagccatgcctgagacctatcgcggccactctgaactgcagagagggttggattcaattaaagtctggaagcatcctgtcatgcctgcttactcacaatatagttcattctgttaaagttatctcaggaaagaaatggtttgtggctgggacatctgatggtgtgatccatgtgtacaattacgacaacagaatacaaaaactcagaagtttcagagccgccagtgattgcttcatcacatcaatggccgtcaatccaacccgttcgtatgtactgtcatcggcttatcatgatataaagctctgggactggagcaagggctgggagtgcacaaaatcat

SEQ ID NO: 5676 - DNA, 2704 bp, Triticum aestivum
  unsure (1)..(2704): unsure at all n locations
  Clone ID: PAT_TA_5676
gtgccgcgcatcctggccactgcctcgctcctccggttgttctctggctctgggcaattgtacaaggtttcagcaaggagttcgaaggttcagctgagagaccgtctggacctgagaatgcaatacaagatgcccgagagggtgccagtgttgctggatcatctggagtgaagcccaatgcagatgatagtggtaaatcatccgcagataatataagtgacctgcaagctgttttgcatagccttccgcaagccgagcttcggttgctatgttcattgcttgcgcatgatgggttatcagacaatgcatatctccttgtagcagaagttctgaaaaagattgtagctttggctcctttcatctgttgccatttcataaatgagctttcacgttcgatgcaaaatttgactgtttgtgccatgaatgagcttcacttgtatgaagattctgaaaaggcaattctgagcacatcatcagccaacggcatggcagttctaagagttgtgcaggccttgagttctcttgtcacatctctgcaagagagaaaagatccagagcttcttgcagagaaggaccattcagatgcgctgtcccagatttctgatattaacacagcattggatgcgttgtggttggagctaagcaactgcataagcaaaatagagagctcttcagaatatacatcaaatttgagtccaacttctgcaaatgcaactagagtatcaactggtgtagcacctcccttgccagctggaacccagaatatattaccgtacatagaatccttttttgtgacatgcgagaagttacgtccaggacaacctgatgctgttcaagagccttcaacatctgatatggaggatgcttcaacatctagtagtgggcaaaaatcatctgcaagccataccagtcttgatgagaagcacactgcttttgttaaattctcggagaagcacagaagattgttaaatgcttttatccgacaaaactctgggttgctagaaaaatcattctctctgatgttgaaggtcccccgcttgattgattttgacaacaaacgtgcatatttccggtctaaaattaagcatcagcatgaccatcatcacagtcctgttagaatttctgtccgacgggcgtacattttggaagactcttataatcagcttaggatgcgctcaccccaggacttgaagggtcgactcacggttcatttccaaggagaagaaggcattgatgccggtggactcacaagagagtggtatcagttactatcacgagtgatttttgacaagggagcccttctattcacgactgttggaaatgacttgacatttcaaccaaaccctaactctgtgtatcagactgaacacctctcatatttcaaatttgttggacgagtggttggaaaagcgctctttgatgcccaacttttggatgcccatttcactagatctttctacaagcacatacttggtgccaaggttacttaccatgatattgaagccattgatcctgcttactacagaaaccttaagtggatgcttgagaacgacataagtgatgtcctggacctcacatttagcatggatgcagatgaagagaagctgatattatatgagaaagctgaggtaactgattgtgagttgattcctggagggcgtaacattagggtcactgaggagaacaagcatgaatatgtggatagggtagcagagcatcgtttaaccactgcaattaggcctcagattaatgctttcatggaaggatttaatgagctcattcctcgcgagctaatatccatttttaacgacaaagagtttgaactgctaatcagtggactccctgatattgacttggacgacctaaaggcaaataccgagtattctggctacagcatagcttcaccagttattcaatggttctgggaaattgtacaaggtttcagcaaggaggacaaagctcgatttctccagttcgttactggcacttcaaaggtacctttggagggtttcagtgcgctccaaggaatatctgggccacaaaggttccagatacacaaggcatacggcagcaccaaccatctgccctcagctcatacttgctttaaccaactggacttgcctgaatacacatccaaagaccagctgcaggagaggttgctattggctattcatgaggcaaatgaagggtttggatttggttaatcagtcattcccgcacttgtgcattcgctgctgggtatttgtacagatagtacgggagttgcaataggcaagtgggaatgtgtgcgtgcttgttccacagtctgctagatcccactagttggcaacatgaagcatcagccttaggcactaccaggaggttctcgatatttgttgggacatggccgagatctaccagaatcattgcattgcaaacaagttactgcaaagaatgtgcagtgagtgggagtttaaacagacaccaactatttgatgttcataatatttttctatcttgtttacattggatttagctggaaggttttttgaagtttttaatagatgtgcggaatactggtggattgctgcaattcgatgagtgctgtgctctatacaatggtagaatgcaccaagaaaaccagcccactcaaggctcctgctgacaggaanatgcgaatttccanaagaactcacaaagagggcccantgcctgaacacgtgna

SEQ ID NO: 5677 - DNA, 740 bp, Triticum aestivum
  Clone ID: PAT_TA_5677
ccaggaactcaaattgatagtgctctcagggattacaacctccacgcctccgttcgatcttgaaaattacatacaattcgtcgagtgacaaataggaggaagaaaaagaaagatacatacagatctatttcttctcacctaccttacagaatataacaaccatgataagcttaaaaaacaaccatacatggtaattcgctacaatgcagagcctgtacaacttatcataaacaacagctgctggactcttaaaaaacaatcatcatgtcatcaaataacagacatgcaatcaatctctgtctttacgatgtaaatagttggctcccaagggtgatgatcgcggttccgtcgcccataatcgttgttagagacatctccgtctcgagaatacggtctagttcagccgcaaccagcctcatcttcggccgccttctggaggatgggttcagacactggaaagcaagcccaacaaattctttcataccttctgtcgtgaaaccgccacctaaccttgggtcaatcagttcatttgaactgaaatgtgcttccagccagtgggccagagattctctggattctgcaggttgcaagctagcagcttctctgccagtaattagctccaaaagaaacactccaaagctgtagacgtcgctgctttcagaaaactgcgccaccgagtgtgcttcgggatcctggtagacactgctactaaacccatgcgatgacccgacatcttcatg

SEQ ID NO: 5678 - DNA, 1792 bp, Triticum aestivum
  Clone ID: PAT_TA_5678
ttcggcacgaggcaatattatacaggccggcggcctcggctgcaggaaaacaaatggggacggagaattactcctaatttcttctccaccccggcctggtctccgtccgctccttcgttcacaccttcttccactagctggtctccggtggtggtgggggacgggacgaccgtcgtccgtcgactccgagcgagctcgcggccgcggttctggattcatcgcgcgcgcgagaggatccccctccccgagatctgccgtggtagggtgagagctgccgagtagccgaggtgctggtgagcttctcaagaaagtaaaaatggaggaggtggaggaggccaacaggatggccgtggagagctgccacagagtgctcggcctgctcgcccagacccaggacccggcgcagctcaggagcatagcgctggggacggacgaagcctgtgccaagttcaggaaggtggtctccctcctcggcaacggcaacggcaacggcaacgaaggagggggaacccaccatcctagagccaagctggtgagcagaaggcagaccccggggttcttgagccagaagagcttcctggacaacaacaccccggtggtggtgctgaacagcgcgcacccttcgaccagctcggctcaggtgtatcctagcagcagaaacagcattctggattcatcacaggccgcgcacccgatcggagggcctcccaagctggtgcagccgttgtccgcgcacttccagttcggcgactcatcgcggtacaaccagttccagcagcagcatcagcaccagcagcagaagatgcgggccgagatgttcaagagaagcaacagtgggatcaacctcaagtttgacagccccagtggcaccgggacgatgtcgtccgcgaggtccttcatgtcatctttgagcatggacggcagtgtggccagcctggatgccaagtcttcctccttccatctgatcggtgggcctgccatgagcgacccggtgaacgcgcagcaggcgccgaggaggcggtgctcgggacgtggggaggatggaaatggcaagtgtgctgcaactggcaggtgccattgttctaagagaagcaggaagttgcgggtgaagaggacgattaaagttcccgcaattagtaataaaattgctgatatacctccagatgaatactcctggaggaagtatgggcagaagccaattaagggttcccctcatcccagggggtactacaaatgcagcagtgtgaggggttgccctgcgcggaagcatgttgaacgttgcgtggatgatccgtcgatgctcattgtgacatacgagggtgaacataaccatacgcgaatgccaactcagtctgcgcaagcttagggaatcccttgattatcactcttttcaggaaatgccaactcgccggcacttgttggacagactgcgttcttctcctaaattaggactgcgaagtgacaaatatgggatccatttgagcagttgatgtgtcggttggcctcctgacctacatgttttgtagtgagtgtcaagtgggaggatgcaaaaatgttgttctcccttatggaggtaatcagaatgatgaaatgttagaacatgatgttagataggacacctgagatttgctcaggagggagtgcgaagagttggaagggaagatagaaattgggggatgatatgtctgtaaagtagcaaaaattgataaaatcactgggtctccctctttttgtacctcggccgcgaccacgctggtttaaaatcaaaaataaatgagacagaaccaatttg

SEQ ID NO: 5679 - DNA, 770 bp, Triticum aestivum
  Clone ID: PAT_TA_5679
agcgcacacacatctcgtggctaagctagctagcaatggcttccagcgtgcggcagccatggcagctcctcctgatcgtcctcctcccgtccttggccgcggcgacggtgttcgacgacaactacgtgccctcgtggggcgcagacggctaccacctcgtcgaccagggcacggagacccgtctcaccatggacagaacctccggcgcagggttccgctccaggtcgacgtacgggtcggggttcttccacatgaggatcaaggtgcccggggggtacacggccggagtcgtcacagccttctatctggcgtcggaagcaccttatgatggcggtgaccgcgacgaggtggacttcgagttcctgggcaacgtggacggcgagaccatcaccctccagaccaacgtcttcgtcaacggcgacggcgacagggagcagaggctcaacctgtggttcgaccccgcagccgacttccacgagtacaagatactctggaacccttaccagctcgtgatattggtggacgatgtgccgatacgggtgctgaggaacctgacggggcaggtgccggagtacgagttcccggcgaagcagatgggcgtgcgggcgagcctgtgggacggctccgactgggcgacggacggcggcaggatcaagatcgactggggccgcgcgcccttcaccgcggggttccggggcttcgacgtcgacgcctgcgccaacaccagctcgacgccgtgcgactcgacggacctgtggtggaacgcccgc

SEQ ID NO: 5680 - DNA, 701 bp, Triticum aestivum
  Clone ID: PAT_TA_5680
cggacgcgtgggcaattcgcacctcccttgcgcccttgccttgttcaccggtcgcctgaccgcatttgagcgatcctcgctccccgttccttcttctacaccttcttccttggtgaagtataagtttatccggccgatcctatccagatatccactccaagctcgtctcttcaatccaaagccacgccctcaaacaagaaagatccaggagaaaccatcgatcgggacatctccagcctagccatatacatggccggcctgtgctctgttcttgcctgagcaccacccctgccgatcaccgagaaactaagagagcaagggagaagaagaagaagaagaagaagaagctctccgtacaatcgagctgggctagcgagaatgcggcagatctcgtcgatgctgcaggggctggcccgctccatgtctctggggaaggagaggaagcaggcggaggaggcgcaggggacggtgctgcggtcgtcggggacgctctggggcgagggctcagagaccttggccgccgcgtgctcccgccgcggcgagaagggcaccaaccaggacacctccatcgtctgggagggatacgggtgccaggacgacaccatcttctgcggggtcttcgacggccacggccagtggggccactacgtcgccaaggccgtccgggagtcgctgccgcagcggctgctgtgccgctggca

SEQ ID NO: 5681 - DNA, 858 bp, Triticum aestivum
  Clone ID: PAT_TA_5681
tcgcgcgggttataaattcaccaatgattcaggagaaagattgcctcctgtcatcctttccaagatctgtacctcagcagtgaaggaatctttggcaaatgtttgacagtttcatgagaaattttgagaattcatttagcagcacattgaggacgcttcatcgtattaatgagatacctgtctatgagagaagtcctactcctgaatactcttctacgcatggaggctctggggctgtagaaaactcgagcgctgctgatctgcgaaatcatacaaaagaaatcgagcaggacctcatgaactctgtagaaagtcaagttgttcccacgcgtccggacaatcgacagctggctgatcgtgctcatagcagatcctctcgtgaagctgatcagtgcattctcagtgcttttgagagatctgtgaaggagcaggctcgctcaaacgaactcaaggagcgtgagattagtcttagcatgagaaagctgcagctgaaacagactgaattagctcttagctcctcctcgcacatgttagagaagattaagttgtccttgggttttcagaaagcttccttccaaggagagaaattcaagactcagatgcaggacacaaggcatgcagaaattctgaggactcttatagatttccttgttagtgcagtggtaattatgtcagtgtgttttgcttatggaacttatgttcactcgtaccaacggataactgatgttacagcagcttgttcagctgcttcaaggggatctaaatcttggtgggtgccaaattcagtgtcaaacttcaattctggcttgcagttcgtcagatgtcatgtgatagcagcaacacgtatgtgctttggca

SEQ ID NO: 5682 - DNA, 514 bp, Triticum aestivum
  Clone ID: PAT_TA_5682
acaaaggactgggatatcacatctggcgagagattgaactattctgaaagattttactcggttcggtctcgaacactggggctctgacaccaaaggtgtggagacgacacgccatttcctgctagaatggctgggctacacgtgccggtacatcccggtcgggctgctggacgtcgtcccgcagcagctgaattggaggcctccaagctactgcggccgcgacgacctccgagaccctgatggcctccgactcaagcagccgactgggtgaggatctccggagctgctgctccggcaaagtcccggaagggttcacctccgcgcccaagcacaagtccaactcctacgaccgcgctgagaacggctagaagactgccgcgtgatggtttctccgctgttttttccctcccgaacatcatcacctcccccctctgttggttggatcctcagcctccgctccctgccgcctgccgctttctggttattcgctactctggagctgctgcacgctgct

SEQ ID NO: 5683 - DNA, 2007 bp, Triticum aestivum
  unsure (1)..(2007): unsure at all n locations
  Clone ID: PAT_TA_5683
gccttcctcttccgccccggccagccgcctcttcctccttccttccccggctcagcccgccgcatctgccgtcgtcccgttccgccagccagccatcatctcagagtagtcgtcgtcgtcgtggtcgtctggctgagaaggatgggagagtcgccgccaccaacgccgccgccgccggcggcgccggccaaggtgtactacgaggggtgccccgggtgcgccatggagcggaggaaggagagcagcacggggaccccgtacaaggagctcttcttcgtcgggatcaccacctttgcatcatctttgccgatcacgtcgctgttcccgtttctctacttcatgatacaagacttgcacgttgctcaaagagaagaagatattggattctatgctggatttcttggtgcatcatatatggttggtagaggtttcgcatcgatcttttggggcatggttgcagatcgcatcggacggaagcctgtaattgtattttcacttttcacggtcattgtgttcaacactttattcggattaagtgtgaaatattggatggctatcactacaaggttgcttcttggtgcactaaacggatttctagcaccaatcaaggcttactccattgaagtttgccgggatgacgaacaagctttgggcatatcaattgtcaatacagcatggggattaggccttataattggcccagcaattgggggctaccttgctcagccagccaaacaatatccacacattttccatgacaagtcaacgtttgggaggttcccatatcttcttccatgtctttgcatatcaattttcgcaacattcgccctcataagctgcatatggcttccggaaacactacacaagcacgccaagtttgaaatgagagctgaaacggctgaagctggcacaactcaggaaagtacagagtcacctaagaagagcttatggaaaaattggccgttgatgtcgtccattatcacatattgtgtcctctcccttcatgacactgcatatagtgagatattttccctgtggactgtaagtggtagaaaatatggtggacttagcttttcatctaaggatgtcggtcaagttcttacagtggcaggtgtcagtcttcttgtataccaaatctttgtttatcgttggctcaataatacactaggacctgtaaactcaacccgcattgcatctgccctgtctataccaattattgctgcttatccctttatgacacgcttgtcaggaataagacttggtctggctctctatattgcagcaatgattaaaagcgttctcgctataactagagtttccggcacttctcttctacaaaacaatgccgtgccacaagggcaaagaggtgctgcgaatggaatagccacaacattaatgtccttgttcaagtctgttgctccagcaggggcaggtattctattctcgtgggcacagaagcgccagcatgcagcgttctttccaggtgatcagatggtgttccttctactgaacgtgacagaggtccttgggctcttgctgaccttcaagcctttcctggcagtcccccaacactacaagtaaaacctgacagagtacctgtgtaggtagtgctatagagcagtgcgtgtgtttgtgtggcactggcatgctataagagcgaagactgaagagtcttcttttcttgtacttgtagatgtagcagtgttgttggcactggtgacctaaatcaatcagtcggccaaattccggcaacaaatgaatcctgtatgctcgtngctccctaacctagtgtatacgtntaaggnggaatagggnaatctgaatcctcanttcctgatcaaaaaaggggggccggngcaantcgccaaagtatcgatagccgccanngcctcgttanactctnactggaaanctgggtacaactaacncttcaaaacccttccancngctatacaaaggccgacatccctcaaattncactaaggaangacccntcgnataccgggg

SEQ ID NO: 5684 - DNA, 596 bp, Triticum aestivum
  Clone ID: PAT_TA_5684
acgacaaacatatccagcttcttagcaggcattcttgcgcgcgaggatccacaagtgctgattcctgctcttcagatagcagaaattatgatggagaaacttcccgagacattctccaagttatttgtgagggaaggtgttgtccatgctgtggaagcacttatatgtccggaatcctcaaatatggtgcctcctcaggtaccgccacaggataaggagggtgatcctgttatgtcctcacgccctagacgacagcgtcgtcgtgggggtgctgcacctacagaaaacagtttgttagatgtatcaaacgtttccaattctggcattgccagtgcatcgccatgctctacagaagttccagtcaccagcctccgttttgaagttagcgaccgtgcgaagtcgttcaaagataaatacttcccttcagaccatggttccagcgatgctggagtcactgacgaccttcttaaactgagagcactgtgtgcaaagttgaatactgcaactgaaaatgtcgtaacaaaagccaaagggaagtcaaaagccttgagccctagccattttgacatctcacatgatgtggaagaacagttaga

SEQ ID NO: 5685 - DNA, 711 bp, Triticum aestivum
  Clone ID: PAT_TA_5685
gttatatttggcatcaccaatacctttcgaccattctcggatgacatatttcgttatgattttaaggaaccatttaagctgcaaaacggctggctcctgtgggctggaattggcctcttttttgctctagtttccatttctttaactggagcagtgatgacctttctgaatggtgaaaccacacagagagagactgactcgctacttcttctattgccactgataggctcgtcgaatatcagcactgcctgtctgctgggcatcactggggttcttgcaccaattttggaggaaacggtcggtggtgccctgcttcgggcatccctcactctgtggtgtgccccgccggtctctggtcgggtcactgctgtggcgtgtgccgtcgccctgctcacgcctggcgtgtccccccgtcgtttgggccctggtgtggcactgggattctcatattctcaaactcggaatcttcttactcctatcacaattcatgctgcttggaattccggagtaatattgttactaacctttcttcagctgcagggatatgatatcaaggagctgctgcaggcatcttgaaggtttcatttggtcaccatagtcttatcttgcaccgattttgtacgttactgtaaaatacatgaactctttgaagtatcccctgctaacaattcatagttgacgtgtcaaaaaaaaaaaaaaaaaaaaaaaaaa

SEQ ID NO: 5686 - DNA, 802 bp, Triticum aestivum
  Clone ID: PAT_TA_5686
acaaggtccagcccaccttcgtccaggagcgccgcgccatgaagagggagtacgaggagttcaaggtgcggatcaacgcgccccacgcgtccgcgcagaaggtgccggacgaggggtggatcatgaaggacggcacgccgtggcccggcaacaacacccgcgaccaccccggcatgatccaggtcttcctgggccacagcgggggcctcgacaccgagggcaacgagctgccgcgcctcgtctacgtctcccgtgagaagcgccccggcttccagcaccacaagaaggccggcgccatgaacgctctcatccgcgtctccgccgtgctgaccaacgcgcccttcatgctcaacctggactgtgaccattacatcaacaacagcaaggccatccgggagtccatgtgcttcctcatggaccctcaggtcggccgcaaggtctgctacgtgcagttcccccagaggttcgacggcatcgacgcgcacgaccgatacgccaacaggaacaccgtcttcttcgacattaacatgaaggggctggacggtatccaagggccagtgtacgtcggaacaggatgcgtgttcaggcgacaggcgctctacggctacaaccctcctagcggccccaagaggccgaagatggtgacgtgcgactgctgcccgtgcttcggccgcaagaagcgaaagggcggcaaggatgggctgccggagggcgtggccgatggaggaatggacggcgacaaggagcagatgatgtcccagatgaactttgagaagcggttcgggcagtcccgcgcgttcgt

SEQ ID NO: 5687 - DNA, 1190 bp, Triticum aestivum
  unsure (1)..(1190): unsure at all n locations
  Clone ID: PAT_TA_5687
aagaactatgttcggnggtagcctaggtaataacatgatgaagggcatggtgtgcctggtggccgtggcactggtcgtcgccggcagcgctagcattgcggcggcgcaggcggccgggctgaagaagggcttctacaagaagagctgcccgcaggcggaggacatcgcgcagaaggtggtgtggaagcacgtcgccggcaaccgcgagctcgccgccaagttcctccgcatgttcttccacgactgcttcgtcagggggtgcgatgcgtcggtgcttctggactcgccgaccaacacggcggagaaggatgcgccgccgaacctgtcgctggccgggttcgaggtcatcgacgaggtgaaggcggcgctggagcgggcgtgcccgggggtggtctcgtgcgccgacatagtggcgctggcggcgcgggactcggtgtcgttccagtacgggaagaagctgtgggaggtggagaccgggcggcgggacggcaccgtgtccagcgacacgcaggcgttaaacgagatcccggcgccgtcctccaccttcgacattctcctcaccaacttctccggcaagggcctcggcctccaggacctcgtcgtcctctctggcggacacaccatcggaataggcactgcaactcttcagctccaggctcttcaacttcacgggcaagaacaaccccaccgacactgacccctccctcaaccctccntacgccaagttcctccaggggcagtgcaggcgtaacctgcaggccccgaacgacaacacgacggtggtgcccatggaccccggcagcagcacctccttcgacagccactacttcgtcaacctcaaggcgcggcaggggatgttcacctccgatgccacgctgctcaccaactcccgcgccgccgcgctcgtcgacaagctgcaggacaacggcgtcttcttcgaccacttcaagaactccatcaagcgcatgggccagatcggcgtcctcaccggcgccagcggccagatcaggaacaagtgcaacgtcgtcaactcctagataccggaagatgcatgtgtacgtgtgtcgatgaattgctgacgtggtatgtatcacagtgtctggaacattcaggcacactgtaacgagtgtcttgatgacccgggagctgtgtgtaaaactactaaataattattttataagaaattaaaa

SEQ ID NO: 5688 - DNA, 1245 bp, Triticum aestivum
  Clone ID: PAT_TA_5688
caccatgtgttggggtgtagcctaggtattaacatgaagaaggtcatggtgagcgtgggggcggtggccctggcactcgccgtcaccgccagcactacccctgcggcagggcgcgcggccggggggggggtggtattctacaagaagcgctccccccaaggacagggcgtcgcacggaaggtggcagcaaggcgccgcccccccgaccctgagctcgcagccactctgcacggcatgctatgcctgcttcgctcggtcgggcggtgcgtcgcggcggcgcgtctggcctcgccgaccagcacgaggagaacgggccgcgcctcctaccctttcgcgggctcgatcagagggaagaggcgaaggggcggcgtcaccggcgccggcgggggcgggagtagtaacgtgagccccgtccgctgccggcgcggtactgggtgaggtgcctgtacgggaaggggatgagctgagtggcggactgtgtatcggagcggcagggagtttatggacacgcgcacgtagaatgtggatgatccgggcgccgtctgcttcaatattcaccaaataattttctagaaattaaattgaaataaagagaaatatgatgtactctcaccctaaaacaccatcggaataggcaactgcaacctcttcagctcgaggctcttcaacttcacgggcaagaacaaccccaccgacactgacccctccctcaaccctccctacgccaagttcctccaggggcagtgcaggcgtaaccagcaggacccgaacgacaacacggcggtggtgcccatggaccccggcagcagcacctccttcgacagccactacttcgtcaacctcaaggcgcggcaggggatgttcacctccgacgctacgctgctcaccaacgcccgcgccgccgcgctcgtcgacaagctgcaggacaacggcgtcttcttcgaccatttcaagaactccatcaagcgcatgggccagatcggcgtcctcaccggcgccagcggccagatcaggaacaaatgcaacgtcgtcaactcatagattggctgaaagatgcatatctgtggacgtgggtcgctgaattgctgacctcatatattatcacgattataacggtgcggtgtatatgggcggtaaacaagtgtctagagatacgggaggtgcgtgtaaaactaccaaataattatgttgtaacgaattgaaaatgcagagaaatattttttaaaaaaaaaaaaaaaaaaaact

SEQ ID NO: 5689 - DNA, 763 bp, Triticum aestivum
  Clone ID: PAT_TA_5689
ctgcgaccccgcgtcctcctcactcgtcctcttccggccctcccctctctagccggaactcggggggcgccgccacgctccgttcacttccgggctacgatctcggccgccgctgcgcctgccaccgtcacacaagccgaccgtcgccgccggccgccttacccaagcctcggggtcctaaaccgtacgcagatccctcttggaatggcgagccaagagaagcccatcacgccgtcgccatctcctccggcgccgccccaaccaccgacgcccgagggagccccccgcatccgcgggttcggcggaggcgcggcgggcggcgggtaccctaaccctcctgacgcggcgctgcccgacgcggctacgctgcgggaccagtggcggttccgcggtgcgccagtacagccggtggtactcccaagcctggggcaccgccatcctcgctggcggcgccttctttgccctgggctggctcgtcaagggttccaacccccttccctcccgcgccgatccccgtccccccaacgacgccaacgcggacgaggataaaaagtgactgaagctagctgggaaagaaactccgcgtgttccaaactgaccagccatgtgttcgtagtaccctgtaaaaaaataatggcgtgtgttccaaactccgcgtgtctattttgagtaagtcagcaaaataatggcgtgttgtcgtagtcaaagctcaggactatcttgtaaatatgacaggtgtttatgatttcatgcaatagaggag

SEQ ID NO: 5690 - DNA, 539 bp, Triticum aestivum
  Clone ID: PAT_TA_5690
cgcatctctccctcagctccggcaagcaacaccagctctcctctcccctcgctcacctgctacaatgtcgaccgacgtggccgccgatgtcccggcccctgaggtggaggtggccgccgaccacgtcgtggagaccacggccgaggccgccgccggcgacgcgaagccggtcaaggagaccaaggccaaggcggcgaaggccaagaagccctccgccccgaggaagccccgcgccacccccgcccacccgacctacgccgagatggtgtcggaggccattaccgccctgaaggagcggacggggtcgagccagtacgccatcgccaagttcgtcgaggacaagcacaaggcgcacctccccggcaacttccgcaagattctgtcggtgcagctcaagaagctggtcgcctccggcaagctgaccaaggtcaaggcctcctacaagctgtctgccgcagcggccaagcccaagccggcggccaagaagaagcccgcggcgaagaagaaggcgccagccaagaagaccgccaccaagacca

SEQ ID NO: 5691 - DNA, 703 bp, Triticum aestivum
  Clone ID: PAT_TA_5691
tcggcaccggcccgagctcagtttcaagtaagaaagaaaagcaagccatggcttcttcagccgtcctgctacttattctgatggttgtggccgcgacggtgcatggccacacccatacccctggaggcactccggcggcactgttctgggaggcggccctcccggactcgccgatgcccgagtccatcgcccacctcgtgcagaagggcaccgatcactcgccgctccagcagcaccattctgccgccatgatcctgcccaacgcgtgcctcggctactcctacaggatcatatgcaatagtcctgcccaacaggcgtcgtctgtggaaggcctcttcttccgcgagtccgacatgcgtgtggggcgcaccatgacggttgccctgccggcgttcgacccggcgccgttcctcccgcgcaaagctgccgagaggattcccttcggcaacctcgcggatgccctctataggttcggcatcacgccgggctcccaagaggcggcccgggtaggcgagacactgagcgcctgccgcgaggcgcctctcgccggctcacggaaggcgtgcgccacgtcgctgggagggggtcgtgctgagcgccacgcgtatgctggcgacgagccggcccttggtcgcggcggcgtccgcacttcccaactccggcctgccgcgccgcacgtacactgtgcaggctatcagccact

SEQ ID NO: 5692 - DNA, 2047 bp, Triticum aestivum
  unsure (1)..(2047): unsure at all n locations
  Clone ID: PAT_TA_5692
attccacacacagccagccgctgccgctccccccgccgccctcggtgcccccggcggccatggcgatggagtcccttggcgtgctgctgctgcaccccatgaacgcctacctggagcaggagctcgacagccgcttccgcctcttccgcttctgggactcccctcccgacggccgcgccgagttcctccgcgccaacgcctccgccatccgcgccgtcgtcggcaacgccggctacaacgccgacgccgcgctcatcgacgcgctgccgtcgctcgagatcgtcgcctccttctctgtggggatcgaccgcgtcgacctccccaagtgccgcgacgcgcgggatccgcgtcaccaacacccccgacgtcctcaccgaggacgtcgccgcgccgtcggcccggctcgccatcgcctcccgaggcaaacccgtgtgcgcccaaggcctgtgctccgaatacgatttggccgagggggatgtctacactctcaccgcgcggatcagtgggaagagagtgggcacagcggtggtgaggatagggcttgccattgtcacccaagaggaggcctatgattatccagtcaactactaccagtgaacaaaaaaaaactaccccagctacacctattaccggactggcgcgctccaatgccctgaacagtgacatccttctggtggcttctccgctgaacgagcagacccggcacatcgtcattcacgccgtgtttatcgagcttggggggccaaggccaggttttcaatcatcgggcgccgcggtcatgtttggggagaccccgagctggttcacgcgctccgttcgaggggcgcctcggcgcggcggagatcgacaaattgttcggatgaccctccctccccggcagcgccgctcctccccttcggtgaagtgtcggggtcgtgccgaacgtggagcgttgcgacggacgcggcgagccaggccctgccggagcttgccctcgctggacctggaactcccgtagactccaatgaaagacgcttgtctccgattgttagttgcccataaggaactgactccgggggtcctttctctggctatggcatgaatgtcagatcttttattccatttgataaagggcgcaggagaggaagaggtaattctatgtgatgcagctgtgacggtccacttgacgtcctcaatgagcaaagccggggtccacgtgccaccaggcctaagaagcaaccagaggatgatagtaaagatgagaagccttctgttggacttgaccaggagccatacaacagggctgactttgttaccgagtacaaaaatgctagattttttatcataaaatcatacagcgaagataatgtgcacaagagcatcaaatatggtgtttgggctagcaccacaaatggaaacaagaaactagacgcagcctatcgtgaagtgaaggacaaggaagaacattgtcccatttttctgttgttttcggtgaatgctagtgcacagttctgcggtgttgcggagatgaccggcccagtgaatttcgagaagagtgtggactactggcagcaagataagtggactggccagttccctgttaagtggcacatagtgaaggatgttccaaataatctcttccgccatataattcttgagaacaatgagaacaagcctgtaaccaacagccgggacacacaggaggtgaaactggaacaaggactggagatgctgaaaatcttcaaggaccatgaggatgatgtgtcaatccttgatgactttgacttttacgaggaacgtgagaaggccctgctggagaataaggcgaggctgcatcagcaacaacagatttccagctccagtgtttctgagcccaagaagccgtcgacagtgccccctgaccttgtgggtcatatcaccaatagtcctagcngtgttgagccgaaaagccctcgaccatacccaatgacgtggtgggtcatatcaccaagaccttcgaacatgccgtgcgggttggcgaggccaaaatgngagcccctttcgcgattaaagccccgctggagaatat

SEQ ID NO: 5693 - DNA, 595 bp, Triticum aestivum
  unsure (1)..(595): unsure at all n locations
  Clone ID: PAT_TA_5693
gcacgaggcacacatcttctacgcagagcctaaaacattacctcctgctctgcaatcctagccaaagtcttccaccgatcaccgcctgcgccaacctgatggcccgcttcgccgtcgtcgccgccatcgtggcgctcctggccgtcaccgccgccgcacaggcccccggtgcggcgcctctccccgcaccgcctgcgaggtccccggccaccgcccctgcgccggtcgccacgccgcccaccgccgcgtcgccgtccccgatggcctctccccccgcgcctcccaccgacgccccgaccgacgctccctccgcgatgaccccgtccgcggtctccgccacacccgagggcgcacctgccggcgcacccagtggcacccccgccagctccgccgtgtacacctcctccgtcagcttcctcgccgtcgccggcgcggtcgccgccgccatcgtgttctagacggagcgagactctgctctcggtgctctgttcccgcgtgtctggactggtgtgccttgttccttgcggccttcctggacctggccggggatgcttgtttcggatgcatgagtttcgtatgaatacaaattcgttnn

SEQ ID NO: 5694 - DNA, 1422 bp, Triticum aestivum
  Clone ID: PAT_TA_5694
cctcgcgtgcgccacggagctcgctcgcacgccgcggccgggtaacaccaccaccgggcaccatggcctcctccttcctctccctacgcctccctaccccctccccgcccaccgcgacgtcgtccccgttcttcccgaatcccctagtccggtccggaaggtgcagtccgccgtcctctaccctcgtggcgcgtgttgccgggtcggcggcgggggctccgtcgccgttgttcaacccgaggggcgacccgttcctatccacgctagccgctgcttctccagagcagctcgcggcagctgcgggtggcgaacgccgcggcgaggaccacctgccgttcctcgagatcttccagaacgccaagctcatgtcctcgcccgcgcaggtggaacgttctagcagctcttacagtcagcacagtcctagaaggcctcccccggatttgccgtcgttgcttctacatggccggattgtttatattggcatgccgttggtgccagcagttaccgagcttattgttgcccagttgatgtaccttgattggatgaatagtagtgagcctgcatatatatacatcaactcaacaggaacggctcgtgatgatggtgaaccagttggaatggagacagaaggttttgctatctatgatgccatgatgcggatgaaaactgaggttcacacacttttgtataggagctgcagcaggtcatgcctgccttgtccttgcagcagggaagaaaggcaaacgatatatgtttccccatgccaaagctttgattcagcaacctcgtattccttcatatgggatgatgcaagcttctgatgttgttattcgtgcgaaagaggtagtgcacaacaggaataccctggtcaaacttttagcaaggcacactggaaatccaccggagaaaatagataaggtgatgagaggaccattttatatggactctttgaaagccaaggagtttggggtaattgacaagatcctttggcgcggtcaggagaagtacatgtctgacatgctctcccctgaggattgggacaaggttgctggagtcagaggccccggtggaatgtgaagttgtgcactggaactcgaatacttagttaggtctttgagctcgcagtcgcaggggttgaacgaacaatcttgcctgttgacaggttgtcagagccgagggtacctgttgtacggactatggagaagctagattagaacttggacgatcatgttagtgcgtatgctcccgggattggagctagcgagtgttttgggtggagctattgttgttagtccgatcgtttgccagtccaggttttggtactctgctcactgtaggtgcatagtgtacaccggagttaaaagcaaaaaacaaccacatttgaggcttcgtttgcgaaaaaatacctaaaaaataaaaata

SEQ ID NO: 5695 - DNA, 719 bp, Triticum aestivum
  Clone ID: PAT_TA_5695
cttcccaactagcttgagtagtacatttcttgcacatccacagaactcgatcatggcggccgttcctcctaatgtcgaggtctccattgtccctgcacccactacatacagaaagactatcctccgcaacctatggttgggccgcactggtgatgacacccagaaatcccttcttgaggtgggcaagtttgggcattacgttgttgtcaactggactgtatttgaaggagagggcaacggggcgaagctagtcgcccgtggacaaggaagcaccatatgcgccggtagctggatatctacttacgtcatagtgtttgtggatggcaggttcaaaggatccacccttcaagtgatgggaaacgccttgggtgttaatggtcagttggctgttactggtgggactggggagtttgctcttgcaagtggtatcatcaaggtggattttgacaaacttactggtgttgaccaccttacggtggaagtgtatacaccagtgttcttaggaccgtgttatgcagcagcggagaattagtcccttggggcctgatcagattttccagttactctgatcaaaataatggtttgacttagtccaatttatctttaaaatgtgtcaactggtgttcccaaccatgttcccgtcatcatgtggttgccctctcaaactcttacacaacacaaatgtaacctttctcatcaatgttgggtttcgtgccatc

SEQ ID NO: 5696 - DNA, 780 bp, Triticum aestivum
  Clone ID: PAT_TA_5696
ccatcctgtaatacacacggtcgagttttgccgaatggagcccaagcggctgttctcgtcagcgcattgctttgcctggcgctctcccgcggcgcgctgtcccagaaggcacgggccccgatcgtcgagaccccggcgccggcgccggccccgcgccacgtcgagctcgccgaactgctctccctcgccgggccgtatggcaagttcctggggtacctcaccaagaccgacgtgatcaagacgttccagagccaggccaacgacacgaagcagggcatcaccgtcttcgcgccgcaggactcggcgttcgcggccctcaacgagaccgtgctgtccaacctcactaccgaccagctccggtcgctcatgctgcaccacgccatgcccagttactaccagctctcggccttctccgcgctggcggcggcgagccaggtgtccatgtttgcgtacaaggtgaacgtcacctacgccgcgggcacgatcggcgtcgtgtcgggctgggccaccgccaagctcgccagcagcgtgtactcgacgtcgcccgtcgcggtgtacgcgctcaacagggtgctgctgcccaaggagatcttcccggctgccccggagatggcgcccgtgcctgcgccggcgccggcgccgggacgtgggggcaaggcgatggctgacgcgccgggcgccagcgagcgtgctgccagtgacaatgcggacgccaagagttcgtcctgccgggtcgttggcgcagggagccttgcacttggctacgtggttctgctggtc

SEQ ID NO: 5697 - DNA, 1166 bp, Triticum aestivum
  Clone ID: PAT_TA_5697
gcactacccctcccctctcttccttccgggcggcgagcgccgccgtcgctcccgcccacatcgatttcaaccgccgcacgcggccgcgtcagcgccgcacctctgccctagccgcctctcccttctccgggcggcgccggtactgaagacgacgacgtcggctctattctccccaaccaatctccgacgatcgcagcccgttttctccgaaatttcggggcctcgtcgcgcctccatctgctaacaggaggcgcggcgtcgggctccccgggatgtcgttccgcggccgtggagggagaggaggagggagaggcggccgcggaggaagaggaggcagaggcttcgggggcgccagctatgaccaccccgccaagcacgctccccacgaggacttcccggagatcaccctgccggagatgacctgcgccaaggcgaccaacgaggagaagactctgatactgtccaccttgaagctcgatgatttcatgaggaattcttgctactacctggagccggatgcccccaagaaaaagaatgacgacaaagagatcgaaagatattctgataggaagcgtaaaacacaaagcaaacgggaagctcttgcgtcatacctcaaacttatccctgcaaattttcctgcagaactgctacatggttctaaacgagcgcaaccagttcagaaaaaacttcggtgggataaagacgcggataatcaggcatttgatatattcgagaaactcgaagcgaaacagaaggatggagaggagaagaccgaaaaggagggtgatgaggaggaggaggatgaagaggaggaagcagaagcggaagaaagttcagatgacgattataatcagaatatcgagttcgatgatgacgatgatgactggaaccaagaggaggaagcacatgaagactgctatgattgatgattggtagccgctgaaaaggttaacccattcaacattggttaggtttcttggtattcttcttcgtttgtaactcattgggcaattttgatggaaggtagtgcgtaattaggtagttagatatgattattcttcccgcgttcatgtcaagaaggtaccagaaactcaggaccatatgaattctgcagcatccagttctgaatgtttcctattgcgtctgtgcaaaaaaaaaaaaaaaaa

SEQ ID NO: 5698 - DNA, 1334 bp, Triticum aestivum
  unsure (1)..(1334): unsure at all n locations
  Clone ID: PAT_TA_5698
gggtcttgagtcttctcgtctactaagctcgtcgtcaggtatggccgccactgcggtgaggtgcctgctcatggctgccgctgtcttggccccgcttttcgccggctccgaaggcgcatttctgtcgtcgaagttctacgaccggaggtgcccgagcttgcaaaccatcgtgcggtcggcgatgccgcaggccgtcgcggcggagccgcggatgggcgcgtccatcctccgcctcttcttccatgactgcttcgtcaatggctgtgaagctgtccagcttgctgggacgaccaccgccaacttcaccggcgacaaaaatgcggggccgaacgccaactcggtgggcggctaaccacgtcatccatcaccatcaaggcccaagtccaggcggtctgcaaaggcaacgtttcctgcgcccacaacgtcgccctccccgcacgcgggagccgccgccacctccgcgcccagccacgtgtcgacgccgacctggttcgacaccacctacttcgagaacctcgcgaacaagcaggggcttttccactcggaccaggagctgtacaacggcgggtcgcaggacgtgctggtgagggtgtacatgcgcaacccggatatattcgccctcgacttcgccaaggcgatggggaagatggggagcctcatgccgtcggcggatactcccacggaagatcaggctggactgcaagaagatcaactaaggtcaacaggatcggaggatgaatctgtggtgtccagtccggtacgaactcgcgaggctatctatgctcacagctcctactcagaccaccccgtacacaagcaggggctgttccattcggaccaggagctgtacaacggcggctcgcaggacatcatggtgaaggtgtacatgcgcaacccggacacattcgccatggacttcggcaaggcgatggtgaagatgggcagcctcatgccgtcggcggacacgcccacggagatcaggctggactgcaagaagatcaactaatataaggtcaaccggatcggaggatgaacctgtggtgtccagtccggacgaattcgcgaggctatgcatgctcacagcttcactcaagagtacattgagcagccaaaagggctgttagccgatatgggactgctcccatttccattttgttgctggcaattgtaatgatcaattaattaatcaagatcttttccaaaaaaaaaaaaaaaaaacaccgagggccggggcccccgcccctttcccctattccgcctgtggctcgttanaagtctgctggaaacctgggtacaantatcnctgagaatcccttcnagtggtatacaaggcg

SEQ ID NO: 5699 - DNA, 480 bp, Triticum aestivum
  unsure (1)..(480): unsure at all n locations
  Clone ID: PAT_TA_5699
acagtgtcctccgccagttaatgcgaagaacattccattgttccatcgctagctagctgtggtgtgagtgatccagactgactggtcggaactagcttggagggcggcgatcgaggactctctccggccgccgtgctccgacgtgtgtagatagcgggatgggggcgcgcgccgtgctgcgacaaggcgagagtgaaagcgggggccgtggtcccccggaggaggaccaagcagctgcgggcctacgtccgggctaatggctccggcggcaactggatcgccctgccgcacaaagccgggctgcaccgggccgccctgggctgccccccgccggggctcatccccctgtccccgctcacccggcacgccggcgcccccgagccggaccaccgcggcatctccgcccccgccgcctccattacttaaggcngnatccgganggggnnaacggcaaggaggacgctcactgtcctctanncc

SEQ ID NO: 5700 - DNA, 726 bp, Triticum aestivum
  Clone ID: PAT_TA_5700
cgcctcctgccccccctccgcctcgccgcgctcgccgtcctccgccgcctcggcctcggcgccctcgccgtcagccgccgctccatgctcggggtcctgtgcctcgcccccggctcgttcgccggtgcggggcccccggcccccgtgaggcccacttctgcggggccgtccgccgcctccagcccgccttccggcgcggtctgccccggggcccacgtgccctgccgctccgtcaggccctgggtgctggtgtcgtgcctgcgcttcgtatcctttgaggtggcccacttgcgtctcgagcgcttggagctccactgggcgcggcccgtgcagttcaccggtgtagtgctgggcattcctgcgcgcgccgctcccggacgttccgggcgtatcgttgaccgcttctcctcggagccctcccggccttgccgatcctggcatcttctcctggacaacggatacagcgggtcagggctgcccctggctgcttctcttggcagtcggtctgggtggagttcgcaccccccccgctgcatcctcgcgccctggatctggttctggtgcacgtccaccactctatccgaatcctgcagtgcaaaaatatgctcaaacaaaaggagttaccagttgcttttgtctcattcaagtcccggttggaggctgcccaagctgctgaaacgcaacagcacgtcaatccgctgtcactggttacacgttatgctcctg

SEQ ID NO: 5701 - DNA, 1844 bp, Triticum aestivum
  Clone ID: PAT_TA_5701
gaaagtataaacaagtacaaaataaagcaaaaaacgaaatcagaaaacctaaaaaaatagaggaaaatgtggttgtggcttctctgccgaactcggcacccgtgagaacttggcgagagaggagatggggaagggcggcgcgctgtgggccgactccgccctctccgacgccttcgaccggcccgtcgccacccacaaggcaatgcatggttagaccggccttgctacgggacttgatgggcagacttgcgcctcgtaggcaaaaaggcggaatggacggttcgtcgacttgtgacggcgactggttttactggagcggaggcgcatttccttttcgtcctcttcgctcgtgggaaggcgcagcaggtcggaggaggaagccgtgagaagttggcgagagaggagatggggaagggcggcgagctgtgggacgactcggcgctggtggacgccttcgaccacgctgtcgccacctacaaggcaatgcatggcaagaacaaccaagctgctccatctgagaaacaagagtcagaagatgtagctgctgctgccgcttctgctgccgcgtacgctgccgctgctgttgcagaagaacctgtctctactgaagtggcagatgagcaaacagagaaaaatgacagctgcactaacttacccattggcccagtggagacaccacagcagccctgcgaagaaagaaagaccgataagcaagctcctcttcgaggaactgatctgggcaaagagacaaatatctctgaatctaagacatgcttctctgatgtcaccaatactgagggaaaggatagctcaaaccagcagacagaggactacaatgaattactgaggaagtactatgaacttgaggtgcaaagccagaaagttcttgagcaattacatcagacaaattattggaattatcaaacccctgaacaatcttcagcatatcaacagcagcaagttcctgcttacattgccacagcaccagacccaaactcttcaaccactcaaacctcatgctgctccttgaatgttcccatggtttcaatctcctgctgttcaactggtcaacaaagtggcgaatccactggtatgccacctaatggaggctgcagcatatcattcacttgtgatcattgccctggagcaagcactacatatcctactggttcagcctttacgcagctcccaactaaggtatctactggcgatgatcaagttgctaaggctgcaatgatgactgctgaaggtgccatgaatttcatgagaaatacaatatctggagatgctgcctcctttccaaatatgagaaatgaaggtggaattggaaaggagaataacacaactgtgggcatgaacctgaatttagacaccacaggagcaaacagtgatctcgctgtcgtactgaatgcatggtatacagcagggttctacactggcaggtacctcatgcagcaatcgatgaaaaatccccgagaaaattgagtgccaaaagccatatagtggctcaccaaggatccctttcacttcgggaagaactgaaatatgcactcaaattatgatgtaactgaacatgctgatggaattctgcaaccactgttttatgccagccagtactttttcaagcaagtgttagggtattcttacatatgaatatgaatttgctgtaatttgcagtaaatgcttgtctggataggtaaggattggctcaatcccttcagattggcaggaattgttgcctgtctattcaactaagttccaagtgggtaaagatgacgtattcatgaccgtgtcgcccaaatttgtgaaattcagtactacctagtatgaatatatattagctg

SEQ ID NO: 5702 - DNA, 1161 bp, Triticum aestivum
  Clone ID: PAT_TA_5702
attcggcacgaggcgatgagcgtgtaggcctggagtccaagagtcaccgttgtcacttgtatctcgtcatccatgatgaggatgatagatatgccatccgcaagtttgatttatcgttacactcttcttctgaccacaccgctctgcagcgcctacctccccctctcatcagccttgagtctccgatgagcggattgtttgcgtccattggctccaaaatcatggtgatggatactgatcggccggagcgcatagtacccgtctttgatgtctgcacgaagtatctcaccctcggtcctcggaatggctcacggccttttcggcccatatatttacccgtcggtgatagtctcgctgcactggacgaggactcctcggagcttctccgtcaacaggaatggggatggtcgtcttggcgcagtctaccgaatccgccgttcaatcttgaagacattacctcccacgcggtgcaccctgacagccggaccatctttgtcagcacaaagaccaccactttttcccttgataccaggctgaatgatactaagtggatgtgtcatggccaatggaagcttccttttgttggacgcgctcactttgaccctaggctggacgcctgggttgggctctctggcggccaggacacgcttggttacctttgctccagtgacgtcgtttcaacagatcctgatgaccccagcggcaacacacagtccccatcttggaagcttagtaagaagagattgttcggtgataaccaggctgagaagcacattggcaccaatcttgtctacctgggggttagactcttctgccttgtgcactacttctctgttagagatgatgcaagtggctcaaattgcaagacaagatatatgcttcggctaacgacgttctctcttgagtatgacaaaaacggagacctgcggactggaaaacccagccgtgttcaatgctacagtctgcctacaccatctaatatccttgcctttcgggatcctgttgcgttctggttgtaatgaaatcaatgtgtgtgtagtctatgcccttctgcatgtgacagacgtcaatgtcgtattgtatcccttctgcatgtatcagacttaagtcgtatttacaaatgcattgtgatgattacagtgtaaaaaaaaaaaaaaaaaa

SEQ ID NO: 5703 - DNA, 1293 bp, Triticum aestivum
  unsure (1)..(1293): unsure at all n locations
  Clone ID: PAT_TA_5703
ggaggctggcggtgggccccgccccactggcgagcggcggcggcgacgacgcgggcgagaagcgcgtcacggaccgctacctcaagcgcgaggtcctcggagagggcacgtacggggtcgtattcaaggccatcgacaccaagactggggagacagttgctatcaagagaatccgcttagggaagtacaaggaaggcgtcaacttcactgcattgagggaaatcaagctgcttaaggagcggaaagatcctaatattatagagttgattgatgctttcccttacaagggaaacttgcaccttgtatttgagtttatggaaacagacctggaagcagtcattcgtgataggaacattgtattatctccagcagacataaaatcttatattcagatgatgttgaaaggtctagccttttgccataagaaatgggtgctgcacagggatatgaaaccaaataatctacttatcggtgctgaaggacagctcaagcttggcgattttggtctagcacgcatattcgggagcccagaacggaacttcactcaccaggtctttgcgcgatggtaccgagcgccagagttactgtttggtactaagcagtatggatctgccgttgatgtttgggctgcatggttgtatttttgccgagttgctgcttagacgaccatttctccagggttctagtgacattgatcaactcgggaagatctttgcggcatttggaaccccaaagtcttctcaatggccagacatggtttgccttccagattacgttgaataccagtttgtctctgctcctcctcttcgttcgttgtttccaatggccagtgacgatgctttgggatcttcctgtcaagaatgttcacatatgacccaaaaagcaagaacactgctcaagcaggctttaagaacacaggtactctccntcaattaccaagcgccaacaaaaccaaatttgttgccaaagccaaactgaaaggggaccccanggaatgacaaataccggttntgancctgcaaggcgcctgtcnttgtgtccccncccnagnattcncaaatgtctgcccccggatggatggaacnatgccnacngancaaagaagcanaacacccactacagnattagncaacnanggattcatcaanttctananacaatncattnatttggatttttgganagacaacctcacaanatgatatccaaatcctcaaaaggatnaaaggtcnantcatccaataaaanttggganatttcccacgggtattttaaannntaagatttaaaaat

SEQ ID NO: 5704 - DNA, 676 bp, Triticum aestivum
  Clone ID: PAT_TA_5704
aactccgcctacgccgccgccgccgccgccgcgccccgcattgacccgcgcatccaccaagcgcgccgccgccgtcaccgccgtcgccgtcgccgccaagcgcaagcgcgtcgcgctcagcgagatccccacgctccccaacggcgccccccagccgcacgccaagccccgggagtcctcgtcccaagtcgccaagcccaagaagaggtccgtgtcttccctgtccctccccgcgcccaagccggcgcccggcgcggccgacgagaccggcgacccgcagctctgcgctccgtacgcgtccgacatctactcctacctccgatccatggaggtccaggcgagacggcggccggcggcggattacatcgagagggtgcaggtggacgtcacccccaatatgcgcggcatcctcgtcgactggctcgtcgaggtcgccgaggagtacaagctcgtctccgacacgctctacctcaccgtctcctacatcgaccgcttcctctcggccaactccctcaaccgtcagaagctgcagctcctcggcgtctcggccatgctcattgcctctaagtacgaggagatcagccccccaaacgtggaggacttctgctacatcactgacaacacctacatgaagcaggagcttgtgaagatggagagggatatactaaacaacctc

SEQ ID NO: 5705 - DNA, 790 bp, Triticum aestivum
  Clone ID: PAT_TA_5705
cccccacgattcattagcaggtcgaggaaaggacttcgccccaccgcacctgccggatctgctgagccagcggccggatccgccgagccagcggccggatccactgagccaccggccggttccgccgaggcagtggccggatctcgatcttctagtcgtccccgccttctcctctatcggcggcaggcagcagaaacgtgcaaggcgcgcatgactgctccagccagaggaaggcgcgaggtgcgactcgacggcgcgtggtcgagccaggcacgacacgggcgggcaccacctcactggggcgcgaccacggcagccaacatcggcgcccaaatcgcatccaccgaacccaagcgcgggctccggtgggcgtgcggttctgcgttcaataggagagcacgcgcgagaaagagcgctgctcgcgtcttccagtgaaccccaaagagagcagaggaggagatgaccaagggcgaggttccattgatcggcatcgaccttgggacgacctactcctacgtcagcgtgtggcagtatgtcgaaatcatggccaacgaccacggcaaccgcatagcacaccacgccctcctacgtcgcctgaaccagctcgccatgaaccccaccaacactgtctccggtacgtgcttccatctggaggctctgcggctgcgcgcaggcgctgttctattcccatgcacaagatatgatttagttgggattggaattatggttatttgataatccgatgtagctgttgtcgaatcccctgtttcccagatttactacagattta

SEQ ID NO: 5706 - DNA, 625 bp, Triticum aestivum
  unsure (1)..(625): unsure at all n locations
  Clone ID: PAT_TA_5706
ttttttttttttttttttttttttcccaagtgtaaaaagcatttctttcaacttgaacagctgtatggaaggaaataacaggtagaaaatactcagtataagcttccttagtaaaacaaatccgtatgtagccaactgtgcttgccaacattttttcccttgcttgtgcatacattctcgaagaagaccaaatccaagtcgaagatgcatatatacttttatacatacaaaatgcattcttttcctcggaaattttctctgtacatcatcaatcatagatcaccaattaacttattcctgagagccttagaaacaaaaggaaaattagtgaaggttggctagtgctgccggctgctggtaactgacgctcttgagcaaggagaggtagccaccctccaggttcttcaccttcgtgaacccggcggcgacgaggtcggcggtggcgagcctggaccgcaccccggagcggcagccgacgaggagccggtcctgtttcgagtggagcgcggcgacctggtccacgaagtccaggttgcgctccttgccgtgggggttgacggaaagtatanggcacttcnccgccgggaatgcccggcgaatctccaatgcggtgtcacgtaccgta

SEQ ID NO: 5707 - DNA, 693 bp, Triticum aestivum
  Clone ID: PAT_TA_5707
gcgctatttttctctgctttctccgtcgcacacacactactatcctttcgtgaagctcccgagctcgatcggcgaccatggcgtccatccggcgagatctgctcgtggcgctgtgcgtggcggcgctcctggccgtcgggtccgagtcccacgggctggaggacttcggcagcgaggggaagacggaggcgacgcccgagatggcctccttcttcggcgccaagcccgaggccgccgtgctcccggaggcgctggacaacaacaaggccgccaagccggaggcggcctcggcgatgcccaccaccaccaccagcaacccacgttcgtccccgccgcgcagatccgtggccgtcgcggccggcgtggcctgcggcgtcgcggccctggcggtggtcggcgtggcggtcgccgtcgccttcgtggtgcgcgccaggcgcggcgagaggcgcgaggccgaggtccattttggttaaaagggccacgagccggcttcgtttgattaggacgtgctcgtcaatttcattagcgtcgtggtttgcgtttagttaatcatctgcttagtttcatgaatgatttttggccgttcttgcccctgtttgtgtgtttggtgtgtgtggtggggatttgcaaagctacgtacggagcggcacgctgtaacataaataacgcttcattggcatgcatgtttctgtg

SEQ ID NO: 5708 - DNA, 825 bp, Triticum aestivum
  Clone ID: PAT_TA_5708
ttcggcacgagggacaccgcccctcttcttgctctctgctctcctctcctctcctcttctctcctctcccacacgcgtcctaaagcaagcaagctcggacgccatgagcaaggactgcggcaaccacggcgaggacgacatccggcgcacgtgccggcgcttcctggccttcctcttcttcctggccctggtggtggccgtcatcgccctcatcgtctacctcgtcctccgccccacgcacccgcgcttctatctccaggacgcctcgctccggcagctggacgtgctcaccgccaacgcctccgccgcggcgggcgtgctctccaccgtgctccaggtgaagatcgacggccgcgtccggtggaaggtgggcagctggatctccggccactaccacatcttcgtgacctgccccgccttcctcatcggcaccggcggcaacggcgcgcccggggccaacgggctcaggttccagaccgccacctactgccacgtcgaggtctagccgtccgtccgtacgtgctctgcttcctcttcttcttcgtcatcttcctctgctccgtcggcggcggcgaggtaggtttcttgcgggtggcgcgcgcgcgtgcgcgtagccaagaagatcatcaaggctgaaggccaagggggtggtacatggtggtaataagtgttagcgtcgaggggtataggtgtaaaaaggaaaagagaatttagtgttggttactcctactaaattgtgttttgctcgtttttaattgttggtaaggtatttattccacgtttaattgtcgatatatataaacctgttgttacgacggaattaaa

SEQ ID NO: 5709 - DNA, 916 bp, Triticum aestivum
  unsure (1)..(916): unsure at all n locations
  Clone ID: PAT_TA_5709
gatacttttcccctttgggatgtagggcccaacaaagggcaggtctaaggttcgcggccagtgggagaggtcaaagtgttacgcatggggcgacctgaagaataatacattttcttaggttccttttgcaagctacaatcataaaaggggaaatcagtattcagctagtagcacttttggttggaacaaagtccatgccaaaaactcaggatgcatatacatgcatagtgccttctttttccatggaaattaattcctcagttctgaacacgcttcttcctcttattcttcataactcataggatgttggataatactacatagtactccctccgtaaactaatataagagcgtttagatcactattttagtgttctaaacacttttatattagtttacagagagagtagtacttattctagatacggaattgatggatcagtggtggctggctgccggctgcgggtagcttgcgctcttgagcaaggagaggtagccaccctccaggttcttcacattcgtgaatccggcggcgacgaggtctgcggtgggcgagccttgaccggatcccggagcggcagccaacggaggaaccggtcctccttggcgtggagcgcggcgacctggtcgacgaagtgagggttgtgctccttgccgtgaggggtgacggagaggtagtatggtacgttgcgcgcgccggcgacatggcccttgtcgaagtcctcccacatgcgcacgtccacgtacccgtactgccccgaggccagcagtgcgcaagccgcctcggggtcaacactctctacgggcactgccgcgccgctgccgctgcttctcagggagcccatggtgtatggaggatttgagcagggaagaagaagacaggggggcgtgttgatgtgttggcnccgggggctgt

SEQ ID NO: 5710 - DNA, 743 bp, Triticum aestivum
  Clone ID: PAT_TA_5710
gagttttttttttttttttttttacacgcaaacatttttatttcttgggaattggttggtccaaagtccatgtccaatatacgtacctacatacatacggctttgttttccctttgatagtaattaaatcccagatgtccgcctcagctgaaggacttgcttcttcttcttcttcttcttcttcagaagaagaagacgaagggtgatagaaacacagtacacaaacaggtcactaacgaactttttcgaaactctcacaagaatcaattgatggatcattgggtgggctgggctgcttgggggctgtgggtaactggtactcttgagcaaggagaggtaaccaccttccaggttcttcacgttcatgaacccagcaacgacgaggtctgccggtggcgagcctggaccggaccccagagcggcagccaacaaggaaccggtcctcctttgagtggagcgcagcaacctggtcgacgaagtccgggttgcgctccttgcccatggggcgtggattgagtggtagtagggcacgttgcgtgcaccggcaacatggcccttttcgaagtccttcccacatccgcacgtccacgtacccgtactgctccaaggccagcagcccgcacgccgcctctgcgtccacgctctccaccgccgtgcttgtgctgctccgcagggaacccatctatggaggattgagcagctaggaagaaggggcctctgtttctgtgtgaggtggtctccag

SEQ ID NO: 5711 - DNA, 570 bp, Triticum aestivum
  Clone ID: PAT_TA_5711
cagggcatagccgaaaacatcacgaccaaatagctccaaacataaagaagggcatacatgctaacaacagggataaagggacaaaaggacaagggggtaacccatgaaagtctcaggcctttcagctaaaggactcataacaccaacatttgataaatataaggggatagctactagttcctcattccttttcctaaaaaccaccggggtcgccgccaccacttgccttcttctggttctttctcttcaccctgcctgcagggcctccgccgaatggacttgtcagggaaaagtcgatgtgcttttcaaattcaaccctcaccatgaacgacgggacattgacgatctgcctgccaaccctgatggggggttgcctgatcaaaacacgggcatgggggatggattttgccatgccagccttgaaaacaaaagtttgaaggcgccttgcaagggaagtttttaacagtcagggcaaggacgtaatcaagcttatcctggccctcaacaaggagaccatagggggttatgccacggaaaagggcccccccctcaaaaaacgggggggatttt

SEQ ID NO: 5712 - DNA, 706 bp, Triticum aestivum
  Clone ID: PAT_TA_5712
gtttgctttacgttaagttggtgtcaaggtgggaggggttgatcgtctttgaaggttcggtccgtgaagcccgttcagtgacggatgcttgtgtttcagtttggttcagagtcaggtcctggatgttgttaagtttgtttacttattatgggcgcttgtgtattggttatttgctgggcattatgccttgatattaaagatttccgcccagtaaaaaaaaaagacacacgacaaacagcaagtactagcaatcatctagccgattcttcccttgctgcagcatctgtagcttccttctcgccttcgttcaccttccgcggctgattaatggcaaccatgatgaccatgagctccttcgccggtgccgccgtcctgccgcgtggctcggccggccacttcggtgcccagtctctgccagcactgggccgacgcgccctcatcgtcagggcacaaaccgaaggcccgagtgcaccaccgccaaacacacccaaggcgagcacctcgatctgggacgcgctggcgttcgccggaccccgcgccggagcgcatcaacgggcggctggccatggtgggtttcgtgactgcgcttgccgtggaagcaggccgtggagacgggctcctctcgcagctcggcagcggcaccgggcaggcgtggttcgcctactccgtggcggtgctgtcgtgggtcctggtgcaacgctcaagg

SEQ ID NO: 5713 - DNA, 691 bp, Triticum aestivum
  Clone ID: PAT_TA_5713
ggtacaaagctgtacacgcaaacatttgtatttcttggaagttggttagtccaaagtccatgtccaatatgcgtacctacatacataatgctttgttttccctttgaaattaattcaatcccagctgcctgaaggacttgcttcctcttgttaagacgaaggatgatagatacatagcacacaaacaggtcactaacaaactttccaaactccaaagtatcaattgattcatcattggtggcttgctgcttacggctgcccgtaactggtactcttgagcaaggagaggtaaccgccttgcaggttcttcacattcgcgaacccagcagcggcgaggtctgcggtggcgagcctggaccggaccccagagcggcagcccacgaggaaccggtcctccttggagtggagcgccgcaacctggtcgacgaagtctgggttgcgctccttgccatggggtgtgacggagaggtagtagggcacgttgcgtgcaccggcgatatggcccttttcgaagtcctcccacatccgcacgtccacgtacgcgtactgctccgaggccagcagcccacacgccgcctccgcgtgcacgctctccaccgccgcgctcgtgctgcttcgcagggagcccatctatggaggatcgagcagcggggaagaaggggcctctgtttctgtgtgaggtggtctccag

SEQ ID NO: 5714 - DNA, 1024 bp, Triticum aestivum
  Clone ID: PAT_TA_5714
tcgaccccgcgtccgtgtttcctttacctcccggaagacttttcgctgcaccgaccgatctcgatcatggaggatgagaggagcacccagtcgtaccagggaggtgaggccgccgagcaggtggaggtgacggacaggggcctcctcggcaacctcctcggcaagaagaaggcggaggaggacaaggagaagaaggaggaggagctggtcaccggcatggagaagaaggagaccctcttctccaagctgcaccgatccagctccagctccagctcgtctagtgacgaggaagaggaggaggtgatcgacgacaacggcgaggtgatcaagaggaagaagaagaagggtctcaaggagaagctccaggagaagctgcccggccacaaggacaccgagggtgagcacgtgacgggcctacccgcaccggcggcccccgcgtccgtgcagacccaccatgacaccgacgtcgtcgtcgagaagatcgacggtgacgtgaagacagaggcgacaccggcagtgcccgaggaggagaagaaaggcttcttggaaaagatcaaggagaagctgcccggcggccacaagaagccggaggacgctgctgcggtgcccgtcacgcacgctgctccggcgcccgtcacgcacgctgctccagcaccggtgcacgcgccggcgccggccgccgaggaggtgagcagccctgacgcgaaggagaagaagggcctgctgggcaagatcatggacaagctgcctggttaccacaagacaggggaggaggacaaggccgccgccgctacaggcgagcacaagcccagcgcttgatcgccgccgtgcccgagacccgtgaccggacctcgattgaattgttggcgtgtgttgtgtttgctttacgtctaagttggtgtcaaggtgggaggggttgatcttctttgaaggtccggtccgtgaagcccgttgagtgacgggtgcttctgtttcagtctttgaaggtcctggatattgttaagcttgttacttatgggcactt

SEQ ID NO: 5715 - DNA, 712 bp, Triticum aestivum
  Clone ID: PAT_TA_5715
accaactgtgcctgcccattattttctccctttgcttgtccatacattctcgaagaagaccaaatccaagtcgaagattcatatatggttttaatacgtacaaaatgccttcttttccttggaaatttactctgtacatcatcaacgatagatcaccaattaacttattcctgagagccttagaaacaaaaggaaaactagtgaaggttggctagtgctgcctgctgcttgtaactgacgctcttgagcaaggagaggtagccaccctccaggttcttcaccttcgtgaacccggcggcaacgaggtcggcggtggcgagcctggatcgcaccccggagcggcagccaacgataagccggtcatgtgtcgagtggagcgcggcgacctggtccacgaagtccaggttgcgctccttgccgtgggggttgacggaaaggtagtagggcacgttgcgcgcgccggcgacatggccgcggtcgaagtcctcccacatgcgcacgtccacgtacccgtattgctccgacgccagcagtgcgcatgccgcctccgtgttcacgctctccaccggcagtcgcttctctccgtcgctgcttcccagggagcccatggatgatggatgtgcgaggagaagaagaagaagatggtgatgatgatgaaggggaggtatgcagggtgggtctggctccgggggctatggactggattgtcccg

SEQ ID NO: 5716 - DNA, 767 bp, Triticum aestivum
  Clone ID: PAT_TA_5716
agcgtggtcgcggccgaggtctagtctcgagttttttttttttttttttttttttttttagtcaagaacatttttagataactttcatcacgaccaaatagctccaaacataaagcagtgcatacatgctaacaacagtgataaagtgacaaaatgacaagaggataacccatgaaagtctcaggcctctcagctaaagtactcataacaccaacatttgataaatataaggtgatagctactagttcctcattcctcttcctcgtcaccaccggcgtcaccgccaccacttgccttcttctggttctttctcttcaccctgcctggcagggcctccaccgaatggacttgtcagtgagaagtcgatgtgcttctcagattcaaccctcaccatgaacgaggggacattgacgatctgcctgccaaccctgatgtggcgttgcctgatcaagacacgggcatggtgggatggattttgccatgccaaccttggaagacaagagtcttgaaggcgccttgcaaggagttctccagcagtcagggcaaggacgtaatcaagcttatcctggccctcagcaaggagaccatagcggttcatgcgacggagaagggccgcgccctcaaagatacggcgggggatttttctcatccagtgtgagcaagtgtcttgcagcattacgaatcctgctcagtgcatactgaaccctccagagctcacgcttgcacctcagtccatattcaccgaccagctttagttctgcatcaag

SEQ ID NO: 5717 - DNA, 1279 bp, Triticum aestivum
  unsure (1)..(1279): unsure at all n locations
  Clone ID: PAT_TA_5717
gcacgaggctcactccaccacccaaataacgacgagccctacatcacatctacgtgcatcatgcgatgcatggtagtgagtgagtgagtgatcggttgattagatagggttctcactcactcactcacgtcacgagcctctcgctctccacaggctcccatactcgtgctaaccaaaccaaggagctcttatatataccgggaatcttcaagagctctcacaagccacaagtgctatttttctctgctttctccgtcgcacacacactatcctttcgtgaagctccggagctcgattggcgaccgaagcaatggcgtccatccggcgagatctgctcgtggcgctctgcgtggcggcgctcctggccgtcgggtcggagtcccacgggctggaggacttcggcagcgaggggaagacggaggcgacgcccgagatggcctccttcttcggcgccaagcccgaggccgccgtgctcccggaggcgctggacaacaacaaggccgccaagccggaggccgcctcggcgatgcccaccaccaccaccagcaccaacccacgctcgtccccgccgcgcagatccgtggccgtcgcggccggcgtggcctgcggcgtcgcggccctggcggtggtcggcgtggcggtcgccgtcgccttcgtggtgcgcgccaggcgcggcgagaggcgcgaggccgaggtccatctcggctaagccagccccaagccggcttgatttgagtaggacgtgttcgtcaattcattagcgtcgtggtttgcgtttagttaatcgtctgcttagtttgatgaatgatttcttccgttcttccgctgttcgtgggtgtgtgtgatggggatttggagagctacgtacggagcggcacgctgtaacataaataacgcttcattggcatgcatgttactgtgatgtttagaccttgaatggagtatttcactaggaattcatcaccactttgttgttcttatgacttgtggtttggtttaaacgccgccgctgcaggcgagcacaagcccagcgcttgatcgccgccgtgcccgagactcgtgaccggacctcgattgaattgttggcgtgtgttgtgtttgcnttacgttaagttggtgtcaangtggaagggtgatcgtcttgaaggtcggtcctnaagcccgttcantgacggatgcttgtgttcagttggtcagatcagtcctgatttgtaattgttactataaggcgctgtgtatggtantgcnggcatangcctgatataaagatccccaaaaa

SEQ ID NO: 5718 - DNA, 775 bp, Triticum aestivum
  Clone ID: PAT_TA_5718
ttttttttttttttttttaggtaaccaactgtgcctgccaacagttcttcccttccttgtccatacattctcgaagaagaccaatcaatacttagggccaaatcgaagtccaagatgcatatatagttttatagtacatacaaaatgccttcttttccttggaaattccctctatacatcatcaataacagattgccaattaacttgttcctgagagccttagaaaacaaaggaaagttatgccggctgtattagtgaaggctggctgctgctgccaactgcgggtaactgacgctcttgagcaaggagaggtagccaccctccaggttcttcaccttcgtgaacccggcggcgacgaggtcggcggtggcgagcctggaccgcaccccggagcggcagccgacgaggagccggtcctgtttagagtggagcgcggcgacctggtccacgaagtccaggttgcgctccttgccgtgggggttgacggagaggtagtagggcacgttgcgcgcaccggcgacatggccccggtcgaagtcctcccacatgcgcacgtccacgtacccgtattgctccgacgacgccagcagtgcgcatgccgcctccgtgttcacgctctccaccgccagtctcttctcgacgtcgctgcttcccagggagcccatggacgatggatgtgcgaggagaagaagaagaagatgatgatgaaggaggggaggtatgcagggtgggtctggttccgggggctgggagggattgtcccgacccggccggc

SEQ ID NO: 5719 - DNA, 1086 bp, Triticum aestivum
  Clone ID: PAT_TA_5719
aattcggcacgaggcaagcaagctcggacgccatgagtcaaggactgcggcaaccacggcgaggacgacatccggcgcacgtgccggcgcttcctggccttcctcttcttcctggccctggtggtggccgtcatcgccctcatcgtctacctcgtcctccgccccacgcacccgcgcttctacctccaggacgcctcgctccggcagctggacgtgctctccgccaacgcctccgccgccgcgggcgtgctctccaccgtgctccaggtcaccgtcgcctcccgcaaccccaacgaccgcgtcggcgtctactacgaccgcctcgacgtctacgcctcctacaagtaccagcagatcacgctggcctccgcgctcccgccggtgtaccagggccacggcgacgtggaggtctggtccccggtgctctccggcccgaacgtccccttcgcgccctacctcgccgacgcgctcgccaaggacgtccaggccgggtaccctcatcctccaggtcaagatcgacggccgcgtccggtggaaggtgggcagctggatctccggccactaccacatcttcgcgacctgccccgccttcctcgtcggcgccggcggcaacggcgcgccgggggccagtgggctcaggttccagaccgccacctactgccacgtcgaggtctagccgccgaaccgcacgtgctctgcttcttcttcttcatcatcttcctctgctccgtcggcgggcggcgaggtaggtttcttgcgggtgggcgcgcgcgcgtgcgcgtagcccaagaggatcatcaaggctcaaggcccaaggggggtggtacatggtggtaataagacttagcgtcgaggggtataggtgtaaaaaggaaaagagaatttagtgttggttactcctactactaaattgcgttttgttcgtgtttaattgttggtgaagtatttattccacgtttaattgtcaatatatatgaacttgtccgttacgatggaattaaagtgaaatggttaatgctggggttacaaaaaaaaaaaaaaaaaaaaaaaaaaaaaaaaaaaaaaaaaaaaaaaaaaaaaaactcg

SEQ ID NO: 5720 - DNA, 1370 bp, Triticum aestivum
  unsure (1)..(1370): unsure at all n locations
  Clone ID: PAT_TA_5720
actctgcttcccaacacacagcccccgcaccacacctcctcctttcctcctccttcactacacctctgaaccactcagaataagagctcatcggagacacaaccaaatcacacgcgaatcaactgatcaaagcagccagctagccatgggcaaggactgcggcaaccacggcgacgaccacctccggaacggctgccggcgcctcctggccgtgctcctggtcctggccttcatcgtcgccataatcaccctcatcgtctacttggtgctccgccccacccacccgcgctttttcctccaggacgcctccctccggcagctcaacctctccaactcctcgggcctcctttccacctccctccaggtcaccgtagcctcccgcaaccccaacgaccgcgtcggtgtctactacgaccgcctcgacgtctacgcctcctacaagtaccagcagatcaccgtcgccgcctcgctcccggcggtctaccagggccacggcgacgtagacgtatggtcaccagtgctcgacgggcccaacgtgcccttcgcgccgtacctcgccagcgccatctcccaggactgccaggctggctacctcatcctccaggtcaagatctacggccgcgtcaggtggaaggtcggcagctggatctctggccactaccacctcttcgtcacctgcccggccttcctcgtcaccagcggcggcaacggcgcaccaggggctagcgggttcaagttccagacgaccacttactgccacgtagaggtctagttttatcacagctagctccggcggtccagtcgccggcgagaggtaggtttcttcttggcttgtgtccactccatactccatagtgaccgcagaggcacagatcggtggcaataattattacactattatatgtggggttataagtgtaaagcaggggtgcatggtttaccatttactcctccgttcaaaaattcttgtgttacatttgtgtagatacggatggagtactttccattgataatcatggggcaatgcacatgacttgtttcataactgtagtatactgtactanaattttggagttcntttggtggtttggtgtcaacanccagtcgtaggcagctctcccatggtctgagatttggtgaagcttcggagaaagtacaaatggggactatgtgtttgtgatcctatgtccaagaacaaaaggtagttggatagtccctctcactcacatggagtttgatcatatgaaacattgggaacacaaatgttagtttgcggaaaccgttttgtttctttaatccctatatgtgccaattgccaatgatacgctggcatccacatgtggaagcatatgttctggtaaaaaaattgt

SEQ ID NO: 5721 - DNA, 1091 bp, Triticum aestivum
  Clone ID: PAT_TA_5721
gctctgctccgctctctccgtcgcacacacactatcctttcgtgaagctcccgaggtacgttccatggtgccgcgttgagcttttcctttgtggaattctgcactttgtttgtttagtatggtctgctgctgcagaaagaacatggtcgtctagctgctcctgcttgtagttgatactgagatctgtcggtgcatgtgacattttcttctactagtagtacttctttggttgcttttcgctctttttgtccggccatttggtgaaccaccgagccgcatgatcgttctgcatttctccacatatatatgtactagcaccttgcacctcattcagtctaaaatctagagagcagttgacgatcgtagtaacagtttgctgtttaggctgttctagtagccactgactgttgattctcgcaacggcagctcgatcggcgaccgaagcgatggcgtcctcccggcgagatctgctcgtggcgctctgcgtggcggcgctcctggccgtcgggtcggagtcccacgggctggaggacttcggcagcgaggggaagacggaggcgacgcccgagatggcctccttcttcggcgccaagcccgaggccgccgtgctcccggaggcgctggacaactccatggccgccaagccggaggcggcatcggcgatgcccaccaccaccagcaccaacccgcgtgcgtccccgccgcgcagatccgtggccgtcgcggccggcgtggcctgcggcgtcgcggccctggcggtggtcggcgtggccgtcgccgtcgccttcgtggtgcgcgccaggcgcggcgagaggcgcgaggccgaggtccatctcggctaagcccgccggcttggtttcattaggggttgctcgtcaattcattagcgtcgtggtttgcgtttagttaattgcgtgtttagttcgatgatgaatgatttcttccgttcttccgctgtttgtgtgtgtgtgatggagatttggggaagcacgctgtaacataaataacgcttcattggcatgcatgttactgtgatgtctagaccttgaatggagtatttcactaggaaaaaaaaaaaaaaaaaaaccgag

SEQ ID NO: 5722 - DNA, 1126 bp, Triticum aestivum
  Clone ID: PAT_TA_5722
gtgcggcgctcgaggcggccgggtccgtagcctggcaccagacaccgcccctcctcttcctctgctctcctctcctctcccacacgcgtcctaacgcaagcaaagctcggcggaaagcggctcggacgccatgggcaaggactgcggcaaccacggcgaggacgacatccggcgcacgtgccggcgcttcctggccttcctcttcttcctggccctcatcgtcgccgtcatcgccctcatcgtctacctcgtcctccgccccacgcacccgcgcttctacctccaggacgcctcgctccggcagctggacgtgctcaccgccaacgcctccgccgccgcgggtgtgctctccaccgtgctccaggtcaccgtcgcctcccgcaaccccaacgaccgcgtcggcgtctactacgaccgcctcgacgtctacgcctcctacaagtaccagcagatcacgctggcctccgcgctcccgccggtgtaccagggccacggcgacgtcgaggtgtggtcgccggtgctctccggcccgaacgtccccttcgcgccctacctcgccgacgcgctcgccaaggacgtccaggccgggtacctcatcctccaggtaaagatcgacggccgcgtccggtggaaggtgggcagctggatctccggccactaccacatcttcgcgacctgccccgccttcctcgtcggcgccggcggcaacggcgcgccgggggccagcgggctcaggttccagaccgccacctactgccacgtcgaggtctagccgccgaaccgtacgcgctctgcttcttcttcttcctcttcctcctctgctccgtcgacggcgacgaggtaggtttcttgcgggtggcgcgcgcgcgtgcgcgtcgccaagaaggatcgtcaaggctgaaggccagggggtggtacatggtggtaataagtgttagcgtcgaggggtatatgtgtaaaaaaggaaaagagaatttagtgttggttactcctactaaattgtgttttgctcatgtttaactgttggtgaggtatttattccgcgtttaattgtcaatatatataaacctgttgttacgatggaattaaagaaaatggttaatgctggggttacaaaaaaaaaaaa

SEQ ID NO: 5723 - DNA, 1250 bp, Triticum aestivum
  Clone ID: PAT_TA_5723
atctgtcacaaagccacaagccaagaaccaatacttgatctgttgtttcctttagctcccggaagacttttcgctgcaccgaccgatctcgatcatggaggatgagaggagcacccagtcgtaccagggaggtgaggccgccgagcaggtggaggtgacggacaggggcctcctcggcaacctcctcggcaagaagaaggcggaggaggacaaggagaagaaggaggaggagctggtcaccggcatggagaaggtctccgtggaagagcccgaggtcaagaaggaggagcacgtggatggcgagaagaaggagaccctcttctccaagctgcaccgatccagctccagctccagctcgtctagtgacgaggaagaggaggaggtgatcgacgacaacggcgaggtgatcaagaggaagaagaagaagggtctcaaggagaagctccaggagaagctgcccggccacaaggacaccgagggtgagcacgtgacgggcctacccgcaccggcggcccccgcgtccgtgcagacccaccatgacaccgacgtcgtcgtcgagaagatcgacggtgacgtgaagacagaggcgacaccggcagtgcccgaggaggagaagaaaggcttcttggaaaagatcaaggagaagctgcccggcggccacaagaagccggaggacgctgctgcggtgcccgtcacgcacgctgctccggcgcccgtcacgcacgctgctccagcaccggtgcacgcgccggcgccggccgccgaggaggtgagcagccctgacgcgaaggagaagaagggcctgctgggcaagatcatggacaagctgcctggttaccacaagacaggggaggaggacaaggccgccgccgctacaggcgagcacaagcccagcgcttgatcgccgccgtgcccgagacccgtgaccggacctcgattgaattgttggcgtgtgttgtgtttgctttacgtctaagttggtgtcaaggtgggaggggttgatcgtctttgaaggtccggtccgtgaagcccgttgagtgacgggtgcttctgtttcagtctttgaaggtcctggatattgttaagcttgtttacttatgggcacttgtgtattggtttattgctgggcattatgccttgatattaaagatttccgcccagtacatattgctgcatgttgtgaagatatatagcgtatattgttgcggttttttcttttgccggaaatatattgttgtgttgtgcatgtt

SEQ ID NO: 5724 - DNA, 1282 bp, Triticum aestivum
  Clone ID: PAT_TA_5724
gttggtttttttttttttttttttttttttttttttttttttttttaccaccccaacagaagcaattgaaggagaattccatgtcatagtcaaaaacatttttagataactttcatcacgaccaaatagctccaaacataaagaagtgcatacatgctaacaacagtgataaagtgacaaaatgacaagaggataacccatgaaagtctccggcctctcagctaaagtactcataacaccaacatttgataaatataaggtgatagctactagttcctcattcctcttcctcgtcaccacctgcatcgccaccaccacttgccttcttctggttctttctcttcacccggcctgcagggcctccgccgaatggacttgtcagtgagaagtcgatgtgcttctcggattcaaccctcaccatgaacgacgggacattgacgatctgcctgccaaccctgatgtggcgttgcctgatcaagacacgggcatggtggatggattttgccatgccagccttgaagacaagagtctgaaggcgccttgcaaggaagttctcagcagtcagggcaaggacgtaatcaagcttgtcctggccctcagcaaggagaccatagcggttcatgcgacggagaagagccgcgccctcaaagatacggcggggattcttctcatccagtgtgagcaagtgtcttgccgcattacggatcctgctcaatgcatactgaaccctccagagctcacgcttgcacctcagtccatactcaccaaccagctttagttctgcatcaagacgctccttctcataaggacgccttggtttcttgaatgtcttaccatagttgcggtagaagttgacgtgcaccatggctggagctctctcctctctctctctcccgctgccgccgccgccgccgccgctctgtggtcgagttgataggagggaggggttgatcgtctttgaaggtccggtccgtgaagcccgttcagtgacgggtgcttctgtttcagtttggttcagagtcaggtcctggatgttgtcaagtttgtttacttatgggcacttgtgtattggtttattgctgggcattatgccttgatattaaagatttccgcccagtacatattgttgcattttgtgaagaaaaaaaaaacaaaaaaaaaaaaaaaaaaaaacagaacaaaaaaaaacaaaacaacaaaaaacaaaaaacatcaacctaaacaaaaaagagaacaaaaaaacaaaaccagcaatcactaaaaagtcaaaaaaaaagcggcc

SEQ ID NO: 5725 - DNA, 2321 bp, Triticum aestivum
  Clone ID: PAT_TA_5725
agctcggacgccatgagcaaggactgcggcaaccacggcgaggacgacatccggcgcacgtgccggcgcttcctggccttcctcttcttcctggccctggtggtggccgtcatcgccctcatcgtctacctcgtcctccgccccacgcacccgcgcttctatctccaggacgcctcgctccggcagctggacgtgctcaccgccaacgcctccgccgcggcgggcgtgctctccaccgtgctccaggtcaccgtcgcctcccgcaaccccaacgaccgcgtcggcgtctactacgaccgcctcgacgtctacgcctcctacaagtaccagcagatcacgctggcctccgcgctcccgccggtgtaccagggccacggcgacgtcgaggtgtggtccccggtgctctccggcccgaacgtccccttcgcgccctacctcgccgacgcgctcgccaaggacgtccaggccaggtacctcatcctccaggtgaagatcgacggccgcgtcccggtggaaggtgggcagctggatctccggccactaccacatcttcgtgacctgccccgccttcctcatcgggcaccggcggcaacgggcgcgcccggggccaacgggctcaggttccagaccgccacctactgccacgtcgaggtctagccgtccgtccgtacgtgctctgcttcctcttcttcttcgtcatcttcctctgctccgtcggcggcggcgaggtaggtttcttgcgggtggcgcgcgcgcgtgcgcgtagccaagaagatcatcaaggctgaaggccaagggggtggtacatggtggtaataagtgttagcgtcgaggggtataggtgtaaaaaggaaaagagaatttagtgttggttactcctactaaattgtgttttgctcgtttttaattgttggtaaggtatttattccacgtttaattgtcgatatatataaacctgttgttacgacggaattaaagtgaaaaaaaaaaaaaaaaaactcgagactagttctctctctctcactctctctctctctctcagcaaaagccacaagccaagaaccaatacttgatctgttgttttctttagctcccggaagaccttttagctgcaccgatcgatctcgatcatggaggatgagaggagcacccagtcataccagggaggtgaggccgccgagcaggtggaggtgacagacaggggcctcctcggcaacctcctcggcaagaagaaggcggaggaggacaaggagaagcaggaggagctggtcaccggcatggagaaggtctccgtggaagagcccgaggttaagaaggaggagcacgaggatggcgagaagaaggagaccctcttctccaagctgcaccgatccagctccagctccagctcgtctagtgacgaggaagaggaggaggtgatcgatgacaacggtgaggtgatcaagaggaagaagaagaagggtctcaaggagaagctcaaggagaagctgcccggccacaaggacaccgagggtgagcacgtgacgggcctacccgcaccggcggcccccgcgtctgtgcagacccaccatgacaccgacgtcgtcgtcgaaaagatcgacggtgacgtgaagacagaggcggcaccggcagtgcccgaggaggagaagaaaggcttcttggaaaagatcaaggagaagctgcccggcggccacaagaaaccggaggacgctgctccggtgcccgtcacgcacgctgctccagcaccagtgcacgcgccggcgccagccgccgaggaggtgagcagccctgacgcgaaggagaagaagggcctactgggcaagatcatggacaagctgcctggttaccacaagacaggggaggaggacaaggccgccgccgctgcaggcgagcacaagcccagcgcttgatcgccgccgtgcccgagactcgtgaccggacctcgattgaattgttggcgtgtgttgtgtttgctttacgttaagttggtgtcaaggtgggaggggttgatcgtctttgaaggttcggtccgtgaagcccgttcagtgacggatgcttgtgtttcagtttggttcagagtcaggtcctggatgttgttaagtttgtttacttattatgggcgcttgtgtattggttatttgctgggcattatgccttgatattaaagatttccacctgatctacccttgtagtactatgtcacaggttacagccatgaatgatcgatgcaatgcaagtggcgcgtcggaggtgacctaggtgaaatgtatgtggcgatcatgtcatgtacagtggccggagtacacatgtgcagatgtctg

SEQ ID NO: 5726 - DNA, 1207 bp, Triticum aestivum
  Clone ID: PAT_TA_5726
gcaaaagccacaagccaagaaccaatacttgatctgttgtttcctttagctcccggaagacttttagctgcaccgatcgatctcgatcatggaggatgagaggagcacccagtcgtaccagggaggtgaggccgccgagcaggtggaggtgacggacaggggcctcctcggcaacctcctcggcaagaagaaggctgaggaggacaaggagaaggaggaggagctggtcaccggcatggagaaggtctccgtggaagagcccgaggtcaagaaggaggagcacgaggatggcgagaagaaggagaccctcttctccaagctgcaccgatccagctccagctccagctcgtctagtgacgaggaagaagaggaggtgatcgatgacaacggcgaggtgatcaagaggaagaagaagaaggggctcaaggaaaagctccaggggaagctgcccggccacaaggacaccgagggtgagcacgtgacggggctaccggcaccggcggcccccgcgtctgtgcagacccacggcggccaccatgacaccgacgtcgtcgtcgagaagatcgacggcgacgtgaagacagaggcggcaccggcagtgcccgaggaggagaagaaaggcttcttggaaaagatcaaggagaagctgcccggcggccacaagaagccggaggacgctgctgcggtgcccgtcacgcacgctgctccagcaccagtgcacgcgccggcgccggcccccgaggaggtgagcagccctgacgcgaaggagaagaagggcctgctgggcaagatcatggacaagctgcctggttaccacaagacaggggaggaggacaaggccgccgccgctacaggcgagcacaagcccagcgcttgatcgccgccgtgcccgagacccgtgaccggacctcgattgaattgttggcgtgtgttgtgtttgctttacgtctaagttggtgtcaaggtgggaggggttgatcgtctttgaaggtccggtccgtgaagcccgttcagtgacgggtgcttctgtttcagtttggttcagagtcaggtcctggatgttgtcaagtttgtttacttatgggcacttgtgtattggtttattgctgggcattatgccttgatattaaagatttccgcccagtacatattgttgcattttgtgaagatatatagcgtatattgttgcgtgtttaaaaaaaaaaaa

SEQ ID NO: 5727 - DNA, 1266 bp, Triticum aestivum
  Clone ID: PAT_TA_5727
gaattcactagtgattagcgtggtcgcggccgaggttttttttttttttttaattcgtttactaagttgattcctttgctaactatcagacaaccaccccaacagaagcaattgaaggagaattccaggtcatagtcaagaacatttttagataactttcatcacgaccaaatagctccaaacataaagaagtgcatacatgctaacaacagtgataaagtgacaaaatgacaagaggataacccatgaaagtctcaggcctctcagctaaagtactcataacaccaacatttgataaatataaggtgatagctactagttcctcattcctcttcctcatcaccaccggcgtcgccgccaccacttgccttcttctggttctttctcttcaccctgcctgcagggcctccgccgaatggacttgtcagtgagaagtcgatgtgcttctcagattcaaccctcaccatgaacgacgggacattgacgatctgcctgccaaccctgatgtggcgttgcctgatcaagacacgggcatggtggatggattttgccatgccagccttgaagacaagagtctgaaggcgccttgcaaggaagttctcagcagtcagggcaaggacgtaatcaagcttatcctggccctcagcaaggagaccatagcggttcatgcgacggagaagagccgcaccctcaaagatacggcggggattcttctcatccagtgtgagcaagtgtcttgcagcattacggatcctgctcagtgcatactgaaccctccagagctcacgcttgcacctcaatccatactcaccaaccagcttcagttctgcatcaagacgctccttctcataaggacgccttggtttcttgaatgtcttaccatagttgcggtagaagttgacgtgcaccatggctggagctctctcctctctcccccgctgccgccgccgccgccgccgccgcacccctacgcttaccatatccagagtgacggcccttctgcttggcctcatgtgccctccttgcacgagacctggagtggatcttctgaggcttcctgatgatgaaaccatcctttaccagcttccggatgttctgccgggagttggccatggagatctcgttgacctcattggggtcgagccagaccttgcccttgccacacttgaggacgctcgaggccaggcgcttctgcagcttcagcgacaccatcttcgccgccgctctcctcctcctcctcccttacctgccgtctgacctgcccgg

SEQ ID NO: 5728 - DNA, 1288 bp, Triticum aestivum
  Clone ID: PAT_TA_5728
aggatttctgagagtcgcatcagaaaagtgtcgcccgactccttggccctcctcctccggcggtgctgccgtcgtgagcgagcatggggaaggtagccaggtctctcctccgtcaagtaggtgtaagattagggtctaggactgagtctatggttgtatctatggcgtttgacgtgatgtcgagttggagcttagtccgggcgacgtcgcgccgcgcttggcggctgattctgtcgtcaggtgagctcgcatggtggaagtctacagcgggtggtagatctggtgatagctcccttaataagctggaatctttccctgatcttggcgatcttcgtcggcttgtaccctttgtccgtcgctgtcgtgaacgtggggacaggcagcggaaaagtgtcgcccggctccttggccctcctcctccggcggtgctgccgtcgtgagcgagcatggggaaggtagccaggtctctcctccgtcaagtaggtgtaagattaggtttaggactgagtctaggtttgtctctgtggcgtttgacgtgatgtcgagttggagcttcgtccaggcgtcctcgagcagcgcctggcggctggttctctcccgaggtgagcttccatggtggaagttgacagcgggtggtagatctggtgatagcttccctaataagctcgaatctttccctgatctggaggatctccgtcgccttgttccatttgttcgtcgctgtcgtggagatggggacagaaagtggaagaggtggagcgcaagtttgtttcgattgggtttgtgcatattctcatcggtgcttggagtggagctacggcgcccactggagctgccggtctccgccgccttcccggtgacatttttggccgaagggcggcctggtgaagccatgctggcttcgtttcttcctcctggcttgatgccatttgagaggcagctgttcaacttcaacatggagtcctcttcttccatctttgtccggagatggagtagtggcggtccagtgatctcaagtggccacgtccccggtgatggccggactggatctacgctggagttgagtattggacccgattgtaatcttaatcatcaggatggggtcctccttgttagtttcaaggactatgatgtaatttccttttcttttcagtcctggtatgagctctgtactgcagccgctgatagttaatggatgctctgggtccttccggaccctttctctgttcaaaaaaaaaaagaaatggtgacaattgactaggcaaaaaactcgagactagttctctcc

SEQ ID NO: 5729 - DNA, 741 bp, Triticum aestivum
  unsure (1)..(741): unsure at all n locations
  Clone ID: PAT_TA_5729
atcagaatgtcgcctcaagatgaaatagaccttttcaatcgacaattgtaacttcctcatgcaggtgttgaaagggctgatgtacttgcaccacgagaagcgcgttatacaccgagatctgaaaccatcgaatatattgataaatcataggggtgaagtaaagatatcagattttggtgttagtgccatcatctcgagttcttccgcacagcgagatacatttactggcacatttaactacatggcgcctgaaagaatcagtgggcagaaacatggttatatgagtgatatctggagcttgggcctagttatgctggaatgtgccactggcaatttcccatatcctcctcgtgaaagcttttatgaacttcttgaagctgttgtcgaccaaccatcaccttctgcaccatcagatcagttttcaccagagttttgttcattcatttctgcttggtatttgtgcttcttcattgacccccctttgttaatcaatattacttgggcaatatttgtaatttgtttagttctaaagtttaaaactatgagcttagctacaataccatcatagtgttttttctaccatttgcttgtgagttgtgaagtagtgattctctggaactggaatatgcttgcggacacgtattgtctgaacctacaatttgtttttctctcatctcatctgttggcagattaattgatcttttatttatttgnttatttattatgcaacatcagtgtcca

SEQ ID NO: 5730 - DNA, 1458 bp, Triticum aestivum
  Clone ID: PAT_TA_5730
cttccctccgcgtcccctcctccgaggccacctagcaagctccggccgtccgcccgtccacgagcgagccggccgccggccgccgccgaagccgatgaagaagccgggaaagctcgcgctgccctcccaggactccaccatcggcaagttcctgacgcagagcgggacgttcaaggacggcgacctgctcgtcaacaaggacggcctccgcatcgtcccgcagagcgaggaaggcgaggctcctcctatcaagccgttggataataatcatcagttgagcatagacgatctagattcaatcaaagtgatcgggaaaggtaatagcggaaccgtgcaattggtgcgccacaaatggactggccagttttttgctctcaaggttatacagctcaatattcaggaaagcatacgcaagcagatggcccaggagttgaaaataagcttgtttacacagtgccagtatgttgtcacatgctatcagtgtttctatgtcaatggtgttatttctattgctttggagtatatggatggtggctctctcgctgatttcctcaaggctgttagaaccgttcctgaggcctaccttgctgcaatttgtaagcaggtgttgaaagggctgatgtacttgcatcacgagaagcgcgttatacaccgagatctgaaaccatcgaatatattgataaatcataggggtgaagtaaagatatcagattttggtgttagtgccatcatttctagttcttctgcacagcgagatacatttactggcacatttaactacatggcgcctgaaagaatcagtgggcagaaacatggtcatctgagtgatatctggagcttgggcctagttatgctggaatgtgccactggcaatttcccatatcctcctcgtgaaagcttttatgaacttcttgaagctgttgtcgaccaaccatcaccttctgcaccatcagaccagttttcaccagagttctgttcattcatttctgcttgtatccaaaaaaatgctgcagataggtcatctgcccaaaccctatcagttcatccattcctgagcatgtacgatgacctgaatatcgatctttctgactacttcaggaccgcaggatcaccgcttgccaccttcaagcaaatcgcgttgtgagacgacaaatgctcaaccatgcgtcatgagctggagctaactgaagcaagtgaatggagttatttttcttttccttttgttcatgaactgggctttggtgatatctttgaaccgagtatgatacaattggctgcataattatacaaatacaagtttgtaaagcatcagcgagcatcgaagttttgcctgtctgcataacggaaacatccgtttgttgtccgactttgacctttgttatgtatgggcttattgcttttgcaattttactgtaatgaaaccatatttgctgggtcgctcgatgacctgatttggac

SEQ ID NO: 5731 - DNA, 546 bp, Triticum aestivum
  unsure (1)..(546): unsure at all n locations
  Clone ID: PAT_TA_5731
gcacgagggagagattgccatggcgatttggagctccccctcgccgctcgatccagctggttggtggtgacttgtccgtgctctccctccctctgcctcgccccctccgcctcgccgctgtttctcccgccgaaggcctgcagcatctcttgcccccctcatccaccccggccccattatttcgccacccgtcgattttgttcgtctgatttggtatattccctctcttttgtttgtttctcaaatctgcatgtcagtgcctgtggactgtggttttttcggtcagatctgttgcttgtgttgatctcctgcagcctctggtgtagatgtgtgaggttgcgcctgtttctccgattgatactcatcagccatgtgaatttgattagtgtttctggctacttgctagtttgattgatctgtatgtgtgattcacccgcgtcagcggacagcgagtcgcctgaacctgatgatccaggcgatggcgcnnnnagccagcatggtggcagagggtgaagcctcgagtgggtgnnggtgggctgactnnng

SEQ ID NO: 5732 - DNA, 851 bp, Triticum aestivum
  unsure (1)..(851): unsure at all n locations
  Clone ID: PAT_TA_5732
gagatctctctctgcatcgccgccggcgccgttgttctcgccgccgccggctgcgccatgctccgcctccgagagtgcttcgtttcccgtctcctctcttcaccttccacccccacctatgccatcttctctccgccgccgcgccccacatttccccaaatcccagtggcttcgccgtcgaggactacctcgtcgccacctgcggcctcacccgaccccaagccctcaaggcctccaccaagctctcccacctcaagtcccccaccaaccccgacgccgtnctcgccttcctcgccggcctcggcctctccggcgccgatgccgccgccgccgtcgccaaagactcgcagctcctatgcgccaaagtggacaaaaccctggccccgctggtcgatgggctcaccggcctcggcctgtcgcgttccgacatcgcccgcctcctctcgctcacccccgaccacttccgccgtagagccatgctctccaggctgcagtactacctgcccctcttcggctccttccacaacttcctccggctgctcaagaactcatcccgcctgttgtatttgaacctcgacaaggttatcaagcccaatgttgtgttcctgagggagtgcgggctaggtgattgtgatattgcccagctgtgtatccatgcgccgaggttgctcaccgctaacccggagcgcgtccgggcgatggtggcatgcgccgaaggtataggcgtgccccgtggctctgggatgttcagagaagcgctacatgctgtcgcattccaaagcaaggagaagattgccgccaaagtggactacttgaagaataccttcaggtgggctgatgccgaagcgagc

SEQ ID NO: 5733 - DNA, 781 bp, Triticum aestivum
  unsure (1)..(781): unsure at all n locations
  Clone ID: PAT_TA_5733
ccacccccaagccgctctgccgtcacggaagcccccgtcgactcctcccgccccgcccggcccctggccccccccccctccatcagcccctccccccgtccgccccccccccgccccgacgcagaccccgcagccccaacgcgcaccccccccccccgctccgtcgcccacccccccctcgccgccggccccgccgccgccgccgtgccccggctccgtcgccgcgccctcgcccaggcccgctcgcctctctccgccccctcgctaccccctctccaccgcctcctctccgccgcgccgcccgccatctccccaaaccctagcttccccgtggaggagtacctcctctccccctgcggccccacccgaccacagccccgcaagccctgcgccaagctctcccacctcaagtcccccgccaatcccgacgccgtgctcgccttcctcgcccgcctcgggcgctccgacgccgatggcgccgccctcgtcgccaaggacccgcagatcctctgcgccagcgtggaagagaagccctggcgccccgtcgtcgccggggctctctgggcctcggcttatcgcgttccgacatcgcgcgccccggctcgctctcccggtagcacgcttccgcttgagatccatcgtctccctagctgcagttctacacgcctctactttcgggtcctttgtggaatcctcctgcgagccctgcaagaagaccttcgatccttcacctcggctgaccctcgatgatgtgggcaatgcccaaccgcgggggcgggtn

SEQ ID NO: 5734 - DNA, 682 bp, Triticum aestivum
  Clone ID: PAT_TA_5734
cggtacgcaaacagtggggctatttcgtggggcccaaagcatatgggtgggacggcgctcgcgcacgggaactctgcgccgccgccccgaccgctactggtccgcccggccgagtgccccccccccccacctctgtctccgttctgagtaggtccttgcggcggcgctcgttctgcaatggcggagcacggggaaatagaagacggtggggttgagttcctgcttgatgccattgacaggttcccattacgagaggagttcgcggacaacctcgagcacccagatccggttcccccggtcttgttgccaaacagcggagccggccttgccgttcctgcggacctcaaatactcgatctggttgcgctcaacagctcggcggcgatgggaatgatatggcaggagtttgagtccgccgtctcgcggatgcatcaccgacgaggtcggctcagtctactgacagagtcaatccagagtcacatgggaggaaaaaaaaggttatggctgggcagtgagccagcagatgacgatggactctaaagtcatgggctatggacttgattggctaaagaaggtcatcggcccggcgcgttctaggcgtgcctcgtcattatatatcctggataccgataagaagattgtgatggtgcttgacccaacggagacaaatttgtcggatgaga

SEQ ID NO: 5735 - DNA, 677 bp, Triticum aestivum
  unsure (1)..(677): unsure at all n locations
  Clone ID: PAT_TA_5735
ccacgcgtccgggaaaaggatccatccccgctccgagtccgatccatccgatccagccaccgccttcccatcccagccgtgcaacgccacgcagcaaggggtggaggtggaggtggaggagcagggcaggagggatccccacaaaaacagcagcaccagcgacagcgagccgggttagaccgaggagccacgcgacgagcgagaaaaacgaggcgagagcttcgacccagccaagcccgaatctgaatggcctccgccaccccggcggtgcccgaccccgccctcggcctccgccaccccggcgctctcgcccgccgcatcgccatggcgcgcggcgccgccgtcgcgccggcgctccgtccctggctcctcttcgacgccgtgcccctcgtcgtcgtcgtcctcatcgccgcgcacgtcctcgccctcggctactggatctacaggctcgccaccgacgggtccaagcaccctgcgcggagcaagaaacactagacagacagcagccgcaggcccgcagtggctgcatgggtgcttgtagcttgttagccgtctaggtttttgcatctctgcttctcgatctccaangtttcccgtgtaaagtgatggcgttggcgaaactcatgaaagnnntggaggtaggaaanctgtcactcgggattgatctggtcagatgt

SEQ ID NO: 5736 - DNA, 897 bp, Triticum aestivum
  Clone ID: PAT_TA_5736
cggcttcctcctcgccggcgcgccgccatcccccctccccgcgacggccaggtgggcggcagcgtctctctccccagtccccacctttctccgacgcgaagggagttaccagtctgccgccactcctctcaccccgccccggcgtgagcttgccccctcgctggcctgctccatctgtccatctgcgctcgtgccgtccctcgctccggcgtatagacttctgaagcgaacccacgctgccgccgccattcgttcgagcattgcaagcgacggtatcgagatctggatcctgaagtgcctgggcaatgagcgcaggtggagcgtttggtggaaacaggggagtgaggcctgtacctcctgaaaagggtgtattccctcttgatcacctgcacgagtgtgacctggagaaggaggactatcttgcctgcctgaaatcaacaggggctcagtctgaaaaatgtcggatgttctcgaagaaatacttggaatgtaggatggagagaaacctgatggcgaagcaagatatgtcagagcttgggttcagtgacgcagacgttgtggtcacaccttcagaggagaagcacaaactgcagagtccagcaagtgattcgaaagagaggaaatagctggtaaatctgcaagttccttatccgtgagaaaaaagcattcgctactcagagaataacaaggagaactgacactgagataacatgtgtttgtgtaattcgacaagctctgtgtgtgcgtgagagtgtggatgcggtggggtggcgcgtgtgctgttgctagttgcccgatcccctttgcgatggacccatgggcctttttggattgtactccttccgttcataatgtaatgtttgacttcccaaaacaacattgggaacggaggtagta

SEQ ID NO: 5737 - DNA, 888 bp, Triticum aestivum
  Clone ID: PAT_TA_5737
cccgaggagaagcgccggttcacgctccggatccgccgcggcgaccgggagaagctgctgccggcctacctcgaccacatcctcgccacggcgcaggagatccgccgccggagccaggaccggctggtccttacaccaacgcgcgcggcggggccatggactcgcgcggcctcccctgggaccctgtccccttcaagcaccccagcacgttcgacaccctcgccatggaccccgaccgcaaggcgtccatcatggccgacctccgcgacttcgccgccggcggctcgttctacgagcgcacgggccgcgcctggaagcgcgggtacctcctgtacggcccgccggggaccggcaagtccagcatgatcgcggccatggccaacttcctcgggtacgacgtgtacgacctcgagctcaccgaggtgagcagcaacgccgagctgcggaagctgctgatgaagaccacgtccaagtccatcatcgtgatcgaggacatcgactgctccgtcgacctcaccaaccgggcggccctgcctccggcgccgaagccgcggccaaccctcgacggcgcgatcgaccaggacgcgggggcggcgtcggggcggtcgatcacgctctccggcctcctcaacttcaccgacgggctgtggtcgtgctgcgggtcggagcgcatctttgtcttcaccactaaccacatcgagaagctggacccggcgctgctccggtccggccggatggacatgcacgtcttcatgagctactgcacgttcccggcgctcaagatcctcctcaagaactacctctgcctccaggacgacggcgccgaggtgatgcgtgggctggaggaatggatcgaggcggcggagatcacgccggcggatgtgagcg

SEQ ID NO: 5738 - DNA, 947 bp, Triticum aestivum
  Clone ID: PAT_TA_5738
gcacgctcctccatagtattctccatcggtgagacaggtggttaggagggaagagaagagggacgggagtgtggagagcagtacaaaactgaagctcacacctctctctctcccactctcttcccgcgagaaaatgatgacgaggtctctagagccggcagccgagcagaaggcctcgtcgtccttcggcaacctgctctccatcttcctccgggtcagctcctccgagcccaagccgccgaggcggagcttcgacgccgagggcgtcgtcgggctcggcatcgtcgcggccatgagccgtgcgtgcctcaccgcccagccgatagcgatcggcgctgccgcacgccgccgcgcgcgcgaggaggacgagctctcggagagctacacgtgcgtcatcacgcacatggccaccggcgccggcgagggcggcagcatgcgcaagcgcgtgtacttcgggttcggcgacggcggggacggttggttcgtggaagccgctgaggaggcgcccgcgagggcagacgacttcttgagccggtgctgcctctgcaacaagaggcttgatgggctcgacatctacatgtattaggggggagaaagccttctgcagctccgagtgccgatgccaccagatgctcatggacgaccgcgcagaaaactgcggatcagaagccctcagagccaacagctactcgggcctcgccgtgctcttgcgccggatgtccttctcccccaagcgtcgcggcggcctagccgaccgagctgcgtgatgccgtcaagctgatcctcagtttgtagtagcagagagcatagagatctaaatgatcttttaagcgaatgaaagcatagagtaattactaaaaaaaaggtttctgaactgtgggtcgaataaaagagagggagaaagttttggggtcatgtccactgcaagatgttcactgcttgagcgt

SEQ ID NO: 5739 - DNA, 1399 bp, Triticum aestivum
  Clone ID: PAT_TA_5739
cgcggccgcgtcgacatctgccgactgtgttgaactccagccagagctcaaaagactaaagcttcgtaaaaacaattgggagtccgacacatttgaattcgatgaagtgcttacagagttttcttcacaaaagagagtgtatgaagttgttgctaaaccagttgtggagagcgttttggagggatataatggtacagttatggcatatgggcagactggtactggcaagacttttacacttggaaggcttggtgatgaagatactgctgcacggggaatcatggtccgcgcaatggaggatattcttgctgatataacccctgagactgatacagtatcactatcttatctacagttgtatatggaaatgatacaggatctccttgatcctgtaaatgataacatagccattgtagaagacccaagaacaggggatgtttcgttgcctggggccactgtagttgaagttagagaccagaagagttttatggaccttttaaggattggtgaagctcatcgtgttgctgcaaacacaaagttaaatacagagtcatctcgtagtcatgcaattctcatggtaaatgtcagaagggctgtaaaaggtagaagtgaaatgaatgttagtatgtctgctgaaaacgggcattcatcttcaatgatggactctctaccaccacctattgtcaggaaaagcaagcttgtagttgtagacctggcaggatccgagcgaatagacaaatctggaagcgagggtcatacattagaagaggcgaagtctattaacttgtccctaagttcactaggaaaatgcatcaatgcacttgctgaaagcagcgcacatgtacctgttcgtgattccaagcttactaggttgcttaaagactcatttggaggcactgcaagaacatcattggttgtgacgattggtccatctccaagacataggggggagactacgagtacaataatgtttggacaaagagcaatgaaggttcagaacatggtgaaattaaaggaagaatttgactacaaaagtttgtgtaggagacttgatattgaattggacaagttaatcgcagaaaatgaaaggcaacgtaaatattttgatgatgaaattgaacgaataacagcagaagcgcaataccgtgttgctgaggcagaaaaggaatgcaaagtttctctagagaatgagaaaatgaagtatcatcaagaatacttggactctataaagatactagaagagaagtggaaagtacaccaacagtcacctaagaaacagattaaagaggagtctacatcaaatggtgacgtgcaggacttactgcagaatgagaaaatgttacgccaatctgctgaagatgagtccaatgaccttaagaatcaattatcacactggaaa

SEQ ID NO: 5740 - DNA, 497 bp, Triticum aestivum
  unsure (1)..(497): unsure at all n locations
  Clone ID: PAT_TA_5740
gcggaactaggcttgtagggtctctctcttcctctccccccttcctaccccgccgtcgccgccgccgccgacgtaaatgttggcggctcgccgccacgccgcctccacttccggtcccctcctcctccggcgcctctccgcccagcccaagcccaaggcccctgcgccatcacctcctccgcctccgccgtcggacgagggggccgcagcgtgggcccgtcgcgcggccgcgctctcgctgctggggctcaccggcgccgtcgccgccagcgccttcagcgacctctccgtcttcctctcctgctccagccaggcaatggagaaggctaccaagaacaagcaggtagcgagcgcgatcggcgagcccatcacgcggggtccctggtacagcgcgtccatcgccgtgaaccgcgcgaggcgctccgtctcgtgcactttcccggtgtcggggccccaaggcgacgggcttctcaagttcaaggctnnncgcttgggnn

SEQ ID NO: 5741 - DNA, 546 bp, Triticum aestivum
  unsure (1)..(546): unsure at all n locations
  Clone ID: PAT_TA_5741
atcactctcgtccgcggacgcgtggggcggcagcagcagcgccacgcccgcgcgccactggctgcctcaccgcctccaccgcagccccgcagcgcgcgagccgctggtgccctcgccaaccgcgcgccgcctcttcttcctcctcctcctcctcctcctcttcaagcggcggaagcccagcggatctagggttgctcccgcgccgccgcgtctcgccctcctccgcggggaggatagcgggcggggctccgccggtccgagcccgggactcccgcgccgaatgcgcgggcggccggtcgagtgcggagcacatcggggtcagcctagaaggcgagaacagagctttggagatgtcttcaactgtgcccaagtcatcaaatatcttctggcatgattgcccagtgggcaagactgaccggcaaaatctactggagcagaaagggtgtgtttgtttggattacaggcttagcggtcaaagtaaaagtacttggcatgcacattangtcgagagtccatacaaganggaactnctatttctgatggcna

SEQ ID NO: 5742 - DNA, 797 bp, Triticum aestivum
  Clone ID: PAT_TA_5742
catggaagctgccggcccacagacgcagccgcccccgccgcccccccgggggcttcaagaaatggaagccgccggccctccaacgcagccgccggcgccgcacccatcgtcggcccccccgtcgtttctgctgggcaagtggcgcggcgagggcgaggggaccttcccctccatcgccccgttccgctacggcgaggagatcctcttctcccaccacccttccaagccggtgatctcgtacacgcagaggacgtggaaggcggcgtccggcgacccgatgcacgccgagagtgggtactggcggccccgccccgacggctccgtcgaggtggtcatcgcccagagcacaggcctcaccgaggtccagacaggttcatatgatagtgaaaagaaaacggtgacactccaaagcgaacttattggcaatgcagcaaaggtgaagcagatcacgagggcttttcaggtggtggatggggagctctcgtacgtcgttcagatggcaacaatcacaaacagtctacagccgcatctgaaagcgcttctcaagaggatctgagcaatctccttgggtgggattgcggtaacataccgtatctgaagctttagattctttgggaaacttaaagctcaactaataaggagcttctatttattatttgcgaggacatgaaaacctatcatttgctggattctcaagaattattcagggtcttacaacctggtggaatctgaagattattcagggcttactttcgtataagcttttatgagcgtcagatgtctatcgcacagcaaac

SEQ ID NO: 5743 - DNA, 631 bp, Triticum aestivum
  unsure (1)..(631): unsure at all n locations
  Clone ID: PAT_TA_5743
gcacgacggtttggggctgtagaaaaggctggacgtgcggccggactaaataactctgcgtcttctacctccagctagccgtgagagagagcggcaacaacaattggtatacagagcttcggttcgggcgatcaccggcgaccatggcgctcgtcccacacggcggcggcgcgggcggatcggcgacgatggcgatgccgatgctgaccgcggacaactacacggtctgggccatcaaggcgcaggcgatcctcgacgtccacaccgtatgggaggcggtggcgccgggcgacgcggcggtgaacgcgcggaaggacaagatggcgcgtgcgttgcttctcggggcgtttgccggaggatgtgctgctgcaggtttcgacgaagctcaaccgccagggaggtttgggactccttgaaggtgaggttcgtcgggccccctcggctccttccggcgggccgggccccgccccgcggcgcatccggccggatgggcgggccggatggcgcggtgctcggcgggggccccgggaggctcgcggcgatggcggcgaggtatgccaacctcggagagacgctgggcgacgcagcacttgtcaagaagttgctggacannnnnccggatcgnnncntc

SEQ ID NO: 5744 - DNA, 626 bp, Triticum aestivum
  Clone ID: PAT_TA_5744
gaggaaccctagccgcccgaggaagaagcgccccaatccccaaggccggcgacgatgacggcggttcggtgcgcggcgaggaggctcggtggctccctgctccagcggaagcaggcggcggagggatgccggctcgtgcgaagcaggttcatgcgctcccgccagctctccagcgagtgtgcacgggagatccagaacaagaaagtggagctccgcaatttggtatctaaggcgatgcaaaagagggcggagctgcatgatgtcctgttgaagaactctgatgctattggtgagcctgaaatgcggctactccagcatttctctgtaccaaaagccgcttcagagccacgtgtccctcccaggacctcgatggggttcgctacaaggatcaagtgctatctggaggcagctgtcaatgcggcggtgtttgctgctgttactgcttatgtctttggtgtcaagggtgacaggggtgtacaggcccaggctgctaccaaggaggaaaaagcccagtgaagacatgatcgaaatttcagagccacagatggccctaggcttggttttaattaaattatcatgatggcactatgctatggctgggatgttgcgtgacatggtatgttact

SEQ ID NO: 5745 - DNA, 1369 bp, Triticum aestivum
  Clone ID: PAT_TA_5745
gggactccgcacgcggccgagcaggcctgtgtcgctgccgccgcgtactgtgtgtgtcacctgtctattagcttgtcttgtcgatctccggccgtctccctcacaggccgtgaaccttttgccggctctcccggcggcggccgaggcagctcctgaggcttttcgccgggctgcagcagctgcgcatcccgccgctccacctcaacgtgaccaccgtcgacgccatggtcctgtattccttcagcctaaaggtggaggatggctccaagctgacctctgtggaagatattgcggccgctgtgcatgagatcctgcccacggggccccggctgaggcgtcctcggagggcaaggcggcggcgccggagccggccatggcagaggggggcccgggggggggccggcggaggcccaccctgtgcggcaagcactgcgccctggtggagagccagcggaggacccacattgccgtggagcgcaaccgccgcccccagatgaccgtgtacctcgcaccgcgccgctcactcctgccccctgcctacgctccaaggggcgaccaagcatcacatcgttggaggggcaatcaactacgctgaaggagctggagcagctcctccaatcgctcgaagtccaaaaaagcgtcaagaaccgcaccggccggtccccgttcgccagctccttcaccttcccacagtactccacctcgtgtaacgccacgcaggccaccgccagcgacggcggctccggtgccgattcgagcggcctcaagagcgaggccggcgtggccgacatcgaggtgaccatggtggaaggccacgcgagcctcaaggtgctctcccggcggcggccgaggcagctcctgaggcttctcgccgggctgcagcacctgcgcatcccgccgctccacctcatcgtgaccaccgtcgacgccatggtcctgtattccttcagccttaaggtaattaaccttctcctgaagtagtttatttacatggagtataaggtgatggagacagatcgacggatcgagccgtggcacgtcgacggtttgtttccgtttctatataagaacggcgtccggtggtggtgatggcatcgatctttctttgttttgcatgcacgtacggtaggtggaggatggctccaagctgggctctgtggaagatattgcggccgctgtgcatgagatcctggccaggatacagcgggaggaggaggaggccggtcgactcagcagctcgagctgatgctgatggctgatcgatgccaaggaggagaccgtcgtcgtgcaagcctgtgacgcgcgcactgctccctgcatctgtgcatgtcgtgtacctgccgcgtcctgaaaatggaatccattctag

SEQ ID NO: 5746 - DNA, 1932 bp, Triticum aestivum
  unsure (1)..(1932): unsure at all n locations
  Clone ID: PAT_TA_5746
cgttctcggacgcgtgggcggacccgaccccaccaaaccaaatcaaaccatccacacaggggaaaggaaccctacctcgccgggtccccgaccgccgaccgacatggccgccgccgccggttcctccgccgcacccctcccggccccaatctccctcaacgacaaggcggcggccgtgggcggcggggtcggcggcgaccgggcggcggggggctgcggggtgtgcgcgatctgcctcgacaggatcccgctccaggagacggcgctcgtcaagggctgcgaccacgcctactgcgtcacttgcattctgaggtgggcatcctacaagcagacaccagtatgcccgcaatgcaagcacccgtttgagttcctcagtgtgcaccgctctcttgatggctgccttcatgactacatgttcgatgagagcgtttgtcttcttctgagagccacttggtttaagcctctggtcgtagaggctcacgaggaggctcaagaggaagaagacatttaccgcagttaccaatatgatgatggcgatgaggatgacctttatgaggaatacataagcaggtcaccgagcattcgaattggcaacaggaggtggggtgacaatgggtacgtcagagggggcaggagggaggcccagcccggccccccagctagccacgcggttccatccaggactcccaagaagaaagagggatcagcatcaggttcaggatcaggttcagtgtccaaggatgtcgcaggacggcgggctagaagggctcagaagcgggaggctgctgacaaggcggctgcagagaagcacctcaagctcctgcagaggctgggccgcgggaaaactcccgaagcgccacctgaagcaccaccggaatcactggaggttggtcctccagcgccactcgaggttggtcctcctgtgatcgggtgatccatcaacctctgtagataacggtgctgcggggaatgctgcagcccctgggagcccctccaataattctcccggtgcgaagaagaggaaaccgggccttgtatcctggcaactttgtcgcgttgtacactaattttagcttcgagtcactcgttaggtcggtcatcggagctgctacccagtctgctccagatgcagcgatgtggtcggtcggtcggtttatcccacactgatagttgtttaattcaagtcatgtactcgtgtcgtattagggggggcacaaaaattgcttgctgtgctaattttcctggcaatgtggcaattctggtaggttgtttacatccatcaacccaaaatgaaaatgaaatgggggaacggagtcttactgtgatcagcatcaggttcaggatcaggttcagtgtccaaggatgtcgcaggacggcgggcaagaagggctcagaagcgagaggctgctgacaaggcggctgcagagaagcacctcaagctcctgcagaggctgggccgcgggaaaactcccgaagcgccacctgaagcaccggaatcacttgaggttggtcctccagagtcactcgaggttggtcctcctgtgatcgagtgatccatcagcctctgtagataacggtgctgcggggaacgctgcagcccctgggagcccctccaataattctcccggtgcgaagaagaggaaaccgggccttgtatcctggcaactttgtcgcgttgtacagtaatttagcttcgagtcactcgttaggtcggtcatcggagctgctacccagtctgctccagatgcagcgatgtggttggtcggtcggtttatcccacactgatagttgtttaattcaaaaaggtcatgtactcgtgtcgtattaggggggcacaaaaattgcttgctgtgctaattttcctggcaatgtggcaattctggtaggttgttacatccatctacccaaaaagaaaangaatgggggaacaga

SEQ ID NO: 5747 - DNA, 500 bp, Triticum aestivum
  unsure (1)..(500): unsure at all n locations
  Clone ID: PAT_TA_5747
ttcggcacgagggtcgcggnacaacaccgaccccttcaccatccccagcgactacacctgggtaaacctaggttccaccaagacccaggacaagaagtcatccaagaccagtaataaaaagggcaagagcaaacccacgcgactaactaactcgaggccacaggatgaaacctcgatttagtggggagctatctaatacaccatgacccagaacctgtaattaccgagcatctgggaggagccctgggttacgctttaggatttttactttttagggaagaacggcggtggcgattggaaacagctagtgtggaacctcttatgttttacctcttgtcgattgacagttcttcttccgtaatgttgttgtacacattgggcagtgccaaattgcacaagctgctcttactgcctacagggatctcttctgttttttttatataatatctactgcacatttccacttaaaggggctcaataagaacaagtacttaaacctt

SEQ ID NO: 5748 - DNA, 648 bp, Triticum aestivum
  Clone ID: PAT_TA_5748
cggccgctcgaggcggcaggcccacgcgtccgcagcgtcctgagagccacatactcgagcgcccctccatcctcatcctgctccccaaccaagaagcgacacaacggtgagcagtccccagaggccagagcagagcgcactcccatcccatggcgtcgggagaagcggccatgcagaccttcgtgctgagggtgaccatccactgccatggttgcaagaagaaggtccggaaggtgctcaagagcatcgaaggcgtgcaggacgtgaaggtagacgcccagctgcacaaggtgatggtgacgggcaccgtggacgccgagacgctcatcaagaggctgcacaagtcaggcaagcaggccctgccatggcaacacacgcctgccaagaatcccgaccctgcgccgccaaccccagccgacgcccccgcgccggccgaggacggcagcaaggatgccgctgtagcggacaagaagccggcggaggagccgcaggccgacagctcggacaagaggccggagcaggagacggcctcggagaagaagaagcctgagacggagaaggaagcagaatctgagaagaaggctggcaaggaggaggaggcgaaaccaaggtcaagcgacgagaaaaagaaagacggcggcgaggggc

SEQ ID NO: 5749 - DNA, 757 bp, Triticum aestivum
  Clone ID: PAT_TA_5749
cggacgcgtgggcggacgcgtgggcgaggccgaggcgaagaataaacagagcaagcccagaggacgccgataggtccctgtccccagcgccggcgcatgcgccgatgcacgcgcgccacgaattcaacccgtacggcgcgccgcagccggtgatgagctacaacatggcgcatccgagagcgagcgtgtcccactacgcgccgcggccggagcagggctactcgctgcagcagcagcaggccgggtactcctcctcctccatgatgcagcacccaccggcgccggcgcagcaggcctactcccagcaggcgcagccaatgcagcaatggtcgccgtcctacctctacatgccgtacccgcacgcgtcgccggagtcctactaccaggactactacagcccgcccgggacgcacgcggcgccgccacccctgccgccgctccaggactcgtaccgcctgttcgacgacgagaaccccaactcgtgcagcgtcatgtgatcgatggcggctccggccaccgccggaaaagtagccagaggcggcctcataatcgtatcgtaatagagacctctctggttgtaggtagagacagtagcttgttactctcttcgattgggaggtcaaagctctccttgaccaatcctttttctttttcttcttcttcctctttaatttcttcttctattattgctactattactgttctaaatagagcatgtaattgtaatgagagaacctttacatgtagtagtagcatc

SEQ ID NO: 5750 - DNA, 662 bp, Triticum aestivum
  unsure (1)..(662): unsure at all n locations
  Clone ID: PAT_TA_5750
nagcgtcctgagcgtgtgggcacagactcgagcgcccccccatcctcatcctgctccctaaccaagaagcgagacgacggtgaccagtccccagagcgcactcccacaccatggatctccagaccttcgtgctgagggtgaccatccactgccatggctgcaagaagaaggtccggaaggtgctcaagagcgtcgaaggcgtgcaggacgtgaaggtggatgcccagctgcacaaggtgatggtgaccggcaccgtggacgccgagacgctcatcaagcggctgcacaagtcgggcaagcaggccctgccatggcaacacacgcctgccaagaatcccgaccctgcgccgccagccccagccgacgcccccgcgccggccggggacggcagcaaggatgctgctgtggccgacaagaagccggcggagcctgtgaaggagccgcaggccgacagctcggacaagaagccggagcaggagacggcccccgagaagaagcctgaggcggagaaggaagcagaatctgagaagaaggctgacaaagaggaggaggcaaaaccaagcgacgaggcaaagcaagacggcggcgagggcgagcccaaggcaaagggcgccgagcccgcgagtgagcccgctgccgccgcaaaggaggccggcggcaat

SEQ ID NO: 5751 - DNA, 1557 bp, Triticum aestivum
  Clone ID: PAT_TA_5751
cgtccgcccacgcgtccgcccacgcgtccgcgcagggggagagactcgagagcccccccagcccccccacctcctcccaagcccgaaaccagtaaccagcccccaggggccaggtccccagagcacaccacggatcggcagaccttcccgctgagggtgaagaagctgtcccaccgctgcaagagctgggtgcggaaggtcccgaagatggtcgaaggcgggcgggacgtgaaggtggatgccgagttgcacgcgttgatgatgacggggaaggcggacggccacacgctgacgacgtagccgcacacgtggcggcaggcacgcgctcgaggatgccggcccagccatgccaacacgccccaccctggcaacacgcacccgcccccgcccccgaccgaggacccccccccgcaggccgggggcgcccgccagcctgccgccgcagcacgactagcaccgcagcggacaagaggaggacgcgcaggccgccagctcggagaacaagccggaggcggaggcggccgccggcaaggaagctgaagcggccaaagaagcagaatctaagaagaaggctgacgaagagtaggaaggaacaggaggcgaagccaaggtccagcgcggaggaaaaggggcaccgcggccaaggcccaacggccgaggcccccgcagagcggaccgtgctcccgagtgaaccggctgccgcggcgagccaaagagaggacgaagcgggcccaaggaagaggatacagcccaggcccaagcgcccgcaccggtccctgcccccagcgcccgcgcccgaccaagtccacgcgccgcagccggtgatgagctaccacgtggcgcagccgagagcgagcgtgtcccaccacgcgccgcagccggagcagggctactcgcagcagcagcaggcccggggtacctcctccctcctccatccatgatggtgacgcagcacccaccgccaccggcgcccagccaggcctactcccagcaggcgcagccaatgcagcaatggtcgccgtcctacctctacatgccgtacccgcacgcgtcgccggagtcctactaccaggactactacagcccgcccgggacgcacgcgtcgccgccgcccccgccgccgctccaggactcgtaccgcctattcgacgacgagaaccccaactcgtgcagcgtcatgtgatctgatcacggctccggccaccggcggaaaagtagaggcggccgtcctcataatcgtaatagagacggacctctctggttgtaggtagagtagcttgttactctcttcgattgggaggtcaaagctctccttgaccaatcctttttcttctcacttcttcctctttaatttcttcttttgttattgctactattactgttctaaatagagcatgtaattgtaatttacatgtagaatagtagcatcaatgagatcttccaccctacatgtacatcccaactacttgtgctactttggtcttggctttgtcatttacatgcggttttgtaccgtcaatgagatcttccaccctactagcaaaaaaaaaaaaaaaa

SEQ ID NO: 5752 - DNA, 347 bp, Triticum aestivum
  unsure (1)..(347): unsure at all n locations
  Clone ID: PAT_TA_5752
acaataattattgttcttttcagcacaattgtctttgggctactgactaagccattgatcagactcctgactccagcgaggcacctcactagggaagtgagtgccctttctgagccatccgagctcaaagtccctccttgaacagcgtgcctcgggaatgggcctnagacggatctcgagaacgctgttagcatacgccgcccgacgagcctccggatgcgcctggcgagtccaacacggtcagtccaccactactggcgcaagtgtgacaacgccttcatgcggccggtgttcggaggtcgaggcttcgtcccatttgtcnctggatctcccaccgaaagcagtct

SEQ ID NO: 5753 - DNA, 244 bp, Triticum aestivum
  unsure (1)..(244): unsure at all n locations
  Clone ID: PAT_TA_5753
ctccatgatgcccggcagcctcaccaagccgcagagacggtaattaagctctgcactccaacagcttgcacggctccgtcaccgccgagatcatcaactgcnccaagccgggtgcaatttatgcgtgccaccaactaaagatgatggtagantttttcctgtcaacgacaactctnctttgatgcggcgcctcggcctcccgtggatgagcngatgatgagaattgcaggcacggaggggttgt

SEQ ID NO: 5754 - DNA, 478 bp, Triticum aestivum
  unsure (1)..(478): unsure at all n locations
  Clone ID: PAT_TA_5754
accaaagaggacagcaaggattcaccaaacattggcgacctaaacttataaacgtgcgccagcaactcgagcatgatccctttttgggcgatactaagataagaagcactaactttgccttttgggacggtgcctaagctcacaagcatctccttgcaatttagcaacatggcaaaacatggcctgtcccttttctctctcaatgaaacatgaactagtcctaactagttatggtgaacatttggcacgagtgtttaattcatacatggttgaaaatattgtgtaatcaacttgtttcaattcacaacaaaagatagtttttttctctttgtaattgtntcgcgtgtaaccagagagtgcggcatatccctgcccctgcctgcccggcggcgcncgaancgaatcccgccgcgcatgggngggagcatgcacgtcggccaattcgcctatagtagtgtatanatcactggcgtcgttt

SEQ ID NO: 5755 - DNA, 649 bp, Triticum aestivum
  unsure (1)..(649): unsure at all n locations
  Clone ID: PAT_TA_5755
tacaccggcgaggcttctnatatggctganggatctgtttagggtttgctggttcatttctcctggccggggtctgcttgttctcttggctcccgggccgtgctgctcgaagttgcttcgctggtttccttgcaggcacccaagcttttcttcgcgcgatggcatcaggcgcacggagggagctcttctccatcggtgcgatgaacaacgaccgtgatctccgttccacaccgtcaccagctagcaagatgaagcgttctgtcacggttaggccgaaggctgtgcttagcgccgttcttgctgaagctgggttacccgaggtgaagtacaagacctgcgcatcctaccgtggccgtgtggcggctactccatcacagtcgcgttcatctgcagcggcagagcatatgaggatcaatggcgaccagctgtggatgccaatgggccatgcaaaatgctgctcctcggtgcttgggagcatcttcaagccaacatggatattgaattgactgcctcaaatgcagaaaattaagacgagatgaagtactgtcgggcantgtcnacgagaaagacaggaagataangatntgaaggtaaggcgtcaacggctacaaggctgggtcacgganatactgccggnttnaatataact

SEQ ID NO: 5756 - DNA, 961 bp, Triticum aestivum
  Clone ID: PAT_TA_5756
acaccaggacaagatgagttgagctttgcaccgcaaaggccaggattgtcagacacagatgagacggaaattgtgtcaaaaaagctaccaggagggagatccccggagagctggttatgtgaaatgttgaagcgaacgaggtgggcaaggttggagagctgttttggcagaccacccatgagcttgttccgagaaagatcagcagtctgaaggttggtgagattggctattgttgctggaatagctccggttaaaccgttgtgtgatagatccagtgacgtgagggcagagcaatccccaatctggggtgggatttctccagtgagggagttcttggcaaggctcagcactttgaacgacctccctccaatggtagatggaatgctcccattgagcctattggcactcaaatcaagcagctccagtgacttcatctccacaatgctggctggaacactcccagacagcgagttccaagacatgttcagcgactgcaaggtgagcagttgcgagagttcggacgggatccgtcctgaaaacgaattgcttgacaggtccacgccttgaatcacagaggatccattcacaggcaccatcacctcaccactgaatgtgttgtaggacaccgatacccatcgcacaccggatgcaaatacccaggtaggcaggctgccagtgagggaattccagctcacgtcaacgtgcactaggcttctacatccaccgattgactcaggcaagccaccggtgaacccatttccggacagcctcagctccctcagtgacatgagcccaccaattgaccccggaatctccccggagaatttgttccccgacaaatctagcgtctccaggctcaccatttctccaacccaagttggaacatttccggtgagctcatttgagctcaagtcaaggtctgtgcaagtggagagcctccgcagggactcggcaagttgcc

SEQ ID NO: 5757 - DNA, 391 bp, Triticum aestivum
  Clone ID: PAT_TA_5757
gaaagattcagccacacagccaaaagtgaagtatttcactcaggtgaaagcgcggccaccaacatttgtcacctttatgagtgggaagactgagctatctgatacagatatcaggttcttgacaagatctctcaaggaagatttcgacatcgggggaataccaatccggatcctacagcgttctattccaagaaaagtgtcgtctttcaagagcaatatcaagaaaagaggatctagtataaaaaggatgaaaacagacaaaagaacagaagtgtctgatcctacccagtcatgattttacaatgtcaccaaagcacctcccgattctcacagaggacctggtatgtgtgtaccactcacaagggaagtcattagtcatgacctacatact

SEQ ID NO: 5758 - DNA, 1342 bp, Triticum aestivum
  Clone ID: PAT_TA_5758
tgaatgtatatgcacatctggactaggtagtgcatcttgttctactaatattaagagcgagcgaggtcacttgatccatacacattttacttctacacagaggagaggagaggagaagagaagagccatcgtctcctccgccttacccttaccataccatccatcacttgtccaaaatgcacacgccaaactacctaccacatacatacattcttccacctgcagcaccttgcttgtgacactactacttgattaccctagctagttagttaattaacccttcctaaacaagcaaccatcgcatcgcaccgcatcaacaaccttctaacacctcagctcgtcccgcggtaccggtaactctgctcctcctcctctccttccttaggaggtggcgccgacctccccggcagtatctgcttccgcacaggcactcgaacggcttcatgggctgcctctcgtcgtcgaaatcgatgccgtagtcccatgtcagttcctcaaaagcctccaccttcttgcttgtgaagaatgcaacatgataatactgatgatcaggagtctccacttcaacaggaatcatggctagatttgcatcacagcatctgtggttgatgaatctgccaacattcccatagaatgttccatctaggcataaagcctcttcatccttcggctcccctccagaacaccaaccggcatccaaaagtattggatgtgtatacctagcattctgcatattttgaatggccctttcatgcagttctgtatgtgttagtatctccccagcatattcacaaacaaaagtgccttttggcaaatcatcgagtttgctgagcccctaacccctcccttcttcagtaaaggacacctgcagattgcatcttatgccacgctgaaccacacggttaccgcattgcatgttacagccacatttgctccagcattcctttgatgaatttcctaacaaggtggcccccgcaaggcttctggcgaggctttgtttctagacctctcaagcgggcaagttttacaatacaccctgtgatgttcttctgggaatcggttcatagagacacattcatcaatgaatgctggcttaaccaaaccgtccagtgtgtatgcatattcacccccagtttctcttgcacaagcacatggtgccggtgcggacaagcagttgccaaagcattcagggcaacagtcttcactgccaatctttgcaagaaacatgcggacgcgtgcattctgggatacagcgtttgttggcatataataaaaggaaggtgggcatttctctctgccagattcatctgcaatggatatcctcacacggacgcggggtcga

SEQ ID NO: 5759 - DNA, 832 bp, Triticum aestivum
  Clone ID: PAT_TA_5759
tctttcatgaacggggccagcgtggacaaggccagccttgacgatgacgacggctccgccccgcggcagaccacggtgtcggcgggcgagctgcgggagctcgtgaagatgcgggaggtcggccacccgatcaccatctacgactcgccggcgagcaccgtcacggccgccagctcgtcgtccggggagcttcgtcaggggaggttcccaatcccagtcagcacgagatcggacagcgcgcactggcctcgggtgagcatctacaagggccatccgttcgtgagaaaccacagctccgaatccggcaagctcatcaatcttcccgccacgatggaggggttcaaaaccatcatcggagagaagctgaaagtcgacgcggagaaggcactgattctgaacggcgaaggggcggagatcgactcgttggacgtgatccgggacaacgacaagctgttcatagtcaccgaagagcacatgaggatgttggcgtcaatggattcctctgttgctttatcgcacacatcgtccgtaggttcagctgtttcagcagcacatgccatataattctgatatgtgctagctgcatttttttttctctagccctgaataatccagtcattcccgtggcaacgattcaagcaaggtgacaactgccacgcgagtgatttgcgatgtttccccttatgcatggacaatagtcgattgcaaatagtgcctccggccccaaaaaaaggagcacggacagtgcagatgcatgaatgatgtacgtggtcattttatcgaagaaaatggatgatgtagacatgatcggacatggaaatcatccttaaaa

SEQ ID NO: 5760 - DNA, 1289 bp, Triticum aestivum
  Clone ID: PAT_TA_5760
caagaagtgcctagcttctttataccaacgcacaactaactattactactccagtagtgaaggagcagaggtaggaatggtgaacttggtggaggcgcagaagccgctgctgcacttcctgatcaggagggccgggctccggcagcacacggtggacgtggacggcgccggcacggtgctcaccttctgggtgcccaaggacaagctccccaaggacaagtccaccgtgtgcgagatcacgcccgaagcggcggcgccggccgccaagaagcagagcaagacgaaagccaaggcctccgcggccatccgtcgtcctcgtgcacggcttcgcggccgaaggcattgtcacgtggcagttccaggctggtgtgctggcgaagcactacgacgtgtacatcccggacctgctctacttcggcggctccacgtcgccgtcgacggaccggtcgccggggttccaggcggagtgcctggtcgctcgctgtgtcgtccgtggtgtgcatcggctgcgctgggcaagctgggcgtggagaggtgcacggtggtggggttcagctacggcgggatggtggccttcaagatggccgagtcgcacccgggcctcgtccggtcgctcgtcgtgtcgggctccgtcgtcgccatgaccgactccatcagcgagaccacgctggagaggatcggcgtcaagtcgtcggcggagctgctgctgccggactccgtcaaaggggctcaaggcgctgctctccatcgtcgcccacaggaaactctggttcccggaacgccttcacagggactacctccaggtgatgttcaccaaccgcaaggaaagagcagagctgctggaaggtttggtggtcagcaacaaagacgccaccgtgcccgttttgccacagaaaatacttctgctctggggacacaacgacaacattttcaacatagagctcgccaggacaatgaaagagcagctcggtgaggagacgatgctgcagagcatagacaaggccgggcatctcgtgcacctggagaggccctgcgtctacaaccgccgcctcttggagttcctggcatacgtcactgctgaagcttccaaagagtgacaaattagtaggtccatcgtgtcccggagagtgcttgatttgttcacagacaactggggtcccatttgttgcagtttgattgtttggccgtgtataatatttgtgagtgtgatgcataatactcctatggagtcagcactggccaatttgtctatttctcttttgcagctaaacagttgtgtaaatcaaaaa

SEQ ID NO: 5761 - DNA, 715 bp, Triticum aestivum
  unsure (1)..(715): unsure at all n locations
  Clone ID: PAT_TA_5761
acaatgcaaccacccaagcctatgccttcaaagaattgatggaagctgagggcaccgaccagaggcttgatggtggatggcctcacagatgctcctaatgacacaccaattatcactgaatgcaccaagattcccagctctagaacctgagataccaccctgtgccggattgtgtcagctatggcagcctcctccggtgagctgacaacaattgcgtcaccatgtgaatggccatgcgcgtgcacatgtggatgatcggccctcccttcctcatctccgggtatgtcgatgttgtcaagtgggcgtgccttgctgaagtgagaccggcggtagttttatttgtgtttctttatggaaaggttttgagagagatgccaaattgaccttggagaattatttaacctgccactatgccttttggttctgctctgaaattgttctgtgtagatattagtttggtcagatgagatattttggaacattatgtgctgacgtagttcacctttccactacgtcatctttattcatgttcatgaaaagctaatatatttgagtatatttgaagttgcttctttcatgctcccatcattttaagattcactatttttctggtatacgggaagttatggaactaacctccaattactgttgcaggaagtcctatgtgctttggagtgntgctcttacttactgagatacacctgtgccggatgtg

SEQ ID NO: 5762 - DNA, 515 bp, Triticum aestivum
  unsure (1)..(515): unsure at all n locations
  Clone ID: PAT_TA_5762
acaacgtgaggagctctgaacgggtctcgtcagcngnctcgacccggtcggcctattagcttacctgtngatgacctgttgcacgccgacacctgtgtcttcacacacaaactgcaagaccaatcaacatcagcaaattattagcaaaactgtngtcatacaaactgggctggagaccgccaaattgcgatggccactgcaatttttatcgtcttttcatgctgtaataccgataggatgataagtcaagtttttggttggtgttgaatccgcctgagggtgtagcatgggccctgtcccagtgtaatgtacatacatggacatgatcaaacagggcatggtaccttcaccatgttatagatcacactagccattgtagctaggtgaagttttttttttctcttccagtttttttaccttttcctcagtatgattattttttacaaaagaacttgtgtcctgcaattgtacttgggatatatatcttccacaaattaggcctcaaaaaaaaaaaa

SEQ ID NO: 5763 - DNA, 762 bp, Triticum aestivum
  unsure (1)..(762): unsure at all n locations
  Clone ID: PAT_TA_5763
gcaggtaagctctgtcataggccacaccaaacacatcacttgggaggggcggccattatctttctttccgagaactcatcaagaaattaggtagataggttacacagatcttggcctcctcttcctgagaattcaacgccggttcacgatgtctgtcgagctgctgacgaaattcctcacggttctgttcgggtatgccatgccggcgttggagtgcttcaaggcggtcgagcagcggaccgggcggaccgatcagctccggttttggtgccagtattggatcatactagtcatcctggtcatattcgacgaaatcgcaggcgccctaatatcgaggattccgatgtactatgaagtcaagctcgccttcctcgtctacctctggtacccacagacaagggggtctgacatcgtgtacgagaacttcgtgcggccgctggtgatgcagtacgagcccaacatcgaggagaggctgcggtacctgcgggccaacgccggcgacctcatcgtcttctacctcaagaacttcaccgacaggggatacgagctcttcctccgggtccttgacttcgctcggtcgcaggcgtccagtggctcaaggacaaggaggttcttctcgttccgaggggaccgggctgagaggccgagcttcgtcgacgacgactacgtccacggcagcgatcggaggagcgcggccaggcagcggcgaccccgcggtgctgattactagcgggctactaggatggcntggtangataagac

SEQ ID NO: 5764 - DNA, 721 bp, Triticum aestivum
  unsure (1)..(721): unsure at all n locations
  Clone ID: PAT_TA_5764
cgaaggatcacccagcattggattctggactgctggcacacaagtctgatatcaactccttcggtaccgtgatactgcagctactaactggtaaacagcctggtagtccaggccttgccagcgaagtaaggcgcgctctgtcctgtggaaagctgtcgtcgatcttggatccaacggccggggagtggccaatggaggcggcccggcggctggcggaatttgggctcgagtgcattggagatagaccggagctgactccggacacggtacgagaactggagcagctgcatctgatcagggggcggcaagtaccgtccttcttcctgtgcccaattctcaaggaaaccatggatgatcctcaggtggccgtggacggggtgacgtacgaggggcgcgctattcgcgagtggatcgaggatggccgggccgtggccgacctgaagctgaagcacctcgacctcacccccaaccacgccctccggttccgccattcaagactgggtctctcagcctcagtggtgaatgatgatgatgatgatgatggcgatctccgaactgttgtcttcaacttgcaactaactagtagatatgtnagagcctccctgtgtacaatacatcttctgccacttctggtacagcantgtgctgctgggcttaatgtaggcaagtgcaagtgaatgggattttggtttttgttcaattcaaaaanaaaaaaaaaaaa

SEQ ID NO: 5765 - DNA, 728 bp, Triticum aestivum
  Clone ID: PAT_TA_5765
atccccacgcgtccccacaatctcacctactccggccatctctccggcgaccaccgccctacctccccacccgaccccagcgatggcgacaacggcaggcggcggccggcggcgggaggggcaagccgaagggcagcaagtcggtgtccggtgaaggcgggcctgcagttccccgtcggccgcgtcgcccggcacctcaaggtcggccgctacgcgaagcgcgtgggcgcgggcgcccccgtctacctctgcgccgtcctcgagtaccttaccccgccgccgaggccctggagctggccggcaacgcgcgcgacgagaacaagaagaccccggatctccgccgcgccacatccagctcgccgtccgcaacgacgaggagctcagccggctgctcggcggccgtcaccatcgccgccggcggcgtcctgcccaacatccactccgtgctcctccccaagaaggccggcaagggcgccggcaccggcgggtccgcctcccagtcccaggagttctagagcgccagagatccgatgagtggcgtggcgtggcgtggtggtgtgatgcttttaggttggtagattagttcttcttggccaacgttcttgttggcgcgtgtatcgagggtggatctggttggaatggaatgcttgcaatctgtttcttgtctgtttggatggaatgcgctctatttctttttgctaaaaaaaaaaaaaaaaaattcgagtgac

SEQ ID NO: 5766 - DNA, 1215 bp, Triticum aestivum
  unsure (1)..(1215): unsure at all n locations
  Clone ID: PAT_TA_5766
gtaaaagacagcgaatttctgagttacaacagagatacaatgcaacaacaaggtaacataaccaaaatgcaacaatgtaacataagncaaaccaaagttccccgtggctgaaatcgataaactagtgtaatctgggcgcacaaatgcgaacaatagtgttacaacaaaacactgctacgaacaagctagcttacaacaatgcggcaggcgcttaaaagacagcaggcaatacatgtgagttcaaaaatactctatcaagaataataactgagactcatcccaccttactcaatcaggtattcaggaggcggctgcgcatgtattgacaccatccttgcagtcgcgtgttaagtcattgaatgtctccaacttcctcttccccctgaggaacacctcagtgtcgactgcaaccctcatgtaaccatcgaactccaccggtttgccattgttgagctcctttgtttcagcataccattcactattttcatcccagagatccttgaaatcatccaggaagcgcgtcttgtacttgttcttcagtgggtcgaagaacgatttatcagactcgtcggtagcaatgtacaaataccgtccggcaccaaccttatcattgagtgtcgtaaggagattttctggcgaggtatctgcatcaaggtttggccacagctgtgtgttctgggctttctctcctctcacgacgtgcatcgagtcgaaatcccaactcattcgagaggcaatggcagacacaatctccatcaagcggcccgacttccacaagaaatgccatggccgtttgatcatggcctccgtctcaccctcgcacacacgtgaccagtagttatccggctcaacatgcccaaacttcctcatgatcagcgtgtccttgacgtcgcgaagtttcatcggggtcaccttgtatgtcttcggtatagtggttcttcagtcgatccttcttgtgccacttcccccagtctgtccagaactgactctgatcgatcaccgatgcagattccttcaggtgctcaaaatcaaagtagagcctgtaatcctcttctccgtccttgccacttgcagtataccgggaattgaggcagacgttgaagtccataacaagtgtccgattcaagaactgcgcctcacctagcgcacacaaaaagccccaaatgtagtggttcatgcgcttgcatctctcaccacctcccatgtaaatnaggg

SEQ ID NO: 5767 - DNA, 391 bp, Triticum aestivum
  unsure (1)..(391): unsure at all n locations
  Clone ID: PAT_TA_5767
acaagggncaactccacctctacggctcctcaggcaagaagaagtgccatcaccagtctgaaactcatgccaggggaagggattccaccactgccttttgagtagcaagtgtaatctccattgaggatcgtcccttttcagcattcatcaacacaatggtcaacttacattcctggatgttttcaaactgatattatttttgtaagtttaggtttgcacttggctatatcagaattagaatattctgaacatgtgttggggaagtgcctattttgaagcttcattgctttaaccatttgtattcatgaaataacattcagtcagtttaaaatcattttcatgtagattggattttgttataggaacgtgcaagaaacttaagtttgatcat

SEQ ID NO: 5768 - DNA, 679 bp, Triticum aestivum
  Clone ID: PAT_TA_5768
catggccatagctcctgctgaaacatgggcagtacggaaagcctgctgaaattgatcccatgggacagtgtcgacggggaaagtggctgtgaaattctcccaccatgatgttgcgggtccttcaagctgatgtgcggcaaacttcaccttctccgcatctgtgcatcctgctgtggtcaactctctagctgtcttgcggagccaatcatctgctactatcggctcggtgctactggaaaacaccggtggattcagcctaagaaaacgggctaagtgatcaacaggtggtggtggtggtgggttgttgttgttgttgttcccctgattctgattctggactagcaactgcatcaatgtgttctgctgctggatcaactgggtgagctccggtgggaaggtaaatccggggtcacgtctcggaggcatctgagggtttagaaaagatgagatttaagaatagagagggggtctaaagagaaaacactacccatatgcacatgaggcaaaagcaaacaattcacttcattcaatcaaacaagggcatacaatcggtctaactatcgcaaaagtgctcggactactatatttacatggtggactactactgttggggtggtctactagaaatattcttcggttgcagactccatgatatctgctccagcttcatcaacataat

SEQ ID NO: 5769 - DNA, 793 bp, Triticum aestivum
  unsure (1)..(793): unsure at all n locations
  Clone ID: PAT_TA_5769
atataaaggattcaatttnctcaaaatccctgcacttacaaaagcatctgtaagactgtaacgagtaaacaaaaatacagaaggaaagtaaaagcgctcttctttgtttctatgtacatcaatgccctattgtactactacacactactgtatatatatatacctcttcagacatatgtacacacctgcagaaacagcagcacctaggagcatttcatctgaatacttgaaggatcaaaccacttacaaagtggaccacccttaatgatgcttgggcgaatctctccgtggcgagaagagccgtcgtggcgaaagcatggagaggaaccccggagatgcggagccgttgagtgagtggtaatccgacatcgagaagccctcagagttgtcgtgggcactcttgcgtccgggagtcatccgcccggagaaggtgttgtacttgaccatcctgggcagccaccccttcttcttcttggcgttgacgccggtgccgttcatcctggagctgaggtaggtacgcatggcgtcaaggctctgctcgacgatgtccataggcgggcagacgagcgggttcccgacggcgctgaacttgttgagcttggctaggcagcccatggagtctgggagcacggagatggagttgtagctgatgtcaagctcccggagcgaggtgaggagccccaggccgtagggcagctccctaaggaagtggaagttctggctgacgttgagcacctcgaggttgacgaggttctcgaggccctcggggagggcgcggatgcagttgaggcgc

SEQ ID NO: 5770 - DNA, 374 bp, Triticum aestivum
  Clone ID: PAT_TA_5770
cgcatgatgacagcctccaccacctccccgtacttctcaaagtactcccggaggcggtcctcgttggtgtcccacgagatgccaccgatgaacagcttcccggcgtccgcctccatctccggctccggctcctacttccaaccaggaatgcccggctccaagaaccgatcgaaagcgcaggaattgggcaccaaaatggagcagaatttggcgcggcggggcggagagagagcggtgaattcaagggcagggcgcaccggttgatccaaggaaggggtctcgagctggctgcctaagatcttgggggaggcatggcaacctcaaaggccataccacggcaccaccacctcctcctcctcttcctctccttcctt

SEQ ID NO: 5771 - DNA, 1628 bp, Triticum aestivum
  unsure (1)..(1628): unsure at all n locations
  Clone ID: PAT_TA_5771
cttgctagcagtaccagttcatatagcagtacgacttatatctccctagataagtacaccagacaacaggatcgtcacaacaaccacaaacttcaaagtagaagatgcttactaagcaacaacatatatcatacatgcacagtagccgtactgtgaaccggagggtctgctcagacccagagcttgtgcagcgcgtgcagctggcccagagaggaagatttcagagacagacgatacatctctttcagcttggccgcgtctcccctgccgccgccgttggcctgaccggcggcggaggctgccggcctgctcgtgtccaggttcctcagcatgctcttcagcaggctctgcagctggctccagaacttcggctttatgtccaggttcacatcgtttgagtattcctcgttcgcttcgacaacatggcggccttccagcaagtgcatcagcgcggcttcaagcatcgcactagaatgaaacgaatcaaagatgctagtagaaagggctgattgtgccataaggatgttaagaaacatggtaggatgcgtctttggaccatagaattctaaagccttctgccagttcttctctgctagcgaaccataccacttagctttcttacgaaatttatcctcgttcttctgtttgacctccttggtaaccaaatccaggaacttcaagcacagatccctttngataacaaccaagctgaaaatggccaaaagcagcctcctgtttgcgaagttcaccaagggactcgtatgtagacaaagcctcccgaaaagcatcacttgctgaaatctcaagaactgttctgttagatgattcatcaacaagtccaccttcgtaactgccagttaaaaagctttcccttgccaaaagcattccgagcctcaggtgggtatgggcatactgggtgtaaacttcgttgtacagtgatttatcaacttcattgtcagcaatagcatacttcagttgcctcttaagctgcggtatagtagttttatggcttggaaatattccgacttggcagaactccacggatggcatatatgagccttcaggaagatcatacatctgaaattcttctatcctcgacgccaatttctctgctaaagctcttctaccatgagctaagttacagttgatcaatataacatttgggtgatcagagacctcttgaaatgcacaaatagcatcagcaaaagcaatgtcagccctactcagatttttactctcaagtctaatgcggccaagttcattgaatgcccaacctcttttcttaaggatggtggagaactctgccgagcgcacaggaaatgtaaacatggctcccttagctgcaccatagcagtgaatagcagaacacaagttgtattcagcatctcctggtttaggacctccaaggtacttgaaaataccaccgctcgaactggaaacatcgccattaggtttatcaggaatagcataagcattacttgactgattatccatggtgtgatcatgatcaggttcagcatttgccaccgtccttttctcaagacgagtatcattcgtgctgttctgagtttcttcagaactttccgtagcttcctgcgcattaggtttctctataatttcagtagatt

SEQ ID NO: 5772 - DNA, 785 bp, Triticum aestivum
  unsure (1)..(785): unsure at all n locations
  Clone ID: PAT_TA_5772
tctttagttagtttcanccccacctcgccgccctcccttagcgcccccgccccccccccccccccctctccccccgccccccccctctgggggcccgcgtcggcgccgccgccgccatcgccgttccccttcttcgtcgactcccagaacatcgcgccagggctgtcctgctaccgtctccctcctttcgaggatgctataaccgatatagcatttggagaagggccacactattttttacattgatctcggcacccgaccgacgacgcacaggaaggcagcaggtggatcaaccgactccaccatggggggctggttctctttcccgggtaacgacgggcgtgcaatcccaagagagtgggcagttgcagctggattggatgccactcccttcaacatgcgtcgactgaagaacgtgggtcgccccggcccgcgcacaccagaagaattcgacgcctaccacattcgcaatctcgcgcgctgggccctccgacattacaactccagccacccgggtgctgagttccggtgccctgatcagcccaccaccgaggcgaaggcagcctgtgttggcttcagggaagatctctggtaccacctcaacttcttggcctgcctaaaggatgacggcgacgagcaganttcttccgccgactacctattccggtgttccaacacaataatccatccgaaacatgcaccatcttaagaaaaccntttncccttttaaaagcattgcacattggtgtcccagatgatccaaatttgcacccaaccatttatgg

SEQ ID NO: 5773 - DNA, 1611 bp, Triticum aestivum
  Clone ID: PAT_TA_5773
gaattcactaagtgatttcgagcggccgcccgggcaggtctaagtctcgagtttttttttttttttttttttttttgaagcatttaggctgtacgtctttattctgctcctcaggcaacttgctgggagttctgggtcagtccatctgaagcaacaatgcatgggcaagtggacatccttactgccatttcgaaataaatactgtagctgttattatgatatacaatgtaccctccactatacaacagctgctatacaccagaagggccgtgaccggggtgtctctgtactgctgcggtatctatttatcatctctgtggtatctacgtaatcacaatttgcgtgatctgatgactctgaaactatacagcttagctcttgggcactagcttcatcatgaactcgtatcgcactgcattgatctatcttgggtgctggccacattggcgtcttctggtacacggatgctttttctcctctgcttcatacacagccccacttcggagggggtcctgccatcgcagcgccaggccgctgaccggattcccccgctccttgctcgctcctcggcttccgcgacgatcattttggctaatccctttcacgacgttcctcctttcgaaccgcgacgtttgctagggatgcaattcctcgttcttctctgcttgagacgtccccttcttggaaggaagcctgccactgtgtcgaccgtaagaatgccagctacagagcctttactgagaccgtatttcccatgaaattcggcgtctcttaaatctccacattcgatactgatagcactgttagctgcagtggggttaactgcaacaaggcaacttctcgtgcagcctggcggaactgaaaagccggataggagagcgatgtaacgatcaagccgtagaacaaggtctaacgggaatttgtaaccagggaagaaggagctgcagtgagtgtctgctacttcccaacagtcctccagctttgcgtctcggacgacgacgcccgtccccgggtacaaagatggcaacaattcaaccgcttgactagcatagcatattcctgcggcgggtttggaggggatcgacgggcggtggcgctggacggcggcggatcggcggcccgggcagagaggagaaggggataccgacggcgacgaggagcgcggtaagcttagcagcgccggcggcttcatcgtgctaaatgggcaaactagtaggttggattcctcgaattaggttcagtttgcggtggaacaggggattggcaacagccacacgacaaagccaaatgcccaatttggccaacctagaacccaccactactactaatctataataccagttctcgattgggagacgcaaatacagaattttccatgccgaatgacgcggtgacgaatcgactaggctccgcataacccagtgccccggccgtacagaggattccaatcggaggggaaaggtggagggacctgcggcgggtttggaggggatcgacgggcggtggcgctggacggcggcggatcggcggcccgggcagagaggagaaggggataccgacggcgacgaggagcgcggtaagcttagcagcgccggcggccctcgtgccgaa

SEQ ID NO: 5774 - DNA, 474 bp, Triticum aestivum
  unsure (1)..(474): unsure at all n locations
  Clone ID: PAT_TA_5774
acgcnatgngccgcatgaagttactgtggggtgacgccgtcgaggagttcaggccggagaggtggctcgacgacgacggcgtgttcgtccccganagcccctacaaattcaccgctttccaggcggggcctcggatctgcttaggaaaggagttcgcttaccggcagatgaagatatttgcggcagttcttctctacctcttcaagtttgagatgtgggagcgcgactcgcggggtggggtatcgtccgatgctcacgctcaaaatggtcggcccgctctatgttcgtgcgtcgccccggccatcaaccgggaactagcatggtgagtgtatgcgcgtgtatatgagcgcttgcatatgtactgtgttaaaaaaatcgggaactagcatgccggctactataagaactagaagatgccctgcacgttgctgcggaaccatttccgacaatcattttgttatataaagaatcagc
